United States Patent 8,541,208 (PROCESS FOR THE PRODUCTION OF FINE CHEMICALS) - sequence listing, part 8

SEQ ID NO: 33010 - DNA, 1686 bp, Bacillus subtilis
  CDS (1)..(1686)
atgagtgaatggtggaaagaagctgtcgtttatcaaatttacccgcgcagtttttatgatgccaatggagatggattcggggatttgcaaggtgtgattcaaaagctggattacatcaaaaatctcggggcggatgtcatctggctctccccggtatttgattccccgcaggatgacaacggatatgatatcagcgattacaaaaacatgtacgaaaagtttgggacaaatgaagatatgtttcagctgattgatgaagcccataaacgcggaatgaaaatcgtcatgcatttggtcgtgaaccacacatcagatgagcatgcttggtttgctgaaagccgcaagtcgaaggacaatccttaccgggattattatttttggaaagatcctaaatcggacggctcagagccgaataattggggatcgatcttttcaggctcagcgtggacatacgatgaaggaacagggcagtattatttgcactacttttcgaaaaaacagcctgatttaaattgggaaaacgaagccgttcgccgggaagtttatgatgtaatgagattctggatggatagaggcgttgacggctggcggatggatgtaatcggctctatttctaaatacaccgattttccggactacgaaacggatcacagccgcagctatattgttggccgttatcactctaacggcccacgtcttcatgattttattcaagagatgaacagggaagtgctttctcattacgactgcatgacagtcggagaggcaaacggctctgatattgaagaggcgaaaaagtacacagatgcaagcaggcaagagctgaatatgatctttacatttgaacatatggatattgatacagaacaaaactcgccaaatgggaaatggcagatcaagccgtttgatttgattgctttaaaaaagacgatgacaaggtggcagaccgggttaatgaatgtcggctggaataccctgtattttgagaaccatgaccagccgagggttatttcccgctggggcaatgatgggaagctgcgtaaagaatgtgcgaaggcatttgcaacggatctggacggcatgaaaggaacgccgtttatttaccagggagaagaaatcggcatggtcaaccgcgatatgccgctggagatgtatgatgatcttgaaataaagaatgcatatcgtgaactagtcgtcgaaaacaaaacgatgtcagaaaaagagtttgtcaaagccgtgatgataaaaggaagggatcatgcgagaacaccgatgcagtgggatgccggaaaacatgcgggattgacagccggagacccgtggataccggtaaattcccgctatcaagatatcaatgtgaaagagtctttggaagatcaagattcgattttcttttactatcagaagctcattcaattacgaaagcaatataagattatgatatatggcgattatcagctgttgcaggagaatgatccgcaggtcttttcttaccttcgagaatatcgaggggaaaagcttcttgtcgttgtgaatttatcggaagaaaaggctctgttcgaagcgcctccagaactgattcatgagcgttggaaagtgctgatttcaaactatccgcaggagcgggctgacttaaagagtattagcctcaaaccttatgaagcagtgatgggcattagtatatga

SEQ ID NO: 33011 - protein, 561 aa, Bacillus subtilis
MSEWWKEAVVYQIYPRSFYDANGDGFGDLQGVIQKLDYIKNLGADVIWLSPVFDSPQDDNGYDISDYKNMYEKFGTNEDMFQLIDEAHKRGMKIVMHLVVNHTSDEHAWFAESRKSKDNPYRDYYFWKDPKSDGSEPNNWGSIFSGSAWTYDEGTGQYYLHYFSKKQPDLNWENEAVRREVYDVMRFWMDRGVDGWRMDVIGSISKYTDFPDYETDHSRSYIVGRYHSNGPRLHDFIQEMNREVLSHYDCMTVGEANGSDIEEAKKYTDASRQELNMIFTFEHMDIDTEQNSPNGKWQIKPFDLIALKKTMTRWQTGLMNVGWNTLYFENHDQPRVISRWGNDGKLRKECAKAFATDLDGMKGTPFIYQGEEIGMVNRDMPLEMYDDLEIKNAYRELVVENKTMSEKEFVKAVMIKGRDHARTPMQWDAGKHAGLTAGDPWIPVNSRYQDINVKESLEDQDSIFFYYQKLIQLRKQYKIMIYGDYQLLQENDPQVFSYLREYRGEKLLVVVNLSEEKALFEAPPELIHERWKVLISNYPQERADLKSISLKPYEAVMGISI

SEQ ID NO: 33012 - DNA, 1794 bp, Penicillium minioluteum
  CDS (1)..(1794)
atgggttctattagtgagatcagccaatctactgcagcaccaaagcagagcaggatggcagcgtggtggaaagaaagcaccgtctaccagatctatcctgcatctttcaaagactctgatggagatggcgtcggcgatctcaagggaattatttccaaacttgactacatccagaccctcggcgtggacatcgtttggttaaatccgatttttagctctcctcaagtcgacatgggatatgacatctccgactactacgacatccatccaccgtatggaacgatggaggatgtgaatgtgttggccgatgggcttcagaagcgagggatgaaattgttgatggatttggtcgttaatcatacttcagatcagcatccttggtttcaagatgccatctcttcagtctccaatccgcgtcgtgactggtatatttggaagaagccgataatagataaggatggcaagccccagccacccaacaactggaggtcatattttggaggaagtgcatgggaatacgacgaccgatctggcgaatattacctccacctgtttgcgaaagaacagccggacctcaactgggagaacgtcgaagtgcggaaggcggttcatcgtatcatccgattctggctggacaagggagttcatggcttccgtatggatgtgattaattttatcagcaaggaccagagttttccggatggcgcaattgttagcgactccaagtggcagaatgggtcagcgcactacgcatgcgggccaaggctccatgaatatctgcaggagatcggtgcgatcctcaaggaatacaatgctttctcggtaggagaaatgcccgaagtgaatgactgcgacgaaatcatcaaggctgttggtttcgaacgtggtgagctgaacatgatcttccattttgagatagtaaacctcgatcatggtgaaaacgacaagatcactcctaaaaattggaacatgcaagagttaaagtccgtggtgtcgaagtggcagaaattcatgcttgagaacgacggatggaatgcgctatatctcgaaaaccatgaccagcctcgtattgtttcgcgattcggctcagaccagccggagtatcgtgaattgtcagctaagatgctggcggccttcctgggcttccagagcggcactttgttcatatatcagggtcaggaactgggaatgccgaatgtgccccggcattgggggattgaccaatatcgggatatcgagacgttgaatcattggaaagaggtcgtctcggaaggactggcagatccaatagtctctcttggggagtacaggttgaagtctagggacaatgcgcgcactccaatgcaatgggatgggtcagcaaatgcgggattctccacctcaacgccgtggatttctgttcatgatgactacacgaccctcaatgcggccgcgcaactagccgataaacacagcgtgtatcacttttggagcacaattctaggcctacgaaaagcatttcctgatgttctcgtatacggatcttcgacctcatttccagtgagcatccggatatgttcggctacatgcgagtgtcagatagcggccgagtggcgattgttgtcctcaactttcgcccgtgggctgtcacatggaccccccctgcaattcagcaagatcaaatctgggggaattgtcttgtccaattatcctggccgccgaagtctcaagtgcatttctgaagagccgctcaatctcgagccattggagacatttttgtggcttgaagacatggaagagtcgtcacgcttgtaa

SEQ ID NO: 33013 - protein, 597 aa, Penicillium minioluteum
MGSISEISQSTAAPKQSRMAAWWKESTVYQIYPASFKDSDGDGVGDLKGIISKLDYIQTLGVDIVWLNPIFSSPQVDMGYDISDYYDIHPPYGTMEDVNVLADGLQKRGMKLLMDLVVNHTSDQHPWFQDAISSVSNPRRDWYIWKKPIIDKDGKPQPPNNWRSYFGGSAWEYDDRSGEYYLHLFAKEQPDLNWENVEVRKAVHRIIRFWLDKGVHGFRMDVINFISKDQSFPDGAIVSDSKWQNGSAHYACGPRLHEYLQEIGAILKEYNAFSVGEMPEVNDCDEIIKAVGFERGELNMIFHFEIVNLDHGENDKITPKNWNMQELKSVVSKWQKFMLENDGWNALYLENHDQPRIVSRFGSDQPEYRELSAKMLAAFLGFQSGTLFIYQGQELGMPNVPRHWGIDQYRDIETLNHWKEVVSEGLADPIVSLGEYRLKSRDNARTPMQWDGSANAGFSTSTPWISVHDDYTTLNAAAQLADKHSVYHFWSTILGLRKAFPDVLVYGSSTSFPVSIRICSATCECQIAAEWRLLSSTFARGLSHGPPLQFSKIKSGGIVLSNYPGRRSLKCISEEPLNLEPLETFLWLEDMEESSRL

SEQ ID NO: 33014 - DNA, 1689 bp, Bacillus sp
  CDS (1)..(1689)
gtgcagcatccatggtggaaaaaagcagtcgtatatcaaatttatccaaaaagctttaatgacacaaacggtgacggaatcggtgatttagcgggaattatcgaaaagctcgattatttgaaacaactcggcgtggatgtgattaagctgaagccgatttacaaatcgccgcagcgtgacaatggctatgatattagcgactattttcaaattcacgatgagtatgggacgatggaagattttgaccgcttgttggaagaagtgcatcggcgcggcatgaaattaatcatggatatggtcgtcaaccatacgtcgacagaacatgaatggtttaagcaggcgcggacatcgaaagataatccgtatcgccatttttacatttggcgggatccaaagccggatggaagcgctccgacgaactggcagtcgaagtttggcggctcggcgtgggagtacgatgagaaaacaggtcaatattatttgcacttgtttgacgtgacacaagcggatttaaactgggaaaacgaagagttgcgccgccgcatttatgatatgatgcatttttggtttcaaaaaggcgtggacggcttccgtttagatgttgtcaacttgttgtctaaagatcaacgttttctcgatgacgacggttcgatgccgccgggcgacggccgcaagttttacacggacgggccgcgcatccatgaatttttgcatgagatgaaccgggaagtattttcgaaatacgatgtgatgacggttggcgaaatgtcatcgacaacgattgatcattgcattaaatacaccaatccagaacgccgtgaattgaatatggtgtttaatttccatcatttaaaggtggattatccgaacggggaaaaatgggcggtcgctgatttcgattttcttgctttgaagcgaattttatcggaatggcaagtagagatgcataaaggcggcggctggaacgcgctgttttggtgcaaccatgaccagccgcggatcgtgtcacgttacggcgatgatggaaaatatcataaagagtcagcgaaaatgcttgcgaccgtcattcatatgatgcaagggacgccgtatatttatcaaggggaagaaatcggcatgaccgatccgaaatttgagcggattgacgattaccgggacgtggaatcgctcaatatgtatcacattttgcgagaacaaggaaaaagcgagcaagaagtgcttgaaattttaaaacggaagtcacgcgataactcacggacgccgatgcaatgggacgacagcgagaatgccgggttcacgacaggcaagccttggattcgcgtcgcaccgaactatcaacaaattaatgtgaaaaaagcgctggaagatccgacatcggttttctatcattatcagcggctcattcaattacgcaaacaatatgatattatcacgacgggagattatcagctattgcttgaagatcatccggatatttttgcctatttgcgaaacggggagaatgaaaagctgcttgttgtgaataatttttacggaagggaaacgacgttcatcttgccggatgatgttgatgtaaacggctatgcgagcgaaatattaatttctaactatgatgactcaccgagcgattttcgaaaaataacgcttcgcccgtatgaatcgattgtttattacttgacaaaatcatga

SEQ ID NO: 33015 - protein, 562 aa, Bacillus sp
MQHPWWKKAVVYQIYPKSFNDTNGDGIGDLAGIIEKLDYLKQLGVDVIKLKPIYKSPQRDNGYDISDYFQIHDEYGTMEDFDRLLEEVHRRGMKLIMDMVVNHTSTEHEWFKQARTSKDNPYRHFYIWRDPKPDGSAPTNWQSKFGGSAWEYDEKTGQYYLHLFDVTQADLNWENEELRRRIYDMMHFWFQKGVDGFRLDVVNLLSKDQRFLDDDGSMPPGDGRKFYTDGPRIHEFLHEMNREVFSKYDVMTVGEMSSTTIDHCIKYTNPERRELNMVFNFHHLKVDYPNGEKWAVADFDFLALKRILSEWQVEMHKGGGWNALFWCNHDQPRIVSRYGDDGKYHKESAKMLATVIHMMQGTPYIYQGEEIGMTDPKFERIDDYRDVESLNMYHILREQGKSEQEVLEILKRKSRDNSRTPMQWDDSENAGFTTGKPWIRVAPNYQQINVKKALEDPTSVFYHYQRLIQLRKQYDIITTGDYQLLLEDHPDIFAYLRNGENEKLLVVNNFYGRETTFILPDDVDVNGYASEILISNYDDSPSDFRKITLRPYESIVYYLTKS

SEQ ID NO: 33016 - DNA, 1695 bp, Pichia angusta
  CDS (1)..(1695)
atgactatcgagtctcaagaaccttggtggaaatccgccgttgtttaccaggtttggcctgcttctttcaaagactccaatggagacggtattggagacctgaacggaattacttccgagctagaccatatcaaatcccttggtactgatgtgatctggctgtctccgcactatgcgtcgccactggacgacatgggatacgatatctctgactacaatgccatcaatcctcaatttggcactatggaggacatggacagactgcttgcagagatcaagaagagagatatgagattgattctagacctcgttatcaaccacacctcgtctgagcacgcttggttcaaggagtctagatccagcagagacaacccaaaaagagactggtacatttggaaagacaacgccaacaactggctttcctttttctctggttctgcatggtcttatgacgaaaagactaagcaatactaccttagaaggtttgctgagactcagcctgacttgaactgggagaacccaaagactcgtgaagccatttacaaatctgctcttgagttttggtacgagaagggtgtttctggtttcagaatcgacactgccggcctctattcgaaagtccagacttttgaggacgcgccagtcaccttcccaggtgagaaataccaacctgctggtccactcatcaactccggccctcgtattcacgagttccacaaagaaatgtacgagaaagtgacttccaggtatgatgctatgactgtcggagaagtgggtcactgctccaaggcagatgctctcaagtacgtttctgcaaaagaaaaggagatgaacatgatgttcctgttcgacactgttgacgttggatccgacaagagcgacagatttagatacaagggcttcacgttgacggacttcaaagatgccatcatcaaccagtcaaacttcatctttgatgacgagaccggcgagctgaatgacgcatggtccactgtatttatcgagaaccacgaccaaccacgctgtgtcacaaggttcggaaatacctccaacaaactgttttggagcagatctgcaaagatgctggcactgttgcagacaaccttgaccggcactctgtttgtgtaccaaggtcaagagattggtatgactaatgtctcgccgaaatgggatatttcagagtatttggatatcaacaccattaactactggaacgcattcaacgagactgagcactctgatgaggagaaggccgagctgctgaagatcatcaatttgctagctagagacaatgcaaggactccagttcagtgggactcctctgaaaacggtggtttcggtggtaagccttggatgagaatcaacgacaactacaaagacatcaacgttgcttcgcaaaaagaagaccctgactctgtgctgaacttctacagaaatgccatcaagaccagaaagcattattctgagacgttgatttttggccgtttcgaggtgcaagactacgataaccaggagattttctactacaccaagaccagcaacaaaggccaaaagaagatggctgttgttttgaattttactgatagagaagtcgagtacccaatccctcaaggaaagctgctcctgtctaatattgcaaacaacatcacaggcaagctgcaaccatatgaaggtagactgatcgaggtcaattag

SEQ ID NO: 33017 - protein, 564 aa, Pichia angusta
MTIESQEPWWKSAVVYQVWPASFKDSNGDGIGDLNGITSELDHIKSLGTDVIWLSPHYASPLDDMGYDISDYNAINPQFGTMEDMDRLLAEIKKRDMRLILDLVINHTSSEHAWFKESRSSRDNPKRDWYIWKDNANNWLSFFSGSAWSYDEKTKQYYLRRFAETQPDLNWENPKTREAIYKSALEFWYEKGVSGFRIDTAGLYSKVQTFEDAPVTFPGEKYQPAGPLINSGPRIHEFHKEMYEKVTSRYDAMTVGEVGHCSKADALKYVSAKEKEMNMMFLFDTVDVGSDKSDRFRYKGFTLTDFKDAIINQSNFIFDDETGELNDAWSTVFIENHDQPRCVTRFGNTSNKLFWSRSAKMLALLQTTLTGTLFVYQGQEIGMTNVSPKWDISEYLDINTINYWNAFNETEHSDEEKAELLKIINLLARDNARTPVQWDSSENGGFGGKPWMRINDNYKDINVASQKEDPDSVLNFYRNAIKTRKHYSETLIFGRFEVQDYDNQEIFYYTKTSNKGQKKMAVVLNFTDREVEYPIPQGKLLLSNIANNITGKLQPYEGRLIEVN

SEQ ID NO: 33018 - DNA, 1590 bp, Thermus caldophilus
  CDS (1)..(1590)
atgagctggtggcaaagggcggtcatctaccaggtctacccccggagcttccaggacacgaacggggacggggtgggggacctcgagggcatccgcaggcggcttccctacttcaagtccttgggggtggacgccttctggctttcccccttctacaaaagccccatgaaggacttcggttacgacgtggccgactattgcgacgtggaccccgtcttcgggacccttcaggactttgaccgcctcctagaggaggcccacgccctggggcttaaggtcctcgtggacctggtgccgaaccacacctccagcgagcacccctggttcctggagtcccgcgcctcccggaatagccccaagcgggactggtacgtctggaaagaccctgccccggacggcggcccccccaacaactggcagagcttcttcggcggccccgcctggaccctggacgaggccacgggccagtactacctccaccttttcctccccgagcagcccgacctcaactgggacaatcccgaggtgcgggaggcgatcaaggaggtcatgcgcttttggctcaggaggggggtggacggcttccgggtggacgtgctctggcttctgggcaaggacccgctcttccgggacgagccgggaagccccctttggcggcccggccttcctgaccgggcccggcacgagcacctttacaccgaggaccagccggagacctacgcctacgtgcgggagatgcgccaggtcctggacgagttctccgagccggggagggagcgggtgatggtgggggagatctacctgcccttgccccgcctggtgcgctactacgccgccgggtgccacctgcccttcaacttcagcctcgtcaccgaggggctttccgactggcggcccgagaacctggcccggatcgtggagacctacgagggcctcctcacccgctgggactggcccaactgggtcctgggcaaccacgaccagccccgcctcgcctcccgcctgggggagccccaggcccgggtcgcggccatgctcctcttcaccttgaggggcacccccacctggtactacggggacgagctcgccctgcccaacggtctcatccccccggagaaggtgcaagaccctgcggccctgaggcagagggaccgggagcccaccgcctaccacaccctgggccgggaccccgagcggacgcccatgccctgggacgcctccccctacggggggttttccacggtggagccctggcttcccctgaaccccgactacaagacccgcaacgtggccgcccaggagaaggatccccgctccatgctccacctggtcaagcgcctcatcgccttgaggaaggaccccggccttctctatggggcctaccgcacctaccgggcgagggagggggtctacgcctacctccggggggaggggtggcttgtggccctgaacctcacggagaaggagaaggccctggagcttccccgcggggggagggtggtcctttccacccacctggaccgggaggagagggtgggggagaggctcttcttgcggcccgacgagggcgtggcggtgcggctagactag

SEQ ID NO: 33019 - protein, 529 aa, Thermus caldophilus
MSWWQRAVIYQVYPRSFQDTNGDGVGDLEGIRRRLPYFKSLGVDAFWLSPFYKSPMKDFGYDVADYCDVDPVFGTLQDFDRLLEEAHALGLKVLVDLVPNHTSSEHPWFLESRASRNSPKRDWYVWKDPAPDGGPPNNWQSFFGGPAWTLDEATGQYYLHLFLPEQPDLNWDNPEVREAIKEVMRFWLRRGVDGFRVDVLWLLGKDPLFRDEPGSPLWRPGLPDRARHEHLYTEDQPETYAYVREMRQVLDEFSEPGRERVMVGEIYLPLPRLVRYYAAGCHLPFNFSLVTEGLSDWRPENLARIVETYEGLLTRWDWPNWVLGNHDQPRLASRLGEPQARVAAMLLFTLRGTPTWYYGDELALPNGLIPPEKVQDPAALRQRDREPTAYHTLGRDPERTPMPWDASPYGGFSTVEPWLPLNPDYKTRNVAAQEKDPRSMLHLVKRLIALRKDPGLLYGAYRTYRAREGVYAYLRGEGWLVALNLTEKEKALELPRGGRVVLSTHLDREERVGERLFLRPDEGVAVRLD

SEQ ID NO: 33020 - DNA, 1752 bp, Kluyveromyces lactis
  CDS (1)..(1752)
atgacgattaccaagttgttacgagacccccaaacagaacccaagtggtggaaagaagcaattgtttacaggtttcaagactctaaccatgatggatgggtacgatatcaaaggtacgtatcgaagctgagtacattaaaggaacttggagctaacgcgatttggatctgcccattctatgattctccacaagaggatatgggttatgatatttcagattacgaaaaggtttggccacgctacggtacgaatgaagatatcttcaatttgatcgacagagcacacggtttgggaatcaaatcaattgtggatcttgttatcaatcactgctcttctgaacacgcttggttcaaagaagctcggtcgagcttggataaccccaaacgtgattggtttatctggaaagcaccaaagggattcgactccaatggcaaaccaatccctcccaatacctggagatctttctttggtggttctgcctggaggtacgatgaacataccggccaattctacctgcgtttatttgcgaaaggtcaaccagatttcaattgggagaatgaagtgactcgtaatgccatttacgaaagtgctgtaggattctggttagaccatggtgtcgatggtttcagaatcgatacagctggtctatactccaagcaaccagggttccctgatgtgccaataatcaaccctggtttggacttccagcatcctgacccagctattttgaatggtccaaggattcatgaattccacaaggagatgaacaaatttatgagagagcgtgttaaagatggcagagagttgttaacggtgggtgagattccttgtgggactcatgacgtgtgcaaggcgtacaccagtgcaaaagaccaagaaattactcaactattcgaatttgagcacgtgtctgtgggtaggaagccgggaaatgttggtgtagttaactttaaactgtcagaattcaaggatggtattgcggcacgattccagttcattgataagacagactcttggtccactgtctacattgaaaaccatgaccagccacgttctgtaacaagattcggggatgacagcccagagtaccgagaaatatcagcaaaattgctggctctgttggaaacaagtttgacaggcactctgtacgtataccaaggccaggaattaggtatgattaacttcagagactggccaattgagaaatatgaagatgtcgaagtgaaaggtatgtacaagtggatggttgatcaattcggtgcggactctgatcaagtcaaagattacgttaatggtttgcagttgatttctagagaccatgcgaggactccattcccatggacatccgaggctccatatgctggattcacagacggcaaggaaccatggttccctttaactgagactttccaagaaggtatcaacgccgaagatgagctgaaagacccaaagtctgttttcaatttttggaagacggctattgaagtcagaaagacacacaaggatgttttgaattatggatatgacttcacctttgttgaccatgctaacaagaaactctttgctttcactaagaagttcggagagaaagtattgtatgtggtgttgaacttcagcaaagaagagattgagttcagcttcttggaaggttacaactcttatgactacattttcggtaattatccagaagccgaaatcgacctggatcttacaagtctacagccatgggaaggtagattttactatgcctaa

SEQ ID NO: 33021 - protein, 583 aa, Kluyveromyces lactis
MTITKLLRDPQTEPKWWKEAIVYRFQDSNHDGWVRYQRYVSKLSTLKELGANAIWICPFYDSPQEDMGYDISDYEKVWPRYGTNEDIFNLIDRAHGLGIKSIVDLVINHCSSEHAWFKEARSSLDNPKRDWFIWKAPKGFDSNGKPIPPNTWRSFFGGSAWRYDEHTGQFYLRLFAKGQPDFNWENEVTRNAIYESAVGFWLDHGVDGFRIDTAGLYSKQPGFPDVPIINPGLDFQHPDPAILNGPRIHEFHKEMNKFMRERVKDGRELLTVGEIPCGTHDVCKAYTSAKDQEITQLFEFEHVSVGRKPGNVGVVNFKLSEFKDGIAARFQFIDKTDSWSTVYIENHDQPRSVTRFGDDSPEYREISAKLLALLETSLTGTLYVYQGQELGMINFRDWPIEKYEDVEVKGMYKWMVDQFGADSDQVKDYVNGLQLISRDHARTPFPWTSEAPYAGFTDGKEPWFPLTETFQEGINAEDELKDPKSVFNFWKTAIEVRKTHKDVLNYGYDFTFVDHANKKLFAFTKKFGEKVLYVVLNFSKEEIEFSFLEGYNSYDYIFGNYPEAEIDLDLTSLQPWEGRFYYA

SEQ ID NO: 33022 - DNA, 1656 bp, Rhizobium meliloti
  CDS (1)..(1656)
atgacaatgaacgaaacgacgagctcactcctcgagcccgatagggattggtggcgcggcgcggtgatctatcagatctatccgcgctcctttcaggacaccaatggcgatggcatcggtgatctgcaggggataacggcccgtctgccccacattgcagggctcggcgcggatgcgatctggatatcgcccttcttcacgtcgccgatgcgggacttcggctacgacgtctcaaactatgtcgatgtcgacccgatcttcgggacgctcgaagacttcgatgcgctgatcgcagaggcccaccggctcggtctccgggtgatgatcgacctcgtgctgtcacatacctccgaccggcacccctggttcgtcgaaagccgctccagccgcagcaatgcgaaagcggactggtacgtctgggcggattcgaagccggacggcacaccgcccaacaactggctgtcgattttcggcgggtccgcctggcagtgggatccgacccgcctgcaatattatctgcacaacttcctcacttcgcagcccgacctcaatctgcataacccgcaggttcaggaagcgctgcttgccgtcgagcgcttctggctggagcggggcgtcgacgggttccggctcgacaccatcaacttctatttccatgaccgcgagttgcgcgacaaccccgcgctcgtgcccgaacgccgaaacgcctcgactgcgccggcggtcaatccctataactatcaggagcatatctacgacaagaaccggccggagaacctggagttcctgaagcgcttccgcgcggttatggacgagttcccggcgatcgccgccgtcggcgaggtcggcgacagccagcgcggcctcgagatcgcaggtgaatacacgtcgggcggcgacaaggtgcacatgtgctacgctttcgagtttctggcgcccgatcggctgacgccgcagcgcgtggccgaggttctgcgcgacttccacagggcggcccccgaaggctgggcctgttgggccttctcgaaccatgacgtggtccgccacgtcagccgctgggccgatggcgtcaccgatcacgacgcgcatgcgaagttgctcgccagccttttgatgtcgctgcgcggtaccgtctgcatctatcagggcgaggaactcgcgctcgccgaggcggagctcgactatgaggatctccaggatccctatggcatccagttctggcccgacttcaagggccgggacggctgccgcacgccgatggtgtgggagagcctgcccgatggcggcttcagcagcgcgacgccgtggctgccgatttcccagagccacattccgcgggcggttgccgtgcaggagggcgacccggcctcggtgctgcaccactaccgacgctttctcgccttcagaaaggcaaatccggcattggccaagggcgagatcgaattcgtcgagaccaggggctccttgctcggcttcctgcgcagccatggcaacgagaaagtcttttgcctgttcaacatgagcgacgaagctgcgactaaggaactgccgatgaagcggctggagccgctcgagggtcacggcttcgtctctgagatactggatcacgaggtcaagctgccggcctggggcgcgtttttcgcgcgcctggcctga

SEQ ID NO: 33023 - protein, 551 aa, Rhizobium meliloti
MTMNETTSSLLEPDRDWWRGAVIYQIYPRSFQDTNGDGIGDLQGITARLPHIAGLGADAIWISPFFTSPMRDFGYDVSNYVDVDPIFGTLEDFDALIAEAHRLGLRVMIDLVLSHTSDRHPWFVESRSSRSNAKADWYVWADSKPDGTPPNNWLSIFGGSAWQWDPTRLQYYLHNFLTSQPDLNLHNPQVQEALLAVERFWLERGVDGFRLDTINFYFHDRELRDNPALVPERRNASTAPAVNPYNYQEHIYDKNRPENLEFLKRFRAVMDEFPAIAAVGEVGDSQRGLEIAGEYTSGGDKVHMCYAFEFLAPDRLTPQRVAEVLRDFHRAAPEGWACWAFSNHDVVRHVSRWADGVTDHDAHAKLLASLLMSLRGTVCIYQGEELALAEAELDYEDLQDPYGIQFWPDFKGRDGCRTPMVWESLPDGGFSSATPWLPISQSHIPRAVAVQEGDPASVLHHYRRFLAFRKANPALAKGEIEFVETRGSLLGFLRSHGNEKVFCLFNMSDEAATKELPMKRLEPLEGHGFVSEILDHEVKLPAWGAFFARLA

SEQ ID NO: 33024 - DNA, 1674 bp, Pediococcus pentosaceus
  CDS (1)..(1674)
atggcagcaacaatcaagtggtggcaacaagccgttgtctatcaggtctatccacggagttttcaagataccaatcatgatggtattggtgacttaaaggggatcacggcccacctagactacttaaagcaattaggaatcgacgtcatttggctcaatcccatttatcgttcacccaacgatgataatggttatgatattagtgattatcaacaaattgcggccgactttggcactatggctgattttgatgaactattgcaagccgcccatgaccggggcttaaagatcatcatggacttggttgttaaccatacctctgatgagcatcctaggttcaaacgcagtcgccaggaccgcaccaatcaatatcgtgatttctacttttggcgctcaggtaacggcaaaaaggcgcccaataattgggaggcggcttttggtggttcagcatggcaatatgatgagcagacccagcagtattatttacacacgttttcaacaaaacaacctgatttaaactgggagaatccgaccttacgagagtcagtttatacgatgatgacctggtggctgaacaagggtgttgacggttttcgaatggacgtcattaaccaaatctctaagttacccggattaccagatggtccactgaaaccgcacagtcagtttggcgatgctcgagtaacgaacggaccgcgagttcatgaattcttgcaagaaatgaaccaagaagtattgtcacagtttgatatcatgacggttggtgagacccacggggtgacaccagcggatgcgctgaagtatgcgggcgctgatcagcacgaattagatatggtctttgaatttcaacatctgcgacttgataatagtcagcatggtcttggtaagtggagtacgcgtaagacaccgttagtggcgctaaagaaagtcattagtgactggcaagtcggacttgaagggcgggcttggaacagcctgttttggaacaatcatgatacgccacgagcggtctcacgttttggtgatgaccgaccagcatatcgggtacgttcggctaaaatgctcgcaacgtgtttacacctcttacagggaaccccatatatttaccaaggtgaggaactggggatgactgacgctcattttactgaactagccagttaccgagatattgaatcgctcagtgcctatcgtgatttagtgactgagcgccagctgctatcaccggcagatatgatggcccgattagcggcggcttctcgggacaactcgcgaacgccgatgcaatgggacacggaggttaacgcgggttttagtgacgcagcgccatggctcacggtcaatcccaactatcgtcaaatcaatgctgccgcagctttggctgatccggattcagtgtggtactattatcagcacttgattcaattacgacatcaatacccctcagtgacgttaggttcgtttgagctcttgtgggccgatgatccgcagtattcttatatgcacggcaatgggaaggcggacctggctagtttgttgcaatttcacagccgagacactgtcccgaccactggatcaatatctgaccccacggccaaatgcttgattagtaattatggcgagcagcagccaaataaattacggccttatgaggcttgggtctaccaactcgcatag

SEQ ID NO: 33025 - protein, 557 aa, Pediococcus pentosaceus
MAATIKWWQQAVVYQVYPRSFQDTNHDGIGDLKGITAHLDYLKQLGIDVIWLNPIYRSPNDDNGYDISDYQQIAADFGTMADFDELLQAAHDRGLKIIMDLVVNHTSDEHPRFKRSRQDRTNQYRDFYFWRSGNGKKAPNNWEAAFGGSAWQYDEQTQQYYLHTFSTKQPDLNWENPTLRESVYTMMTWWLNKGVDGFRMDVINQISKLPGLPDGPLKPHSQFGDARVTNGPRVHEFLQEMNQEVLSQFDIMTVGETHGVTPADALKYAGADQHELDMVFEFQHLRLDNSQHGLGKWSTRKTPLVALKKVISDWQVGLEGRAWNSLFWNNHDTPRAVSRFGDDRPAYRVRSAKMLATCLHLLQGTPYIYQGEELGMTDAHFTELASYRDIESLSAYRDLVTERQLLSPADMMARLAAASRDNSRTPMQWDTEVNAGFSDAAPWLTVNPNYRQINAAAALADPDSVWYYYQHLIQLRHQYPSVTLGSFELLWADDPQYSYMHGNGKADLASLLQFHSRDTVPTTGSISDPTAKCLISNYGEQQPNKLRPYEAWVYQLA

SEQ ID NO: 33026 - DNA, 1497 bp, Dictyoglomus thermophilum
  CDS (1)..(1497)
atgaagataaagttttttatcaaaagaactcttattttcatattcatcttagttacttttctaacttatattcatggatataatgagccatggtataaaaacgcgattttttatgaagtctttgtaagatcttttgcagatagcgacggggatagagtaggagatttaaatggacttatagacaaattagattactttaaaaatctaaatattactgctctatggctaatgcctatcttcccctcagtgagttatcatggatatgatgtcacagactattatgatatccatccaggttatggtaccatggaggactttgaaaacctaataagaaaagcccatgaaaaaaatattaaaataattcttgatttggtagtaaaccacacctcttcaaggcatccatggtttgtttcttctgcctcttcttacaattctccgtatcgcgattattatatatggagtactgaaaaacctgaaaaaaattctaatttatggtataaaaaacctacaggatactactatgcattattctggtcagaaatgcccgatctaaactttgataatccaaaagtaagagaagaggtcaaaaaaattgcaaaattttggatagaaaaaggtgttgacggatttagactcgacgcagcaaagcatatttatgatgatgactctaaaaacattcagtggtggaaagaattttactcatatttaaagagtataaaacccgatgtataccttgttggtgaagtttgggataacgagtataagatagcagaatactataaaggattaccctcaaactttaattttcctctttctgacaaaataatgaactccagtagcaaatcaaaaagacttaggaattatagaatttctcgattgaagagactttttggggaaaacaatacagactttgctgatgccatatttttaagaaaccacgatcaagtaagagttaggacattctttggtggaagcatagataaaagtattttggcaggatctatttacttaactttggccgggaataccttcatatactacggagaagaaataggaatggaaggatcaaaacctgacgaatatataagagaaccgtttaagtggactgacgatatgaaatctaaataccaaacctattggattattccacgatataacttaccaggaaatggtatagccctcgataccgaagaaaaagatccaaatagcatatacaatcactataaaaaactcttagaaataagagtcaaatgcagagctttatctaatggaaaaatagagagaataaagactcaagatagatctatacttgcctataagttagaattagaggatgaaaaaataatggtagtccacaatctaaataggattgaaaatacctttaactttaacaacgagataaaagaaaaagacatactatatattagaaacgctaaaactgaaaaaaataaaataatcttaggaccttatagcactgttatagtcaaaatcccataa

SEQ ID NO: 33027 - protein, 498 aa, Dictyoglomus thermophilum
MKIKFFIKRTLIFIFILVTFLTYIHGYNEPWYKNAIFYEVFVRSFADSDGDRVGDLNGLIDKLDYFKNLNITALWLMPIFPSVSYHGYDVTDYYDIHPGYGTMEDFENLIRKAHEKNIKIILDLVVNHTSSRHPWFVSSASSYNSPYRDYYIWSTEKPEKNSNLWYKKPTGYYYALFWSEMPDLNFDNPKVREEVKKIAKFWIEKGVDGFRLDAAKHIYDDDSKNIQWWKEFYSYLKSIKPDVYLVGEVWDNEYKIAEYYKGLPSNFNFPLSDKIMNSSSKSKRLRNYRISRLKRLFGENNTDFADAIFLRNHDQVRVRTFFGGSIDKSILAGSIYLTLAGNTFIYYGEEIGMEGSKPDEYIREPFKWTDDMKSKYQTYWIIPRYNLPGNGIALDTEEKDPNSIYNHYKKLLEIRVKCRALSNGKIERIKTQDRSILAYKLELEDEKIMVVHNLNRIENTFNFNNEIKEKDILYIRNAKTEKNKIILGPYSTVIVKIP

SEQ ID NO: 33028 - DNA, 1563 bp, Bacillus megaterium
  CDS (1)..(1563)
atgaaagggaaaaaatggacagctttagctctaacactgccgctggctgctagcttatcaacaggtgttgacgccgaaaccgtacataaaggtaaagctccaacagcagataaaaacggtgtcttttatgaggtatatgtaaactctttttacgatgcaaataaagatggacatggtgatttaaaaggccttacacaaaagttggactatttaaatgacggaaattctcatacaaagaatgatcttcaagtaaacgggatttggatgatgccggtcaacccttctcctagctatcataaatatgatgtaacggactattataatattgatccgcagtatggaaatctgcaagattttcgcaaacttatgaaagaagcagataaacgagacgtaaaagtcattatggaccttgttgtgaatcatacgagcagtgaacacccttggtttcaagctgcgttgaaagataaaaacagcaagtacagagattactatatttgggctgataaaaatactgacttgaatgaaaaaggatcttggggacaacaagtatggcataaagctccaaacggagagtatttttacggaacgttctgggaaggaatgcctgacttaaattacgataaccctgaagtaagaaaagaaatgattaacgtcggaaagttttggctaaaacaaggcgttgacggcttccgcttagatgctgcccttcatatttttaaaggtcaaacgcctgaaggcgctaagaaaaacattctatggtggaatgagtttagagatgcgatgaaaaaagaaaacccgaacgtatatctaacgggtgaagtgtgggaccagccagaagtagtagccccttactatcaatcacttgattctctatttaattttgatttagcaggaaaaattgtcagctctgtaaaagcaggaaatgatcaaggaatcgccactgcagcagcggcaactgatgagctgttcaaatcatacaatccaaataaaattgacggcattttcttaaccaaccatgaccaaaatcgcgtcatgagtgagttaagcggcgatgtgaataaagcaaaatcagccgcctctatcttacttacgcttcctggaaatccgtatatttattacggtgaagaaattggcatgacaggtgaaaagcctgatgaattaatccgtgaaccgttccgctggtacgaaggcaacggaattggacaaactagctgggaaacacctgtatataacaaaggcggtaacggcgtgtctgtagaagcacaaacaaaacaaaaggattccttgttaaatcattaccgtgaaatgattcgtgtgcgccagcagcacgaagagttagtaaaaggaacgcttcaatccatttcagtagacagtaaagaagtcgttgcctatagccgcacgtacaaaggcaaatcgattagcgtgtatcataatatttcaaatcaacctgtaaaagtatctgtagcagcgaaaggtaacttgatttttgctagtgaaaaaggtgctaagaaagtcaaaaatcagcttgtgattccggcgaatcggacggttttaataaaataa

SEQ ID NO: 33029 - protein, 520 aa, Bacillus megaterium
MKGKKWTALALTLPLAASLSTGVDAETVHKGKAPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGIGQTSWETPVYNKGGNGVSVEAQTKQKDSLLNHYREMIRVRQQHEELVKGTLQSISVDSKEVVAYSRTYKGKSISVYHNISNQPVKVSVAAKGNLIFASEKGAKKVKNQLVIPANRTVLIK

SEQ ID NO: 33030 - DNA, 1755 bp, Saccharomyces cerevisiae
  CDS (1)..(1755)
atgactatttctgatcatccagaaacagaaccaaagtggtggaaagaggccacaatctatcaaatttacccagcaagttttaaagactccaataacgatggctggggtgatttaaaaggtatcacttccaagttgcagtatattaaagatcttggcgttgatgctatttgggtttgtccgttttatgactctcctcaacaagatatggggtatgatatatccaactacgaaaaggtctggcccacatacggtaccaatgaggactgttttgagctaattgacaagactcataagctgggtatgaaattcatcaccgatttggttatcaaccactgttctacagaacacgaatggttcaaagagagcagatcctcgaagaccaatccgaagcgtgactggttcttctggagacctcctaagggttatgacgccgaaggcaagccaattcctccaaacaattggaaatctttctttggtggttcagcttggacttttgatgaaactacaaatgaattttacctccgtttgtttgcgagtcgtcaagttgacttgaattgggagaatgaagactgcagaagggcaatctttgaaagtgctgttggattttggctggaccatggtgtagatggttttagaatcgataccgctggtttgtattcgaaacgtcctggtttaccagattccccaatttttgacaaaacctcgaaattacaacatccaaattgggggtctcacaatggtcctaggattcatgaatatcatcaagaactacacagatttatgaaaaacagggtgaaagatggtagagaaataatgagagtcggtgaagttgcccatggaagtgataatgctttatacaccagtgcagctagatacgaagtcagcgaagttttctccttcacgcacgttgaagttggtacctcgccatttttccgttataacatagtgcccttcaccttgaaacaatggaaagaagccattgcatcgaactttttgttcattaacggtactgatagttgggctaccacctacatcgagaatcacgatcaagcccggtcaattacgagatttgctgacgattcgccaaagtaccgtaaaatatctggtaagctgttaacattgctagaatgttcattgacaggtacgttgtatgtctatcaaggtcaggagataggccagatcaatttcaaggaatggcctattgaaaagtatgaggacgttgatgtgaaaaacaactacgagattatcaaaaaaagttttggtaaaaactcgaaggaaatgaaggatttttttaaaggaatcgccctactttctagagatcattcgagaactcccatgccatggacgaaagataagcccaatgctggatttactggcccagatgttaaaccttggtttttcttgaatgaatctttcgagcaaggaatcaatgttgagcaggaatccagagatgatgactcagttctcaatttttggaaaagggccttgcaagccagaaagaaatataaggaacttatgatttatggttacgatttccaattcattgatttagacagtgaccagatctttagcttcactaaagagtacgaagacaagacgctgtttgctgctttaaatttcagtggcgaagaaattgaattcagcctcccaagagaaggtgcttctttatcttttattcttggaaattatgatgatactgacgtttcctccagagttttgaaaccatgggaaggtagaatctacctcgtcaaataa

SEQ ID NO: 33031 - protein, 584 aa, Saccharomyces cerevisiae
MTISDHPETEPKWWKEATIYQIYPASFKDSNNDGWGDLKGITSKLQYIKDLGVDAIWVCPFYDSPQQDMGYDISNYEKVWPTYGTNEDCFELIDKTHKLGMKFITDLVINHCSTEHEWFKESRSSKTNPKRDWFFWRPPKGYDAEGKPIPPNNWKSFFGGSAWTFDETTNEFYLRLFASRQVDLNWENEDCRRAIFESAVGFWLDHGVDGFRIDTAGLYSKRPGLPDSPIFDKTSKLQHPNWGSHNGPRIHEYHQELHRFMKNRVKDGREIMRVGEVAHGSDNALYTSAARYEVSEVFSFTHVEVGTSPFFRYNIVPFTLKQWKEAIASNFLFINGTDSWATTYIENHDQARSITRFADDSPKYRKISGKLLTLLECSLTGTLYVYQGQEIGQINFKEWPIEKYEDVDVKNNYEIIKKSFGKNSKEMKDFFKGIALLSRDHSRTPMPWTKDKPNAGFTGPDVKPWFFLNESFEQGINVEQESRDDDSVLNFWKRALQARKKYKELMIYGYDFQFIDLDSDQIFSFTKEYEDKTLFAALNFSGEEIEFSLPREGASLSFILGNYDDTDVSSRVLKPWEGRIYLVK

SEQ ID NO: 33032 - DNA, 1704 bp, Apis mellifera
  CDS (1)..(1704)
atgaaggcagtaatcgtattttgccttatggcattgtccattgtggacgcagcatggaagccgctccctgaaaacttgaaggaggacttgatcgtgtatcaggtctacccgagaagcttcaaggatagcaatggagatggtattggtgatatcgaaggtattaaagaaaaattggatcattttctcgaaatgggggtcgacatgttttggttatcccctatttatccaagccctatggtcgattttggttacgacatttcgaattacaccgacgttcatcccatatttggcaccatatcagacttagataatctagtcagtgctgcacatgagaaaggattgaagataatcttggatttcgtcccgaatcatacatctgatcaacacgaatggttccagttgagtttgaaaaacattgaaccttataacaactattacatttggcatccaggaaaaattgtaaatggcaaacgtgttccaccaactaattgggtaggcgtgtttggtggatcagcttggtcgtggcgggaagaacgacaggcatattatctgcatcaatttgcaccagaacaaccagatctaaattactataatccagttgtactggatgatatgcaaaatgttctcagattctggctgagaaggggatttgatggtttcagagtagatgctctgccttacatttgcgaagacatgcgattcttagacgaacctctatcaggtgaaacaaatgatcccaataaaaccgagtacactctcaagatctacactcacgatatcccagaaacctacaatgtagttcgcaaatttagagatgtgttagacgaattcccgcaaccaaaacacatgcttatcgaggcatacacgaatttatcgatgacgatgaaatattacgattacggagcagattttcccttcaattttgcattcatcaagaatgtttctagggattcaaattcatcagacttcaaaaaattggtcgataattggatgacgtacatgccaccaagtggtattcctaactgggtgcccggaaatcacgatcaattgagattggtgtcgagatttggagaggagaaggcccgtatgatcaccacgatgtcgcttttgctgccaggtgttgccgtgaattactacggtgatgaaattggtatgtcggatacttatatctcgtgggaggatacgcaggatccgcagggatgcggcgccggtaaagaaaactatcaaacgatgtcgagagatcccgcgagaacgccattccaatgggacgactcagtttctgctggattttcctcaagctctaatacctggcttcgtgtcaacgaaaattacaagactgtcaatctagctgctgaaaagaaggacaagaactcgttcttcaatatgttcaagaaatttgcgtcgctgaaaaaatcgccatactttaaagaggccaatttaaatacgaggatgctgaacgacaatgttttcgcattctctagggaaaccgaagataatggatctctttacgcaatattgaacttctcgaacgaggaacaaatcgtggatttgaaagcgttcaataacgtgccgaaaaaattgaatatgttttacaacaattttaactctgatataaagtccatctccaacaatgaacaagtaaaagtttctgctttaggatttttcatcttaatttctcaagatgctaaatttggaaacttttaa

SEQ ID NO: 33033 - protein, 567 aa, Apis mellifera
MKAVIVFCLMALSIVDAAWKPLPENLKEDLIVYQVYPRSFKDSNGDGIGDIEGIKEKLDHFLEMGVDMFWLSPIYPSPMVDFGYDISNYTDVHPIFGTISDLDNLVSAAHEKGLKIILDFVPNHTSDQHEWFQLSLKNIEPYNNYYIWHPGKIVNGKRVPPTNWVGVFGGSAWSWREERQAYYLHQFAPEQPDLNYYNPVVLDDMQNVLRFWLRRGFDGFRVDALPYICEDMRFLDEPLSGETNDPNKTEYTLKIYTHDIPETYNVVRKFRDVLDEFPQPKHMLIEAYTNLSMTMKYYDYGADFPFNFAFIKNVSRDSNSSDFKKLVDNWMTYMPPSGIPNWVPGNHDQLRLVSRFGEEKARMITTMSLLLPGVAVNYYGDEIGMSDTYISWEDTQDPQGCGAGKENYQTMSRDPARTPFQWDDSVSAGFSSSSNTWLRVNENYKTVNLAAEKKDKNSFFNMFKKFASLKKSPYFKEANLNTRMLNDNVFAFSRETEDNGSLYAILNFSNEEQIVDLKAFNNVPKKLNMFYNNFNSDIKSISNNEQVKVSALGFFILISQDAKFGNF

SEQ ID NO: 33034 - DNA, 1761 bp, Drosophila virilis
  CDS (1)..(1761)
atgagtttgaagtggagcttagttttgggcctaagttggctcctttttgtggcttcgtcagaattaaaaaagcataagccaaacgagttggacgacaatattaattggtggcgacacgaggtcttttatcagatttatcctaggtcctttaaggacagcgatggcgatggcattggtgatcttaagggcatcacctccaagctgcagtactttgtggacactggcatcacggccatctggctaagtcccatttacaagtcacccatggttgactttgggtacgatatatccgactacagggacatccagccggagtatggcaccctggaggactttgatgcgctgatcgccaaggccaatcaactgggcatcaaggtcattttggactttgtgcccaatcacagctcggacgaacacgaatggtttaagaagtccgctgctagagagcctggctatgaggatttctatgtgtgggaggacggcatacctggggataatgaaactcgcttaccgccaaacaactgggtatctgtattctccggctccgcttggcagtggcacgaggagcggcaacaattctatttgcgtcagtttaccaagggacagcccgatttgaactatcgtaatcctgctgtggtgcaggccatggatgaagttttgttgtactggctgcaaaagggcgtggctggcttccgcatcgatgccgttatctatatatatgaggacgaacagttgcgcgacgagcccttgagcggttccaccagtgatccgaactcagttgattatctggagcacatctacacaaggaacctgccggaatgctatggcctcattcagcattggcgtcagctgttggacaactacacggccgataatccgggaccagtgcgcattatgatgaccgagggctatgcggatctatcgctgctaatgaactactatgaagatgaggacggcgtgcagggcgcccactttccctttaattttgattttattaccgagctgaatgcaaactcagcggctccggactttgtatacttcattcaaagatggctgacctatatgccgcctggacactcagccaactgggtgatgggcaatcatgataatccgcgcgttgcatctcggtatggcgttggcactgtggatgccatgaacatgctgatgatgactttgccgggcatcggcattacctactatggcgaggaactcggcatggtagactatcgtgacattagctggaacgatacagtggatcagcccgcctgtgatgctggtcttgacaattacaagtgggtctctcgcgaccccgaacgcacgccaatgcagtggagtgatgagaagaatgctggtttctccacgggagattccacctggttgccagtgcacccgaattatcaggagcttaatctgctcacccagcaagaagccacttacagccattataaggtctatcagtcgctgatcaagctgagacaatcgcgagtcttgcgggatggctcatttacagcccaggcccttaatcgtaatgtttttgctattaagcgcgaattgagaggtcagcccaccctgctaactgtcattaatgtgagcaatcgcacccagcaagtcgatgtcagtaactttatcgatttgcccaatcgtcttacattgttggttgtgggcgtttgctcccagcatagggtgagcgagcgccttaagcccgccgaggtcaaactgtcgccccatgagggtctagttatacagctcaaagctcgctag

SEQ ID NO: 33035 - protein, 586 aa, Drosophila virilis
MSLKWSLVLGLSWLLFVASSELKKHKPNELDDNINWWRHEVFYQIYPRSFKDSDGDGIGDLKGITSKLQYFVDTGITAIWLSPIYKSPMVDFGYDISDYRDIQPEYGTLEDFDALIAKANQLGIKVILDFVPNHSSDEHEWFKKSAAREPGYEDFYVWEDGIPGDNETRLPPNNWVSVFSGSAWQWHEERQQFYLRQFTKGQPDLNYRNPAVVQAMDEVLLYWLQKGVAGFRIDAVIYIYEDEQLRDEPLSGSTSDPNSVDYLEHIYTRNLPECYGLIQHWRQLLDNYTADNPGPVRIMMTEGYADLSLLMNYYEDEDGVQGAHFPFNFDFITELNANSAAPDFVYFIQRWLTYMPPGHSANWVMGNHDNPRVASRYGVGTVDAMNMLMMTLPGIGITYYGEELGMVDYRDISWNDTVDQPACDAGLDNYKWVSRDPERTPMQWSDEKNAGFSTGDSTWLPVHPNYQELNLLTQQEATYSHYKVYQSLIKLRQSRVLRDGSFTAQALNRNVFAIKRELRGQPTLLTVINVSNRTQQVDVSNFIDLPNRLTLLVVGVCSQHRVSERLKPAEVKLSPHEGLVIQLKAR

SEQ ID NO: 33036 - DNA, 1575 bp, Drosophila virilis
  CDS (1)..(1575)
atggcagcagcgcatcagttaacccgaacaacccaactgcttctactttgcagcctgctgtggacacaggcgcctcgtccggtcatgtccagtctgttgagcgctcaaacagaagattttatcgactggtggcagcacgcggtcttctaccagatctatcccagatcctttaaggacagtaacggcgatggcatcggcgacttgcagggcgttatctccaagctgccgtatctagctgaaacgggtattacagcgacctggctgagtcccatttttcagtcacccatggtggactttggctatgatgtatctgactataagtctatacaaacggagtatggaactatggccgactttgagcagctggtgaacacggctaccagtctgggcatcaagataatcttggactttgtgcccaatcacacctcggataagcacgaatggttcataaagtcagcggctcgggaccccttgtatgataacttttatgtatgggcagatgggaaactggataatcagggtgttcgacagccaccgaacaactggcagtccgtgttctatggctccgcctggcaatggcatgagcaacgcgggcagtactatttgcaccagttcgccaaggagcagccagatcttaactttcgcaacccggccgtggtgcgtgctatggatgatgttctgctgttctggcttaataaaggtgtggctggttttcgcattgacgcactcaatcatttgttcgaagatgaaaccctgcccgatgagccccttagtggcaagactacgaatcccctctcttacgactatacgaagcacatctacaccaaagatttgcctgaggttttgagcatggtgcagcactggcggcagctgttggacgattataccgccaagcactcggaaggtgccacgcgcattatgatgacagaggcgtatgccgacttgcaggtgctcatggactactatgaggatgccggcggagtgcgcggctcccaattgcccttcaattttcactttattacggatgtgagcggagattcggatgcccgtgactttgtatacaatatagagaagtggctgatctacatgcctcgcgggcacactgccaattgggtcatgggcaaccacgataaaccgcgtgtcgccacgcgttttggccccgccagtgtcgatgccatgaacatgctgctgctgacacttcccggcgttgctgttacctataatggcgaggagctgggcatgcaggactatgacgaaatcagttgggaggacacggtggatccgccagcgcgcattgccggtaaactggactataagaaagtgtccagagatccggagcgtacaccctttcagtggagcaatgctaccaatgctggtttctccactgctgccaagacatggctacctgtaaatcccaactatctggtattaaatctagaagcgcaaaagcaagccgtcaaaagccactacaaagtctacaaatcgctgattgagctacgcaagttgccggtgctgagacgtggaaggtttagcatagagccgctatcccgcacagttttcgcgtttaagcggtaa

SEQ ID NO: 33037 - protein, 524 aa, Drosophila virilis
MAAAHQLTRTTQLLLLCSLLWTQAPRPVMSSLLSAQTEDFIDWWQHAVFYQIYPRSFKDSNGDGIGDLQGVISKLPYLAETGITATWLSPIFQSPMVDFGYDVSDYKSIQTEYGTMADFEQLVNTATSLGIKIILDFVPNHTSDKHEWFIKSAARDPLYDNFYVWADGKLDNQGVRQPPNNWQSVFYGSAWQWHEQRGQYYLHQFAKEQPDLNFRNPAVVRAMDDVLLFWLNKGVAGFRIDALNHLFEDETLPDEPLSGKTTNPLSYDYTKHIYTKDLPEVLSMVQHWRQLLDDYTAKHSEGATRIMMTEAYADLQVLMDYYEDAGGVRGSQLPFNFHFITDVSGDSDARDFVYNIEKWLIYMPRGHTANWVMGNHDKPRVATRFGPASVDAMNMLLLTLPGVAVTYNGEELGMQDYDEISWEDTVDPPARIAGKLDYKKVSRDPERTPFQWSNATNAGFSTAAKTWLPVNPNYLVLNLEAQKQAVKSHYKVYKSLIELRKLPVLRRGRFSIEPLSRTVFAFKR

SEQ ID NO: 33038 - DNA, 1740 bp, Aedes aegypti
  CDS (1)..(1740)
atgaagatctttgttccacttctaagcttcctcctagcaggactaaccaccgggttggactggtgggaacatggaaacttctaccaagtttacccaagatccttcaaggactccgacggcgacggtatcggggatctggacggagtcaccgaaaagctgaaatatctgaaagacatcggcatggacggagtttggttgtcaccgattttctcttctccgatggctgattttggctatgacatctcgaacttccgagagattcaaacggaatacggggatctagatgctttccagcggttgtccgataagtgtaagcagctgggcttgcatctaattttagacttcgtcccgaatcatactagcgaccaacacgaatatttcaaaaagtctgttcaaaaagatgagacatacaaggatttctacgtatggcatccgggtgtacatggtccgaacaacaccaaggtaccgccatccaactggatcagtgtgttccgaggatcttcctgggaatggaatgaggagcgccaagagttttatctgcatcagtttttgaaagaacaaccagatctgaactaccgcaatcctgccgtagtggaagagatgaagaacgttcttcggtattggctggaccggggagtttctgggttcagaatcgatgcagtaccgtatcttttcgagagcgacattatcgacggacgatatcgtaatgaaccagaaagtcgtaccactgatgaccccgagaacccagcttatttggttcatacgcaaaccatggatcagccggaaacctacgatatgatctatcaatggcgtgcggtattggacgagtacagtaaaacggataatagaactcgtatcatgatgactgagggctacactagccttccaaagatcatcgagttctttggtaatgccactgctaacggagcacagattccgttcaactttgaagtgatcagtaatgtgaagaagaacagcactggcgctgattttgccacttatgttaaacgctggttggatgctaaacctgccaacagaagatccaattgggtacttggaaaccacgacaacaatcgcttagggtcccgtttgggcgagaataagattgatttgtacaacatcgctttacaaacattaccggatattgccgtcacatactacggtgaggaaatcggaatgctcgatcagtggattccttggaacgaaactgttgatccggctgcttgcagatcagatgaggcttcttattccgcttactctagagatcctgcccgtactccaatgcagtgggacagcggaaagaacgcaggtttctctaaggcggccaagacttggcttccagtggcagacaattacaagacccttaacgtaaagattcaggatcgtgcccgcaaaagccatttgaagatattcaagaagttgaccaagtaccgcaagcgtcaaatcttgaccgaaggagacatcgacattaaggtttccggggaaaatctactcgtgtacaaacgtaaggtcgataaggttggctacgtggtcgttgcactgaactttggtacggaacctgtagcgctgggtctttccagtttgtttgatcgagctgatcagagaatgcaagtagtggtatcgtcgaacagggtctccactccagataacgtatgggtagatgtggataactacgtactaatcggagagagtggcatcgtgctgcaatatttatggggaaagaacccgattgtttcttaa

SEQ ID NO: 33039 - protein, 579 aa, Aedes aegypti
MKIFVPLLSFLLAGLTTGLDWWEHGNFYQVYPRSFKDSDGDGIGDLDGVTEKLKYLKDIGMDGVWLSPIFSSPMADFGYDISNFREIQTEYGDLDAFQRLSDKCKQLGLHLILDFVPNHTSDQHEYFKKSVQKDETYKDFYVWHPGVHGPNNTKVPPSNWISVFRGSSWEWNEERQEFYLHQFLKEQPDLNYRNPAVVEEMKNVLRYWLDRGVSGFRIDAVPYLFESDIIDGRYRNEPESRTTDDPENPAYLVHTQTMDQPETYDMIYQWRAVLDEYSKTDNRTRIMMTEGYTSLPKIIEFFGNATANGAQIPFNFEVISNVKKNSTGADFATYVKRWLDAKPANRRSNWVLGNHDNNRLGSRLGENKIDLYNIALQTLPDIAVTYYGEEIGMLDQWIPWNETVDPAACRSDEASYSAYSRDPARTPMQWDSGKNAGFSKAAKTWLPVADNYKTLNVKIQDRARKSHLKIFKKLTKYRKRQILTEGDIDIKVSGENLLVYKRKVDKVGYVVVALNFGTEPVALGLSSLFDRADQRMQVVVSSNRVSTPDNVWVDVDNYVLIGESGIVLQYLWGKNPIVS

SEQ ID NO: 33040 - DNA, 1746 bp, Saccharomyces cerevisiae
  CDS (1)..(1746)
atgacgatcatccataatcctaaatggtggaaagaagccaccgtctaccaaatttatcctgctagtttcaaggactccaacaatgacggatggggtgatttagctgggattacctccaaacttgactatgtcaaagaattaggtgtcgatgcgatatgggtgtgcccattttatgactctcctcaagaagatatgggttacgatattgccaactatgagaaggtttggccacgttacggtaccaatgaggattgtttccaaatgatagaagaagctcataagagaggtatcaaggttattgttgacctggttatcaaccactgttctgaagagcatgaatggttcaaggagagtagatcttctaaggctaatccaaagcgtgactggtttttctggagacctccaaagggttacgatgagaaaggtaatccaattcctcccaacaattggagatctttctttggtggatctgcttggagatatgacgaaaaaactggtgagttctttctgcatgtgtttgctcttggccaacctgatttcaattgggaaaatgaagagtgccgtaaagccatttatgactcctcagtgggctattggctacgtcacaacgttgatggctttcgtattgacgtaggcagcatgtattctaaggttgagggcctacccgatgctcctatcactgatcctacagttccttaccaaaaaggaactgaatttttcataaatgggccacgtatccatgagtatcataaagaaatgcataactacatgctctcgcaagttccagagggtaaagaaatcatgactgttggagaagttggtatcgggaatgaagacgacttcagagtttataccagtgccaaagaaggagaactaaatatgatgttcaacttcaagcacacctcagtaggtgaaaacccaaaatgcaagtacgaacttattccctttactttaaaagactttaagctggctcttgctgaaagctttctgtttatcgaaaacacagattgctggtcgaccatctatttggagaatcatgatcaacctcgtagcgtttcgcgttttggctcagattctcctaaatggcgtgagatttcgtccaagatgttggctactctcatcatttcattgactggtactgtttttatctaccaaggacaagaattgggtatgcccaacttcaaaaacagaaaaattgagcaaatcaaatgcgttgaaggtactggtacatatgccgccattaaacgtgattatggtgaagattctgaaaagatgaaaaagttttttgaagcattagctttgatctctagagatcatgggagaacaccattcccatggagtgctgatgagccttctgcaggtttctcgaaggatgccaaaccatggattgacatgaatgaatcatttagagacggaatcaacgcagaagctgagttaaaagataaaaactcagtcttctttttctggaaaaaggccttacaagttagaaaggagcacaaagatatccttgtttatggacataactttcagttcattgatcttgataatgacaagctattcatgtttacaaaggacacagataacaaaaaaatgtttgctgttttcaatttcagtagcgataatacggacttttcagttcctgataatgaggcctcctacaccatgttttttggcaactatgcaaactcaaatggtgattcccgcaccttgcagccatgggaaggaagactttacttgttgaagtaa

SEQ ID NO: 33041 - protein, 581 aa, Saccharomyces cerevisiae
MTIIHNPKWWKEATVYQIYPASFKDSNNDGWGDLAGITSKLDYVKELGVDAIWVCPFYDSPQEDMGYDIANYEKVWPRYGTNEDCFQMIEEAHKRGIKVIVDLVINHCSEEHEWFKESRSSKANPKRDWFFWRPPKGYDEKGNPIPPNNWRSFFGGSAWRYDEKTGEFFLHVFALGQPDFNWENEECRKAIYDSSVGYWLRHNVDGFRIDVGSMYSKVEGLPDAPITDPTVPYQKGTEFFINGPRIHEYHKEMHNYMLSQVPEGKEIMTVGEVGIGNEDDFRVYTSAKEGELNMMFNFKHTSVGENPKCKYELIPFTLKDFKLALAESFLFIENTDCWSTIYLENHDQPRSVSRFGSDSPKWREISSKMLATLIISLTGTVFIYQGQELGMPNFKNRKIEQIKCVEGTGTYAAIKRDYGEDSEKMKKFFEALALISRDHGRTPFPWSADEPSAGFSKDAKPWIDMNESFRDGINAEAELKDKNSVFFFWKKALQVRKEHKDILVYGHNFQFIDLDNDKLFMFTKDTDNKKMFAVFNFSSDNTDFSVPDNEASYTMFFGNYANSNGDSRTLQPWEGRLYLLK

SEQ ID NO: 33042 - DNA, 1770 bp, Saccharomyces cerevisiae
  CDS (1)..(1770)
atgactatttcttctgcacatccagaaacagaacccaagtggtggaaagaggccacaatttatcaaatttatcccgcaagtttcaaagactccaacaacgatggttggggtgatatgaagggtattgcctccaagttggagtacatcaaagagcttggtaccgatgccatttggatctcgccattttacgactcgccacaagatgatatgggttacgatattgccaactacgaaaaggtctggccaacctacggtacgaacgaggactgctttgccttgatcgaaaagacacataagcttggtatgaaatttatcaccgacttagtcatcaaccattgctccagcgaacatgaatggttcaaagagagcagatcctcaaaaaccaatccaaaacgtgactggttcttctggagacctcctaagggttatgacgccgaaggcaagccaattcctccaaacaattggaggtcttacttcggtggttctgcatggacgttcgatgaaaagacacaagagttttacttgcgtttgttttgctccacccaacctgatctaaactgggagaacgaagactgcagaaaggcaatctacgaaagtgccgttggatactggttagaccatggtgtagacggctttagaattgatgtgggaagcttgtactccaaggttgctggtctaccagacgctcctgtgattgacgaaaactcaaagtggcaactcagtgatcctttcacaatgaacggaccacgtatccatgagtttcatcaagaaatgaacaagttcatcagaaacagagtgaaggatggcagagaaattatgacagttggtgaaatgcgacatgctactgatgagaccaagaggttgtatacaagtgcgtcaagacacgaacttagtgagttattcaacttttcccacactgatgtcgggacttcgcccaagttccgtcaaaatttgataccatatgaactaaaggattggaaggttgcccttgctgaacttttcagatacgttaacggaactgattgttggtcaacaatttatctggaaaatcacgaccaacctcgttcaattaccagatttggtgacgattctcccaaaaaccgtgttatttctggtaagttgttgtctgtgttgttggtgtcactgagcggtactctatatgtgtaccaaggacaggaactgggtgaaatcaatttcaagaactggcctatcgaaaaatacgaggatgtcgaagttagaaataactatgatgcgatcaaggaagagcatggagaaaactcgaaggagatgaagaggtttttggaagcaattgcccttatttccagagaccatgctagaacacctatgcaatggtctcgtgaggagccaaatgctggtttttctggtcctaatgctaaaccatggttttacttgaacgagtctttcagggaaggaattaacgctgaagacgaatccaaggaccccaactcggttttgaacttctggaaggaggccttgagatttagaaaggcacacaaggatattactgtgtatggatatgattttgagtttattgatttggacaataagaaactgttcagcttcacaaagaaatacgacaacaaaacattgtttgctgctttgaacttcagctctgattcgatcgacttcacgattccaaacaatagctcatcgtttaagttggaattcggaaactacccaagaagtgaagttgatgcgtcttccagaacattgaagccatgggagggcagaatttacatatctgaatga

SEQ ID NO: 33043 - protein, 589 aa, Saccharomyces cerevisiae
MTISSAHPETEPKWWKEATIYQIYPASFKDSNNDGWGDMKGIASKLEYIKELGTDAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWRSYFGGSAWTFDEKTQEFYLRLFCSTQPDLNWENEDCRKAIYESAVGYWLDHGVDGFRIDVGSLYSKVAGLPDAPVIDENSKWQLSDPFTMNGPRIHEFHQEMNKFIRNRVKDGREIMTVGEMRHATDETKRLYTSASRHELSELFNFSHTDVGTSPKFRQNLIPYELKDWKVALAELFRYVNGTDCWSTIYLENHDQPRSITRFGDDSPKNRVISGKLLSVLLVSLSGTLYVYQGQELGEINFKNWPIEKYEDVEVRNNYDAIKEEHGENSKEMKRFLEAIALISRDHARTPMQWSREEPNAGFSGPNAKPWFYLNESFREGINAEDESKDPNSVLNFWKEALRFRKAHKDITVYGYDFEFIDLDNKKLFSFTKKYDNKTLFAALNFSSDSIDFTIPNNSSSFKLEFGNYPRSEVDASSRTLKPWEGRIYISE

SEQ ID NO: 33044 - DNA, 1770 bp, Saccharomyces cerevisiae
  CDS (1)..(1770)
atgactatttcttctgcacatccagagacagaaccaaagtggtggaaagaggccacgttctatcaaatttacccagcaagtttcaaagactctaatgacgatggctggggtgacatgaaagggattgcctccaagctggagtacatcaaagagcttggtgccgatgccatttggatctcaccattctacgactcgccacaagatgatatgggttacgatattgccaactacgaaaaggtctggccaacatatggtacgaatgaagactgctttgccttgatcgaaaagacacataagcttggtatgaaatttatcaccgacttggtcatcaatcactgttccagcgaacatgaatggttcaaagagagcagatcctcgaagactaatccaaagcgtgactggttcttctggagacctcctaaaggttatgacgccgaaggcaagccaattcctccaaacaattggaaatcctattttggtggttccgcatggaccttcgatgaaaagacacaagaattctacttgcgtttgttttgctccactcaacctgatttgaattgggagaatgaagactgtagaaaggcaatctacgaaagtgccgttggatactggttagaccatggtgtagacggctttagaattgatgtcggaagtttgtactccaaagttgtaggtttaccagatgctcctgttgttgacaaaaactcgacttggcaatccagtgatccatacacattgaatggaccacgtattcacgagttccatcaagaaatgaatcaattcatcagaaacagagtgaaggatggcagggagattatgacagttggtgaaatgcaacatgcctccgacgaaactaagagactttatacgagtgcttcaagacacgaacttagtgagttatttaacttttcccacactgatgtggggacttcacctttgttccgttacaacttggtcccatttgaactgaaggattggaagattgcccttgctgagctgttcaggtacattaatggtacagattgttggtcaacaatctatctggaaaatcacgaccaacctcgttcaattacgagatttggtgacgattctcccaagaaccgtgttatttctggtaagttactctctgtgttgctaagtgccttgaccggtactctatatgtgtatcagggacaagagcttggccaaatcaatttcaagaactggcctgttgaaaagtacgaggatgtcgaaatcagaaacaactacaatgccattaaagaagagcatggggaaaactcagaggagatgaaaaagtttttagaagccattgcccttatctccagggaccatgctagaacacctatgcaatggtctcgtgaggagccaaatgctggtttttctggtcctagtgctaaaccatggttttacttgaacgactctttcagagaaggcattaacgtcgaagatgaaatcaaggatcccaactcggttttgaacttctggaaggaggccttgaagtttagaaaggcgcataaagacattactgtgtacggatacgatttcgagtttattgatttagacaataagaagttgtttagcttcacaaagaagtacaacaataaaacattgtttgcggctttgaactttagctctgatgcgacagatttcaagattccaaatgatgattcatcgttcaagttagagtttggaaactatccaaagaaggaggtagatgcctcttccagaacattgaagccatgggaaggaagaatatatatcagcgaatga

SEQ ID NO: 33045 - protein, 589 aa, Saccharomyces cerevisiae
MTISSAHPETEPKWWKEATFYQIYPASFKDSNDDGWGDMKGIASKLEYIKELGADAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWKSYFGGSAWTFDEKTQEFYLRLFCSTQPDLNWENEDCRKAIYESAVGYWLDHGVDGFRIDVGSLYSKVVGLPDAPVVDKNSTWQSSDPYTLNGPRIHEFHQEMNQFIRNRVKDGREIMTVGEMQHASDETKRLYTSASRHELSELFNFSHTDVGTSPLFRYNLVPFELKDWKIALAELFRYINGTDCWSTIYLENHDQPRSITRFGDDSPKNRVISGKLLSVLLSALTGTLYVYQGQELGQINFKNWPVEKYEDVEIRNNYNAIKEEHGENSEEMKKFLEAIALISRDHARTPMQWSREEPNAGFSGPSAKPWFYLNDSFREGINVEDEIKDPNSVLNFWKEALKFRKAHKDITVYGYDFEFIDLDNKKLFSFTKKYNNKTLFAALNFSSDATDFKIPNDDSSFKLEFGNYPKKEVDASSRTLKPWEGRIYISE

SEQ ID NO: 33046 - DNA, 1689 bp, Bacillus thermoglucosidasius
  CDS (1)..(1689)
ttggaaagagtatggtggaaagaagcggtggtataccaaatttatccgcgcagtttttacgattccaatggagacggcattggcgatatccgcggcattatcgctaaattggactatttaaaagaacttggcgtcgatgttgtttggctgtcgccggtatataagtcgccaaatgacgataacggatatgatataagcgattatcgcgatattatggatgagtttggcacgatggcagattggaaaacaatgcttgaagaaatgcacaagcggggaataaaactagtgatggatttagtcgtcaaccatacatcggatgaacatccgtggtttatcgaatcgagaaaatcaaaagacaacccatatcgtgattattatatttggcggcctgggaaaaatggaaaagaaccgaataactgggagtctgtttttagcggttctgcatgggaatacgatgaaatgacaggagaatattatttgcatcttttttcaaaaaagcaacctgatttaaactgggaaaatccgaaagtgcgccgcgaagtgtatgagatgatgaagttttggctcgacaaaggcgtcgatggtttccgcatggatgtcattaatatgatttccaaagtgccggaattgccggatggtgagccgcaaagcgggaaaaaatacgcgtcgggaagccggtattatatgaacggcccgcgtgtccatgaatttttgcaagagatgaaccgggaagtgttgtcgaaatatgacattatgacggttggagaaacgccgggtgtcacaccaaaagagggaattttatatactgatccgtcgcgccgtgagttaaacatggtgtttcaattcgaacatatggatttggattcagggcctggcggaaaatgggatattcgtccatggtcgttggcagatttgaaaaaaacgatgacaaaatggcaaaaagaactggaaggaaagggctggaacagtctttacttaaataaccatgaccagccgcgcgctgtttctcgttttggcgatgacggcaaatatcgggtcgaatcggcgaaaatgctggcaacatttctccatatgatgcaaggaacaccgtatatttaccaaggggaagagatcggaatgaccaatgtgcgcttcccgtcgattgaagattaccgcgatattgaaacgttaaacatgtataaagaacgtgtcgaagaatatggagaagatccgcaagaagtgatggaaaaaatttattataaaggacgcgacaacgcgcgcacgccgatgcagtgggatgacagcgaaaacgcaggatttaccgcagggacgccgtggattccagtcaatccaaattataaagaaatcaatgtgaaagcggcgttagaggatccaaattcggtgtttcattattataaaaaattaattcaactccgcaagcagcatgacattatcgtttatggaacatatgacttaattttggaagacgacccgtatatttaccgatatacacgcacgctgggaaatgaacaactgatcgttattaccaatttttcagaaaaaactcctgttttccggcttccggaccatatcatttataaaacaaaagaactgcttattagcaattacgatgtggatgaagcggaggaattgaaagaaattcgcttgcgtccatgggaagcgcgcgtatataaaatccgtttgccataa

SEQ ID NO: 33047 - protein, 562 aa, Bacillus thermoglucosidasius
MERVWWKEAVVYQIYPRSFYDSNGDGIGDIRGIIAKLDYLKELGVDVVWLSPVYKSPNDDNGYDISDYRDIMDEFGTMADWKTMLEEMHKRGIKLVMDLVVNHTSDEHPWFIESRKSKDNPYRDYYIWRPGKNGKEPNNWESVFSGSAWEYDEMTGEYYLHLFSKKQPDLNWENPKVRREVYEMMKFWLDKGVDGFRMDVINMISKVPELPDGEPQSGKKYASGSRYYMNGPRVHEFLQEMNREVLSKYDIMTVGETPGVTPKEGILYTDPSRRELNMVFQFEHMDLDSGPGGKWDIRPWSLADLKKTMTKWQKELEGKGWNSLYLNNHDQPRAVSRFGDDGKYRVESAKMLATFLHMMQGTPYIYQGEEIGMTNVRFPSIEDYRDIETLNMYKERVEEYGEDPQEVMEKIYYKGRDNARTPMQWDDSENAGFTAGTPWIPVNPNYKEINVKAALEDPNSVFHYYKKLIQLRKQHDIIVYGTYDLILEDDPYIYRYTRTLGNEQLIVITNFSEKTPVFRLPDHIIYKTKELLISNYDVDEAEELKEIRLRPWEARVYKIRLP

SEQ ID NO: 33048 - DNA, 1686 bp, Bacillus subtilis
  CDS (1)..(1686)
atgaaaacagaacaaacgccatggtggaaaaaagctgtggtttatcaaatttatccgaaaagctttaacgatacgacaggaaatggtgttggcgatctgaacggcattattgaaaagctggattacttaaaaacgctacaggtggatgtgctttggctgacgccgatttatgattctccccagcatgataatgggtacgatattcgtgattattactcgatttatcctgaatacggaacgatggaggattttgagcggctagtgtccgaagcacataaaagagacctgaaagtcgtcatggatcttgttgtcaatcatacgtcaacagagcacaaatggtttcgcgaggcgatctcttcaatagacagcccgtaccgtgatttttatatatggaaaaaaccgcaggaaaacggttctgttccgacgaactgggaatcgaaattcggcggctcggcatgggagcttgacgaagcatcgggccaatactatttgcatctgtttgatgtgacgcaggctgatttgaattgggaaaatgaagaggtcagaaagcatgtctatgacatgatgcatttttggtttgaaaagggaatagacggctttaggcttgatgtcatcaacctgatttctaaagatcagcgctttccgaatgcggaggaaggcgacggccgctctttttacactgacgggccgcgggtgcacgaatttctgcatgaaatgaacgaaaaggtgttttcacattacgacagcatgacggtcggtgagatgtcttcaacaaccgtagaccactgcatccggtatacgaatcctgacaataaagaacttgatatgacattcagcttccatcatctcaaggttgactatcctaacggcgaaaaatgggccttggcgccgtttgattttttgaagctgaaggagatcctatctgactggcaaacggggatgcacgcaggagggggatggaacgctctgttctggtgcaatcatgatcagccgcgcgtcgtatcaagatatggagatgatggcgcatatagggtgaaatcggcgaaaatgcttgctacggccattcatatgatgcagggcacgccttatatttatcagggcgaggagctggggatgacgaatccgaagttcactgacataagctcctatcgggatgtcgaatcgctgaacatgtatcacgcctttaaggaaaaaggaatggctgatcaagatattacagccattttacaggcgaaatcccgtgacaattccagaacccccgttcagtgggatgctacggaaaatggtggttttacaacgggcacaccatggataccggttgcaggaaattaccgggaaatcaatgctgaagcggcgctgagggatcagaattcggtgttttaccattatcaaaaattgattcagattcgcaaaatgtatgacattgtgacagagggtacgtatgagataattgcaaaggatgacccgaacatttttgcgtatctcagacacggcagcaatgaaaagctgctcgtgatcaataatttttacgggacagaggcggcctttacactgccggactctttagcgcctgacgaatggaaggcagaggtgctgttgacgaacgatgaagcaagggaagggcttcagaacatgacgcttcgcccatatgagtccattgtttatcgtttaacgaaaccgtgttaa

SEQ ID NO: 33049 - protein, 561 aa, Bacillus subtilis
MKTEQTPWWKKAVVYQIYPKSFNDTTGNGVGDLNGIIEKLDYLKTLQVDVLWLTPIYDSPQHDNGYDIRDYYSIYPEYGTMEDFERLVSEAHKRDLKVVMDLVVNHTSTEHKWFREAISSIDSPYRDFYIWKKPQENGSVPTNWESKFGGSAWELDEASGQYYLHLFDVTQADLNWENEEVRKHVYDMMHFWFEKGIDGFRLDVINLISKDQRFPNAEEGDGRSFYTDGPRVHEFLHEMNEKVFSHYDSMTVGEMSSTTVDHCIRYTNPDNKELDMTFSFHHLKVDYPNGEKWALAPFDFLKLKEILSDWQTGMHAGGGWNALFWCNHDQPRVVSRYGDDGAYRVKSAKMLATAIHMMQGTPYIYQGEELGMTNPKFTDISSYRDVESLNMYHAFKEKGMADQDITAILQAKSRDNSRTPVQWDATENGGFTTGTPWIPVAGNYREINAEAALRDQNSVFYHYQKLIQIRKMYDIVTEGTYEIIAKDDPNIFAYLRHGSNEKLLVINNFYGTEAAFTLPDSLAPDEWKAEVLLTNDEAREGLQNMTLRPYESIVYRLTKPC

SEQ ID NO: 33050 - DNA, 1722 bp, Pimelobacter sp
  CDS (1)..(1722)
gtgagcatcgcggagtcgaccgtcctgggcgaggaacccgagtggttccgcacggcggtcttctacgaggtcctggtgcggtccttccgggaccccaacgccggcggcacgggtgacttccgcggcctggcggagaagctcgactacctgcagtggctcggcgtcgactgcctgtgggtgccgccgttcttcagctcgccgctgcgcgacggcgggtacgacgtcgccgactacaccgggatcctcccggagatcggcacggtcgaggacttccacgccttcctcgacggcgcgcacgagcgcgggatccgggtgatcatcgacttcgtcatgaaccacacgagtgacgcgcacccgtggttccaggcctcccgcagcgatcccgacggcccgtacggcgacttctacgtctggtccgacaccgacgagctctaccaggacgcgcgggtgatcttcgtcgacaccgagccgtcgaactggacgtgggaccagacccgcggccagtactactggcaccgcttcttccaccaccagcccgacctgaacttcgacaacccgaaggtccaggacgccatgctggaggcgatggcgttctggctcgacatgggcctcgacggcttccggctcgacgcggtgccctacctctacgagcgtcccggcaccaacggcgagaacctccccgagacgcacgagatgctcaagcgggtgcggcgcttcgtcgacgacaactaccccgaccgggtgctgctgtacgaggcgaaccagtggccgaccgacgtggtggagtacttcgggcccgaggagcgtgaggacggcacggtcgtcgggcccgagagtcacatggccttccacttcccggtgatgccgcgcatcttcatggcggtgcgccgcgagtcgcgcttcccgatctcggagatcatggagcagacgccggcgatcccggagggctgccagtggggcatcttcctgcgcaaccacgacgagctgaccctcgagatggtcaccgacgaggaccgcgactacatgtggggcgagtacgccaaggacccccgcatgaaggccaacatcggcatccggcggcggctcgcgccgctgctcgacaacgacacgaaccagatcgagctgttcaccgcgctgctgctgtcgctgcccggctcccccgtcctgtactacggcgacgagatcggcatgggcgacaacatctggctcggtgaccgcgacggcgtgcgtacgccgatgcagcggacccccgaccgcaacgtcggcttctcggcggccacgcccggcaagctgcacctgccgacgatccaggacccggtctacggctaccagagcgtcaacgtcgaggcgcagctggagaacccctcctcgctgctgcactggacccgccggatgatccacatccgccgccagcgcgacgccttcgggctgggcaccttcgaggacctcggcggctcgaacccggcggtgctgtcctacgtgcgcgagctgccgggcgacgggggcgacgacgtgatcctctgcgtcaacaacctgtcccgcttcccgcagccggtcgagctcgacctccggaagtacgagggccgggtaccggtggagctgatcggcggcgtgccgttccccgccgtcggggagctcccgtatctcctgacgctcagcgggcacggcttctactggttccggctcacggatccggacacgaccgggaggcccgtcctgtga

SEQ ID NO: 33051 - protein, 573 aa, Pimelobacter sp
MSIAESTVLGEEPEWFRTAVFYEVLVRSFRDPNAGGTGDFRGLAEKLDYLQWLGVDCLWVPPFFSSPLRDGGYDVADYTGILPEIGTVEDFHAFLDGAHERGIRVIIDFVMNHTSDAHPWFQASRSDPDGPYGDFYVWSDTDELYQDARVIFVDTEPSNWTWDQTRGQYYWHRFFHHQPDLNFDNPKVQDAMLEAMAFWLDMGLDGFRLDAVPYLYERPGTNGENLPETHEMLKRVRRFVDDNYPDRVLLYEANQWPTDVVEYFGPEEREDGTVVGPESHMAFHFPVMPRIFMAVRRESRFPISEIMEQTPAIPEGCQWGIFLRNHDELTLEMVTDEDRDYMWGEYAKDPRMKANIGIRRRLAPLLDNDTNQIELFTALLLSLPGSPVLYYGDEIGMGDNIWLGDRDGVRTPMQRTPDRNVGFSAATPGKLHLPTIQDPVYGYQSVNVEAQLENPSSLLHWTRRMIHIRRQRDAFGLGTFEDLGGSNPAVLSYVRELPGDGGDDVILCVNNLSRFPQPVELDLRKYEGRVPVELIGGVPFPAVGELPYLLTLSGHGFYWFRLTDPDTTGRPVL

SEQ ID NO: 33052 - DNA, 23 bp, Primer
atgactcatcttccccactggtg

SEQ ID NO: 33053 - DNA, 24 bp, Primer
ttacttctgtaaccaccagacagc

SEQ ID NO: 33054 - protein, 111 aa, consensus
  MISC_FEATURE (1)..(111): consensus for the disclosure of xaa see table XV
YXXXXXXXXXXXXXXXGXXXGXXXXXXXXXXXXXXXXXXXXXXXXWXXPXXXXXXXXXXYDXXXXXXXXXXXGXXXXXXXXXXXXXXXXXXXXXDXXXXHXXXXXXXFXXX

SEQ ID NO: 33055 - protein, 43 aa, consensus
  MISC_FEATURE (1)..(43): consensus for the disclosure of xaa see table XV
XXXXXXXXXXXXXXXXXXXXXXXXXXXXXXXWXXXGXXGXRXD

SEQ ID NO: 33056 - protein, 73 aa, consensus
  MISC_FEATURE (1)..(73): consensus for the disclosure of xaa see table XV
XXXXXXXGXEXXXXXXXXXXXXXXXXXXXXXXXXXXXXXXXXXXXXXXXXXXXXXXXXXXXXXXXXXRXPXXW

SEQ ID NO: 33057 - DNA, 912 bp, Escherichia coli
  CDS (1)..(912)
atggatgactgtggtgcgattttgcataatattgaaaccaaatggctttatgattttctgaccctggaaaaatgccgcaatttttcccaggcggcagtcagtcgcaacgtctcgcaaccggcattcagccgccgcatccgtgcgctggaacaggcgattggtgttgaattgtttaaccgccaggtaacgccgctgcaactctcagaacaagggaaaatcttccattcgcagatccgccatctgttgcaacagttagagagcaatctggcagagctgcgtggcggcagcgattacgcgcaacgaaaaatcaagatagccgctgcacactctctttccctcgggctgttaccgtccattatcagccagatgccgccgctctttacctgggcaattgaagctattgatgtcgatgaagcggtcgataaactgcgtgaagggcaaagtgactgtattttttcctttcacgacgaagatttgctggaagcgccgtttgaccacattcgcttatttgaatctcaattgttccctgtctgcgccagtgacgaacacggagaagcactttttaacctcgcgcagccacactttccgttactgaattacagccgcaactcctacatggggcgattgattaatcgcaccctgacgcgccacagtgagttaagtttcagcaccttttttgtctcttcgatgagcgagcttttaaagcaggttgccctcgacggctgtgggattgcctggctgccggagtacgccatccaacaagaaattcgcagcgggaagctcgttgtactgaatcgggacgaactggtgatcccgattcaggcctatgcataccggatgaatacccgcatgaatcccgttgccgaacgcttctggcgtgaactgcgcgagctggagattgtgcttagctga

SEQ ID NO: 33058 - protein, 303 aa, Escherichia coli
MDDCGAILHNIETKWLYDFLTLEKCRNFSQAAVSRNVSQPAFSRRIRALEQAIGVELFNRQVTPLQLSEQGKIFHSQIRHLLQQLESNLAELRGGSDYAQRKIKIAAAHSLSLGLLPSIISQMPPLFTWAIEAIDVDEAVDKLREGQSDCIFSFHDEDLLEAPFDHIRLFESQLFPVCASDEHGEALFNLAQPHFPLLNYSRNSYMGRLINRTLTRHSELSFSTFFVSSMSELLKQVALDGCGIAWLPEYAIQQEIRSGKLVVLNRDELVIPIQAYAYRMNTRMNPVAERFWRELRELEIVLS

SEQ ID NO: 33059 - DNA, 885 bp, Silicibacter pomeroyi DSS-3
  CDS (1)..(885)
atggatatcaactggctgcgcgatttcacttgcctggcccggacgctgaatttcacccgcgcctcggaagagcgcaacatcacccaatccgccttcagccgccgcatcaagtcgctggaaaactggctgggcatcccgctgatcaagcggtcgacctacccggtgcagctgaccgaggcagggcagcagttcctgccggtggcgcaggaaaccatcgccagcctgaccgatatccgccaggtgctgcgcgcgcaggaacagggggtgaccgcgttccagcgctttgcggtgctgcacacaatctcggtcaattacctgacccggcgcatcgccgagttcgaggacctgatccccaacctgcgggtgcgggtctactccgacaacctgcgcacctgctgtcagctgctgtcggacggcacctgcgatttcctgctctattaccggcatcaggatgtgcagccggtgttcgaggagaaacagttcgcgcgcaaggatatcggggtcgaactgatgtatccggtggcagagaccggcgccgcgcgggccggcggctgggacctggacggcgacgggcgccagcccatcccctatctcagctacgatccgagcagcttcctgggcaccgtggtcgaccagaccatcggcacccgcaccccgccgctggcgatccgctacatggatgcactgaccgaggcgatcaagcggcgggtgctctcgggcagcggcatggcctggctgcccgaaagcgtgattgccgaggaactggccgccgggcgcgtcaccatcatcggcggcccggactggcaggcgccactgaccctgtcgctgttctgctcgcgcgaccggctggacgagaccggccagaaggtatggaacgcgctctga

SEQ ID NO: 33060 - protein, 294 aa, Silicibacter pomeroyi DSS-3
MDINWLRDFTCLARTLNFTRASEERNITQSAFSRRIKSLENWLGIPLIKRSTYPVQLTEAGQQFLPVAQETIASLTDIRQVLRAQEQGVTAFQRFAVLHTISVNYLTRRIAEFEDLIPNLRVRVYSDNLRTCCQLLSDGTCDFLLYYRHQDVQPVFEEKQFARKDIGVELMYPVAETGAARAGGWDLDGDGRQPIPYLSYDPSSFLGTVVDQTIGTRTPPLAIRYMDALTEAIKRRVLSGSGMAWLPESVIAEELAAGRVTIIGGPDWQAPLTLSLFCSRDRLDETGQKVWNAL

SEQ ID NO: 33061 - DNA, 894 bp, Silicibacter pomeroyi DSS-3
  CDS (1)..(894)
atggaactcgattggctggaagattttgttgccctctcctcagcgggcgtttttgcaaaggcggctgacgcgagaaacatcagccaatcggcgttcacacggcggatcaagaacctggaatactgggtcggcacaccgctgttcgaccgcagcgtgcacccggtcaccctgacccaggcgggcgaatcctttcgccctgtggcgctcgacatgatcaacacgctcaacaccgcccgggccgaggcccgggggttggcgcggcgcgaggatgcggtgctggatttcgccgcgcttcatacgctggcaatttcctatttcccgcgctggctgaaccggataagcggcgcgatcggcccgatccggacccgcgtggtggccgagaacttctcgggctgcgtcgaggcgatcctgtcggggtcgagcgatttcatgctgtgttatcatcaccataccgtgccgatgatcgccgatgacgcgcgctatccctcaatcaggatcgccgaggatcggatgatcgcggtcagttgcccgggtctggacggccagccccggttcaccctggacgggaccgacacgatcccgctgctctgttacacccgcgacagtttcctgggaaagatgaccaaccagatcatcgaccgggccggactgcgcgcacgctgtgactttctctacgagaactcggtcggcgaggcgctcaaatccgcctgtgtcgaggggctgggcatcgcctggctgccaatggccgctgtcgaacgcgagctgagcgagggccgcctgatccgggtcagcaccgaagcggccgagaacccgatctcgattcgcctgtaccggtcgatggaacgcagccggcgcgaggttgaacggttctggtcctacgcttcgagcctttga

SEQ ID NO: 33062 - protein, 297 aa, Silicibacter pomeroyi DSS-3
MELDWLEDFVALSSAGVFAKAADARNISQSAFTRRIKNLEYWVGTPLFDRSVHPVTLTQAGESFRPVALDMINTLNTARAEARGLARREDAVLDFAALHTLAISYFPRWLNRISGAIGPIRTRVVAENFSGCVEAILSGSSDFMLCYHHHTVPMIADDARYPSIRIAEDRMIAVSCPGLDGQPRFTLDGTDTIPLLCYTRDSFLGKMTNQIIDRAGLRARCDFLYENSVGEALKSACVEGLGIAWLPMAAVERELSEGRLIRVSTEAAENPISIRLYRSMERSRREVERFWSYASSL

SEQ ID NO: 33063 - DNA, 897 bp, Francisella tularensis subsp. tularensis
  CDS (1)..(897)
atgggacatcttgaaagattaaagatatttataaaagcagcacatttaaaaagctttagtaaggctgcaaaagctataggcatatctccaccagtagtatcaaaacaaatacaaatcttagaaacaaaatatagaaaatcactatttaatcgtaatactaggactgtacacttgacagaatatggaaaactactttatgaaaaagctagtttaatactaaacgaattagaagccacagaagaaaaaatttttgccgaagatatcctaatagatagcgaattaaagatttctgcaccaaattcatttggtattaaatatctttgcaatatattttctaaatttgctattgattatccaaaatataaactaaatatcaacttatcagatagttatataaacattattgatgaagatttcgatttagttataagaattggtgctctagatgactcaaatttaattactaaaaaacttatgtcgatgcctagtttattatgcgcaagtgaacaatatttaaaaaattatggcatacctaaaacaataaaagatttagagaatcatctatttatccaatataacaatcacagctcatcaaatcgcataatcctagaatccgtcaataaaactgagataataaatgtaagacaaagaatcgtaactaatagtgctggaatgatgctccagagttgtttagatggcttaggcatagcaaagttaccattatttgaaattatcgataaacttcacgataaaaagctagttcatctattacctaataccagaaatcctatagaaaaaaatctctatttaataagttcaagagataaatacagattaaagaaagttaggttactaagcgcttatatagagaaaaatttgccaaagattgaattataa

SEQ ID NO: 33064 - protein, 298 aa, Francisella tularensis subsp. tularensis
MGHLERLKIFIKAAHLKSFSKAAKAIGISPPVVSKQIQILETKYRKSLFNRNTRTVHLTEYGKLLYEKASLILNELEATEEKIFAEDILIDSELKISAPNSFGIKYLCNIFSKFAIDYPKYKLNINLSDSYINIIDEDFDLVIRIGALDDSNLITKKLMSMPSLLCASEQYLKNYGIPKTIKDLENHLFIQYNNHSSSNRIILESVNKTEIINVRQRIVTNSAGMMLQSCLDGLGIAKLPLFEIIDKLHDKKLVHLLPNTRNPIEKNLYLISSRDKYRLKKVRLLSAYIEKNLPKIEL

SEQ ID NO: 33065 - DNA, 888 bp, Mesorhizobium loti MAFF303099
  CDS (1)..(888)
atgcacggaaccgagcttgccgagttgtcgaccttcctggctgtcgcccgccacaggagcttcaagcaggccgcggtcgagcggggcgtggcggcttcggcgatcagccacacgatccgtagcctggaggaacgcgtcggcgtgcggctgttccatcgcaccacacgcagcgtatcgctgaccgaagcgggcgcacgatttctctcagagctgcatcccgcctttggccagatcgaaaaagcgctcgacagtctcaattccttccggggtacgccgttcggcacggttcggatcaacgtccccaactcgatcgcaccctttgtcctgcatgacgtgatgggaccattgctcaaacagaatccgggcctccacctcgacattgtggcaacggacaggctggtcgacatcgtcgagggcggcttcgacgctggtatccgctttggcgagcggctgatgcaggacatgatcgccgttcacatcaagccgaccctgcgcttctcggtcgtcggctcccccgattaccttgccgggcgcaagacaccagtcatgcccgccgacctgcgcgaacacgcttgcattcggtatcgctatccgagcggcgctatctacaactggcagtttgagaagaatggcgaggctgttgatgttgaagtcaatggccccgtcactctcgatgaccaggaactgatggtcgaggccgcgctacaaggctgtggccttgcctatgtctgggacaaccgggtgatgcgtcacttggcaagcggcgcgctaatccgctgcctggatgattggtgtgccccggacgatggcttgtttctctattaccccagccggcggtatctctcagccggcctgcgcgccctgatcgatatgctcaagaccggctag

SEQ ID NO: 33066 - protein, 295 aa, Mesorhizobium loti MAFF303099
MHGTELAELSTFLAVARHRSFKQAAVERGVAASAISHTIRSLEERVGVRLFHRTTRSVSLTEAGARFLSELHPAFGQIEKALDSLNSFRGTPFGTVRINVPNSIAPFVLHDVMGPLLKQNPGLHLDIVATDRLVDIVEGGFDAGIRFGERLMQDMIAVHIKPTLRFSVVGSPDYLAGRKTPVMPADLREHACIRYRYPSGAIYNWQFEKNGEAVDVEVNGPVTLDDQELMVEAALQGCGLAYVWDNRVMRHLASGALIRCLDDWCAPDDGLFLYYPSRRYLSAGLRALIDMLKTG

SEQ ID NO: 33067 - DNA, 948 bp, Vibrio cholerae O1 biovar eltor str. N16961
  CDS (1)..(948)
ttgtttgctgaacgcgcgagccaaatggctttatttgcggtgttaatccaacatcaaagttttactgctgctgcgcacgcgctaggcgtgtcggtgtctcatgtcagtaaacagctcgccgcgttagaggcctcgctgggcgttaaactggtgcagcgcaccacgcgcagctttactctgacggatgctgggaatctgttttatgcccagtgccgtgaacttttaacgattgtgaccaatgcacaaagtgaaatggaagatcagcgtgatgaagtggtagggctgattagacttggtttatcgcaatcttttggcaccttgcatgtgttgcctgctttggagcagcttcgccaacaatatcctgagttgaacgtcgaagtgcatctgtttgatcataaagtcgatatgctcaaggaagggttggatttatggatcaccagtaacgagcagctaccagagggttatgtggcgcagcgcattgccgattgccgttttgtggtggccgcatcgccagactacctgctgcgttatggatcacccacagaacctatggccttaatggagcataactgcttgatttatcgaagctgggagcgcgattacacccgttggtcattcagccgagatggacacaatcaaaccattaaagtggccggaaactactcggtcgatctggcggaggcggtacgcgatgctgccgtggcaggatggggaatcgcttatttggcgacctatttgctgcgagatgaatttcgcacagggcagcttattcagctgctgccggagtggtccgccaatcaacagatgccgttttatgcggtgtatcccagtcgtcaacatatgccgaaaaaaacatcggcggtgattgaatttatcaaacagcggctcggtacgccttgttactgggatactcgtttacaaccttatgttcgttttgcagcagaatag

SEQ ID NO: 33068 - protein, 315 aa, Vibrio cholerae O1 biovar eltor str. N16961
MFAERASQMALFAVLIQHQSFTAAAHALGVSVSHVSKQLAALEASLGVKLVQRTTRSFTLTDAGNLFYAQCRELLTIVTNAQSEMEDQRDEVVGLIRLGLSQSFGTLHVLPALEQLRQQYPELNVEVHLFDHKVDMLKEGLDLWITSNEQLPEGYVAQRIADCRFVVAASPDYLLRYGSPTEPMALMEHNCLIYRSWERDYTRWSFSRDGHNQTIKVAGNYSVDLAEAVRDAAVAGWGIAYLATYLLRDEFRTGQLIQLLPEWSANQQMPFYAVYPSRQHMPKKTSAVIEFIKQRLGTPCYWDTRLQPYVRFAAE

SEQ ID NO: 33069 - DNA, 954 bp, Pseudomonas aeruginosa PAO1
  CDS (1)..(954)
atgatcgacctggtgatgctcaaggacttcctcgtcctctgtcggatcaagagcttcagccgtgcggcgcaggagtgccatgtctccgtgtccgggttgagccggcgtatccagaccctggaacagtggctcggtgcaccggtgttcgagcgccacaagcacgccctcgaactgaccgaggccggccgccagttgcaaggcgtggcgcaggacgcggtgcgcgccctggacaacctgcgccagtcgatccgcgagcgcgacgaagacgcccagcggcgcatccgtttctgcgccccgcacatcctctcctcggtgtttttcccgcactggattccgcgtctgcaggcggacttccgcagcgccaagttcagcgtcgactgcgattacctgccgcaatgcctgtcgcgcctgcgcgacggctcggtggactacgtggtggcgttgctcgacgaaggcgaggcggtgtcgcgccgcctgggcatcgacagcgaagccgagttccagcgcctggagcttggtcacgaacaactggtggcggtctgcgcgccggacgccgccggccagccgctgttcaacctcgaccgcctgcagaccgaagcgctgtcgttcctcggctactccgaggaatgccacctgggctgggccctggaaccgctgctgcgcgacagcggcctgttcctccagcgccatcacagctccagccagaccgaggggctgcgcttcttcgcccagtcgcgtctgggcgtcgcctggctgccgcataccctggtccgcgaggacctcgccagccgtcgcctggtgcgcgccggcggccagcgcttcgacgtgccgttgcgctacaccctgatccgtcgccgcctgccgctacccggcgaggccgaacgcctgtggaccttcctcggcgagctggcgcgcccggcgccgcgctatgcggtggtcggcgcggcctcctga

SEQ ID NO: 33070 - protein, 317 aa, Pseudomonas aeruginosa PAO1
MIDLVMLKDFLVLCRIKSFSRAAQECHVSVSGLSRRIQTLEQWLGAPVFERHKHALELTEAGRQLQGVAQDAVRALDNLRQSIRERDEDAQRRIRFCAPHILSSVFFPHWIPRLQADFRSAKFSVDCDYLPQCLSRLRDGSVDYVVALLDEGEAVSRRLGIDSEAEFQRLELGHEQLVAVCAPDAAGQPLFNLDRLQTEALSFLGYSEECHLGWALEPLLRDSGLFLQRHHSSSQTEGLRFFAQSRLGVAWLPHTLVREDLASRRLVRAGGQRFDVPLRYTLIRRRLPLPGEAERLWTFLGELARPAPRYAVVGAAS

SEQ ID NO: 33071 - DNA, 888 bp, Pseudomonas aeruginosa PAO1
  CDS (1)..(888)
atgaaagccaactccgatgaactgcaaagcttcgtcagtgtagtcgacagcggttccatcagcgccgccgcggaacagatgggactgaccgcctcggccgtcagccggaccctctcgcgcctcgagcacaagctcggcaccaccctgctcaaccgcaccacccggcgcatggagctgaccgaggaaggccgctacttcctcgaccaggcacggcagatcctgcagcagatggaggcgctcgaggaacgcctggccctgcgccggcagagccccgccgggcgcctgcggatcaacgccgcctcgcccttcatgctgcacgcggtggtgccgcacatcggcgagttccgccggctgtacccggacatccagctcgaactcaacaccaacgacctgatcatcgacctgttggagcaacgcaccgacgtggcgatccgcatcggtgcgctcagcgactccaccctgcacgcgcggccgctgggcgccagccgcctgcacatcctcgccagcccggagtacctggcccgccacggcacgccggcgagcatcgaggggctgcgagggcacaccctgctcggcttcacccagcccgagcatctcaaccgctggccggtggtgcacgccgacggcgatcgcctggagatccagccggatatctctgcctccagcggcgagacgctccgccaactggccctgagccaccagggcatcgcctgcctggccagcttcatgaccgaccgcgatatccaggatgggcgcctggtgccgctgttcgccgaacagatgagcgaataccggcaaccgatccacgccgtctactatcgcaactcgcaactggcgctgcgcatccagtgcttcctcgacttcatccagcagcgcctgggcgcctga

SEQ ID NO: 33072 - protein, 295 aa, Pseudomonas aeruginosa PAO1
MKANSDELQSFVSVVDSGSISAAAEQMGLTASAVSRTLSRLEHKLGTTLLNRTTRRMELTEEGRYFLDQARQILQQMEALEERLALRRQSPAGRLRINAASPFMLHAVVPHIGEFRRLYPDIQLELNTNDLIIDLLEQRTDVAIRIGALSDSTLHARPLGASRLHILASPEYLARHGTPASIEGLRGHTLLGFTQPEHLNRWPVVHADGDRLEIQPDISASSGETLRQLALSHQGIACLASFMTDRDIQDGRLVPLFAEQMSEYRQPIHAVYYRNSQLALRIQCFLDFIQQRLGA

SEQ ID NO: 33073 - DNA, 909 bp, Pseudomonas aeruginosa PAO1
  CDS (1)..(909)
gtgaacctcgaactgaagtggctggaggatttcatcgccctggccggcacccgcagcttttcccaggcggcggagaaacgcttcgtcacccagccggccttcagccggcgcattcgcagcctggaggacgccctcggcctgaccctggtgaatcgccagcgcacgccggtggaactgaccgaggccgggcagctgttcctggtcaccgcgcgcagcgtggtcgagcagctcggccaggtggtgcgccacctgcaccacctggaaggcgggcagggcgaggtgctgcagttcgccgccgcccactcgctggcgctgggcttcttcccgcagtggatcgcgcggctgcgcaacgaggggctgaacatcgccagccggctgatcgccaccaacgtcggcgaggcggtgcattccctgcgcgagggtagctgcgacctgatgctggcgttctacgaccctgacgccgcgttgcagatggacccggagatcttcccctcgctgcacctggggcgcaccgagatgctgccggtttgcgcggtgaacgccgagggccagccgctgttcgacctggagaacggccagagcgtgccgctgctcgcctacagcgccagcgccttcctcggccgcggggtcaacctgctgctgcgccagcgcaacctgcgctacaccacagtctacgagacggcgatggccgacagcctgaagagcatggcgctgcaaggcatgggcgtggcctgggtgccacggctgagcgtggtcaacgaactggagcgcggcgagctggcgatctgtggcgggccgcaatggttcgtgccgcaggaaatccgcctgtaccgctgcgcgctggtacgcaaggcggcgatccgcctgctctggcgcaagctggaaggcgggctgggcagcgtcgagtag

SEQ ID NO: 33074 - protein, 302 aa, Pseudomonas aeruginosa PAO1
MNLELKWLEDFIALAGTRSFSQAAEKRFVTQPAFSRRIRSLEDALGLTLVNRQRTPVELTEAGQLFLVTARSVVEQLGQVVRHLHHLEGGQGEVLQFAAAHSLALGFFPQWIARLRNEGLNIASRLIATNVGEAVHSLREGSCDLMLAFYDPDAALQMDPEIFPSLHLGRTEMLPVCAVNAEGQPLFDLENGQSVPLLAYSASAFLGRGVNLLLRQRNLRYTTVYETAMADSLKSMALQGMGVAWVPRLSVVNELERGELAICGGPQWFVPQEIRLYRCALVRKAAIRLLWRKLEGGLGSVE

SEQ ID NO: 33075 - DNA, 900 bp, Neisseria meningitidis MC58
  CDS (1)..(900)
atgaaaaccaattcagaagaactgaccgtatttgttcaagtggtggaaagcggcagcttcagccgtgcggcggagcagttggcgatggcaaattctgccgtaagccgcatcgtcaaacggctggaggaaaagttgggtgtgaacctgctcaaccgcaccacgcggcaactcagtctgacggaagaaggcgcgcaatatttccgccgcgcgcagagaatcctgcaagaaatggcagcggcggaaaccgaaatgctggcagtgcacgaaataccgcaaggcgtgttgagcgtggattccgcgatgccgatggtgctgcatctgctggcgccgctggcagcaaaattcaacgaacgctatccgcatatccgactttcgctcgtttcttccgaaggctatatcaatctgattgaacgcaaagtcgatattgccttacgggccggagaattggacgattccgggctgcgtgcacgccatctgtttgacagccgcttccgcgtaatcgccagtcctgaatacctggcaaaacacggcacgccgcaatctacagaagagcttgccggccaccaatgtttaggcttcaccgaacccggttctctaaatacatgggcggttttagatgcgcagggaaatccctataagatttcaccgcactttaccgccagcagcggtgaaatcttacgctcgttgtgcctttcaggttgcggtattgtttgcttatcagattttttggttgacaacgacatcgctgaaggaaagttaattcccctgctcgccgaacaaacctccgataaaacacacccctttaatgctgtttattacagcgataaagccgtcaatctccgcttacgcgtatttttggattttttagtggaggaactgggaaacaatctctgtggataa

SEQ ID NO: 33076 - protein, 299 aa, Neisseria meningitidis MC58
MKTNSEELTVFVQVVESGSFSRAAEQLAMANSAVSRIVKRLEEKLGVNLLNRTTRQLSLTEEGAQYFRRAQRILQEMAAAETEMLAVHEIPQGVLSVDSAMPMVLHLLAPLAAKFNERYPHIRLSLVSSEGYINLIERKVDIALRAGELDDSGLRARHLFDSRFRVIASPEYLAKHGTPQSTEELAGHQCLGFTEPGSLNTWAVLDAQGNPYKISPHFTASSGEILRSLCLSGCGIVCLSDFLVDNDIAEGKLIPLLAEQTSDKTHPFNAVYYSDKAVNLRLRVFLDFLVEELGNNLCG

SEQ ID NO: 33077 - DNA, 900 bp, Clostridium acetobutylicum ATCC 824
  CDS (1)..(900)
atggattttaagcagttaaatacatttatagctgtaagtaagtatcaaagctttacggaagcagcccattcgcttaattacgcacaatctactgttactactcaaataaaaatattagaagaagaacttcaaataaagctttttgaaagaataggaaaaaaagttaccttaacatatgaaggaaaaaagttattgccatatgctaaacaaatgattaaactgtcaaatgaaataaaaaaagtagttttagatgatgaaaagccaagtggaacacttacaataggtgctgctgaatctttatgcgttataaggcttccagagatacttaaagaatatagaagattatatccagatgtagaggtgtctttaaagttcggaagttgcgctgattttagacattttttgaaggataatataatagatgtagcattttctctaggaactaagattgattcaaatgaatttatatctgaggttgaatttgatgaacctatgattcttttggcatatccagatcatccgcttgtaaaaaaagaaaaaatatatccagaagatatagtggaagaacctcttgtgttaacagaaatgggatgcagttatagagctgcatttgaaaatattttaagaagttataatataaaacctaaacttgttcttgaaacaggaagtgttcaggctataaaacaatttaccatgagtagattgggaataacacttcttcctaaggttgctgtagaagaagaaataaagaatggaaagttaattccacttaactggtgtggaccagatttcggtattatatcacaggtattgtatcataaggacaagtggatttcgccggcattaaatgcctttcttaaattatctaaaaaaattatgtcagataaagataaatattaa

SEQ ID NO: 33078 - protein, 299 aa, Clostridium acetobutylicum ATCC 824
MDFKQLNTFIAVSKYQSFTEAAHSLNYAQSTVTTQIKILEEELQIKLFERIGKKVTLTYEGKKLLPYAKQMIKLSNEIKKVVLDDEKPSGTLTIGAAESLCVIRLPEILKEYRRLYPDVEVSLKFGSCADFRHFLKDNIIDVAFSLGTKIDSNEFISEVEFDEPMILLAYPDHPLVKKEKIYPEDIVEEPLVLTEMGCSYRAAFENILRSYNIKPKLVLETGSVQAIKQFTMSRLGITLLPKVAVEEEIKNGKLIPLNWCGPDFGIISQVLYHKDKWISPALNAFLKLSKKIMSDKDKY

SEQ ID NO: 33079 - DNA, 903 bp, Agrobacterium tumefaciens str. C58
  CDS (1)..(903)
atggcaatgccattggactgggataaactgcgcatttttcatgccgcagccgaagcggggtcttttacccacgctgccgacaagctgcatttgtcccagtcggccatcagccgccaggtcagcgcactggaacaggatgtcggcgtcaagctgttccaccgccatgcccgcggcctgatcctcaccgaacagggcgagctgctgtatcgcaccgcccatgacgtgctgctgaagctcgaaacggtgaagatgcaactgaccgaaacgacggagaagccgagcggcaagctgcgcgtgacgacgacggttggtctcggccagggctggctgacggacaaggtgcaggaattcctgcaactctatccggaaatgtcgatccagctcatcctcgacaacgaggaactggacgtgaacatgcgccatgccgattgcgccatccgcctgcgccagccgcagcagtcggaccttatccagcgcaagctgttcacggtgcacatgcacgtctatgccgcaccgtcatatatcaatcgccatggcgagccgcaatcggtcgaagatctcgacaatcaccgcatcatctcctttggcgaacccgcgcctaactatctgctcgacgttaactggctggagaatgccggacgatcgtccgacaacacgcgcattccgcatctgcagatcaacagccagacctcgatcaagcgcgcgtgcctgctggggattggtattgcctgtttgcccgactatatcgtcggtcgcgatcccggcctcatccagctgtcgctcgccgcagatattccgtccttcgatacctatttctgctatcccgacgagatgaaaaacgctgcaaagctgaaggctttccgcgacttcatcgtcgccaaggcgcggaactggaacttctga

SEQ ID NO: 33080 - protein, 300 aa, Agrobacterium tumefaciens str. C58
MAMPLDWDKLRIFHAAAEAGSFTHAADKLHLSQSAISRQVSALEQDVGVKLFHRHARGLILTEQGELLYRTAHDVLLKLETVKMQLTETTEKPSGKLRVTTTVGLGQGWLTDKVQEFLQLYPEMSIQLILDNEELDVNMRHADCAIRLRQPQQSDLIQRKLFTVHMHVYAAPSYINRHGEPQSVEDLDNHRIISFGEPAPNYLLDVNWLENAGRSSDNTRIPHLQINSQTSIKRACLLGIGIACLPDYIVGRDPGLIQLSLAADIPSFDTYFCYPDEMKNAAKLKAFRDFIVAKARNWNF

SEQ ID NO: 33081 - DNA, 921 bp, Agrobacterium tumefaciens str. C58
  CDS (1)..(921)
atgtttttgttgggagtgtgcgccttggaagtcaaatggctcgaggatttcctggcgctggccggaacgctcaatttttcaaaggccgcggatgagcggcatgtgacgcaatccgccttcagtcggcgcatcaagcagctggaagcctgggtgggtgcgacgctggtcgaccgtgcctcctatccgtcgcggctgacggaggccggggcgaagttcgtgccggtggcgcaggagacgctgaagcagctttaccatgcgcggcgcacgctgctgcaggaagaaggagccgatgccagaaccgttcggttgacggccctgcataccctgtccttcaccttctttcccgactggctgaagcgcgtgaacgaaaaggcgggaccgctgttttccgttctgcggccggattccggcagcatggaggaaaacctcaattcactcgtggacgggcagagcgattttcttctgacctatgcccatcacgaagtgccgatgctactcgatgcgcagctgttcgaattccgcgtgctcggcgcggaaaacatcattcccgtttccgcgccaacacaggatggcgcaccgctgcatgcgctggtggaaaatgcgaaaaaaccctttgcctatctggattatgaaaaagcctcgttcttcgggccgctgctgcgcgatctcttgagcgcgcggctgccgcaatacgagcgggtgcatgagggcagcatgtcggtggggctgaaagccatggcgatggccggctggggggtcgcctgggtgccggaaagcctgatgcgacaggaactggacagcggcgccctagtgcgcgccgccgatccgagtttcgatattaccgtcgatatcaggctttatcgctcgaaggagaaccgccggcccgtggtcgagcgcatttgggcggttctcgaagactag

SEQ ID NO: 33082 - protein, 306 aa, Agrobacterium tumefaciens str. C58
MFLLGVCALEVKWLEDFLALAGTLNFSKAADERHVTQSAFSRRIKQLEAWVGATLVDRASYPSRLTEAGAKFVPVAQETLKQLYHARRTLLQEEGADARTVRLTALHTLSFTFFPDWLKRVNEKAGPLFSVLRPDSGSMEENLNSLVDGQSDFLLTYAHHEVPMLLDAQLFEFRVLGAENIIPVSAPTQDGAPLHALVENAKKPFAYLDYEKASFFGPLLRDLLSARLPQYERVHEGSMSVGLKAMAMAGWGVAWVPESLMRQELDSGALVRAADPSFDITVDIRLYRSKENRRPVVERIWAVLED

SEQ ID NO: 33083 - DNA, 897 bp, Agrobacterium tumefaciens str. C58
  CDS (1)..(897)
atgagcatcaattgcgaaattcttgatttacgggcttttcaagcagtggttgaattggagagctttcaccgagcggctgatgcgctgcatatttcgcaaccggcgctcacccggcgtatccagaaactggagcaggccatcggtgcgccgcttcttgaaagaaccacacgccatgtcgctccaacggcgatgggccaggaggtgatgccgcttgtccggcgcatgctggaggaatttgacggatcgctttttgcaatgaaggacggtgcgcagcggcgtggccttattaccatggcatgtgttccgactgcggcattctactttttacccaccgtcatcaaaacctttagtaagcaatatccgcatattaggctgcgtatcagagacctgaccgcaaacgagggcttgcaggcggttgcccgcggcgaagtggaattcgggattaacctgatgggaaattccgatcccgatctggcattcgagccgttgatcgatgacccatttgtgctggcgatgaggaaagaccatcctctggcggctttcgaaacaatccagtgggatcaattggagccacaccctctggtggttgtcgatcgttccagcggcaacaggacgcttctcgacggtgcgcttgcgcggcacaatctaaagctgaactggttttacgaggtgactcacctcaacacgtcgctcggactcgtcgaagccgggctggggatttccgtgctgccgcgattggccaccccgcaggatgagcaccctttcctcgtcacgcgaccgatcgtcaatcccgtcgtgtcgcgaacgatcggtattgtgcaaaggcgcagcagcgcgctgtctccggctgcggaaaaattcgtgcaaatgctgttgaagacctggaaaacaccctga

SEQ ID NO: 33084 - protein, 298 aa, Agrobacterium tumefaciens str. C58
MSINCEILDLRAFQAVVELESFHRAADALHISQPALTRRIQKLEQAIGAPLLERTTRHVAPTAMGQEVMPLVRRMLEEFDGSLFAMKDGAQRRGLITMACVPTAAFYFLPTVIKTFSKQYPHIRLRIRDLTANEGLQAVARGEVEFGINLMGNSDPDLAFEPLIDDPFVLAMRKDHPLAAFETIQWDQLEPHPLVVVDRSSGNRTLLDGALARHNLKLNWFYEVTHLNTSLGLVEAGLGISVLPRLATPQDEHPFLVTRPIVNPVVSRTIGIVQRRSSALSPAAEKFVQMLLKTWKTP

SEQ ID NO: 33085 - DNA, 900 bp, Agrobacterium tumefaciens str. C58
  CDS (1)..(900)
atgaacgatcataaagctctcaaaatctttctgatggcggccgagaagcgcaatttcgcgcaggtcgcccgcgaactcagcatgacggccgccggcgtcacgcgcgctattgccgcgctcgaatgtgatctcggtgtgcaactattcgtccgcaccacccggcaggtatcgctgaccacagatggcgccgtcttcgccgcgcagatacagcctgcggtcgaggcgctggagaatgcccggcgcgatgtccgcaacgcccacaaggccgatgagggccggctcaggatcagcgcgccgacatggctcggcaagacggtgctgccaccgatcctgtcgggtttccgggaactgtatccgaaaatgtgtttcgagatttccctgtcggacggcctggtcaatattgtcgatgacgactacgatctggcgatccgcatttcgtcggccccgtcagacaaattcaccatctggcgcaagatcagggctgtgccgagaatcctggtggcggcaccgggcagccggttcacacagatgaaacatccaagcgacctcactcctgatgattgccttgcctatagcggtgaaagccggcgggagaactggatcctctcggacggcggatcgagcatcaccataacggccggtcgcgccttcagcgccaataatggcgaggttctggctgatatggcagccgatggcgcaggtgtggccatgctgccgggatttcatatcgccgaacatatccgcagcggccggcttgtccatgttctgccgggctgggccccaccggaactctggctgacgctctattatccgccctatcagacgctgccgccgcgcatcgccaccttctcgaaattcttcgaagaacagttgacggcccatatggtggcgctcgactag

SEQ ID NO: 33086 - protein, 299 aa, Agrobacterium tumefaciens str. C58
MNDHKALKIFLMAAEKRNFAQVARELSMTAAGVTRAIAALECDLGVQLFVRTTRQVSLTTDGAVFAAQIQPAVEALENARRDVRNAHKADEGRLRISAPTWLGKTVLPPILSGFRELYPKMCFEISLSDGLVNIVDDDYDLAIRISSAPSDKFTIWRKIRAVPRILVAAPGSRFTQMKHPSDLTPDDCLAYSGESRRENWILSDGGSSITITAGRAFSANNGEVLADMAADGAGVAMLPGFHIAEHIRSGRLVHVLPGWAPPELWLTLYYPPYQTLPPRIATFSKFFEEQLTAHMVALD

SEQ ID NO: 33087 - DNA, 909 bp, Sinorhizobium meliloti 1021
  CDS (1)..(909)
atgggggattctatgtcgctggactgggacaaactgcgcattttccatgcggcggccgaggctggctcgttcacgcacgcggcagacaaactccacctttcgcagtcggcgatcagccggcaggtcagttcgctcgagcaggacgtcggcatcaagctctttcatcggcacgcccgcggcttgatcctgaccgaacagggcgaaatgctctatcgcacggcgcacgacgtgctgatgaagctcgaaagcgtcaaggcccagcttagcgagacgacggacaagccaagcggcaagttgcggatcacgaccacggtcggcctcggccaggggtggctgaccgacaagatccaggaattcatgtccttgtatccggaaatccaggtacagctcatcctcgacaacgaggaactggacgtgaacatgcgccatgcggactgcgccatcaggctgcggcagccgcaacagtcggatctgatccagcgcaagctcttcacggtgcacatgcatgtctatgccgcgccgtcctacatcaacaaatatggcgagccgcagtcgcttgacgatctcgacaatcaccggatcatcaccttcggcgagcccgcccccaactatctgctcgacgtgaactggctggagattgccggacgcgattccgacaatccgcgcatatcgcatctgcagatcaacagccagacatcgatcaagcgcgcctgcctgctcggcatcggcatcgccatgcttccggactatatcgtcggtcgcgatcccggcctcattcaactgccgataagcgccgatatcccctctttcgatacctatttctgctatccggacgaactgaagaacgcagcgaagctgaaagtcttccgcgattacatcgtcgctaaagcgagaaactggaacttctga

SEQ ID NO: 33088 - protein, 302 aa, Sinorhizobium meliloti 1021
MGDSMSLDWDKLRIFHAAAEAGSFTHAADKLHLSQSAISRQVSSLEQDVGIKLFHRHARGLILTEQGEMLYRTAHDVLMKLESVKAQLSETTDKPSGKLRITTTVGLGQGWLTDKIQEFMSLYPEIQVQLILDNEELDVNMRHADCAIRLRQPQQSDLIQRKLFTVHMHVYAAPSYINKYGEPQSLDDLDNHRIITFGEPAPNYLLDVNWLEIAGRDSDNPRISHLQINSQTSIKRACLLGIGIAMLPDYIVGRDPGLIQLPISADIPSFDTYFCYPDELKNAAKLKVFRDYIVAKARNWNF

SEQ ID NO: 33089 - DNA, 942 bp, Sinorhizobium meliloti 1021
  CDS (1)..(942)
atggagatcaagtggctggaggatttcgtgacgcttgccgacacgtccagcttctcgcgcgcggccgagctgcgcaacgtgactcaacctgccttcagccgccggatcaagcagttggagagctggctgggcgcaacgctgatcagccgcgcgaccatgccggccgaactcacgcctgcggggcgcaatttcctgccggtcgcacaggaagcgatccgcaccttctatgcggcgcgcgaagtgctgcgtctcccgcacgagccgggcctcatccgctttgccgcgctgcatacgctgacggtcaccttctttccccgctggctgaagacgctggaagcggcgggtggatcgttcagcacctcgctcattccggaccgcggcggaatcgaagcgaacctcgacgcgctcgtcggcgatgaggcggatttcttcctcacctatgcgcatccggaagtgccgtttcatctcgatagcgggcagttttcctcgctgaccgtagcccatgaccgactgattccgctggtcgcggcggagatcgtattgtccggcgatccgcagcccggactgaacctcctcgaccgcgccatcgcgcagccgcggctcgccatcccctatctgagctacggcttcaattccttcttcggggtggccctgtcgcgcctgctgctgcgccgcccgcccttccggcgccgtacgacgcacgaaaacacaatcagcgccggcctgatgaacatggcggtgacgggtgcgggcgtgtgctggctgccggagagcctggcgcgcgaggaaatcgacgcgcgccgcctcgtgcctgcctctgccgacgagggttggaacctcgacctcgaaatccgcctttaccgccacgcagcgagccgcaaccgcaaggtcgaggaactatgggcgacggcgcagcgactcctggaacccgcaccggcctga

SEQ ID NO: 33090 - protein, 313 aa, Sinorhizobium meliloti 1021
MEIKWLEDFVTLADTSSFSRAAELRNVTQPAFSRRIKQLESWLGATLISRATMPAELTPAGRNFLPVAQEAIRTFYAAREVLRLPHEPGLIRFAALHTLTVTFFPRWLKTLEAAGGSFSTSLIPDRGGIEANLDALVGDEADFFLTYAHPEVPFHLDSGQFSSLTVAHDRLIPLVAAEIVLSGDPQPGLNLLDRAIAQPRLAIPYLSYGFNSFFGVALSRLLLRRPPFRRRTTHENTISAGLMNMAVTGAGVCWLPESLAREEIDARRLVPASADEGWNLDLEIRLYRHAASRNRKVEELWATAQRLLEPAPA

SEQ ID NO: 33091 - DNA, 984 bp, Salmonella typhimurium LT2
  CDS (1)..(984)
gtgtataatgctacttatataaatgaaactcatccaatgctaataaggttgcagcttatgcaatatcggcatcacctcgaactaacatggctcgaagactgtctggctctaaaagaaacgttgaatttctcaaaagcgtctgcctcaagatatgtgactcaacccgcatttagtcgtcggatacaatctctcgaagaatgggtgggtacgcccctttttgaaagaagtaaacggggagtcacccttaccaaggccggagaagtatttacagaccagcttcccgaactgatccactccttgtacacattgaaaagtgatacccttgaggccgcaggtaataaacaacccagtcttgttttttcagcaacgcatgctttgtctttctcttttgtaccgcatttgttaaaacagagtgataaaattgcaaaatttggttcatttcgtcttttatctgactcattgaatgcgtgcgaaaaaatgatgcggcagggagattcacaatttttgctgtgtcaccatcacccacatatgcatctaaatttaaataaaaataactttatgagcattcgtcttgggtttgatacattaattccattcagtaaaccagactcagaaacgttaaaaccgttgtggaatataaataataagattcaattcccttacctttctttttcatcacaatcaggtctgggaagaataatagcaaatacagcgtctattaacagaattacccataatataaatgttgcctttgtggccgatctggcagcaacactattggcaatggtcagatctggcgatggtgttgcctggatacctcaaagccttgccaggcaagatatagaggctaaaactattgttactgcagcggaaaaagaaagtaatttatgggtacccatagaaataagactttatagaccagccaagagaatgcctccagatgccgaagagctatgggaaatttttgttgaagaacaaatataa

SEQ ID NO: 33092 - protein, 327 aa, Salmonella typhimurium LT2
MYNATYINETHPMLIRLQLMQYRHHLELTWLEDCLALKETLNFSKASASRYVTQPAFSRRIQSLEEWVGTPLFERSKRGVTLTKAGEVFTDQLPELIHSLYTLKSDTLEAAGNKQPSLVFSATHALSFSFVPHLLKQSDKIAKFGSFRLLSDSLNACEKMMRQGDSQFLLCHHHPHMHLNLNKNNFMSIRLGFDTLIPFSKPDSETLKPLWNINNKIQFPYLSFSSQSGLGRIIANTASINRITHNINVAFVADLAATLLAMVRSGDGVAWIPQSLARQDIEAKTIVTAAEKESNLWVPIEIRLYRPAKRMPPDAEELWEIFVEEQI

SEQ ID NO: 33093 - DNA, 909 bp, Salmonella typhimurium LT2
  CDS (1)..(909)
atggatgtaactggagcaggtttgcacaatattgagacaaaatggctatatgattttctgacgctggaaaagtgccgcaatttctctcaggccgccattatccgcaacgtatcgcaacccgcttttagccggcggattcgcgccctggaacatgccgtgggcgttgaactgtttaaccgacaggtctcgccgctacagctttccgaacagggtaaaatctttcactcccaggttcgccacctgttacagcagctggaaagtaatctgaccgaactgcgcggcggcagcgattatacgctgcgtaaaatcaagattgccgccgcccactcgctctccctcggcctgttgccgaccatcgttaagcagatgcctacgcagtttacctacgccgttgaggcgatagatgtcgaccaggcggtggatatgttacgtgaggggcaaagcgattttatcttttcttatcacgatgaaaacctgcaacaagcgccgtttgataatatccgcctgtttgagtcgagactgtttccggtttgcgccaacaatggccggggcgagccgcgctatacgcttgagcagccgcactttcccctgcttaattacagtcagaactcctatatgggccgattgataaatcgtaccctgactcgccatgctgaactgagtttcagtacatttttcgtctcttcgatgagtgaattgttaaaacaggttgcgatggacggctgcggaatcgcctggttgcccgagtatgctatccgtcaggagattaccgacgggcgcctgatagtgcttgatgccgacgaactggttatcccgatccaggcttatgcttatcgcatgaatacccgcatgagtcaggtagccgaaacattttggcgcgacctgcgtgggcttcaggccgcgctgtaa

SEQ ID NO: 33094 - protein, 302 aa, Salmonella typhimurium LT2
MDVTGAGLHNIETKWLYDFLTLEKCRNFSQAAIIRNVSQPAFSRRIRALEHAVGVELFNRQVSPLQLSEQGKIFHSQVRHLLQQLESNLTELRGGSDYTLRKIKIAAAHSLSLGLLPTIVKQMPTQFTYAVEAIDVDQAVDMLREGQSDFIFSYHDENLQQAPFDNIRLFESRLFPVCANNGRGEPRYTLEQPHFPLLNYSQNSYMGRLINRTLTRHAELSFSTFFVSSMSELLKQVAMDGCGIAWLPEYAIRQEITDGRLIVLDADELVIPIQAYAYRMNTRMSQVAETFWRDLRGLQAAL

SEQ ID NO: 33095 - DNA, 945 bp, Ralstonia solanacearum GMI1000
  CDS (1)..(945)
atggaactcaaatggctggaagatttcatcagcctggcggaaacgcgcagcttttcgcgttcggccgagctgcggcacgtcacgcagccggccttctcgcggcgcatccagtcgctcgaagcctggctgggcaatgagctgatcgaccgctccagctatcccacgcgcctgacgcccgccggcgaagtcttctacgaacaggcgctggcgatgctcgcgcaggtcagcgagacgcgcgccctgatgcgcgggcagcgtccggccagcgcctcgaccatcgattttgcggtgccgcatacgttgtcgctgaccttctttccgggctggctggccaaggtcgaggagaagatcggcaagctgcagtgccggctgcgcgcgctcaacgtgcatgacgcggtgatgacgctggtggacggcggctgcgatctggtcatggtttaccaccacgcgcgccagatgatccagctcgacccgacgcgctacgacatgctggtgctcggcaccgagcggctgtcgccgttcagcaagcccgacgtgggcggccgcccgatctacaagctgacgcccgccgcgcgcaagccgatcgcctatcttagctatacgcccaatgccttcctcgggcgcatggtcgatgtgctgctggagaactcgccggtggcgccgctgctcgacaagtgctacgagaccgacatggccgaggcgctcaaggtgatggcgctggccgggcatggcgtcgcctttctgcccgagagcgcggtacgcgacgatgtggcggccggacggctggtccgcgccgaaggcaagggcggcggcaccctgtcgattgagatggagatccggctgtatcgcgagcacccgcagagcggcgcgcacgaccggcggcaccagcagtccaagcgcaagcgcgagctggtcgacatgctgtgggccgtgctgtcggcgtga

SEQ ID NO: 33096 - protein, 314 aa, Ralstonia solanacearum GMI1000
MELKWLEDFISLAETRSFSRSAELRHVTQPAFSRRIQSLEAWLGNELIDRSSYPTRLTPAGEVFYEQALAMLAQVSETRALMRGQRPASASTIDFAVPHTLSLTFFPGWLAKVEEKIGKLQCRLRALNVHDAVMTLVDGGCDLVMVYHHARQMIQLDPTRYDMLVLGTERLSPFSKPDVGGRPIYKLTPAARKPIAYLSYTPNAFLGRMVDVLLENSPVAPLLDKCYETDMAEALKVMALAGHGVAFLPESAVRDDVAAGRLVRAEGKGGGTLSIEMEIRLYREHPQSGAHDRRHQQSKRKRELVDMLWAVLSA

SEQ ID NO: 33097 - DNA, 897 bp, Clostridium perfringens str. 13
  CDS (1)..(897)
atgaatttaacttatcttagatctttctatacaacagttaagtgtaatagtatttccaaagctgcaaaacaattgcatttaactcagccaggagttagtatgcaaattcaaaagcttgaaaatgatataaactttaaacttttaaatagaagtaatacaggagtaagtttgacaagtgctggtgaaataatctttgaatttgctgaatcaatgttatccatagaagataacttacaaaaaaaattagatgaattaaaaaatattaattcaaaacttattatttcttgttgtaaaagtttaggtgagcatgtaatgccttgcagtatatatacatttaaagaaattcattataagactgatatctctatggaaatagataatacctcagatatattaaaaaaattaactaatcatgaaacaaatataggcattattcaaggtaaacctagtgattgtaaaaacttagaacttattccattgatgactgataatctagttttagttggtggtagaaatacttcatttaaatcagtaaatgttgaagaactttataaacttcctttaataacaagagaagatggatcagctaataaattattagtagaatcaagcttaaagaaaaataaaattaatatagataatcttaattttgttttatcacttaattctcctcaatcaataaaatcttctgtatcttttggacaaggatattcatttttacctgcaatttctttaaaccatgaattgagaagtggtgaattaaagaaaatcgatataaatgatttaacacttcctttccaatactatattgcacttagaaaaaactataaattagattattatgaacaaaaatttgtagattttctaacctcaaaaaaaagatgcttttgctattaa

SEQ ID NO: 33098 - protein, 298 aa, Clostridium perfringens str. 13
MNLTYLRSFYTTVKCNSISKAAKQLHLTQPGVSMQIQKLENDINFKLLNRSNTGVSLTSAGEIIFEFAESMLSIEDNLQKKLDELKNINSKLIISCCKSLGEHVMPCSIYTFKEIHYKTDISMEIDNTSDILKKLTNHETNIGIIQGKPSDCKNLELIPLMTDNLVLVGGRNTSFKSVNVEELYKLPLITREDGSANKLLVESSLKKNKINIDNLNFVLSLNSPQSIKSSVSFGQGYSFLPAISLNHELRSGELKKIDINDLTLPFQYYIALRKNYKLDYYEQKFVDFLTSKKRCFCY

SEQ ID NO: 33099 - DNA, 873 bp, Bacillus anthracis str. A2012
  CDS (1)..(873)
atggaaatgagacatgttaaaacattttgtgcgattgttaagtatggtagtttttctaaagctgctcatgcattaggttatgcgcaatctacagttacagcgcatatgaaagcattagagaacgatttacatattcctcttttcgatcggttaggaaaaaaagtacttcttacaaaagcaggtcatcaatttcatccttatgctttagaattacttgcaatttatgaaaaggcgcaagaaatccctcaaaataccgatcaattagaaggtacattgagtattacatcaaacgaatcattagcagtatatcgtttaccacaactattacgtacttacaaacagaaaaatccgaaagtaaatatcgtacttgaaacaaacacaaatgaacaagcattacaaaaattacatgaaggagaaacagacgttgtcttcataattggagaaagtatagaacataatgattttattacatgtacttttagtaatgaaacatttggatggattttaccaccccattattctacacagtctaatccgttttgtttattaaaggaaactcagtttatttttactgaacaaagctgcggttatagaccaatggtagatcgttttttacgtcaaagcgggaatattccagctaaaacatttgaaacttccaacgttgaagttattaaacaatctgttatgtgtgagttaggaatttcaattcttccttacatcgttgtacaagaaaattgtcaaaaggaacaaatacgatttcaccctatcgaaactccttctgttattcaaagtcatgtaatctatcataaatctagatggatctcccctgtagtacagtcgtttctttcacaattaaaggtaatgaaagtataa

SEQ ID NO: 33100 - protein, 290 aa, Bacillus anthracis str. A2012
MEMRHVKTFCAIVKYGSFSKAAHALGYAQSTVTAHMKALENDLHIPLFDRLGKKVLLTKAGHQFHPYALELLAIYEKAQEIPQNTDQLEGTLSITSNESLAVYRLPQLLRTYKQKNPKVNIVLETNTNEQALQKLHEGETDVVFIIGESIEHNDFITCTFSNETFGWILPPHYSTQSNPFCLLKETQFIFTEQSCGYRPMVDRFLRQSGNIPAKTFETSNVEVIKQSVMCELGISILPYIVVQENCQKEQIRFHPIETPSVIQSHVIYHKSRWISPVVQSFLSQLKVMKV

SEQ ID NO: 33101 - DNA, 909 bp, Thermosynechococcus elongatus BP-1
  CDS (1)..(909)
atgcgacttgatcagttgcaatcttttttggctgttgttgagacagggagtttccaagcagcagcgcgacggtgtggcgtgacacaacccacaattactcggcaaatccaagccctagaaaacagtttgggaattcaactgctccatcgctcgaatcgtgccaagttaactgtggccggggacttgttttttcgccgtgcccatcgcatttgtcaggagtggcaggccgctagtgctgaactcaaagccatgggaaatggccagcagcaagaactctgcattgctgcgattcactccatctgccgctactttttgcctacactgttgcccaggtttcgtcaggcttttccccagatgcagttgcggctgactgccctagggagcgatcgcgccctcaaagtgttgcaggatggcttagtcgatctagcaattgtcatgggcgatcgccatttcctaaaacagccggaatgggtgattgaaccgctgtacactgaaccggtgcaagtgctgatggccgctgaacatcccctcgctgttaatgagaggttgacatgggaagaactagctcgctttccccatgtggtgtttaaggatggctatggcatgcgccgcttggtagctgaagaatttagccgtcgaggcttatcttggcaacctgctcttgaactcaacaccccagatgcctttatcgccgtcattcgcgaaagtgaaatggtggccttactgccccactcagcactgaaacaggcctgccacgatcctaccctagcgatccgcgatctggtgacgccaccgcccccgcgtcaagtattggccattaccacccgcgatcgcctccacttaccacccgttacccaattgctcacgttgatccgccagcaggccgcccatgagtcctctctttcgtga

SEQ ID NO: 33102 - protein, 302 aa, Thermosynechococcus elongatus BP-1
MRLDQLQSFLAVVETGSFQAAARRCGVTQPTITRQIQALENSLGIQLLHRSNRAKLTVAGDLFFRRAHRICQEWQAASAELKAMGNGQQQELCIAAIHSICRYFLPTLLPRFRQAFPQMQLRLTALGSDRALKVLQDGLVDLAIVMGDRHFLKQPEWVIEPLYTEPVQVLMAAEHPLAVNERLTWEELARFPHVVFKDGYGMRRLVAEEFSRRGLSWQPALELNTPDAFIAVIRESEMVALLPHSALKQACHDPTLAIRDLVTPPPPRQVLAITTRDRLHLPPVTQLLTLIRQQAAHESSLS

SEQ ID NO: 33103 - DNA, 876 bp, Oceanobacillus iheyensis HTE831
  CDS (1)..(876)
atgcatatggaagaactggagacctttattgttctagcacgcgagaaaaatttcacacgaacagcaaccaaacgctcactgtctcaaccaaccgtcagtgttcatattaaaaatttagagaacgaatttgccacatcgcttatccaacgcacgacaaagcgtgttcaccttacacctgaaggggagttattttatgaacatgcattaaagatatggaatcaatatcaacaactccaggaacatctttatcaaaagaaacaaactgcttccggcctgattcgagtaggggctagttttaccatcggtgaatacctccttccagaagtgatagcgatattgcagaaacaatacgaacaattagacttttatgtaacgattggcaataccgagaaaattattgattctgtgcgcagacttgaggtggatatcgggctggtagaaggatcaaattacacaaaggacgtgttgcaaacatcgtttaaagaggatcggctcgttattgtttgctcgcccgaatatgagactaattttaaaaacttagcagatttacatcatcataaatgggtaataagagaagaaggttcagggacgcgacaatactttgaccacctcgtccaatcgaatgagattcaagtcaaatcaacattggttattagttcaacacaaggaataaagaacagcgttaccaacggattaggtttagctctcttatctgaagcaaccatcaaagaagaattagcacatgggacacttaaaatggttccgattgaatctctgtatgaaaaacgagatttttcctatgtcttaacaaagggctcccagttaaaccgaaatacacaactattaattgatacattaaccaagatcgatagatga

SEQ ID NO: 33104 - protein, 291 aa, Oceanobacillus iheyensis HTE831
MHMEELETFIVLAREKNFTRTATKRSLSQPTVSVHIKNLENEFATSLIQRTTKRVHLTPEGELFYEHALKIWNQYQQLQEHLYQKKQTASGLIRVGASFTIGEYLLPEVIAILQKQYEQLDFYVTIGNTEKIIDSVRRLEVDIGLVEGSNYTKDVLQTSFKEDRLVIVCSPEYETNFKNLADLHHHKWVIREEGSGTRQYFDHLVQSNEIQVKSTLVISSTQGIKNSVTNGLGLALLSEATIKEELAHGTLKMVPIESLYEKRDFSYVLTKGSQLNRNTQLLIDTLTKIDR

SEQ ID NO: 33105 - DNA, 912 bp, Shigella flexneri 2a str. 301
  CDS (1)..(912)
atggatgactgtggtgcggttttgcataatattgaaaccaaatggctttatgattttctgactctggaaaaatgccgcaatttttcccaggcggcagtcagtcgcaacgtctcgcaaccggcattcagccgccgcatccgtgcactggaacaggcgattggcgttgaattgtttaaccgccaggtgacgccactgcaactctcagaacaagggaaaatcttccattcgcagatccgccatctgttgcaacagttagaaagcaaccttgcagagctgcgtggcggcagcgattacgcgcaacgtaaaatcaagatagccgctgcacactctctttccctcggtctgttaccgtccattatcagccagatgccgccgctctttacctgggcaattgaagccattgatgtcgatgaagcggtcgataaactgcgtgaagggcaaagtgactgtattttttcctttcacgacgaagatttgctggaagcgccgtttgaccacattcgcttatttgaatctcaattgttccctgtctgcgccagtgacgaacacggagaagcactttttaacctcgcgcagccacactttccgttactgaattacagccgcaactcctacatggtgcgattgattaatcgcaccctgacgcgccacagtgagttaagtttcagcaccttttttgtctcttcgatgagcgagcttttaaagcaggttgccctcgacggctgtgggattgcctggctgccggagtatgccatccaacaagaaattcgcagcgggcagctcgttgtgctgaatcgggacgaacaggtgatcccgattcaggcctacgcataccggatgaatacccgcatgaatccagttgccgaacgcttctggcgtgaactgcgcgagctggagattgtgcttagctga

SEQ ID NO: 33106 - protein, 303 aa, Shigella flexneri 2a str. 301
MDDCGAVLHNIETKWLYDFLTLEKCRNFSQAAVSRNVSQPAFSRRIRALEQAIGVELFNRQVTPLQLSEQGKIFHSQIRHLLQQLESNLAELRGGSDYAQRKIKIAAAHSLSLGLLPSIISQMPPLFTWAIEAIDVDEAVDKLREGQSDCIFSFHDEDLLEAPFDHIRLFESQLFPVCASDEHGEALFNLAQPHFPLLNYSRNSYMVRLINRTLTRHSELSFSTFFVSSMSELLKQVALDGCGIAWLPEYAIQQEIRSGQLVVLNRDEQVIPIQAYAYRMNTRMNPVAERFWRELRELEIVLS

SEQ ID NO: 33107 - DNA, 882 bp, Shewanella oneidensis MR-1
  CDS (1)..(882)
atgaacatcccaatcaagaccttgcaatgttttttaaccctagtagaaacggaaaacttcacccgtgccgcccaaaaatgctttatcacccagccaacactcagcaagatcatccaaagacttgaagaaagtctgggagaaaccctgcttattcgcaataaccaaaaagtagagttaacccaagcagggcagctatttgagcacagtgcgcgggaaatccttggtcaatggcatagattgcaggaggacatgagtaacttaagcggcctaaaatcggggcggcttaggctgggcgtatgccctatgatgagcagcttaatcataggattactgacgagctatcgtaagcgttatccaggggttgaactgcaaatgtatgaatacggcggtttcggctgtgagcaggcgctgttgaataacagcttagatatcgcctttaccgcactgcccacaacccatgagacagaactgattaaccagccgctaaccaagtatcccctcttagcttgcttgcctgaagctcatccgcttgccgctaagtcatacctcagttggcaggattttgaaccttacccgtttattctctataacgaggacttctcgctcgccaagctgataaatcgtctgagccgtaaggctggcgtgcaattaaatatcgcctttcgcagtggtcaatgggattttcttgcaaccatggttgaagccgatatgggactagccatattacccgaacctatttgccaaaaactcagcaacagcaaacttgtctttagacctatgcaaccggccttgacttgggatttagccctgatttggcgacagaacttaccgttaactcccgcggcaaatgccttgctggaattgagcaaacagaaagcgtga

SEQ ID NO: 33108 - protein, 293 aa, Shewanella oneidensis MR-1
MNIPIKTLQCFLTLVETENFTRAAQKCFITQPTLSKIIQRLEESLGETLLIRNNQKVELTQAGQLFEHSAREILGQWHRLQEDMSNLSGLKSGRLRLGVCPMMSSLIIGLLTSYRKRYPGVELQMYEYGGFGCEQALLNNSLDIAFTALPTTHETELINQPLTKYPLLACLPEAHPLAAKSYLSWQDFEPYPFILYNEDFSLAKLINRLSRKAGVQLNIAFRSGQWDFLATMVEADMGLAILPEPICQKLSNSKLVFRPMQPALTWDLALIWRQNLPLTPAANALLELSKQKA

SEQ ID NO: 33109 - DNA, 876 bp, Shewanella oneidensis MR-1
  CDS (1)..(876)
atgtacctgtgggatggtatctctgagtttgtcgcggtggctgaagctgaaaactttaccctcgctgcccagcgcttaaatgtctccactgcccatgtaagtcggcaaatcggtgcactggaaaatcgtcttggtactaagttgttttaccgcacaactcgcaaggtgtcactcaccgaagaaggcacgatttactatcgccattgccgccaattgcagacgggattagaggaagctgagcgggcgattaccgatcttaaagactcgcctcaaggactggtgaaactcaccgcgcccgtggcctacggtgaaaaatttattatgccgctactgaatgactttatggtgcagtatcccagtgtggaatgtaatgtcgatttgacgaacagaaccttagatttgattgaagggggctacgatttggccattcgactaggtaaactcgccgattcaagcctgatggctaagcccttaagcagccgcacccattatgtagcggcctcgccaagttacgttgaaaaatatggcgaaccccatacactttcggagttaaatcaacataattgcttgatcgggaatcacaattattggcgctttattgaacatggccgtgagcgaaattttaaagtacgcggcaagctgatctgcaacagcggttatgccctgcgggatgcggcattaaagggtattgggatagtacaacttcctgattattatattgaagaggatattcacgccggcaggcttatctccttcctcgatacacaccgcgaagccaaagaaggtatttgggcgctctatccgcaaaatcgccacctaagcgcaaaagtgcgggtattagtggattatctggcggaaaaactgactggcggttaa

SEQ ID NO: 33110 - protein, 291 aa, Shewanella oneidensis MR-1
MYLWDGISEFVAVAEAENFTLAAQRLNVSTAHVSRQIGALENRLGTKLFYRTTRKVSLTEEGTIYYRHCRQLQTGLEEAERAITDLKDSPQGLVKLTAPVAYGEKFIMPLLNDFMVQYPSVECNVDLTNRTLDLIEGGYDLAIRLGKLADSSLMAKPLSSRTHYVAASPSYVEKYGEPHTLSELNQHNCLIGNHNYWRFIEHGRERNFKVRGKLICNSGYALRDAALKGIGIVQLPDYYIEEDIHAGRLISFLDTHREAKEGIWALYPQNRHLSAKVRVLVDYLAEKLTGG

SEQ ID NO: 33111 - DNA, 894 bp, Shewanella oneidensis MR-1
  CDS (1)..(894)
atgtttactagcttgccaccgctcaatgcattacgggcattcgagtcagccgcccgcttacagagtataacgctggcgagtaaagaactgcacgtcacccatggcgccatcagtaaacaaatcagggtattagaagattttttaggtttcgccctctttgttaggctccataaaaaagtcgaactcactgacgaagccaagcgttactttccccatgtacaagcggctctgcaaaccctgtcgagcgcaaccgccgatttgcgtagccaaggttcccggccacaaaccttagccatcaatgtattaccaagtttaaccattaactggttaatccctcgtatggagcaatttaagtcgcgttatccacatctatatgtggatctctcgataggtgactttgccgttgacttcagccaagggcgctacgacatcgcgatccgcagtagtaccaagcttcctaagggagtcaattacatcaaactcatggatgaagatctgtgcttagtttgcgcgccgtcattagccccaaaactgcaatgtattgaggatattaatcatgtcaccttactcaaacacaccactcgaccagaactttgggattattgggctgaaaaggtagggttagtgctcacacaagagcaaacattcggcgttgagcatttttatatgttaagtcaggcggctgcaagtggcatgggcgcggcgctgatcccacgcttttttattgaagaacaattagctaacggcagtttagtcatcccctttcattcaacgtttaccagcccatatgtttattacctactcacgcctaaatccccaagcttgccgttaaaagtgcaagcatttatcgagtggatgctcgacctcttcgctccttatcgcaatgcatgctaa

SEQ ID NO: 33112 - protein, 297 aa, Shewanella oneidensis MR-1
MFTSLPPLNALRAFESAARLQSITLASKELHVTHGAISKQIRVLEDFLGFALFVRLHKKVELTDEAKRYFPHVQAALQTLSSATADLRSQGSRPQTLAINVLPSLTINWLIPRMEQFKSRYPHLYVDLSIGDFAVDFSQGRYDIAIRSSTKLPKGVNYIKLMDEDLCLVCAPSLAPKLQCIEDINHVTLLKHTTRPELWDYWAEKVGLVLTQEQTFGVEHFYMLSQAAASGMGAALIPRFFIEEQLANGSLVIPFHSTFTSPYVYYLLTPKSPSLPLKVQAFIEWMLDLFAPYRNAC

SEQ ID NO: 33113 - DNA, 939 bp, Shewanella oneidensis MR-1
  CDS (1)..(939)
atgttagaactattagaacctattgcgatttttactcatgtggccagagccggaagttttagtgccgccgcaagaaggcttgggatctctaaatctaaggtcagtacgcaggtagccgatctcgagcatcgacttggcgttcaattgatccagcgtacaactcgtagcttaagcctgaccgaagctggacatttgttatatctgcaaggtgaggagttgctccgcgatgccgagcaagcgattgccagtgtgcataacttaaacgatgcaacccgtggcgtcctaaaagtggggatttcccaatcctttggtgctatgcatattatcccagccttaccctcctttatggcaaaacaccctgagcttgagctacaagtcagtttgcttgatcataaggttgatgtggtcagtgaaggtttagatttgttgctaactatgtctgagcagttaccgctaggtatggttgcacgtcctttgatgaagtgtcagtttttactcgttgcttcacccgattatattgctaagcatggcgaaccgtcgcgccctgaacaattggttgaccataactgtttggtctatcaaggtgagtggcatgaacacagcatgtggcaatttaagaaaggcgatgattactgtgagattggtgtctcgggtaactttagagtggataacgcaccagcgttaaaatctgccgcaatcagtggcttaggggttgtttacctcgctagctatttgatggaagatgagatcgccaagggaactttagtaccactgcttaaagattggcaattgacccatcatctaccgctacaggcggtgtatccacgtcgtaagcatttagcgcctaaggtcagcgcctttatcgagtttattaaagaccatatcggcaacccgccttattgggatatcccttatgctgagcttttcagtgaacgttag

SEQ ID NO: 33114 - protein, 312 aa, Shewanella oneidensis MR-1
MLELLEPIAIFTHVARAGSFSAAARRLGISKSKVSTQVADLEHRLGVQLIQRTTRSLSLTEAGHLLYLQGEELLRDAEQAIASVHNLNDATRGVLKVGISQSFGAMHIIPALPSFMAKHPELELQVSLLDHKVDVVSEGLDLLLTMSEQLPLGMVARPLMKCQFLLVASPDYIAKHGEPSRPEQLVDHNCLVYQGEWHEHSMWQFKKGDDYCEIGVSGNFRVDNAPALKSAAISGLGVVYLASYLMEDEIAKGTLVPLLKDWQLTHHLPLQAVYPRRKHLAPKVSAFIEFIKDHIGNPPYWDIPYAELFSER

SEQ ID NO: 33115 - DNA, 978 bp, Shewanella oneidensis MR-1
  CDS (1)..(978)
atgaatagaaatatggtcaagggcatgatcgtgtttgccaccattgcggaaaaaggctcgatgagtgctgcggcgcagcaattaaatctcagctcatcggcggtgagccagcaagttgcgaagcttgaaatggacatgggaattagtctatttcaccgtaatactcgccatctgacgctcacggaggcggggcatttattttatgaaaattgcataaaaatcataaaaatagttgagagtggtgaacacaagctcaatgcgttaaagggtacaccctcgggggagcttaaaatcgccgcacctgtaggttttggcagtggtttactcagccaaccgctcgccaatttattagccgctcacccacagatcagcctcaatctgcagttgcaggacggtccgatcgatatagtaaatgaaggaatcgatctggcgatttgcatcggccccctctcagattcaaacctcatcgcccgccccttggccgattggcgcatgctgctgtgtgccgccccgagctatattccgcagcatcagatcctgcaacaccctggcgagttacaagcgttcaatcgcatcagccacagctatgctaagcccgagttcttaacccattcacagactcaagagcgagtcgagctctcggcgcagcgtatcagcgtgaacaatatgcaaactttgattcaacttacgcttgatggattggggtttgccgtgttgccagaacccgaagtgcatcaatatcttgcatcgggacagctggtgacactcttacccgagtggtcactacgcacttacagtgtttacagcgtaacatcggcgcgggacaaacaacccgccaaagtgaaagaagccattgcagcccttagccaatattttagccaaatcgattttagcccgagctcaactcagccacttgctccacccagcacctccgagctagcaccaaaattcatctatggattagccatacccgtttaa

SEQ ID NO: 33116 - protein, 325 aa, Shewanella oneidensis MR-1
MNRNMVKGMIVFATIAEKGSMSAAAQQLNLSSSAVSQQVAKLEMDMGISLFHRNTRHLTLTEAGHLFYENCIKIIKIVESGEHKLNALKGTPSGELKIAAPVGFGSGLLSQPLANLLAAHPQISLNLQLQDGPIDIVNEGIDLAICIGPLSDSNLIARPLADWRMLLCAAPSYIPQHQILQHPGELQAFNRISHSYAKPEFLTHSQTQERVELSAQRISVNNMQTLIQLTLDGLGFAVLPEPEVHQYLASGQLVTLLPEWSLRTYSVYSVTSARDKQPAKVKEAIAALSQYFSQIDFSPSSTQPLAPPSTSELAPKFIYGLAIPV

SEQ ID NO: 33117 - DNA, 894 bp, Pseudomonas putida KT2440
  CDS (1)..(894)
atggaatatgagctgcaagacatcagatctttcgtgaaaatcgccgaactgggcagtttccatgaggccgccgaagcgctccacttgtcccagccggccctgagccgacggatcaagaagctggaggaaggcctgggcacctcgctactggaacgcaccactcgccgggtcagcctgaccagcgtgggccgcgacttcctgcccaaggccaggcgcctgctggatgattttgaagactcgatcctcagcatccgcgagctggccgagcgccagaccggtcaggttaccctcgcctgcattcctaccgcggcgttctacttcctgccgtcggtgatccgcgattacaacgagcaatacccgaaaatccgcattcgcctgctggaccttagcgccaacgacgggctcgaagccgtgctgcgcggcgaggccgacttcggcatcaacatgatgagtggccagcacccggacatcgagtttgtctcgctggtgcaggagcactttgtactggcctgccggcgtgaccacccactggcgaatcgcgcctccgttacctggacagagctggctgattaccgcctgatcggcgtcggccgcctgagtggcaaccgcatgctgctggaccatgcgttgtccgggctcaacctgcggcccaagtggttctacgaagtgcaacacctgtccacgtcgctgggcatggtcgaggccgggctgggcgtgtcggccatgcccagcctggccatgcccaatgccgaccaccccacgctggtgagcgtgccgttgatcgagccgcaagtcacccgcacgctagggctggtgtaccggcgcggcgcatcgctgtcgccggctgcggagaaattcgtttcgatcctgctgcagaaatggccaaatcgctga

SEQ ID NO: 33118 - protein, 297 aa, Pseudomonas putida KT2440
MEYELQDIRSFVKIAELGSFHEAAEALHLSQPALSRRIKKLEEGLGTSLLERTTRRVSLTSVGRDFLPKARRLLDDFEDSILSIRELAERQTGQVTLACIPTAAFYFLPSVIRDYNEQYPKIRIRLLDLSANDGLEAVLRGEADFGINMMSGQHPDIEFVSLVQEHFVLACRRDHPLANRASVTWTELADYRLIGVGRLSGNRMLLDHALSGLNLRPKWFYEVQHLSTSLGMVEAGLGVSAMPSLAMPNADHPTLVSVPLIEPQVTRTLGLVYRRGASLSPAAEKFVSILLQKWPNR

SEQ ID NO: 33119 - DNA, 897 bp, Pseudomonas putida KT2440
  CDS (1)..(897)
gtgaaaacccgatccgaagaactccaggtattcgtcgccgtcatcgactgcggctcgatttccgctgctgccgagcagatgggccagaccccgtctgccgtcagccgcaccttgtcgcgtctggagggcaagctgggcaccacgctggtcaaccgcaccacccggcgcatggaccttaccgaagaggggcgctactttcttgagcgcgcgcggctgatcctgcagcagatggacgagatggaagagcgtctgtcgatgaaccgccagaccccgaccgggcgattgcgcatcaatgccgctgcgccgttcatgctgcatgccatcctgccctggattggcgagttccgccgccagtacccaggcatcgaactggagctcaacaccgacgacctgatcatcgacctgctggagcagagcactgatgtggcgatccgcatcggagagctggccgactccagcctgcacgcgcgcagcctgggttgcagtccggtgcaggtgctggccagtccggcctacctggagcagcacggcacgccacggcaggtcgaggacctggccaaccactgtctgctcggcttcagccaacctgagtcgctcaatcactggccgctacgccacgctcagggcgatcgctggagcatccgcccgacgctggtcgcttccagcggcgaaacccttcgccagctggcgttggccggggagggcatcgtcagcctgtcgcacttcatgacccacgaagatatccgcacagggcgcctgcaggtgctgctgagcgaggccaacaatggctaccgtcagccgatccacgcggtgtattaccgcaacacccagttggcgctgcgcatccagtgcttcctggatttcatccagcgcaagctggcgatgtacgcctgctga

SEQ ID NO: 33120 - protein, 298 aa, Pseudomonas putida KT2440
MKTRSEELQVFVAVIDCGSISAAAEQMGQTPSAVSRTLSRLEGKLGTTLVNRTTRRMDLTEEGRYFLERARLILQQMDEMEERLSMNRQTPTGRLRINAAAPFMLHAILPWIGEFRRQYPGIELELNTDDLIIDLLEQSTDVAIRIGELADSSLHARSLGCSPVQVLASPAYLEQHGTPRQVEDLANHCLLGFSQPESLNHWPLRHAQGDRWSIRPTLVASSGETLRQLALAGEGIVSLSHFMTHEDIRTGRLQVLLSEANNGYRQPIHAVYYRNTQLALRIQCFLDFIQRKLAMYAC

SEQ ID NO: 33121 - DNA, 918 bp, Pseudomonas putida KT2440
  CDS (1)..(918)
gtgaaccttgaaagcaaatggctggaagacttcagtgctctggccgctacccgcagtttttcccaggccgcagagcggcgtttcgtgacccaaccggccttcagccggcgaattcgcagccttgaggcggcgttgggcctgcaactggtgaaccgctctcgcacacccatcgagctgaccgaggcgggtcagctatttctcgtcacagcacgtactgttgtcgaccagttgagcgaaattctccgccatttgcatcacttggaaggcgggcagggcgaggtggtgcaggtggctgcggcacactccttggcgtcgggtttcttcccccgttgggtggcccagttgcgcaacgacgggttgaacatcgccacccgcctggttgcgactaacgtcggagatgccgtacatgcactgcgcgaaggcggctgcgacctgatgctggcgttctacgacccggacgcggccttgcagatggatgccgagatcttcccgtcgctgcacatgggcaccactgaaatgctgccggtgtgcgctgtggatgccgatggcaagccattgttcgacctggagggcgagggcagtgtgccgttgctagcctacaccgccggcgcgttcctcggccgctcggtcaacttgctgctgcgccagcgcaacctgcggtataccaccgtttatgaaactgccatggccgacagcctcaagagcatggccctggaagggatgggcatcgcttgggtgccgcgtctgtccatgcgtggcgagctcgaacgcggtgaactggcgatctgcggcggtagccaatggcatgtgccgctggaaatccgcctgtaccgctgcgcgctggtgcgtaaggctaacgtccgcttgctatggcgcaagctggagtcgtctggagcacaaggtgaagcgtcactttga

SEQ ID NO: 33122 - protein, 305 aa, Pseudomonas putida KT2440
MNLESKWLEDFSALAATRSFSQAAERRFVTQPAFSRRIRSLEAALGLQLVNRSRTPIELTEAGQLFLVTARTVVDQLSEILRHLHHLEGGQGEVVQVAAAHSLASGFFPRWVAQLRNDGLNIATRLVATNVGDAVHALREGGCDLMLAFYDPDAALQMDAEIFPSLHMGTTEMLPVCAVDADGKPLFDLEGEGSVPLLAYTAGAFLGRSVNLLLRQRNLRYTTVYETAMADSLKSMALEGMGIAWVPRLSMRGELERGELAICGGSQWHVPLEIRLYRCALVRKANVRLLWRKLESSGAQGEASL

SEQ ID NO: 33123 - DNA, 972 bp, Bradyrhizobium japonicum USDA 110
  CDS (1)..(972)
atggagcttgccatgaacgcagaacttctcgacctcaaggcgttcatcaccgtggcggagacgggaagcttcgtgcgcaccgccagggcgctgaacctgtcgcagccggcgctgagccgacgcattcagaagctggaagaaagcctcggtgcgccgctgctcgaacgctcgacgcgtcacgtcaatctcaccatgaccggccgtgatttcctgccgaaggtgcgccgcctcatcgacgagttcgagacctcggtgctcgccatccacgatatcggcgcgcgaagttcgggcctggtctcggtggctgcggtgccgacagcggtgttctacttcctgccgcgtgcgatcggccggtttgccgaaacgtatccacgcattcgcatccggattctggacatcggtgccaatgaaggattggaagcggtcgcgcgcggagaagccgacttcggcatcaatttcatcggtgcttcgcatgccgagatcgaattcgagaaactggttgaggaccccttcgtcctggcctgccgtcatgaccatccgttggcatcgcgcaaacgggtcagctggtcagagattgtgtcacaccgggtcatcaccgtcggtcgcaacagcggcaatcgcgcgctgatcgacaatgcgctcgcgcgacacggcctgcagctgaactggtcctatgaggtcgctcacctctccggttcgcttggcctcgtcgaagcgggactcggcatcgcggtgctgccgaagcttgcgacgcccgccgccggtcaccccatcattcacaccgttcggttgatcgagccggaggtgtcgcggacgatcggaatcgtgcgcaggcgcgggaccacactatctcctcacgcgagccagtttctcaagatgcttctcgaggcgtggcacacgccttccgggacgcgcgggcaagacaagccgaagccccgatccgctcaggcaaactcgattcggcgggcctga

SEQ ID NO: 33124 - protein, 323 aa, Bradyrhizobium japonicum USDA 110
MELAMNAELLDLKAFITVAETGSFVRTARALNLSQPALSRRIQKLEESLGAPLLERSTRHVNLTMTGRDFLPKVRRLIDEFETSVLAIHDIGARSSGLVSVAAVPTAVFYFLPRAIGRFAETYPRIRIRILDIGANEGLEAVARGEADFGINFIGASHAEIEFEKLVEDPFVLACRHDHPLASRKRVSWSEIVSHRVITVGRNSGNRALIDNALARHGLQLNWSYEVAHLSGSLGLVEAGLGIAVLPKLATPAAGHPIIHTVRLIEPEVSRTIGIVRRRGTTLSPHASQFLKMLLEAWHTPSGTRGQDKPKPRSAQANSIRRA

SEQ ID NO: 33125 - DNA, 876 bp, Vibrio parahaemolyticus RIMD 2210633
  CDS (1)..(876)
atgaaattagatgatttgaacctgtttcgactggttgtcgaaaatgggagctataccgcaacttcgcgaaaaaccatgatcccggtggcaaccatcacccgacgcattcaagcgctagaagactctgtcaatcttcgactattgaaccgtcacgcacgtaagctttctctgactgaagccggagaacgcttttaccatgaatgctctcccctacttcaaaggctgacatcaaccgcggaagaaatcaccgatgactgccgtggcgcatcaggcaaaattaaaatttctgcgccttacaatctgaccaagcgcatgatgatgccgatgtttaatgacttcatgaagaagtatccggatatcaatatcgagctgacgacagagaacaacgctgatcaattagacccaacggaatgggatgttattttccgtgtaggtccgcaacgagattccagtctaattgctcgtaaaattggcgaagtaaaagatattttggttgccagccaagactatctagcagccaaccctgcgccaaaccacgcagaagagctctcaaaccactctttgctaaaaggctacccacttatcaagtggacactgatcaacagcaaaggtgagtctgtggtgaacgtagagcgtggtcgtttccaagccaacgcactcaatgttgttcgcagtgcttgttcagaaggtctaggtattacattaatgcctgatgtgatgattaaggaatacatcgaaagtggtgaattgttgcgagtattgccagattggagcgcaaacccgcgcgacatctacatgctgtacaaccacaaagatcacttgccagagaaagtgcgtctgttcatcgactttgtgattgcctacaacattcactaa

SEQ ID NO: 33126 - protein, 291 aa, Vibrio parahaemolyticus RIMD 2210633
MKLDDLNLFRLVVENGSYTATSRKTMIPVATITRRIQALEDSVNLRLLNRHARKLSLTEAGERFYHECSPLLQRLTSTAEEITDDCRGASGKIKISAPYNLTKRMMMPMFNDFMKKYPDINIELTTENNADQLDPTEWDVIFRVGPQRDSSLIARKIGEVKDILVASQDYLAANPAPNHAEELSNHSLLKGYPLIKWTLINSKGESVVNVERGRFQANALNVVRSACSEGLGITLMPDVMIKEYIESGELLRVLPDWSANPRDIYMLYNHKDHLPEKVRLFIDFVIAYNIH

SEQ ID NO: 33127 - DNA, 924 bp, Vibrio parahaemolyticus RIMD 2210633
  CDS (1)..(924)
gtgaacgcgattgcctccctgcccgtttttgttgctgttgtcgaatgcggcagcttttcccttgcggccaaacagctgaatctgacgaaatcggcgatcagcaaacgcatcaaccaactagaagacgatttgggcattcgtctccttaatcgaactacgcgtaagctgagcctgaccgaagcaggagaacgctattttgagtacgcctctcaagcgctcaacctagcccagcaaggcgtggacgcggtatcggaactgcaaggctctccacaaggtcggctcaaaattaccgtgccgatgtctttcggtgtactgcatatcgcgcctttgatcagcgagtttctcgctcgttacccgaaaattgaagtggatttaaccctcgaagacaaaatggtcgatttggttaaagacggttttgatttggggatacgtattggtgaactctcctcttccaatctaatcgcaaaacgtctcgccccttgtaaaagtgtgctttgtgcctcgccagattacttagcggagtttggaacaccacaaaaaccaagtgatttagtcagtcacaactgcctgcgctactcctatttccgtggcggcgtcgaatggatgttcatcaacaacggcagcgaatacaaggtgcttccaaaaggaaactttatcgtcaataacagtgaagccattcgccagttgctgttaagaggttcgggcattgcgcaactgccaacatttattgcaggaagagactttgccgcaggaaatctaaaaccggtgatggaagagtattctctaccagaacacgccatttatgcggtttttcctgagcgcaagcacatgccgttgaaagtaagagcctttatcgattttatcagcgaaaaactcggtacagatttaccttactgggatcgttacaacagcccagaaaaatag

SEQ ID NO: 33128 - protein, 307 aa, Vibrio parahaemolyticus RIMD 2210633
MNAIASLPVFVAVVECGSFSLAAKQLNLTKSAISKRINQLEDDLGIRLLNRTTRKLSLTEAGERYFEYASQALNLAQQGVDAVSELQGSPQGRLKITVPMSFGVLHIAPLISEFLARYPKIEVDLTLEDKMVDLVKDGFDLGIRIGELSSSNLIAKRLAPCKSVLCASPDYLAEFGTPQKPSDLVSHNCLRYSYFRGGVEWMFINNGSEYKVLPKGNFIVNNSEAIRQLLLRGSGIAQLPTFIAGRDFAAGNLKPVMEEYSLPEHAIYAVFPERKHMPLKVRAFIDFISEKLGTDLPYWDRYNSPEK

SEQ ID NO: 33129 - DNA, 903 bp, Salmonella enterica subsp. enterica serovar Typhi Ty2
  CDS (1)..(903)
atgatggataaaatatatgcaatgaaattgtttgtgcgcgtggcggaacgggaaagtttttcccgcgcagcagaagatatcggccttcccaaaggcagcgtctcacggcaaatacaagcgttagaacatcaactgggcatccgcctgctccaccgcaccacccggcgggtacagcttactcaggacgggatggtttactacgaacgggcaaaagatctgttgagtaacctggatgaactggagggtcttttccagcctgatcccgccagtatcagcggcaaaatacgggtagatatcccgccaggtctcgcaaacagccttatcatgccgcgcctgctcacttttttgcatcagtatcccggcattgcgctggaactttgtagtagcgatcgacaggtcgatttactacgggaagatttcgactgtgtggtgcgcacagagccgctacatgcgccagggatactgacgcgcccgcttggcaaactaagaagggtgaactgcgccagcccacaatacctggcgcgctttggatatccagaaaaccttgacgacctcgcctcacatgcgatggtgcattattcattgaccccgggagtctcttcaccgggttttgccttcgaaactccccacggtatgcagtgggtaaaaaccggcggaatgctaacggtaaacagtacggagacctggcatacggcctgtctggcaggattagggatcattcagacgccgcgcattgctgtacgggaggcgttacgcgccggagcgctcattgaaattttaccgcaatatcgcgccgctccactgccggtgacgctgcattatccccatcgccgtaatctttcccgccgggtacacctgtttatggtatggctgactgaaaccattaaagaggccgcagagtag

SEQ ID NO: 33130 - protein, 300 aa, Salmonella enterica subsp. enterica serovar Typhi Ty2
MMDKIYAMKLFVRVAERESFSRAAEDIGLPKGSVSRQIQALEHQLGIRLLHRTTRRVQLTQDGMVYYERAKDLLSNLDELEGLFQPDPASISGKIRVDIPPGLANSLIMPRLLTFLHQYPGIALELCSSDRQVDLLREDFDCVVRTEPLHAPGILTRPLGKLRRVNCASPQYLARFGYPENLDDLASHAMVHYSLTPGVSSPGFAFETPHGMQWVKTGGMLTVNSTETWHTACLAGLGIIQTPRIAVREALRAGALIEILPQYRAAPLPVTLHYPHRRNLSRRVHLFMVWLTETIKEAAE

SEQ ID NO: 33131 - DNA, 867 bp, Bacillus cereus ATCC 14579
  CDS (1)..(867)
atggaaatgagacatgttaaaacattttgcgccattgtgaagtatggtaatttttctaaagctgcgcacgcgctaggttatgcgcaatctactgttacagcacatatgaaagctttagagaacgatttacatattcctcttttcgatcggttagggaaaaaagtgctacttacaaaagcaggtcatcaatttcatccttacgcattagaattactttcaatatatgaaaaagcgcaagaaatcccccaaaatacagattatttagaaggtacattaagtattacatctaatgaatcattagcggtataccgattaccacaattattacgtacttacaaacagaaaaatccgaaagtaaatatcgtacttgaaacaaacacaaatgaacaagcattacaaaaattacgtgaaggagaaacagacgttgtcttcataattggagaaagtatagaacataatgattttattacgcgtacttttagtaatgaaacatttggatggattttaccagcttattccgctgcacatacaaatccattccagttattacaggaaactcagttcatttttacagaacaaagttgcggctataggacaatggtagatcgttttttacgtcaaagcggaaatattccagctaaaacatttgaaacttccaatgttgaagtcattaaacaatccgtcatgtgtgagttaggcatttcaattcttccttatatcgttgtacaggaaagttgtcaaaaagaacaactatgttttcagcctatcgaaactccatccgttattcaaagtcatgtaatctatcataaatccagatggatttccccggtgttacagtcgtttctttccttacttgaaccagattaa

SEQ ID NO: 33132 - protein, 288 aa, Bacillus cereus ATCC 14579
MEMRHVKTFCAIVKYGNFSKAAHALGYAQSTVTAHMKALENDLHIPLFDRLGKKVLLTKAGHQFHPYALELLSIYEKAQEIPQNTDYLEGTLSITSNESLAVYRLPQLLRTYKQKNPKVNIVLETNTNEQALQKLREGETDVVFIIGESIEHNDFITRTFSNETFGWILPAYSAAHTNPFQLLQETQFIFTEQSCGYRTMVDRFLRQSGNIPAKTFETSNVEVIKQSVMCELGISILPYIVVQESCQKEQLCFQPIETPSVIQSHVIYHKSRWISPVLQSFLSLLEPD

SEQ ID NO: 33133 - DNA, 903 bp, Bacillus cereus ATCC 14579
  CDS (1)..(903)
gtgattccaatcgaattacgacaacttgaatactttttagctgtttcaaaagaattacatttcacaaaagcagctgagaaattaaatatttcacagccttcactaagtcaacaaatacgtgcattagagcatgaagtaggaatgccacttttcgatcgaattggtaaaaaaatatctttaactgaagcagggaaggttttattatcacatagtaaaaccatttttcatgaagtcgaacaagctcgttcagctattcaagacctaaacggattacagcaaggttccttaacaataggggctttgttaaccgtcgtaaattatttactaccaccagctattttaaattttaataatttatatcctaatatagagctttctgtattagggcttcgtacaggagatattcgtgaaaaattattacaaaacgaactagatattggaattacatttctcccggtgcaagataaagagattatctccatccctctatacaaaagccatcttacattggtcgtgcccactggtcatcgattagctgaacgtaatcatgtatctattgctgaattacagaactaccctttaattcttttacctaaaaatttctttttaaccgaactaattacatctcattgtcaaaagttaaactttaaaccaaggccaattttagaaattagtacgatggaatctttaatccaaatggtttccaaaggaatgggaattacagtgttacccaaaccatatatagactttttacaaaataaaaacattcaagctattaaaatagaaaaccctactccaataattgaaatagggctaatttatagaaaagataaatatatgtgtgctgcaactcgagaatttattgagcaactaaaaatcacagtacgttctttccaaaactaa

SEQ ID NO: 33134 - protein, 300 aa, Bacillus cereus ATCC 14579
MIPIELRQLEYFLAVSKELHFTKAAEKLNISQPSLSQQIRALEHEVGMPLFDRIGKKISLTEAGKVLLSHSKTIFHEVEQARSAIQDLNGLQQGSLTIGALLTVVNYLLPPAILNFNNLYPNIELSVLGLRTGDIREKLLQNELDIGITFLPVQDKEIISIPLYKSHLTLVVPTGHRLAERNHVSIAELQNYPLILLPKNFFLTELITSHCQKLNFKPRPILEISTMESLIQMVSKGMGITVLPKPYIDFLQNKNIQAIKIENPTPIIEIGLIYRKDKYMCAATREFIEQLKITVRSFQN

SEQ ID NO: 33135 - DNA, 900 bp, Bacillus cereus ATCC 14579
  CDS (1)..(900)
ttgcaaatgaacgtagacattttaaaaatttttgttactgtcgttgaacagaaacacttctctcgtgcagcggaattattaaatctttcacagcctggcgtaagtatgcatatacgcaacttagaaaacgaatttggaactacactcattcagcgatctccgaaacatgtccaagtcacggaagctggaaatatattatatattcatgcaaagcaaatgctctctctttacgaagatgctaagcaagaaattaatgaactacataacgttgtaacaggaacacttcgcatcggtgctagttttacaattggcgaatacttacttccaaaaatactcgctaactatgcgaatgaaaatccacgcgtcgaagtgcatacctttatctcaaatacagaagaagttttgcaaagtcttcgctctaatcaaattgatatcggcttagtggaagggcaagtcgtatacgctgatgttaacgttgaaacatttatgcaagatgaaatgaagctcgtcgttccgccaaatcatccactactccgcacaaaggaaataaatgaaagcacactccaagatcaagtatgggtactaagagaaagtggttctggtacacgcgcttatagtgaccgctttattcatcaacaccatttaaaaatgaaacgattctttacattcagtagtatccaaagtgtaaaggaagctgttagtgccggtcttggcatcgctatactttctgattggactgtacggaaagagctactagcaaaagaactattccacgtcgaagttccaaatgaacaactaatccgtccgttttccatcgtacgcggtaaatatttcattccatctaaagccattcaagtgttcttaaatcatgtagattcttttgcgaaaaaacagagttga

SEQ ID NO: 33136 - protein, 299 aa, Bacillus cereus ATCC 14579
MQMNVDILKIFVTVVEQKHFSRAAELLNLSQPGVSMHIRNLENEFGTTLIQRSPKHVQVTEAGNILYIHAKQMLSLYEDAKQEINELHNVVTGTLRIGASFTIGEYLLPKILANYANENPRVEVHTFISNTEEVLQSLRSNQIDIGLVEGQVVYADVNVETFMQDEMKLVVPPNHPLLRTKEINESTLQDQVWVLRESGSGTRAYSDRFIHQHHLKMKRFFTFSSIQSVKEAVSAGLGIAILSDWTVRKELLAKELFHVEVPNEQLIRPFSIVRGKYFIPSKAIQVFLNHVDSFAKKQS

SEQ ID NO: 33137 - DNA, 918 bp, Nitrosomonas europaea ATCC 19718
  CDS (1)..(918)
atggatcgattcgaaaatatgaatgcgtttgtgcgtgttgtggaaacaggtagcatcagtgcggctgccgatcgcatggatatagccaaatccgttgtcagccggcgtttgaaggagcttgaggaacatctgggggtggaattgtttcaccgcaccacgcggcaaatgaatctcaccgatagcgggcgcgccttttatcagcaatccgtgcgcatcctcgctgatgttctcgaagccgagcacgccacgtcgcagtttcacggcaggttgaaaggtcatttgaaagtggcggttccgctcagttttggcttgatgcatctgggggccgccatctccacctttctgcaaactcatccggatatcgaatttgatctggatttcaatgaccggcaggtcgatttgctggcggaaggttttgatcttgccatccgcatcgcaaacctgcccgattccagcttgatcgcacgtcgccttgcacctattcaggctgtcatgtgtgccagcccggcataccttgagcgcatgggcacgccgcaagcgccggaagaactcatccggcatcgctgcctggtttataacctggtcagtcacagcgataactggaatgtttatggcaccacgggagagttgatcaaaacccggatcattccctatctcaaggccagtaacggggaatttctccgtgatgctgccgtcgatggtctgggtatcgtattgctgccaacttttatcgtttaccgggaaatccagcgcggtgcattgatcccgatattgaccggataccactacgcccagctggctgcttatgccatttacccgcaaacccgccacctctcgcagcgggttcgggcatttgtcgattttctaagccagcggtttgaagggatgccttactgggatgcgtgtctgaatcaataa

SEQ ID NO: 33138 - protein, 305 aa, Nitrosomonas europaea ATCC 19718
MDRFENMNAFVRVVETGSISAAADRMDIAKSVVSRRLKELEEHLGVELFHRTTRQMNLTDSGRAFYQQSVRILADVLEAEHATSQFHGRLKGHLKVAVPLSFGLMHLGAAISTFLQTHPDIEFDLDFNDRQVDLLAEGFDLAIRIANLPDSSLIARRLAPIQAVMCASPAYLERMGTPQAPEELIRHRCLVYNLVSHSDNWNVYGTTGELIKTRIIPYLKASNGEFLRDAAVDGLGIVLLPTFIVYREIQRGALIPILTGYHYAQLAAYAIYPQTRHLSQRVRAFVDFLSQRFEGMPYWDACLNQ

SEQ ID NO: 33139 - DNA, 903 bp, Bacillus anthracis str. Ames
  CDS (1)..(903)
gtgatccaaatcgaattacgacaacttgaatattttttagctgtttcaaaagaattgcatttcacaaaagcagctgagaaattaaatatttcacagccttcacttagtcagcaaatacgttcattagaacatgaagttggaatgccccttttcgatcgaattggtaaaaaaatatctttaaccgaagctgggaggattttattattacatagtaaaacaatttttcatgaaattgaacaagcccgttctgctattcaagatttaaacggattacaacaaggttccttaacaattggatcattattaaccgtcgtaaattacttactaccaccagctattttaaattttaataacttatatcccaatatagaactttctgtattaggacttcgcacaggagatattcgtgaaaaattattacaaaacgaattagatattggcattacatttctaccggtgcaagataaagaaattatttctgctcctctctacgaaagtgaacttataatagtcgtaccaactggtcatcaattagctaaacataatcatgtatctattgctgaattgcagaattaccctttaattcttttacctaaaaatttctttttaaccgaattaattacatcccattgtcaaaaattcaactttaaaccaaaaccaattttagaaattagtacaatggaatctttaatccaaatggtttcaaaaggaatgggaattacagttttaccaaaaccgtatatagactttctacaaaataaaaacattcaagctattaaaatagaaaatcctactccaacaatagaaatagggcttatttatagaaaagataaatatatgtgtgctgcaactcgagaatttattaaacaattgaaactaaccgtacattctttacaaaattaa

SEQ ID NO: 33140 - protein, 300 aa, Bacillus anthracis str. Ames
MIQIELRQLEYFLAVSKELHFTKAAEKLNISQPSLSQQIRSLEHEVGMPLFDRIGKKISLTEAGRILLLHSKTIFHEIEQARSAIQDLNGLQQGSLTIGSLLTVVNYLLPPAILNFNNLYPNIELSVLGLRTGDIREKLLQNELDIGITFLPVQDKEIISAPLYESELIIVVPTGHQLAKHNHVSIAELQNYPLILLPKNFFLTELITSHCQKFNFKPKPILEISTMESLIQMVSKGMGITVLPKPYIDFLQNKNIQAIKIENPTPTIEIGLIYRKDKYMCAATREFIKQLKLTVHSLQN

SEQ ID NO: 33141 - DNA, 909 bp, Bordetella pertussis Tohama I
  CDS (1)..(909)
gtgatggtgatggatctacgttggttccaggattttctgaccctggccgaatgcggccagttcacgacggctgccgagctgcgccatgtgtcgcagtcggccttcagccggcgcatccagtcgctggagacctgggtcggcacgcctctgatcgaccggggctgcttcccgacacgcctgacggcggcgggcgagcagttccgctcggccgccgccgagatcgtacgcaaggtgatcgacgcgcgcggcgaagcgggcgcgaccgggcacgacagcatggtgttgcgcgtggccatgccgcattgcctggcgacctcgcgctttcccgcctggtgcgcgcgctggcagcaggttggcggcgcggcgtcgctgcgcctgcacgtgggcaatgtgcatgactcggtcgaatggctggccgccggcgtggtggacctgctggtgtgctttcgccatgccgtggaggacatccagctcgatgcgcagagttatatgcgggcaggcgtcgaggccgatgtcttgcgcctgtatcgcccggcgggcatggcgctggacgaggccgagctggcgtgcgaggcgccgcaggcgcgctatccctatgtgtcgtatgcgcagggcgcctatttccggcgcctgatcgagctgtcgtgcgggccgctgctgcagcgcgccgtcctgcagcgggtgtgcgagaccgatttcgtcgacggcgcgcgcgacctggtgcgcgccggcgtggggctggcgtggctgcccgattccagcgcccgcgcggccgtggagcacggcgagatcgtcgcggtggcggaccggcgttgcgccattccgatggaaatctgtatgtacgcgcgacgccacgggccggcgcaggaagccgtggagcgcgtgttcgaccagttcgggcgcggctag

SEQ ID NO: 33142 - protein, 302 aa, Bordetella pertussis Tohama I
MMVMDLRWFQDFLTLAECGQFTTAAELRHVSQSAFSRRIQSLETWVGTPLIDRGCFPTRLTAAGEQFRSAAAEIVRKVIDARGEAGATGHDSMVLRVAMPHCLATSRFPAWCARWQQVGGAASLRLHVGNVHDSVEWLAAGVVDLLVCFRHAVEDIQLDAQSYMRAGVEADVLRLYRPAGMALDEAELACEAPQARYPYVSYAQGAYFRRLIELSCGPLLQRAVLQRVCETDFVDGARDLVRAGVGLAWLPDSSARAAVEHGEIVAVADRRCAIPMEICMYARRHGPAQEAVERVFDQFGRG

SEQ ID NO: 33143 - DNA, 957 bp, Bordetella pertussis Tohama I
  CDS (1)..(957)
atgagaccacaggccgatctgtccacccgccaattgcgcgccttcgtcatgcttgccgacctgcgccacttcaccaaggccgcgcaggcatgccatttgtcccagcccgcattcagcgcactgatccagtccctggaggcgacgctggccatgcagctgttcgatcgcagtacgcggcgggtggtgctgacgcaggaaggcgagctgttcgagcccctggcgcgcaggctgctggccgaccttggccacgccatgacgcacatcgccagcttcgtcgagttgcggcgcgggcgcgtccatgtcgccgcccttccctccctggcggcgggatggctgccgaaagtcctgcatgagttccacgccgagcaccccgacatcgaactcatgctctcggatgtcctgtccgacgagtgcatcgaactggtgcgcagcggccaggccgatttcgcgcttgcctcgcgcggcatccgcgcctcggaccccgcggtcctgcatgcgcgcgagctgtgcagcgacacgttccacctgatctgccgcaaggaccatccgctggcgcgcgagccgcgccttaccctcaagcacctggcgccgtggcctttcatccatctcacgcgcaacagcagcgtacgccagacggtggaagcggcgctgcgcccgcaggtcgcgaaaacgatactggaggtcgcgcagctcgcgaccgtggcgggcatgatcgaagccgggctgggcatcagcgtcgtgccgaccttcacgctgtaccagttcgaacgacccggcctgctcatccgccccatctcgctgcccggcctgacgcgccagatctacatcgtccgccggcaggaggaaaggctgtcgatcgccgcgcaggcgctgtacgacctggtggtcgcgaaactgggcacgccggcggcttccccggccaggccgcggcggcggcgcaccgagaagcgcgattga

SEQ ID NO: 33144 - protein, 318 aa, Bordetella pertussis Tohama I
MRPQADLSTRQLRAFVMLADLRHFTKAAQACHLSQPAFSALIQSLEATLAMQLFDRSTRRVVLTQEGELFEPLARRLLADLGHAMTHIASFVELRRGRVHVAALPSLAAGWLPKVLHEFHAEHPDIELMLSDVLSDECIELVRSGQADFALASRGIRASDPAVLHARELCSDTFHLICRKDHPLAREPRLTLKHLAPWPFIHLTRNSSVRQTVEAALRPQVAKTILEVAQLATVAGMIEAGLGISVVPTFTLYQFERPGLLIRPISLPGLTRQIYIVRRQEERLSIAAQALYDLVVAKLGTPAASPARPRRRRTEKRD

SEQ ID NO: 33145 - DNA, 909 bp, Bordetella pertussis Tohama I
  CDS (1)..(909)
atgtccgacctgaaactcttcgaagacctgatcgcgttggcgcagaccggcagcttcgtgcgcgcggccgagttgcgccacgtcacgcatccggccttcgggcggcgcatccgcgcgctggagacctgggccggcgcgccgctggtcgagcgcggccgcacgccggtcgtgctgacggcgcagggcgaagccttgctgcaggcggccggccaggtcgtcgagcaggtcgatcgggtgcgcgaacagctgcgcagcgctggccgccaggaagagcgcatcttgcgcatcggcaccggccgcagcctggcgcgtaccctggtggccgactggatagcgcggctgcgccagcgccccgcgcgcctgctggacggcgcgcaggtggaactgtctaccggcgtgatgcaggagatggcggcgttgctggagcagggccgtgtcgacctggtgtgctgctatgagcatccggcgctgtcggtgcaattgacgccgggacggtttcgctacatgaccctgggcatcgacaaactggtgccggtatgccaggccgatgcgcgcggccgcccgcgccatgccctgagcgaaggcgggccggccgcgccgctgatcacgtattcgggcggactggccatggcgcgcatcgccggcgaccggctcgagacctttccctatgcgctggcgccgttcgtgcgctgcgactccctcgatgccgcgcacggcatggcgcagaaggggctgggcatcgcctggctgccgtggtcgatggtggccggggattgccggcgcggcgtcctggccgcgctgggcggacgggccgaggaaatcgctttcgaggtgcgcctgtaccggccgcgtacccgcctgtcggcgctggccgaggcggtctgggagtgcacccagcgcggccgctag

SEQ ID NO: 33146 - protein, 302 aa, Bordetella pertussis Tohama I
MSDLKLFEDLIALAQTGSFVRAAELRHVTHPAFGRRIRALETWAGAPLVERGRTPVVLTAQGEALLQAAGQVVEQVDRVREQLRSAGRQEERILRIGTGRSLARTLVADWIARLRQRPARLLDGAQVELSTGVMQEMAALLEQGRVDLVCCYEHPALSVQLTPGRFRYMTLGIDKLVPVCQADARGRPRHALSEGGPAAPLITYSGGLAMARIAGDRLETFPYALAPFVRCDSLDAAHGMAQKGLGIAWLPWSMVAGDCRRGVLAALGGRAEEIAFEVRLYRPRTRLSALAEAVWECTQRGR

SEQ ID NO: 33147 - DNA, 993 bp, Bordetella parapertussis 12822
  CDS (1)..(993)
ttgcataacgggtctgcgcacaagaaaggccatgcgatgaaacaactgtggatagaagacttcctgaccctggtcgacgcggggacgttctcccgggccgcggcattgcgcaacgtcacgcagccggccttctcgcgccgcatacagcagctggaagggtggctgggcctggagctgatcgaccggcgcagccccacgctgcgcctgacgcctgtcgcgcagcgccatatcccgggtttccgcatgctgctgcgcgacatggcgcagctgcgcacgcgcatgcagtccgagcagaacggcctggcgcgcctcgtgctggcgacccagcattccctgaccatgtcgcggctgcccgccttgttgacgctgctcggcgagcaggacagcccgcgcatcgagttcagcgtgcgctcggagaaccgcgacgattgcgtggcgctgttcctgcgcggcgaggccgacctgctgctgtgcatggaggagaggaacgacgccttgtaccggctggtcccggcgcacttgcgcctgccggtagggcaggaggtcctggtgccgttgagcgcgccggccaggaacggccgcgccttgcatgcgccgcggcgcggcaagccgctgagcctgctggcgtttccgcccgacagcttcctgggacgcgtcatgtacgagcagtcgttcacggcgctgctgcagcactgcaaggtcgagatcgtccacgaatcggtgtttctcgccggggtcaaggagatggtcctggcggggctgggcatggcctggctgccgctgagcctgatcgagcgggaggtgaaggccggcgcgctggtcatgctcgatgcgcgcgaggagtacctgcagcccgtgacgctgcagctgggcctgtaccgcaatacgcattcgaattatcccgaggccatagaccgcctctggaccttgctgcgggagtccgaggcgccgccggcttcaggcgggggcggccgggcccggcggaaaacgtag

SEQ ID NO: 33148 - protein, 330 aa, Bordetella parapertussis 12822
MHNGSAHKKGHAMKQLWIEDFLTLVDAGTFSRAAALRNVTQPAFSRRIQQLEGWLGLELIDRRSPTLRLTPVAQRHIPGFRMLLRDMAQLRTRMQSEQNGLARLVLATQHSLTMSRLPALLTLLGEQDSPRIEFSVRSENRDDCVALFLRGEADLLLCMEERNDALYRLVPAHLRLPVGQEVLVPLSAPARNGRALHAPRRGKPLSLLAFPPDSFLGRVMYEQSFTALLQHCKVEIVHESVFLAGVKEMVLAGLGMAWLPLSLIEREVKAGALVMLDAREEYLQPVTLQLGLYRNTHSNYPEAIDRLWTLLRESEAPPASGGGGRARRKT

SEQ ID NO: 33149 - DNA, 963 bp, Bordetella bronchiseptica RB50
  CDS (1)..(963)
atgggcaaagaaaagagccgacccttaccgaacatcaatctgaagctgctgcatacgttcatgctggtggccgagcattgcagcttccgccaggccgccgagctttcgcaccgctcgcaggccgcggtgacgggacagatcaagcagctcgaagcgcagctgggcgtggaccttttccaccgcaccacgcggcaggtcaggctgaccgccgaaggcgcgcaattgctggagagcgcgcgccgggcggtccacgaaatggagaacgggctgcggcagatccaggaaacggtggacctcaagcgcggccgcattttcctctcgtgctcgaccaccgtgtcgtcgacgcggctggcgcccatcctggcggctttcgagcgcgactatcccggcgtggaagtgttcgtgcgggagctgacctcgggcgatatgttcgagacggtgcgccgcgaagaggcggacttcggcatcgggcccatcatggagctgccggagttcgatttcgagcccatcctgaccgagaacctgtacgcggtggtgcccaggaatcttttccccgacaccgccgagcagatcaccctggcgcggctggcctcgatgccgctgctgctgctcaaccccggcacggcgctgcgcgccctgatcgacgatacggcgcgcagccgcggcttgacgatcaatacgaagttccagttttcgcaggcgcagacgctgatatcgatggccaccgccgggctcggggcggcggtgctgcccgccatggtcttgcccgcgaagccgcacaaggatgtgcaggtgctgcccatcgcgagcccccggatgacccgggacgtggcgatcgtgcggctgcggcatagaaagctgacgcccgccgcggccaggctggcgcaactggtgcgcgacctgatccacgggccgagcggacggcgaaccgcccgggcgactacacgacgcccgcctgcctga

SEQ ID NO: 33150 - protein, 320 aa, Bordetella bronchiseptica RB50
MGKEKSRPLPNINLKLLHTFMLVAEHCSFRQAAELSHRSQAAVTGQIKQLEAQLGVDLFHRTTRQVRLTAEGAQLLESARRAVHEMENGLRQIQETVDLKRGRIFLSCSTTVSSTRLAPILAAFERDYPGVEVFVRELTSGDMFETVRREEADFGIGPIMELPEFDFEPILTENLYAVVPRNLFPDTAEQITLARLASMPLLLLNPGTALRALIDDTARSRGLTINTKFQFSQAQTLISMATAGLGAAVLPAMVLPAKPHKDVQVLPIASPRMTRDVAIVRLRHRKLTPAAARLAQLVRDLIHGPSGRRTARATTRRPPA

SEQ ID NO: 33151 - DNA, 951 bp, Bordetella bronchiseptica RB50
  CDS (1)..(951)
atgagaccacaggccgatctgtccacccgccaattgcgcgccttcgtcatgcttgccgacctgcgccacttcaccaaggccgcgcaggcatgccatttgtcccagcccgcgttcagcgcactgatccagtccctggaggcgacgctggccatgcagctgttcgatcgcagtacgcggcgggtggtgctgacgcaggaaggcgagctgttcgagcccctggcgcgccggctgctggccgaccttggccacgccatgacgcacatcgccagcttcgtcgagttgcggcgcgggcgcgtccatgtcgccgcccttccctccctggcggcgggatggctgccgaaaatcctgcatgagttccacgccgagcaccccgacatcgaactcatgctctcggatgtcctgtccgacgagtgcatcgaactggtgcgcagcggccaggccgatttcgcgcttgcctcgcgcggcatccgcgcctcggaccccgcggtcctgcatgcgcgtgagctgtgcagcgacacgttccacctgatctgccgcaaggaccatccgctggcgcgcgagccgcgccttacccttaagcacctggcgccgtggcctttcatccatctcacgcgcaacagcagcgtgcgccagacggtggaagcggcgctgcgcccgcaggtcgcgaaaacgatactggaagtcgcgcagctcgcgaccgtggcgggcatgatcgaagccgggctgggcatcagcgtcgtgccgaccttcacgctgtaccagttcgaacgacccggcctgctcatccgccccatctcgctgccgggcctgacgcgccagatctacatcgtccgccggcaggaggaaaggctgtcgatcgccgcgcaggcgctgtacgacctggtggtcgcgaaactgggcacgcctgcggccgccaagccgcggcgacgccggacggaaaaaggccgctga

SEQ ID NO: 33152 - protein, 316 aa, Bordetella bronchiseptica RB50
MRPQADLSTRQLRAFVMLADLRHFTKAAQACHLSQPAFSALIQSLEATLAMQLFDRSTRRVVLTQEGELFEPLARRLLADLGHAMTHIASFVELRRGRVHVAALPSLAAGWLPKILHEFHAEHPDIELMLSDVLSDECIELVRSGQADFALASRGIRASDPAVLHARELCSDTFHLICRKDHPLAREPRLTLKHLAPWPFIHLTRNSSVRQTVEAALRPQVAKTILEVAQLATVAGMIEAGLGISVVPTFTLYQFERPGLLIRPISLPGLTRQIYIVRRQEERLSIAAQALYDLVVAKLGTPAAAKPRRRRTEKGR

SEQ ID NO: 33153 - DNA, 909 bp, Chromobacterium violaceum ATCC 12472
  CDS (1)..(909)
atggaaacccgctggctggaagacttcctggtattggccgacaccggcagcttcacccgctcggccgagctgcgccacctgacgcagccggcgttctcgcgccgcatccgcgccttggagagctggctgggcgccgacctgatagaccgcaccacttaccccaccaagctcaccgccgccggcaagctgctgcgcgagcaggcggtgtcgctgctggcccaactcaacaccacccgcaccatgctgcgcggcctgcagcccctgccgcagggcacgctggaattcgcggtgccgcacacgttgtccttctcctattttcccaagtggctgaccgaggtcgaggccggcttcggcaagctgtcctgccggctgcaggccagcaacgtccacgacgcggtgctggccttcgtcgaaggcggcagcgacctcttgatgtgctaccaccatcccaagcagccggtggagctgcacgacgcgcgctacggcggcctgcggctgggcgtggagcgtctgcggccgtacgccgcggccgatggcggcgcggcgcgctacgcgctgccgggctccgccgacgcgccgcagcctttcctcggctacgccagcaacgcctatttccggctgatgagcgatttgctgctggtcggcggccccgagcccgcccacctgtcgctgcgctacgagaccgatatggccgagggcctgaagcagatggcgctggccggccacggcctcgccttcctgccggaaagcgcggtggcggcggagtgcgaggctggacggctggcggcggccggcggcgatgaatggagcgtggagatggaggtgaggctgtattgcgaccaccgccgcggccgcgcggcgctggaagacttgtgggattacctggccgaacgctatccggcggtgtag

SEQ ID NO: 33154 - protein, 302 aa, Chromobacterium violaceum ATCC 12472
METRWLEDFLVLADTGSFTRSAELRHLTQPAFSRRIRALESWLGADLIDRTTYPTKLTAAGKLLREQAVSLLAQLNTTRTMLRGLQPLPQGTLEFAVPHTLSFSYFPKWLTEVEAGFGKLSCRLQASNVHDAVLAFVEGGSDLLMCYHHPKQPVELHDARYGGLRLGVERLRPYAAADGGAARYALPGSADAPQPFLGYASNAYFRLMSDLLLVGGPEPAHLSLRYETDMAEGLKQMALAGHGLAFLPESAVAAECEAGRLAAAGGDEWSVEMEVRLYCDHRRGRAALEDLWDYLAERYPAV

SEQ ID NO: 33155 - DNA, 945 bp, Vibrio vulnificus YJ016
  CDS (1)..(945)
atgttatctgaacgcgcagcacaaatggtggtttttgccgccctcgtcaaacatcaaaacttcacttctgccgctaagagcttagcggtgtcggtttctcatgtcagtaagcaactggcacaactcgaagcatcgttggggatcaagttgatccaacgcaccacgcgcagctttacaccaactgaagcagggttggccttctatcaccattgccagcaagtggtgcaggcggtgaataatgcacagcatgaaatggagagccagcgcgatgaaattgccggtttagtacgaattggcttgtcgcaatcctttggtactttgcatattctccctgccattgatgaactgcgccagaaatacccgctactgcaagtggaaatgcacttgtttgattacaaagtcgacatgctgcaagaagggttagacttgtggatcaccaaccatgagcatttaccagaaggctacattgctcagcgtttagcggattgtcagttcgttgtcgcggcgtctcctgactatttgctgcagcatgatgcaccgaaggagcccaatgatctcgccaatcacaactgcctgatttaccgaagctgggagcgtgactacaccagttgggcgtttcgccgccaaggggagcaccttagcgtcaaggtatcgggtaattattcggtcgatctggctgaggcggttcgggatgcggcgatctcagggtgggggattggctatctggcgacctacttgcttggtgatgagtttagaactgggaaactgattcaactgttgccagattggcgcgcgaatcaggaaatgccattttatgcggtgtatcctagccgccagcatatgccgaaaaaaacctccgctgtcatcgatttcattaaacaaaaaatcggtacgccgtgtcattgggacaaacagctggagccctatgtcagcttccctgattag

SEQ ID NO: 33156 - protein, 314 aa, Vibrio vulnificus YJ016
MLSERAAQMVVFAALVKHQNFTSAAKSLAVSVSHVSKQLAQLEASLGIKLIQRTTRSFTPTEAGLAFYHHCQQVVQAVNNAQHEMESQRDEIAGLVRIGLSQSFGTLHILPAIDELRQKYPLLQVEMHLFDYKVDMLQEGLDLWITNHEHLPEGYIAQRLADCQFVVAASPDYLLQHDAPKEPNDLANHNCLIYRSWERDYTSWAFRRQGEHLSVKVSGNYSVDLAEAVRDAAISGWGIGYLATYLLGDEFRTGKLIQLLPDWRANQEMPFYAVYPSRQHMPKKTSAVIDFIKQKIGTPCHWDKQLEPYVSFPD

SEQ ID NO: 33157 - DNA, 864 bp, Bdellovibrio bacteriovorus HD100
  CDS (1)..(864)
atgtcagagccgaatatttatcatttgaagtatttttcaaaagccgccgaactgcaaagcctggccgctgccgccaaggccctgaatgtcagtcagccggccatcagccaggctatacgcaagctggaggacactctgggctgcgagcttctgctgcacaccaaaaaccgcttcaaactgaccgaagaaggccgcctgctgctggaaagatcccgcgggattctgagccagctggaagatctaaaagctgaactgaagggccgctctgaaattgttacaggctctttgagtattgcgacctccagcgccgtagcccactatctactgcctccccgcctgaaggacttcatgaaagcccatgtggaagttcagcccgaaattcacttcggcacagtaccggaaattgccgagctggttcgcggcggcaaagccgactttgggatcattatcgaagaaaaccgcctgcccggatttgaaaaccgactgctgggcgagggtggcttcacatgtgtgattcgcaccggagcacaatggccggcggccccccggttcctggcaacacaggaaagtcccggttggtctgagctgcaaaaggcctggcgtcgccatacggggaccgacgcccgcgccgctctgacggtcgaaaactgggaggtcatcagtcagatgagtctgctgggtatgggcgtcggctttgtcccggactttatcgctgaaaatcaaagcggcctcaaagccgctgaagaacaaaacatctgggctggcaagatccgctataagatatatctgattcacctgggcgagcaccaattggccaaacccgcccgggtctttgttaaatctctggtacagcagggtttctaa

SEQ ID NO: 33158 - protein, 287 aa, Bdellovibrio bacteriovorus HD100
MSEPNIYHLKYFSKAAELQSLAAAAKALNVSQPAISQAIRKLEDTLGCELLLHTKNRFKLTEEGRLLLERSRGILSQLEDLKAELKGRSEIVTGSLSIATSSAVAHYLLPPRLKDFMKAHVEVQPEIHFGTVPEIAELVRGGKADFGIIIEENRLPGFENRLLGEGGFTCVIRTGAQWPAAPRFLATQESPGWSELQKAWRRHTGTDARAALTVENWEVISQMSLLGMGVGFVPDFIAENQSGLKAAEEQNIWAGKIRYKIYLIHLGEHQLAKPARVFVKSLVQQGF

SEQ ID NO: 33159 - DNA, 870 bp, Bacillus cereus ATCC 10987
  CDS (1)..(870): y means t/u or c
atgaatatcgaaaatattgaagcttttatatatgtttgtcaacttggtagtttcaataaagctgccgaagctctttatttaacccaaccttctgtaacagcacgtatccaatcacttgaacgtgaaattaatataaagctttttcatcgaaatggtaataaaatctctttaaccgaaaaaggagagtattttttcccacatgcacaaaaaattttgcaatcttaccaggaagctaagtatggtttgcaacaagtaacaattccgtatgacttggtaattgggagtgctttatcaatatctaataatatcctccctgaaattttacctggttttaaatctgaatttaaggatgttagaataaaaattgtaactggtcattcacaagacatcctacagaaggttattaataaagaagttgactttggcatcgtacgaacagaaacacatcytcaagtagaatcaattcgtctttataatgaccctatcggcctttttgtacctcgaaatcatatatttttaaaagaagaaaaagtaacaatagaacatgtaagtaaacaacctcttatcttctttgattatggatcaatggattggctcatgattcatcggctattttcaagtaatgacgtaagcccgaatatatctttagaagtagataatatggaaacagcgaaaaatttagtgatacaagggatgggcattagctttttacctgaacattgtgtcaaacaagaattagaaaatggagaattgatccgagtggaaatgacgcctccggtgaaaattaatattagtattgattttatctatttaaaaggcagaccaaaatctgtttttattgactttttaaaagagaagatgtgtaaataa

SEQ ID NO: 33160 - protein, 289 aa, Bacillus cereus ATCC 10987
  misc_feature (150)..(150): Xaa can be Leu or Pro
MNIENIEAFIYVCQLGSFNKAAEALYLTQPSVTARIQSLEREINIKLFHRNGNKISLTEKGEYFFPHAQKILQSYQEAKYGLQQVTIPYDLVIGSALSISNNILPEILPGFKSEFKDVRIKIVTGHSQDILQKVINKEVDFGIVRTETHXQVESIRLYNDPIGLFVPRNHIFLKEEKVTIEHVSKQPLIFFDYGSMDWLMIHRLFSSNDVSPNISLEVDNMETAKNLVIQGMGISFLPEHCVKQELENGELIRVEMTPPVKINISIDFIYLKGRPKSVFIDFLKEKMCK

SEQ ID NO: 33161 - DNA, 903 bp, Bacillus cereus ATCC 10987
  CDS (1)..(903)
gtgattccaatcgaattacgacaacttgaatactttttagctgtttcaaaagaattacatttcacaaaagcagctgagaaattaaatatttcacagccttcactaagtcaacaaatacgcgcattagagcatgaagtaggaatgccacttttcgatcgaattggtaaaaaaatatctttaactgaagcagggaagattttattattacatagtaaaaacatttttcatgaagtcgaacaagctcgttcagctattcaagacctaaacggattacagcaaggttctttaacaataggtgctttgttaaccgtcgtaaattatttactaccgacggctattttaaattttaataatttatatcccaatatagaactttctgtattagggcttcgtactggagatattcgtgaaaaattattacaaaacgaactggatattggaattacatttctcccggtgcaagataaagaaattatttctacccctctctacaaaagtgaacttatattagtcgtaccaactggtcatcaattagctgaacataattatgtatctattgctgaattacagaactaccctttcattcttttacctaaaaatttctttttaaccaaactaattacatctcactgtcaaaaattcaactttaaaccaagaccaattttagaaattagcacgatggaatctttaatccaaatggtttccaaaggaatgggaattacagttttacccaaaccatatatagactttttacaaaataaaaacattcaagctattaaaatagaaaaccctactccaacaattgaaataggactaatttatagaaaagataaatatatgtgtgctacaactcgagaatttattgaacaactaaaaagaacagtacattctttacaaagctaa

SEQ ID NO: 33162 - protein, 300 aa, Bacillus cereus ATCC 10987
MIPIELRQLEYFLAVSKELHFTKAAEKLNISQPSLSQQIRALEHEVGMPLFDRIGKKISLTEAGKILLLHSKNIFHEVEQARSAIQDLNGLQQGSLTIGALLTVVNYLLPTAILNFNNLYPNIELSVLGLRTGDIREKLLQNELDIGITFLPVQDKEIISTPLYKSELILVVPTGHQLAEHNYVSIAELQNYPFILLPKNFFLTKLITSHCQKFNFKPRPILEISTMESLIQMVSKGMGITVLPKPYIDFLQNKNIQAIKIENPTPTIEIGLIYRKDKYMCATTREFIEQLKRTVHSLQS

SEQ ID NO: 33163 - DNA, 894 bp, Bacillus thuringiensis serovar konkukian str. 97-27
  CDS (1)..(894)
atgaacgtagatattttaaaaatctttgttactgtcgttgagcagaaacatttctcccgtgcagcagaattattaaacctttcacagcctggcgtaagtatgcatatacgcaacttagaaaatgaatttggaactacacttattcagcgctcaccgaagcacgttcaagtgaccgaggccggaaacattttatatatacatgcaaagcaaatgctctctctttacgaagatgctaagcaagaaattaacgagctacataacgttgtaacaggaactcttcgcatcggtgctagttttacaattggcgaatacttacttccgaaaatactagctgactacgcgaatgaaaatccacacgtcgaagttcacaccttcatttcaaatacagaagacgttttgcaaagccttcgctctaatcaaattgatatcggcttagtagaaggtcaagttgtatacgccgacgttgacgttgaaacgtttatgcaagatgaaatgaaactcgtcgtcccgccaaaccatccactactccgcacaaatgaaataaatgaaaggacactccaagatcaagtatgggtattaagagaaagtggttctggtacacgtgcttatagtgaccgttttattcatcaacaccatttaaaaatgaagcgattttttacattcagcagtatccaaagcgtgaaggaagcggtgagtgctgggcttggcatcgctatcctttctgattggactgtacggaaagagctactggcaaaagaactattccacgtcgaagttccagatgaacaactcatccgtccattctccatcgtgcgcggcaaatattttattccgtctaaggccattcaagtgtttttaaatcatgtagattcttttgcgaaaaaacagcattga

SEQ ID NO: 33164 - protein, 297 aa, Bacillus thuringiensis serovar konkukian str. 97-27
MNVDILKIFVTVVEQKHFSRAAELLNLSQPGVSMHIRNLENEFGTTLIQRSPKHVQVTEAGNILYIHAKQMLSLYEDAKQEINELHNVVTGTLRIGASFTIGEYLLPKILADYANENPHVEVHTFISNTEDVLQSLRSNQIDIGLVEGQVVYADVDVETFMQDEMKLVVPPNHPLLRTNEINERTLQDQVWVLRESGSGTRAYSDRFIHQHHLKMKRFFTFSSIQSVKEAVSAGLGIAILSDWTVRKELLAKELFHVEVPDEQLIRPFSIVRGKYFIPSKAIQVFLNHVDSFAKKQH

SEQ ID NO: 33165 - DNA, 897 bp, Acinetobacter sp. ADP1
  CDS (1)..(897)
atgtccttgatacaaaatattgaattaaagtggttgtacgatctgattactttagaaaagtatcggaacttcaccatggccgctgatatgcgaaatatttctcaatcatcactcagtagacgcattcaaaccctagaaaatacgttaggatttgaggtctttaatcgagaaatgtcaccattacaactcaccgagaaaggcaagctctttgttttacatgcaaggagctttctcgatgattttgaatataatattgataaaattaaaggaactgacaatatcagaagtaaagtgaccattgcttctgcccattctttagctggctatatttttccaaaaatcttaggcaatcttaaaaattatcaagaaaaaatctttcatgtcgaagcaatcaatgtcaatgaaacggtagaccatttacgaaatggaaaatgtgattttattgcttcattttatgatgatgaattgatgaatccacagtttttatgccataaaattttttctgcaaaactgtatttagtgaccgcaccgaatcatcttgggcgtccaaaattctctttagaagatcggtcattgccattaatgaattataccgatgatagctatatgggcaaaaaggtcaataaatttcttcaagacagtcaatctgaatattttaatattacttttgtttcttctatgagtattttgcttaaagatatgattaaagggggttttggtattggatggttacccgattatagtattcaggaagaacttaaaaataatgaattgatgattattccgttaaaagattctgttttatccgttgatatctacttatatagaagtagctcaagattgaatgcagcatcagaaggtctatggaacttcattaaagcaattgactggacatga

SEQ ID NO: 33166 - protein, 298 aa, Acinetobacter sp. ADP1
MSLIQNIELKWLYDLITLEKYRNFTMAADMRNISQSSLSRRIQTLENTLGFEVFNREMSPLQLTEKGKLFVLHARSFLDDFEYNIDKIKGTDNIRSKVTIASAHSLAGYIFPKILGNLKNYQEKIFHVEAINVNETVDHLRNGKCDFIASFYDDELMNPQFLCHKIFSAKLYLVTAPNHLGRPKFSLEDRSLPLMNYTDDSYMGKKVNKFLQDSQSEYFNITFVSSMSILLKDMIKGGFGIGWLPDYSIQEELKNNELMIIPLKDSVLSVDIYLYRSSSRLNAASEGLWNFIKAIDWT

SEQ ID NO: 33167 - DNA, 891 bp, Acinetobacter sp. ADP1
  CDS (1)..(891)
atgagtcttgaaattcgctggattgaagatctactcacactcgaacaagaacgttcattttcaaaagctgcagagcgacgctttgtcagtcagtccgcttttacaagacgcattcaacagctagagcaatctttgggttatcccattttggagcgaaactcgcgttatatggagtttaccgatgcgggtcagatattattgacgacagccaaaagtattgaacaacaattgaatgcaactttggctttattaaataatttaaatcgtgcaaatgaagtgaccatcaaatttgcagtcgttcattcattaagttctacttttttttcaaagtttttaaaattattccccgaatatattaaagattttaaaatagaattggttgctgccaacgtgggtgaggggtttaaacttttaaaagaaggggcttgtgatttcttgatttgttattcagatgaatccaaattgaaattaattaatcatgaagtacttagttatttaaagcttggtgaaacagaaattattcctgttacacttattgatgaagatggaaatgcaaaatatgatttaaatcaaagatttccattgttatcttacagtaaaaatgcgtacttaagaaatctggttgatcaggttattgtaaatagattagattatcgaattttatatgaaacagatcatgcaaataatcttaaggatttcgtattgcaaggtgcaggaattgcttggttgcctaaaattacgattgaagaagatttgttaagaaaaaggttaaaaattattaatgcgcgtgaatttattattaagcagcaaatttttatatttaaaaataagttaagaaaagatgattatttgaaaatattttgggattctcttagaaatatcgaatactaa

SEQ ID NO: 33168 - protein, 296 aa, Acinetobacter sp. ADP1
MSLEIRWIEDLLTLEQERSFSKAAERRFVSQSAFTRRIQQLEQSLGYPILERNSRYMEFTDAGQILLTTAKSIEQQLNATLALLNNLNRANEVTIKFAVVHSLSSTFFSKFLKLFPEYIKDFKIELVAANVGEGFKLLKEGACDFLICYSDESKLKLINHEVLSYLKLGETEIIPVTLIDEDGNAKYDLNQRFPLLSYSKNAYLRNLVDQVIVNRLDYRILYETDHANNLKDFVLQGAGIAWLPKITIEEDLLRKRLKIINAREFIIKQQIFIFKNKLRKDDYLKIFWDSLRNIEY

SEQ ID NO: 33169 - DNA, 930 bp, Acinetobacter sp. ADP1
  CDS (1)..(930)
atgaattttaaaagtatcgaaaatttttattgggtggcacgtttaaatagttttaataaggctgcggtcaagttaaatacaacccaaccagcagtttcccagcgtttgaacagttttgaacaagaactgggggtgaaattattggaacgtacatctcgaagcctgcaactgactgacaaaggcaaagtggtatatgaatatgctgaaaaatatattcaactgaatcaggatttgttaaaggccttgtctgaaaataaagcgattcaagccacgattcgtcttggggttgcagaaacgattgtacatacttggctggttgattttatagaacaagttcaactggaatttccgcaagtcaccattgatattgtgattaatattacgccagtattgaagcaggcagtccaatcgggtgagcttgatatggcctttttactcgaatctggctgtgattttgattgtatagaattgcccttatgtgaattccagcatagttttttaatcgcacctcgttttcataaacgatttatgtcaaggcagctttcactcaaagatatttctcaaacgacaattttgacttaccctaaaaccacgtatccctatgtcgatttaaaaaaacagctcactttacatcagtttaaagagccaaaaaccattaccagttactcattggccaccttaattaagatgacagaagaagggatggggattggtattattccgcacttgtctgttattcatgaattgcgagagcgacgcttacaaattttacctgccgaactcactctcaagccttttcgtttttcctgtatctatgtcgcgggtaaagatgatttggtcaagcagcagctttctaaaatggcttatcagattgctcagcaatctttacgcaaattgaataatcaatttgatggtgatcattatgtatag

SEQ ID NO: 33170 - protein, 309 aa, Acinetobacter sp. ADP1
MNFKSIENFYWVARLNSFNKAAVKLNTTQPAVSQRLNSFEQELGVKLLERTSRSLQLTDKGKVVYEYAEKYIQLNQDLLKALSENKAIQATIRLGVAETIVHTWLVDFIEQVQLEFPQVTIDIVINITPVLKQAVQSGELDMAFLLESGCDFDCIELPLCEFQHSFLIAPRFHKRFMSRQLSLKDISQTTILTYPKTTYPYVDLKKQLTLHQFKEPKTITSYSLATLIKMTEEGMGIGIIPHLSVIHELRERRLQILPAELTLKPFRFSCIYVAGKDDLVKQQLSKMAYQIAQQSLRKLNNQFDGDHYV

SEQ ID NO: 33171 - DNA, 909 bp, Acinetobacter sp. ADP1
  CDS (1)..(909)
gtgaaatcgactgtagaagagttaattgcgtttattaccattgtagatacaggttcgattgtcggcgcggcagagcagttgcagcaaacaccatctggcgtgagtcgttctctgaaccgactggaaaagaagcttaatgtcaccttactggaacgaaccacgcgtaaaattaaactcacccaagagggcagtttatttttgatgcgggcacggacgattttggccgatctatcagatgccgaagaagcactgttaaaatcggatagcgatacctcaggtttgattcgcatcgattctgccacaccgtttgtactgcatgtattggcccccctgatgcaaaagtttatgcagctttatccacatatcgagattgaactcaatagtaatgatcaggtcattgatttattgcagcacaaaactgatgttgcgattcgctttggtgcgctgcacgattcaagcctgcatgccagactgatctgcaaaagtcgattatatattgtggcaagtccagactatctaaaaaaagctggaacaccgagccatccacaagaactgtttcagcatcaattggtcgggtttagcaagcctgtgtatttaaatacatggcctttaaagattgaagatgaatacatcaccgttcatcctcaaattaaggcatcgagtggcgaaacagtaaggcaactgaccctgcgtggtcatggcattgcacgtttatctgagtatgaaatctggcaggatttacaggctggcagtttaattgccttatttgaagaccagattgaaattcagttgcaacatattcatgcggtgtattatcaacaaaagcatttacctaaacgtgtacgtttatttattgattttttagccgatgaacttagtcagcaattttcaaccacacaggcgttatag

SEQ ID NO: 33172 - protein, 302 aa, Acinetobacter sp. ADP1
MKSTVEELIAFITIVDTGSIVGAAEQLQQTPSGVSRSLNRLEKKLNVTLLERTTRKIKLTQEGSLFLMRARTILADLSDAEEALLKSDSDTSGLIRIDSATPFVLHVLAPLMQKFMQLYPHIEIELNSNDQVIDLLQHKTDVAIRFGALHDSSLHARLICKSRLYIVASPDYLKKAGTPSHPQELFQHQLVGFSKPVYLNTWPLKIEDEYITVHPQIKASSGETVRQLTLRGHGIARLSEYEIWQDLQAGSLIALFEDQIEIQLQHIHAVYYQQKHLPKRVRLFIDFLADELSQQFSTTQAL

SEQ ID NO: 33173 - DNA, 900 bp, Erwinia carotovora subsp. atroseptica SCRI1043
  CDS (1)..(900)
atgctaaacaatatcgaaaccaagtggctctatgactttatcatgttggaagagcaccgtagttttacgctggctgccgagaagcggaatatctctcaatcctcatttagtcggcgcattcaggcgctggaagcggcggtcgggtttgatattttcgaccgcagcgtgctgccgctgcaattaaccgaacagggtcgcgtgttccacgcctatatccgcaatacgctagacgacttggagtatcagctcaataagctgcacggtggggataattacaaaaataagatcactattgcggcagcgcattcgctgtcggtgtttatcatgccggagctgttaaaagacgtgccggacccgcaggaaaaaatcttctatgtcgaatcgatcgatgtggatgaagcggtgctgaatcttaaagaaggacgcagtgacttcattttctcgttttacaatgaggatctgatgggcgagccctttatgcacgagaagatactggaatctcggctttatccggtatgcgcgtgcgacagtgcagggaagccgctgtttgatgtaagcgcctcatcggtgccgttactcaattataccgagacgagctatatggggcgtcaggtcagccgttacttatctagcgtcgatagcgataagtttacggtcaattttgtttcttccatgagcgacttgctcaagcgtatgacaaagaaagggtatggcattgcctggctgccggactattcgattcaggaagagctgaaaaacaaagagctggcgatcctgagcatggaaaatgccgtgatccgcatgggcgtttatctgtatcggcttgatgcgcggctgaatgtggcttcggagaaattctggcgctatatgaaagggctgtcatcgacgtccggactataa

SEQ ID NO: 33174 - protein, 299 aa, Erwinia carotovora subsp. atroseptica SCRI1043
MLNNIETKWLYDFIMLEEHRSFTLAAEKRNISQSSFSRRIQALEAAVGFDIFDRSVLPLQLTEQGRVFHAYIRNTLDDLEYQLNKLHGGDNYKNKITIAAAHSLSVFIMPELLKDVPDPQEKIFYVESIDVDEAVLNLKEGRSDFIFSFYNEDLMGEPFMHEKILESRLYPVCACDSAGKPLFDVSASSVPLLNYTETSYMGRQVSRYLSSVDSDKFTVNFVSSMSDLLKRMTKKGYGIAWLPDYSIQEELKNKELAILSMENAVIRMGVYLYRLDARLNVASEKFWRYMKGLSSTSGL

SEQ ID NO: 33175 - DNA, 933 bp, Erwinia carotovora subsp. atroseptica SCRI1043
  CDS (1)..(933)
atgcacagctccgagattcgttattttttggtggttgccaccaccggttcgctcagcgccgccagtcagcacctgtttgttgccgtttctgctatcagccgccagattcagcgattagaggaacgcatcggtgtgccgctgttcgagcgtcatgcacgcggcatggtgttaaatgatgcgggacgcattctggaaaatcatgtgcgcaagagtatgatggatatggatgccgctgtggcagagattcaggggctgaaggccagtcgccgggcactgctgcggattggctgtacggaaggaatggcgtttgatctgttgccgacattgtttgcgcgttttcgccaacatgatccagataccacctttgcgctgaaagtggactcggcgatgcaagtgtcccagatgatccgtaacggtgaagtggatatcgcgctacagtttgcgctggctcccgagcagggcgtgaatgtagagctggcgctgcctgcgccgctgatgctgctgatgtcggatgaacatccgctggcgcagcagtctattcaactggcggatctgcatcctttcccgctggcgctgccggaatcatcgacgacgttacgacagctgtttgacctctcatgccgcatgaacggcacctttctggaaccgacgctgtgctgcaacaacttcaccacgctctattactatgcgatgagcacgccgggtgcggtcaccgcctgtagcttctattccgtgatgtataagtgcttacaggaaccgatgcgcctgaagccgttaaatattaagcagctcgaccagcgttcgctccagatccaaacgctggctggtaaagcgcatgcgccgcagcagcaggcttttctggatttcatgatggcggagttgcgtcagggggaggcgtactatctgagtcacatggcgacggatatggtttga

SEQ ID NO: 33176 - protein, 310 aa, Erwinia carotovora subsp. atroseptica SCRI1043
MHSSEIRYFLVVATTGSLSAASQHLFVAVSAISRQIQRLEERIGVPLFERHARGMVLNDAGRILENHVRKSMMDMDAAVAEIQGLKASRRALLRIGCTEGMAFDLLPTLFARFRQHDPDTTFALKVDSAMQVSQMIRNGEVDIALQFALAPEQGVNVELALPAPLMLLMSDEHPLAQQSIQLADLHPFPLALPESSTTLRQLFDLSCRMNGTFLEPTLCCNNFTTLYYYAMSTPGAVTACSFYSVMYKCLQEPMRLKPLNIKQLDQRSLQIQTLAGKAHAPQQQAFLDFMMAELRQGEAYYLSHMATDMV

SEQ ID NO: 33177 - DNA, 936 bp, Symbiobacterium thermophilum IAM 14863
  CDS (1)..(936)
atgcgagggccgacccggagggggagttcgatgctgctgcagcacctgaccaccttctgccgcgtcgtggaggaagggtcgttcacccgcgccgcgcaagtgctgaacctgacccagccgtcggtcaccaagcaggtgggggccctggaagactacctgcaggtgcagctgttcacccggcaaggcaagcgggtccacctcaccccggtgggggagctggtatacgactacgcccgccaggtgatccacctggtgcagcggtgcgaggaggcggtacgggagtaccgctcgcccggcagcggcagcgtgacggtgggttgcgtgcacacgatcggcctgtttaccctgccggagctcctggcggcgtacgtgcgggagcacccgcgggtgaagatcaacgtgaagaccgggaacaaccgggagacggtgacgatgctcctgcacggcgaggtggacgtggggctcgtcacgacgccgcaggtacacgagcgcatcgaggtggtgccgctgtttgaggatccgctggtggtggtcgcaggccccagcttcgccgccgatctgccgccggtggtcagcaacgccgatctggcgcagctgccgttcatcggctacgtgcgcggcgcccgcttccgtatgaccacggaccaggtgctggaggagatgggcatccagccgcagttcgtgatggagttcgacaaccacgaggcgatcaagacgatggtcgcgctgggcttcgggatcgccctggagccggtgtcggcggtgcagcgggagctgatctcggggcagctggtgcggctgaacgtgccggggctgccgcgcctcagccggaccacgtcgctgatcctgcggcggggcgagcggcgcagcgaggcggtgcgggcgttcctgtcgctgctggagcagcggtacaacgtcacgattccgacgcggtag

SEQ ID NO: 33178 - protein, 311 aa, Symbiobacterium thermophilum IAM 14863
MRGPTRRGSSMLLQHLTTFCRVVEEGSFTRAAQVLNLTQPSVTKQVGALEDYLQVQLFTRQGKRVHLTPVGELVYDYARQVIHLVQRCEEAVREYRSPGSGSVTVGCVHTIGLFTLPELLAAYVREHPRVKINVKTGNNRETVTMLLHGEVDVGLVTTPQVHERIEVVPLFEDPLVVVAGPSFAADLPPVVSNADLAQLPFIGYVRGARFRMTTDQVLEEMGIQPQFVMEFDNHEAIKTMVALGFGIALEPVSAVQRELISGQLVRLNVPGLPRLSRTTSLILRRGERRSEAVRAFLSLLEQRYNVTIPTR

SEQ ID NO: 33179 - DNA, 873 bp, Bacillus cereus ZK
  CDS (1)..(873)
atggaaatgagacatgttaaaacattttgtgcgattgttaagtatggtagtttttctaaagctgcccatgcattaggttatgcgcaatctacagttacagcgcatatgaaagcattagagaacgatttacatattcctcttttcgatcggttaggaaaaaaagtacttcttacaaaagcaggtcatcaatttcatccttatgctttagaattacttgcaatttatgaaaaggcgcaagaaatcccccaaaataccgatcaattagaaggtacattgagtattacatcaaacgaatcattagcagtatatcgtttaccacaattattacgtacttacaaacagaaaaatccgaaagtaaatatcgtgcttgaaacaaacacaaatgaacaagcattacaaaaattacatgaaggagaaacagacgttgtcttcataattggagaaagtataaaacataatgattttattactcgtacttttagtaatgaaacatttggatggattttacctattcattcccctatacacgctaatccgttgcgtttattacaggacacccagtttatttttactgaacaaagctgcggctatagaccgatagtagatcgttttttacgtcaaagcgggcattttccagagaaaacatttgaaacttccaacgttgaagtcattaaacaatccgttatgtgtgagttaggaatttcaattcttccttacatcgttgtacaagaaaattgtcaaaaggaacaaatacgatttcaccctatcgaaactccgtctgttattcaaagtcatgtaatctatcataaatctagatggatctcccctgtagtccagtcgtttctttcgcaattaaaggtaatgaaagtataa

SEQ ID NO: 33180 - protein, 290 aa, Bacillus cereus ZK
MEMRHVKTFCAIVKYGSFSKAAHALGYAQSTVTAHMKALENDLHIPLFDRLGKKVLLTKAGHQFHPYALELLAIYEKAQEIPQNTDQLEGTLSITSNESLAVYRLPQLLRTYKQKNPKVNIVLETNTNEQALQKLHEGETDVVFIIGESIKHNDFITRTFSNETFGWILPIHSPIHANPLRLLQDTQFIFTEQSCGYRPIVDRFLRQSGHFPEKTFETSNVEVIKQSVMCELGISILPYIVVQENCQKEQIRFHPIETPSVIQSHVIYHKSRWISPVVQSFLSQLKVMKV

SEQ ID NO: 33181 - DNA, 903 bp, Bacillus cereus ZK
  CDS (1)..(903)
gtgatccaaatcgaattacgacaacttgaatattttttagctgtttcaaaagaattgcatttcacaaaagcagctgagaaattaaatatttcacagccttcacttagtcagcaaatacgtgcattagaacatgaagttggaatgcctcttttcgatcgaattggtaaaaaaatatctttaaccgaagctgggaggattttattattacatagtgaaacaatttttcatgaagttgaacaagcccgttctgctattcaagatttaaacggattacaacaaggttccttaacaattggatcattattaaccgtcgtaaattacttactaccaccagctattttaaattttaataatttatatcccaatatagaactttctgtattaggacttcgcacaggagatattcgtgaaaaattattacaaaacgaactaaatattggcattacatttctaccggtgcaagataaagaaattatttctacccctctctacaaaagtgaacttataatagtcgtaccaactggtcatcaattagctgaacataatcatgtatctattgctgaattgcagaattaccctttaattcttttacctaaaaatttctttttaaccgaattaattacatcccattgtcaaaaattcaactttaagccaaaaccgattttagaaattagtacaatggaatctttaatccaaatggtttcaaaaggcatgggaattacagttttaccaaaaccgtatatagactttttacaaaataaaaacattcaagctattaaaatagaaaatcctactccaacaatagaaatagggcttatttatagaaaagataaatatatgtgtgctgcaactcgagaatttattaaacaattgaaactaaccgtacattctttacaaaattaa

SEQ ID NO: 33182 - protein, 300 aa, Bacillus cereus ZK
MIQIELRQLEYFLAVSKELHFTKAAEKLNISQPSLSQQIRALEHEVGMPLFDRIGKKISLTEAGRILLLHSETIFHEVEQARSAIQDLNGLQQGSLTIGSLLTVVNYLLPPAILNFNNLYPNIELSVLGLRTGDIREKLLQNELNIGITFLPVQDKEIISTPLYKSELIIVVPTGHQLAEHNHVSIAELQNYPLILLPKNFFLTELITSHCQKFNFKPKPILEISTMESLIQMVSKGMGITVLPKPYIDFLQNKNIQAIKIENPTPTIEIGLIYRKDKYMCAATREFIKQLKLTVHSLQN

SEQ ID NO: 33183 - DNA, 867 bp, Mannheimia succiniciproducens MBEL55E
  CDS (1)..(867)
atgaatgataaattttcaggtattgaagaatttttaatgacagtagaaatgggcagtttcagtgctgcagcagaacgattgaatttaacaggttctgcggtgggaaaaagtatttcaagattggaacaacgattgaatacgcagctttttcaccgatcaacccgtaaaatcacgctgactcgagaaggtgaagtttggctagcaagttgtcggcgaatgatggaagaattagaacaggcgaaattgttactttctagtcaatcacaacaaattattggcgaaatacgaattgatttgcccaccacttatgggcgcagtcatattttgcccaaattgcttgccatacaagcagattatccaaagctttatttaaatattagctttcaagatcgcaaagtggatatgattgcggaacatattgatattgctgtgcgatttggggaattagcagatttaacagacattattgccaaacaaattgattgttttcaaaatcaactttgtgcgacacctgcctttgtgtcaaagtggggaaaacttaaccacccagatgatttaactcattttccctgcattgtaggcaatcaaatttcttggcggttgatgaacgaacaaggcaaatcaacaggattccccctaaatgtacagcaccaaatcaatgacggcgatgcacgtttacaggcggtattggcggattgtggcattgcctttttacctgattggctcattcaaccagccgtagaagcaggtaaattggtacaattactccctgaatttacgccaccacctgaacctatttatgtgttatggcagaagaaattacatttacagccaaaggtaaaagcgatagtaaatagcttggtttag

SEQ ID NO: 33184 - protein, 288 aa, Mannheimia succiniciproducens MBEL55E
MNDKFSGIEEFLMTVEMGSFSAAAERLNLTGSAVGKSISRLEQRLNTQLFHRSTRKITLTREGEVWLASCRRMMEELEQAKLLLSSQSQQIIGEIRIDLPTTYGRSHILPKLLAIQADYPKLYLNISFQDRKVDMIAEHIDIAVRFGELADLTDIIAKQIDCFQNQLCATPAFVSKWGKLNHPDDLTHFPCIVGNQISWRLMNEQGKSTGFPLNVQHQINDGDARLQAVLADCGIAFLPDWLIQPAVEAGKLVQLLPEFTPPPEPIYVLWQKKLHLQPKVKAIVNSLV

SEQ ID NO: 33185 - DNA, 879 bp, Bacillus licheniformis DSM 13
  CDS (1)..(879)
atggattttaaatggcttcatacctttgtcactgccgcaaaatacgaaaatttcagaaagacggcggaaaccttatttatttctcagccgaccgtcaccgtccaaattaaactgcttgaagaagaactcgggtgccagctgttcacccgcaaaggaagaagcattcatttaacgaaagaaggacgggcttaccttccttttgcccttcgcctgttggaagactatgaatcgagcatggcagagcttcacagaatcagacaaggctactcacagacattgaacttagcggtttcgccgcttatcgccgatacgattctcccatttgtattaaaaaaatacacagcgctgcatccgaattcggagatcaaagtaaagatcgccgaatcagctgaaatcgctcccctgatttcagctggccatgcagatatcggactaagctgcttaaacgtgcaatcgtcaaacctgaactgctattccatgtacagcgatcccgtgattttggttgcccctcatgacggccgcgctgcagaacaagcgccgccgctcgatgtcgaggatttgcttgaagaatatttgctgttgacccacaatcaccctgaatactgggacgacctcgtcaggcagctgaggatcaagtttccgtttgtcagaacgatgctcgtaagccagacgcatattacgaaacgatttatttcagaaggactcggtatatcatttttgccgctgtcgactgtgcgccgcgagctgatggaaggaagattaatagaggtgccgtgcgatttcatgaagcttcccgttgcagggggatatgcgattagtctgaaagataatgagaaggtcgagcactttttggcgtttttagccgagttccgtttctaa

SEQ ID NO: 33186 - protein, 292 aa, Bacillus licheniformis DSM 13
MDFKWLHTFVTAAKYENFRKTAETLFISQPTVTVQIKLLEEELGCQLFTRKGRSIHLTKEGRAYLPFALRLLEDYESSMAELHRIRQGYSQTLNLAVSPLIADTILPFVLKKYTALHPNSEIKVKIAESAEIAPLISAGHADIGLSCLNVQSSNLNCYSMYSDPVILVAPHDGRAAEQAPPLDVEDLLEEYLLLTHNHPEYWDDLVRQLRIKFPFVRTMLVSQTHITKRFISEGLGISFLPLSTVRRELMEGRLIEVPCDFMKLPVAGGYAISLKDNEKVEHFLAFLAEFRF

SEQ ID NO: 33187 - DNA, 909 bp, Legionella pneumophila subsp. pneumophila str. Philadelphia 1
  CDS (1)..(909)
atgataaatttttcacaaatccaggtatttattacaattgtcgaatctggtggatttattgctgctggagagaagatgcatcgttcacagccggcaataactaatgccataaaaaaattggagtccagcctgggcttcgaactgtttgatagaaaagtataccgacctcaactcactgcgaaaggtaaagctttttatcaaaaagcaagagaagtggtcgctcaatttatgcaactggaaaatagtgctgaaacattgagatccggagtagaaacacaattttctatagatctcgatattgctttaccattgccaggatatgctccgcttattcaatctttcataagacaatatcccgaaacttgtttttcactaagtaacaatacttttgttcgatgtcttgagcgcctggaaagaagagagtgccatttatgtatagctgcaagccatattcgttctccacagatagaatatttgcgtatgccttccatacgaatgattcctgttgcgagcagggactattatgaccagcataaagaaagaataaataatcccaagctgggaatatactgtatgcaaattatgatagctggcacgcaacaggaattatatcaactcaagattgagccattaagtcattctatgcccaaatggttagtgggtgatatgtatattcgtaaacaactgattttatcgggtatgggtattggccgtttaccggatcatctggttgaaaaggagttggcagagggctctttggttcagttaaataccagggattatgtagccgttactatggatatttatgctatgcggttaaataatcaagagcatggcatggtctccaattatgcttggcaatcactaaaaagttatgctgaagacacggtatctcccgatttgaaataa

SEQ ID NO: 33188 - protein, 302 aa, Legionella pneumophila subsp. pneumophila str. Philadelphia 1
MINFSQIQVFITIVESGGFIAAGEKMHRSQPAITNAIKKLESSLGFELFDRKVYRPQLTAKGKAFYQKAREVVAQFMQLENSAETLRSGVETQFSIDLDIALPLPGYAPLIQSFIRQYPETCFSLSNNTFVRCLERLERRECHLCIAASHIRSPQIEYLRMPSIRMIPVASRDYYDQHKERINNPKLGIYCMQIMIAGTQQELYQLKIEPLSHSMPKWLVGDMYIRKQLILSGMGIGRLPDHLVEKELAEGSLVQLNTRDYVAVTMDIYAMRLNNQEHGMVSNYAWQSLKSYAEDTVSPDLK

SEQ ID NO: 33189 - DNA, 954 bp, Photobacterium profundum SS9
  CDS (1)..(954)
gtgcttgaaatatatctggatagcttactcgtttcgatatactacttttttatctttagctcaaatcttatgaatatagaaagtaagtggttagaagattttctggctctcgcggatgttcgaaatttttctatggcagcaaaaatacgcaatgtgacccagccagcctttagtcgccggattaaagcattggagcatatggtgggcacggaattggtagacagaagcaagactcctgtttctcttacgcccagtggtcgattatttcggataacagcccgtagtctgatgaaccaaatggtggatggaattggtcagttgtctgatttatcgaaacttggcggtaatatggtccgggtggcggctgcacattcattagcaaccagccttgtaccggctattcaacctaagttattggcgggtaagcatagccccttattgagtgttgaagcgatcgatgtcgatcaggcaattgaggagctgcaagaaggtagttgtgatttgttattagcatttgatgatgagttgcttcggttaccaccctatcaatcattacaaattggacaggcggagctgttgcccgtttgtgcgtgtaatagtgaggggcaaccactttatcagctcaccaaagacaaagaagtgccatggttggcatacagtccgagttcttatatggggcgtcaaattgaagctattcgtgatcaggttaacctgaaggcagtatttttatcatcgatgaccgatttacttaaagtactggtactcaaagggcagggagtcgcttggttaccggattatgctatacaggaagaactggcgagcgggaaagtggcggttgtcggtgaaccctatcttagattaccgatcacctattatgcttatcgctatcaggctcgtttacacccagcaggtgagcaagtatggcaaacattgcgcaacttgaacggtgaatga

SEQ ID NO: 33190 - protein, 317 aa, Photobacterium profundum SS9
MLEIYLDSLLVSIYYFFIFSSNLMNIESKWLEDFLALADVRNFSMAAKIRNVTQPAFSRRIKALEHMVGTELVDRSKTPVSLTPSGRLFRITARSLMNQMVDGIGQLSDLSKLGGNMVRVAAAHSLATSLVPAIQPKLLAGKHSPLLSVEAIDVDQAIEELQEGSCDLLLAFDDELLRLPPYQSLQIGQAELLPVCACNSEGQPLYQLTKDKEVPWLAYSPSSYMGRQIEAIRDQVNLKAVFLSSMTDLLKVLVLKGQGVAWLPDYAIQEELASGKVAVVGEPYLRLPITYYAYRYQARLHPAGEQVWQTLRNLNGE

SEQ ID NO: 33191 - DNA, 900 bp, Photobacterium profundum SS9
  CDS (1)..(900)
atgaaaaatatagaaacaaaatggttacaagattttcttattcttgctgagctgcaaaatttttcccatgccgctactgttcgcaatgttactcaaccagcatttagccgacgaataaaattgcttgaagcagaattaggtttagtcttgattgatcgcagcaaatcacctattgaactaactttgtgcgggaagcagtttaaaaccacggcgcaatctattattcatcaaatagatgaagaagttagtcgtttagccgggtgctcatttcttggccggcatacggtgaggttaagtactgcgcactctatttccatcagcttgctgcccaagctgcattcaagcctgtttaatccaaagctgaataccaatttatctgttgtggcgaatgaagttgatgatgccgttgaattgcttatagatggtaagtgtgatttcttattctcattttatgaagacaggctgcaagttgcaccgtatcgttctatatatcttggccgtagttttttgtattgtgtttccgctgtggatgaaagtggaaatacgctctatgacttggaaaataatgatgatgtcccatgtctggattatactcctgagagctatatgggaagagcacttcatcgagccaatagcaaacttacttctaatacggtctgttcgtcatcaatgactgattttattaaggctttagtgttgcaaggtaagggaattagctggcttcctgattatgcaataaaagaagagttagcatctggccaattaaaaatattaacggagagagagcctgttccattagacctgtatgtttatcgctattattctaaactacactcatcatgtgaggctatgtggaatgagttaagtcaagtgagtccgataaaagagttgagcgcttaa

SEQ ID NO: 33192 - protein, 299 aa, Photobacterium profundum SS9
MKNIETKWLQDFLILAELQNFSHAATVRNVTQPAFSRRIKLLEAELGLVLIDRSKSPIELTLCGKQFKTTAQSIIHQIDEEVSRLAGCSFLGRHTVRLSTAHSISISLLPKLHSSLFNPKLNTNLSVVANEVDDAVELLIDGKCDFLFSFYEDRLQVAPYRSIYLGRSFLYCVSAVDESGNTLYDLENNDDVPCLDYTPESYMGRALHRANSKLTSNTVCSSSMTDFIKALVLQGKGISWLPDYAIKEELASGQLKILTEREPVPLDLYVYRYYSKLHSSCEAMWNELSQVSPIKELSA

SEQ ID NO: 33193 - DNA, 954 bp, Azotobacter vinelandii
  CDS (1)..(954)
atggaggcattcgtccgtgtggcggaaaccgggaatttcgccaaggcggccaggcaactgggcgtcacgcgctcggtcatcagccaccgtatccagcaactggagcagttcatccaggcgccgctgttccatcgcagcagccggcacgtccgcctgtccgaggtgggcgagacctattaccaggattgcgtggagatgctggccggtttcgagcggctgaccgagaacatgcgcaacctgcgcgccaagccccagggcaggttgcgcatccaggtgacttcggcgttcgccatcgattacctgggttacctgctggccgagttcatgcagttgtatcccggcatcgaactcgaagtggtcgtccaggaccggatcgtggatctgatccaggagggtttcgacgtcgccctgcagtttttccccgcgctggtcgacaccctggtcgagcgccagttgttccgggtccggcggattttctgcgcgtcgcccggctatctgcgcaatcacgccgcgccctgtcatcccggtgacctgctgcggcatacgatcggcctgtacgacggttatccgagtcgctatcagttcgtgttccgtcgtggcgacgagcggctggaaatcaatcttcccggccaggtgcgttccagttccgtccatctgctgcgtgatttcgccctgggcggggcggggatcgtgtgcctgccaagcctggtcgccggcaaggagctgctggcggggcgcctggtgccggtgctgggcgactatgtggtgggtactttcgcgttccgcgcggtctatcccaccacccagcgcggttccctcaaggtccgcaagctgatcgagttcctcgccgaacgcctggcgcagatgccgcactgggagggggatgattccttcgcgccgcttggcgaggccctgtccgctggcggtgtggagcctgcatggcgaccggcctga

SEQ ID NO: 33194 - protein, 317 aa, Azotobacter vinelandii
MEAFVRVAETGNFAKAARQLGVTRSVISHRIQQLEQFIQAPLFHRSSRHVRLSEVGETYYQDCVEMLAGFERLTENMRNLRAKPQGRLRIQVTSAFAIDYLGYLLAEFMQLYPGIELEVVVQDRIVDLIQEGFDVALQFFPALVDTLVERQLFRVRRIFCASPGYLRNHAAPCHPGDLLRHTIGLYDGYPSRYQFVFRRGDERLEINLPGQVRSSSVHLLRDFALGGAGIVCLPSLVAGKELLAGRLVPVLGDYVVGTFAFRAVYPTTQRGSLKVRKLIEFLAERLAQMPHWEGDDSFAPLGEALSAGGVEPAWRPA

SEQ ID NO: 33195 - DNA, 930 bp, Haemophilus somnus 129PT
  CDS (1)..(930)
ttgtattattctatacaagctataaattatttttatggaattgatatgaatttaagtcaacttaaagcttttatagtactttctgaatgtttaaatgtaacagaaactgcgaacaaactcttttgcacgcaaccgtcagtaagtattaagattaaaaaacttgaagagtcattaaatacagttttatttgagcgaattaataatcgactttatttaaccgaacaaggcaagattttccaaaattatgcaaagcaaatactttctacattggaaacttcaatagaacatctccatcaatacgatgatcccaactacggaaaaattactattggtgccagccattttgtaggtgtttatttgctcccgaaaataattgccgaatataaaaaaatatcacctaacgttaagctaagtattgatattttaccttccccccaactcattcataaattagaaaatcaccaaattgattttttgattatgtcagatcaaatttattttgatccgcaaacctatcaaactcacagatttttatctgacgagctcattttaattgcttcacctaaaaatcctttagcaaaaaaaacagcatgtgatttcaccgcacttagccagcaacaactcatcatgaaacctaatctttctgaaacaagaaaatttatttttcaacattttaaccatgaacaaattacacaactaaaaataatggaatttaacagcttagaaggaattaaacattgtgtaatcaataatctaggggtttcctttatttcaagactggctgtaacgcatgaattgaatagtcaactgttagttgaaattccattaaaaaacttaacttttgaaagagggattaattatattttttataaagacaaatttatttcccctgcgatacaaagatttttttcattacttcacaacaaataa

SEQ ID NO: 33196 - protein, 309 aa, Haemophilus somnus 129PT
MYYSIQAINYFYGIDMNLSQLKAFIVLSECLNVTETANKLFCTQPSVSIKIKKLEESLNTVLFERINNRLYLTEQGKIFQNYAKQILSTLETSIEHLHQYDDPNYGKITIGASHFVGVYLLPKIIAEYKKISPNVKLSIDILPSPQLIHKLENHQIDFLIMSDQIYFDPQTYQTHRFLSDELILIASPKNPLAKKTACDFTALSQQQLIMKPNLSETRKFIFQHFNHEQITQLKIMEFNSLEGIKHCVINNLGVSFISRLAVTHELNSQLLVEIPLKNLTFERGINYIFYKDKFISPAIQRFFSLLHNK

SEQ ID NO: 33197 - DNA, 888 bp, Anabaena variabilis ATCC 29413
  CDS (1)..(888)
atggaattacgacacctacgctacttcgtcactttggcagaagaacttcactttggcaaagcagcagagagactgcatattgcccaacctcccctcagccaacaaattcgccagctagagatagaattagggtttgacctgtttcaccgtactaaaagaactgtgcggttaacagaggcaggacaagtgtttttaggtgaagtgcagcaaattctccagcagttgcagcaagcaattcaattagggcaaacaagcagtcggggcgaagttggacagttgattgttggttttgttagttcagccgcgtataacattttgccaattattctccgaaattttcgtgcttgtactccagcagtcaaattagaattacacgaaatgacgacagaccaacaactagaatggttgagggaaggtggtatagatataggttttatccgtccccctgttgaagagaacatatttaactgggagacaatttttcaagagtcgctaatggtagctttacctgaaacacatctactggcaaatcaattcaatattcctttaacatctttggggaatgagtcatttattctatttccgagaaaaatagcgcccggactctacgatttaattatcagtctttgtcaacaagcaggttttagtcctcatgtcgcccaagaagccatccaaatgcaaactaccgtcagtttagtagcagcagatatggggatagctattgtccctgcatctttgcaaaatctacaacgaaccggagtagtttataaaaatatccaagaagccactgcaaaagttgcattagcaatgacttggcgcaaaaacgaaacatcgccaactttacagagatttctgcacacagttcgagcgcttcgggagtgtttttaa

SEQ ID NO: 33198 - protein, 295 aa, Anabaena variabilis ATCC 29413
MELRHLRYFVTLAEELHFGKAAERLHIAQPPLSQQIRQLEIELGFDLFHRTKRTVRLTEAGQVFLGEVQQILQQLQQAIQLGQTSSRGEVGQLIVGFVSSAAYNILPIILRNFRACTPAVKLELHEMTTDQQLEWLREGGIDIGFIRPPVEENIFNWETIFQESLMVALPETHLLANQFNIPLTSLGNESFILFPRKIAPGLYDLIISLCQQAGFSPHVAQEAIQMQTTVSLVAADMGIAIVPASLQNLQRTGVVYKNIQEATAKVALAMTWRKNETSPTLQRFLHTVRALRECF

SEQ ID NO: 33199 - DNA, 924 bp, Exiguobacterium sp. 255-15
  CDS (1)..(924)
atggaaatcaggcatcttgccacatttttgaaaatcattgagaccggcagttacacggcagcagctgctgagctggggtacacgcagtcgacgattacctcccatatgcaaactctggaacaaagtgtcgggggcgaagtgttcacgtacttcaatcggaaattacagctgaccgctttaggaaaagagctgattccgttagcggaagacctgcttgcgactcatgacaagattaaaaacatgcaaaaaacggacgtattgtgcggaacgttgcgcgtagccgctccggaatccttgacgatctcccgcctcggtcccgtcatcaaacgattttcgcaacaccatcccgatgtcaaactgattttgacgaacgggacgtgcggcgaaaaccaggaggaacttttgaatggacgggtcgacgtggccatgatgctgtttcctgccatggcagtcgaaaaatgtctccatcatgttttgaccgaagaaaaaatcgtgatggtcggtgccccggacgcacctgaacattttaaggacatccaaaaaaagcaatcggaccatgtgtatatcaccaatgaacaaggatgcagttaccggacgatgtttgagcaacacctgaccaaacaaaatctgctttcttttcagacaatggagttatggagtatcggtgccatcaagaaaatggtcatgagcggtcttggattcgccgtgttaccgtatatcacggtccaagaggaactggagaacggcagcctgaaaatcatcaagcaagacgaggcgttcgaaccaatctattcgcatatcctgatcaagaaaaagaaatgggtctcacccatcgcccatgcgtttatggaagcggtcatcgatgcgattccgaaacaagttgattggacggctgatgtcgaggcgaactcgttcaaagaataa

SEQ ID NO: 33200 - protein, 307 aa, Exiguobacterium sp. 255-15
MEIRHLATFLKIIETGSYTAAAAELGYTQSTITSHMQTLEQSVGGEVFTYFNRKLQLTALGKELIPLAEDLLATHDKIKNMQKTDVLCGTLRVAAPESLTISRLGPVIKRFSQHHPDVKLILTNGTCGENQEELLNGRVDVAMMLFPAMAVEKCLHHVLTEEKIVMVGAPDAPEHFKDIQKKQSDHVYITNEQGCSYRTMFEQHLTKQNLLSFQTMELWSIGAIKKMVMSGLGFAVLPYITVQEELENGSLKIIKQDEAFEPIYSHILIKKKKWVSPIAHAFMEAVIDAIPKQVDWTADVEANSFKE

SEQ ID NO: 33201 - DNA, 933 bp, Mesorhizobium sp. BNC1
  CDS (1)..(933)
atggaccttacctggctggaagatttcctggctctcgctgaaacactgaacttttcgaaagcggctgcaacgcggtccgtgacgcagcccgctttcagccggcgcatccgcgccctggaaaattgggtagggaccgccctattccaccgcacgacgcatcaagtatctctcactcccgccggtgaacatttccgcagcgaggctggcaacctcgtgcgaggcttgcagcagctccgccgcgaaacggcggaagccagtcggcgtcacgtctcccggctttccttcgctgcgacgcatgccctttcctttaccttctttccccgatggatccgcaatgaagacaccggatttgcgaccgaaagcgtgacattgagttcgggaacgatggaagcctgcgggcaaatgatgctgcatggagacgttcaattcctgttgtgccacgatcatccggccagccagagccggcttgcgcgtcccggcttttccagcgtcgttgtcggcgacgatgtgcttattcccctctcggctcccttgccctccggcctgccgaagtggtcgctggagaaccaggccgaagcccgataccttgcctatagcgatagatcggcgctcggccgcatcgtcgcggactggattacccgttgtgatgacgctccccctctcgtccaggtttttacctcggatctggcgacgacattgatgtcgatggcctgcggtggcgacggcctcgtatggcttccgaagatgttggccggagaccaaatcgatcgaagccggcttgtcgttgccggcagcaaccgctttttcatccccgtacatatccgcctgtaccggtccacctcgcgccttagcccaatggcagaggcagtatggtcaaggctgaaaaagcttgagacagatggaacaccgcatcaagccgcatcatccgcataa

SEQ ID NO: 33202 - protein, 310 aa, Mesorhizobium sp. BNC1
MDLTWLEDFLALAETLNFSKAAATRSVTQPAFSRRIRALENWVGTALFHRTTHQVSLTPAGEHFRSEAGNLVRGLQQLRRETAEASRRHVSRLSFAATHALSFTFFPRWIRNEDTGFATESVTLSSGTMEACGQMMLHGDVQFLLCHDHPASQSRLARPGFSSVVVGDDVLIPLSAPLPSGLPKWSLENQAEARYLAYSDRSALGRIVADWITRCDDAPPLVQVFTSDLATTLMSMACGGDGLVWLPKMLAGDQIDRSRLVVAGSNRFFIPVHIRLYRSTSRLSPMAEAVWSRLKKLETDGTPHQAASSA

SEQ ID NO: 33203 - DNA, 909 bp, Burkholderia cepacia R18194
  CDS (1)..(909)
atgcaactgaaatggctcgaagacttcgtcgaactcgcgcgcacgcgcagcttcacgcgcgcagccgagaaccgcttcgtcacgcacccggcgttcggccgccgcatccggtcactcgaggaatgggtcggcacgcgcctgatcgcacgcacgaagccgctcgaactgacggcggccggcaccgtgttcctcgatgcggcgtcgaacgcgctcgacatcctgcacggcgcccgcacgcaacttcaggaagcggcgccggtgctggagaacaatctccggatcgcgaccggccgcacgctctcggccaccttcttccccgactggtacgacgaaacggttgcgcgcgcaggcttcttcacggcgaccatatcgaccggcagcgcggaggaagcaatcctgcagctcacggccggcgatgccgacatgctgatcgtctattcgagcccgcatacgcggctgctgatcgatcgcgaccgcttcgactggctgtccgtcgcgcgcgaggtgctggtgccggtcagcgcattcgacgcgcgcggcagcgtgcgctaccggctgccggccgggcaggcgccggtgccgtggctcgcgttcgcgcgcatgctgacgctgcgcgcggtgctggcgcgccatctggccgaaatgccgaaccgcccgacgttgcgccccgtgtaccaggccgattcgtacgaagcaatcctcgcgatggcgcgtcgcgggctcggcctcgcgtggttgccgcagcggctcgtcgccgacgacgtgcggcgcggcgagcttgcgatcgtcggcggcgccgactggcagatcggcttcgacatcgcgctgtaccggcgccggaacgatccgcacccggtactggatgcgatctggcgcaccgcgccgtcacgcgaagacggcgaggcatag

SEQ ID NO: 33204 - protein, 302 aa, Burkholderia cepacia R18194
MQLKWLEDFVELARTRSFTRAAENRFVTHPAFGRRIRSLEEWVGTRLIARTKPLELTAAGTVFLDAASNALDILHGARTQLQEAAPVLENNLRIATGRTLSATFFPDWYDETVARAGFFTATISTGSAEEAILQLTAGDADMLIVYSSPHTRLLIDRDRFDWLSVAREVLVPVSAFDARGSVRYRLPAGQAPVPWLAFARMLTLRAVLARHLAEMPNRPTLRPVYQADSYEAILAMARRGLGLAWLPQRLVADDVRRGELAIVGGADWQIGFDIALYRRRNDPHPVLDAIWRTAPSREDGEA

SEQ ID NO: 33205 - DNA, 867 bp, Bacillus cereus G9241
  CDS (1)..(867)
atggaaatgagacatgttaaaacattttgtgcgattgttaagtatggtggtttttctaaagctgctcatgcattaggttatgcgcaatctacagttacagcgcatatgaaagcattagagaacgatttacatattcctcttttcgatcggttaggaaaaaaagtacttcttacaaaagcaggtcatcaatttcatccttatgctttagaattacttgcaatttatgaaaaagcgcaagaaatccctcaaaataccgatcaattagaaggtacattgagtattacatcaaacgaatcattagcagtgtaccgtttaccacaattattacgcgcttataaacagaaaaatccgaaagtaaatatcgtactggaaacaactacaaacgaacaagcaattaataagctacgtgaaggagaaacagatgttattttcataattggagaaagtatagaacataatgattttattacatgtacttttagtaatgaaacatttggatggattttacctattcattcccccatacatgctaatccatttcatttattacagaacacccagtttatttttacagaacaaagctgtggatatagaccaatggtcgatcgttttttacgtcaaagcggaaatattccagagaaaacatttgaaacctccaatgttgaagtaattaagcaagctgttatgtgcgagttgggaatttcaattcttccttacatcgttgtgcaagaaaattgtcaaaaggaacaaatacaatttcaacctattgaaactccagctgttattcaaagtcatgtaatctatcataaatctagatggatttcacccgttttacaatcgtttctttccttactagagaaaaattaa

SEQ ID NO: 33206 - protein, 288 aa, Bacillus cereus G9241
MEMRHVKTFCAIVKYGGFSKAAHALGYAQSTVTAHMKALENDLHIPLFDRLGKKVLLTKAGHQFHPYALELLAIYEKAQEIPQNTDQLEGTLSITSNESLAVYRLPQLLRAYKQKNPKVNIVLETTTNEQAINKLREGETDVIFIIGESIEHNDFITCTFSNETFGWILPIHSPIHANPFHLLQNTQFIFTEQSCGYRPMVDRFLRQSGNIPEKTFETSNVEVIKQAVMCELGISILPYIVVQENCQKEQIQFQPIETPAVIQSHVIYHKSRWISPVLQSFLSLLEKN

SEQ ID NO: 33207 - DNA, 972 bp, Rubrivivax gelatinosus PM1
  CDS (1)..(972)
atggagaccaagtggctggaagacttcgtgagcctggccgagacgcgcagcttctcgcgctcggcccaactgcgccacgtcacccagccggcgttctcgcgccggatccaggcgctggaggcctgggccggcaccgatctggtcgaccgctcgtcctacccgacccgcctcacgccggccggcgagagcttccacgcccaggccctggagatcctggtggcgctgcaggccacccgcaacctgctgcgcggtcaccgggccgcggggccggacatgatcgagttcgcggtgccccacacgctggcattcgccttctttccgcactggatcatggagctcaaccgcgacctgaagcgcgaatccggtgcgctgaagagccgcctgatcgcactcaatgtgcacgatgcggtgctgcgcctgaccgagggcagctgcgacctgctgatcgcctaccaccacccggcgcagccgctgcagctcaacaccgaccgctacgagatgctgacgctcggcgaggagtcgctgcgcgcctacgccaaggccgggccggacggcgagccgctgttccgcctgcccggacgtgagcgcgagcgggtgcccttcctgggctatgccagcggcgcctacctcgggcagctggtggacctgatcatcaagcagacgccgctgccggtgctgctcgacccgatctacgagaccgacatggccgagggcctgaaggcgatggcgctcgaggggcatggcctggccttcctgccggccagttcggtgcgcaaggagctgaagacgcgcaagctggtgccggccgcgccgtcgggcagcttcgaactcagcatggaggtgcgcatctaccgcgagcgccccgaggtcgcgaagcacgtcaagccgggcgtccgggcgctgtgggcacacctgttgcaggccggcgccgggccgctgtcggccggcgcggcgccgcgggcagcggcctga

SEQ ID NO: 33208 - protein, 323 aa, Rubrivivax gelatinosus PM1
METKWLEDFVSLAETRSFSRSAQLRHVTQPAFSRRIQALEAWAGTDLVDRSSYPTRLTPAGESFHAQALEILVALQATRNLLRGHRAAGPDMIEFAVPHTLAFAFFPHWIMELNRDLKRESGALKSRLIALNVHDAVLRLTEGSCDLLIAYHHPAQPLQLNTDRYEMLTLGEESLRAYAKAGPDGEPLFRLPGRERERVPFLGYASGAYLGQLVDLIIKQTPLPVLLDPIYETDMAEGLKAMALEGHGLAFLPASSVRKELKTRKLVPAAPSGSFELSMEVRIYRERPEVAKHVKPGVRALWAHLLQAGAGPLSAGAAPRAAA

SEQ ID NO: 33209 - DNA, 996 bp, Ralstonia metallidurans CH34
  CDS (1)..(996)
atgatcttgcgcgccgtgcgtccgggcgggcgccgggtgataatccgcgccatggaaatcaaatggcttgaagacttcgtcagcctggccgagacgcacagcttctctcgctcggcggaactgcggcatgtcacgcagccggcattctcgcgtcggatccagtcgctcgaggcgtgggtcggcaccgaactgatcgaccgttcgagttaccccaccagcctgactgccgccggcaaggtgttctatgaacaggcgctggcgatgctggcgcaggtcagcgagacgcgggcgctaatgcgcggccagcgctcggccaacgcgcaggtgctggaattcgcggtgccgcacacgctgtcgctgacgtttttcccggagtggctcaagggggtcgagcgcaaggtcggcacgctgccatgccggctgcgggcgctgaacgtgcacgacgcggtgctgatgctcgtcgaaggtgggtgcgacctcgtcatggtctatcaccactcgcgccaggccatccagctcgacccggcgcactacgacatgctggtgctcggcaccgagcgcctgtctccctatagcgtccccgatgcgtccggccgcccgctgttccggatgcccggcaccgacaagaagccggtgccgtacctgagctacacgcccaatgccttccttggccgcatggtggacatgctgctggccgaatcgccggaaacgctcaagctcgacaaatgctacgagactgatatggccgaggcgctcaaggtcatggcgctggccgggcatggcatggccttcctgcccgagagcgcggtacgcgaggacgttgccgccggccggctggtgcgcgccgatgccgcgaagggcttgccccagtcgatcgacatggaaatccggctctatcgcgaacggccgccggaacacgccaacgagcggcgcggcagccagcagcgccgcaagcgccagctcgtggacaagatctgggcggcgctgacctcgtaa

SEQ ID NO: 33210 - protein, 331 aa, Ralstonia metallidurans CH34
MILRAVRPGGRRVIIRAMEIKWLEDFVSLAETHSFSRSAELRHVTQPAFSRRIQSLEAWVGTELIDRSSYPTSLTAAGKVFYEQALAMLAQVSETRALMRGQRSANAQVLEFAVPHTLSLTFFPEWLKGVERKVGTLPCRLRALNVHDAVLMLVEGGCDLVMVYHHSRQAIQLDPAHYDMLVLGTERLSPYSVPDASGRPLFRMPGTDKKPVPYLSYTPNAFLGRMVDMLLAESPETLKLDKCYETDMAEALKVMALAGHGMAFLPESAVREDVAAGRLVRADAAKGLPQSIDMEIRLYRERPPEHANERRGSQQRRKRQLVDKIWAALTS

SEQ ID NO: 33211 - DNA, 939 bp, Ralstonia metallidurans CH34
  CDS (1)..(939)
atgcatatccgttggctcgaagatttcgtctgcctggcccaggccgggagtctcgcgcgtgccgccgagttgcgcaacgtcacgccgcccgcatttggccggcggatgcaggcgctcgaagtctgggccggcgcgccactgatcgatcgcagcacgtttccggtgcggctgaccgccgagggccgccagttcctggaggccgcgcagacggcgctgcgcacgctggaggacgcacgcctgtcgctgcgggcggcgcatcgcgcggacgccagcacgctgaccatcgccaccggcaagacgctcgcgcgttcgatggtgccagcatggctggccggcctgcgcgaggcactgcgcgacgacccggccggcgccggctttcgcacacggctatcgacccatgccacgcacgatgcgctggccatgttcaccgagggcgatgctgactttctgctttgctacagtccgcacgatatgcccgtgatgctggacgacgcgcgctatgtgttccatcccgtgggcgtggagcgcatggtctgcgtggcggctgccgatgcgcgtggtggccccgccttccggctgcaacgaccgaagtcgggcacgcgccccgcgccggtgccgatgattgcctatgcggagacgctgacgatgggccgcatggtcaaccaggagattgcccgccgcaagctggcaagctggctcgacgtgatcgccgtcagtgacttcgccgagtcggtacacgagatggtgcggcagaagatgggcctggcctggctgccggcgcgtctgattgccgacgatctccattcgggacgcctggtgcgtgccgatcttcagggcggcgactccgccgacctcgcgcttgatatccgcctgtaccgcccgcgcgcgcaaatgcgcccgttggccgaggcgttctggcgggccgcggcggcagcctga

SEQ ID NO: 33212 - protein, 312 aa, Ralstonia metallidurans CH34
MHIRWLEDFVCLAQAGSLARAAELRNVTPPAFGRRMQALEVWAGAPLIDRSTFPVRLTAEGRQFLEAAQTALRTLEDARLSLRAAHRADASTLTIATGKTLARSMVPAWLAGLREALRDDPAGAGFRTRLSTHATHDALAMFTEGDADFLLCYSPHDMPVMLDDARYVFHPVGVERMVCVAAADARGGPAFRLQRPKSGTRPAPVPMIAYAETLTMGRMVNQEIARRKLASWLDVIAVSDFAESVHEMVRQKMGLAWLPARLIADDLHSGRLVRADLQGGDSADLALDIRLYRPRAQMRPLAEAFWRAAAAA

SEQ ID NO: 33213 - DNA, 948 bp, Burkholderia fungorum LB400
  CDS (1)..(948)
atgacgatgcgaaatgcgactctgcgtcaactcaaggttttcgaaacggtggcgcgccacctgagcttctcgcgcgccgcggaagaattgcatctcacacagccggccgtctccacccaggtgcgccaactcgaagaacacgcggggctgccgctgttcgaacaactcggcaagaaaatctatctgacaccggccggcaccgagatgcttcactacagccgcgcgatcatccagcagttccacgaagtggacgaagcgatgagccagctcaagggcgtctccggcggcaagctgaatgtcgcggtgatcagcgcgggcgactacttctttccccgactgctggccgaattcacgcgccgctactcgggcgtggtgctcaacctcgccgtgcacaaccgcgaagaactgctgcatcagctcgccaccaatcagaccgatctcgcggtgatggtgcgcccgccccacgaaaccgacgcgaccaacgagccgttcgcgccgcacccgtacgtgatcgtggcggcacccacgcacccgcttgcgcacaagcgcaacatcaggatcggtcagttggcgagcgaagcgttcatcgtgcgcgaacgcggctcggacacgtggaattcgatggaagaaggcttcgccgggcgcctcgccaacctcaagatcgcgatggagatcaaaagcaccgagacgatcaagcaggccgtgatcgcgggcatgggcatcgccttcctgtccgcgcatacgatcagcctcgaactgcagctcggccatctggtcgtgctcgacgtcgaaagctttccggtcatgctcaactggtacgtggtgcaccgcaagaacaagcgcctgccgccggtagcggtcgcgttcaaacgttttctcatggaggaaggcgcgaacctgatcgaaaagatcacgcgcgtcaaggaattgagcgtgtataagcagtag

SEQ ID NO: 33214 - protein, 315 aa, Burkholderia fungorum LB400
MTMRNATLRQLKVFETVARHLSFSRAAEELHLTQPAVSTQVRQLEEHAGLPLFEQLGKKIYLTPAGTEMLHYSRAIIQQFHEVDEAMSQLKGVSGGKLNVAVISAGDYFFPRLLAEFTRRYSGVVLNLAVHNREELLHQLATNQTDLAVMVRPPHETDATNEPFAPHPYVIVAAPTHPLAHKRNIRIGQLASEAFIVRERGSDTWNSMEEGFAGRLANLKIAMEIKSTETIKQAVIAGMGIAFLSAHTISLELQLGHLVVLDVESFPVMLNWYVVHRKNKRLPPVAVAFKRFLMEEGANLIEKITRVKELSVYKQ

SEQ ID NO: 33215 - DNA, 903 bp, Burkholderia fungorum LB400
  CDS (1)..(903)
atgaatgtcacgctgcgccagcttagggttttcatcgaggtcgcccgtctgcaaagcttcagccgggccggcgatgaaatcggcctgacgcagtcggccgtcagccgctgcgtgcgcgaactggagagcgagatcggcctcaagctgatcgatcgcaccacccgcgaggtgcagctcacggacgtgggcggcaacctggtgtcgagcgtgtcgcgtctgctgacggatctggacgacgcactgcgcgagattcgcgaaatcggcgagcagcgtcgcggacgggtggtggtggccgcgagcccgacggtggcctgccggctcatgccgcgcgtggtggccgcgtgcgggcagcagtttccctacgtcgcgctgggtctgcgcgacgacgttcagagcgacgtggtgcgcaaggtcaagtcgggcgaagtcgacttcggcgtgatcatcggcccattcgccgcggacgacctgctcagcgaatcgctgatgacggactcgttctgcgtcgtttgccgcgacgataatccgctggcggcccaggagcgggtagcctggacggacctggaaggccagcagctcgtcatgctcgattacgcgtcgggcagccggccgatcatcgacgccgtgatgcaggaatacggcgtgagcgccacggtggtgcaggagctggggcattccgcgaccgttttcgggctggtcgaggcgggtgtcggcgtgagcgtgctgccgtggctggcattgccgctgccggctggcgcctcgctggttgcccggccgctcgtgccgcgcgccgagcgaacggtcgaactggtgcgccggcgtgaccgctcgctgtcgccggcggcggaggcggtgtgggggctgattcgccaattgccggggcgggcggaggacctggcgtag

SEQ ID NO: 33216 - protein, 300 aa, Burkholderia fungorum LB400
MNVTLRQLRVFIEVARLQSFSRAGDEIGLTQSAVSRCVRELESEIGLKLIDRTTREVQLTDVGGNLVSSVSRLLTDLDDALREIREIGEQRRGRVVVAASPTVACRLMPRVVAACGQQFPYVALGLRDDVQSDVVRKVKSGEVDFGVIIGPFAADDLLSESLMTDSFCVVCRDDNPLAAQERVAWTDLEGQQLVMLDYASGSRPIIDAVMQEYGVSATVVQELGHSATVFGLVEAGVGVSVLPWLALPLPAGASLVARPLVPRAERTVELVRRRDRSLSPAAEAVWGLIRQLPGRAEDLA

SEQ ID NO: 33217 - DNA, 963 bp, Polaromonas sp. JS666
  CDS (1)..(963)
atggaaaccaaatggctggaagatttcgtcagtcttgctgaaacccgcagtttcagccgctcggcccaactgcgtcatgtgacccagccggccttttcgcggcgcatccaggcgctcgaagcctgggccggcaccgacctggttgacagaagctcctatcccacgcgcctgacgccggccggcgagacgctgtacagccagtcgctggaaatgctgcagggtctgcagtccacccgcgccatgctgcgcggccatacctcggccgggcaggatgtcatcgagttcgctgtgccgcatacgctggcctttaccttcttcccggcgtgggtcagcagcctgcgcgagaagttcgggccgatcaagagccggctgatcgcgctcaacgtgcatgacgcggtgttgcggctggtggagggcagttgcgacctgctgatcgcctaccaccatgactcccagcctttccagctggaccccgagcgctatgaaatggtgacgctgggccaggaagtgctcgcgccgtttgtgaaggccaatgccgccggcgagcccgagttcagcctgccggggcgggccgggcagcctttgccctacctgggctacgcgcccggcgcctatctggggcgggtggtcgacctgatcctcaagcagtccagtaccgcgattcacctggaccgggtgtatgaaaccgacatggccgagggcctgaaggccatggcgctcgaggggcatggcatcgcatttttgccgctcagtgccgtcaggaaagaactccgggccaaaaagctggtcagcgcgggcggtaacctggagatgaccatggacgtccgcgtctaccgcgcacggcccacatccaaagaggcggccaaaagccatgcacaggccctgtggacctatttgcagacctcaaccggcccccgggacaaggcggcgggccggggcggaatccagccgccgacccgatag

SEQ ID NO: 33218 - protein, 320 aa, Polaromonas sp. JS666
METKWLEDFVSLAETRSFSRSAQLRHVTQPAFSRRIQALEAWAGTDLVDRSSYPTRLTPAGETLYSQSLEMLQGLQSTRAMLRGHTSAGQDVIEFAVPHTLAFTFFPAWVSSLREKFGPIKSRLIALNVHDAVLRLVEGSCDLLIAYHHDSQPFQLDPERYEMVTLGQEVLAPFVKANAAGEPEFSLPGRAGQPLPYLGYAPGAYLGRVVDLILKQSSTAIHLDRVYETDMAEGLKAMALEGHGIAFLPLSAVRKELRAKKLVSAGGNLEMTMDVRVYRARPTSKEAAKSHAQALWTYLQTSTGPRDKAAGRGGIQPPTR

SEQ ID NO: 33219 - DNA, 903 bp, Polaromonas sp. JS666
  CDS (1)..(903)
atggaccataaatggctggaagatttcattgtgctggcgcgagagcgcagcttttcaagggcagccgaactgcgtcatgtgacgcagccgcagttctcgcgccgcatacgcgcactggagctgtgggccggcgccgacctgatcaaccgcgccagcatgccgctggggctgactgccgctggcgaggaactgctgccggtggcgcaccgggcggcggcgagcctcaacgacgcccgcgcccgcatacgccatgcgcgtggcagccttgactgggtcacgctggcgaccgggcgcacgctgtcacgcacggccgtgccggactggctcgcgcgcgtcaagcgttcggccggcgagtttcggctgcgcatcctgacaggctccatccatgagggggccacggccctggagcagggcgccgccgatttcctgttgtcgtttacccatccgcgcctgccgctgctgctggacgagcagacgtttgaaggcatcacgctgggcaccgacgagctggtggccgtgagcgcgccgcgcggcgatggccagccgcggcatgccttgcctggcacggaccgccacccggtgccggtgctgggctatgccccgacgctggcgctcagccagatccttcaggacggactcagccgcagttcgcgcgagctgcacctgcacacggtgaccgaatcggactttgccgagtcgctgcatgagcaggcgcttcagggcgtgggcatggcgtggctgccccgcgggttggtggatggcgacctgcgcagcggccggctggtggaggcggacggcaaaggtgcggcggtccgctttgaaatccgcctgtaccgcccgcggagcccgcgcaacgatctggtgcagcgcatctggtcggccagtaccgcagccggcgcctga

SEQ ID NO: 33220 - protein, 300 aa, Polaromonas sp. JS666
MDHKWLEDFIVLARERSFSRAAELRHVTQPQFSRRIRALELWAGADLINRASMPLGLTAAGEELLPVAHRAAASLNDARARIRHARGSLDWVTLATGRTLSRTAVPDWLARVKRSAGEFRLRILTGSIHEGATALEQGAADFLLSFTHPRLPLLLDEQTFEGITLGTDELVAVSAPRGDGQPRHALPGTDRHPVPVLGYAPTLALSQILQDGLSRSSRELHLHTVTESDFAESLHEQALQGVGMAWLPRGLVDGDLRSGRLVEADGKGAAVRFEIRLYRPRSPRNDLVQRIWSASTAAGA

SEQ ID NO: 33221 - DNA, 1071 bp, Collimonas fungivorans
  CDS (1)..(1071)
atgcagcttgtcggccgcaggtccgccaattttctatgccgccgcgccgactcgcgttacgatagcggcatggaaagcaaatggttagaagacttcatttcgttggcggaaacgcatagtttcagccgctccgcagaattgcgtcatgtcacgcagccggccttctcgcgccgcatccagtcgctggaagcgtggctgggcgccgacctgatcgaccgcacctcctatccgacgcggctgaccgcagccggcgaagtgttttacgagcaggcgctggagatgctgggccagatcaacaacgcccgtgcgctgatgcgcggcaagcgtccgaccgcgttgagcacggtggatttcgccgtgccgcataccttgtcgctgacctacgtgccgcgctggatccgtttgctggaagacggtttcggaccgctcaatacgcgcctgctggccttgaacgtgcatgacgccgtgatggcgatggtggacggcggctgcgacctgctgctgtgctatcaccatccgcgccagccggtgcagctcgataccggccgctacgacctgatcacactgggcagcgaggtgctgcgcgcgtatgcccattgcaacaaggccggggtgccggactatgtctttcccggcagcgcaggcgcgcctttgccattcttgtcctataccagcaatgcttacctcgggcgcatggtggaactgatcctggccgacgccaagaagccgctctaccttgaaaaacgctacgagacagacatggcggaaggcttgaaaatgatggcgctggaagggcatggcgtggccttcctgccggagtcggcggtgacccgagaagtcaagctgaagcagctggccagggtcgacaggatcgacgatagcgcacccgaatgggaagcgaccatggaaatccgcctctaccgcgaacgtcctaccgtgcaacggcccggcaagccggtggtggcgcggttatgggcttacctgctgcaacagcaggaacaggcaaccaaagaagcagccaaggaagccgccaaaaacgcaaaacgtaaaacgccggcggcgctcgcataa

SEQ ID NO: 33222 - protein, 356 aa, Collimonas fungivorans
MQLVGRRSANFLCRRADSRYDSGMESKWLEDFISLAETHSFSRSAELRHVTQPAFSRRIQSLEAWLGADLIDRTSYPTRLTAAGEVFYEQALEMLGQINNARALMRGKRPTALSTVDFAVPHTLSLTYVPRWIRLLEDGFGPLNTRLLALNVHDAVMAMVDGGCDLLLCYHHPRQPVQLDTGRYDLITLGSEVLRAYAHCNKAGVPDYVFPGSAGAPLPFLSYTSNAYLGRMVELILADAKKPLYLEKRYETDMAEGLKMMALEGHGVAFLPESAVTREVKLKQLARVDRIDDSAPEWEATMEIRLYRERPTVQRPGKPVVARLWAYLLQQQEQATKEAAKEAAKNAKRKTPAALA

SEQ ID NO: 33223 - DNA, 915 bp, Rhizobium leguminosarum
  CDS (1)..(915)
atgaagaaccttaccctgaaacagctacgttattttgaagccctggccagagatggccgcttccgacgcgctgccgacgcctgtgcgatctcccagccggcattgtcaatgcaaatcaaagaacttgagcaagagttgggcggtgagcttttcgagcgtaatgcgcgtgaggtgaagctgaccgccttcggtcagaccgtggctctcaggatccgcgatatactgcgtggcgtggatgagttggcggagctggcgcggacctcgcgcgatcccttcctgacgcggctgcgcatcggcatcatcccaacgattgcaccctatctgttgccagcgatcatcaacgatctgaacaggagctttgccggtatccagatcgaggtgcgtgagacgcagacgtctaagctggttcaggagttggcgcaaggccagctggacactgcaatcgttgctttgcccgtgtccgaaccctccctgaccgagcacgagctcttcaaggaagagttcgtgctggtccggcggcccgaagacgagggcaagccggtgccccaacgcgaggcgctgcgcgaaatgcggttgctgctgcttgaggaaggccattgctttcgcgatcaggccttgtcgttctgcaagatagggccggcccgcccccgggaagtcatggaaggcagctctttatccactctggttcagatggtcagcgccggtattggcatcaccctgattccggagatggctgttcctctcgaaacgcgctcggcgcatgtatcgatttcgcgcttccaatctccgcagccgtcgcgaacgatcggaatgatttggcgccattcgacgcccatggccaaacagctcgtgcaggtttcagaggcggttcgccgatcagccgacagcatgcgcgaacagtatgtcgcgcggtga

SEQ ID NO: 33224 - protein, 304 aa, Rhizobium leguminosarum
MKNLTLKQLRYFEALARDGRFRRAADACAISQPALSMQIKELEQELGGELFERNAREVKLTAFGQTVALRIRDILRGVDELAELARTSRDPFLTRLRIGIIPTIAPYLLPAIINDLNRSFAGIQIEVRETQTSKLVQELAQGQLDTAIVALPVSEPSLTEHELFKEEFVLVRRPEDEGKPVPQREALREMRLLLLEEGHCFRDQALSFCKIGPARPREVMEGSSLSTLVQMVSAGIGITLIPEMAVPLETRSAHVSISRFQSPQPSRTIGMIWRHSTPMAKQLVQVSEAVRRSADSMREQYVAR

SEQ ID NO: 33225 - DNA, 939 bp, Shigella flexneri 2a
  CDS (1)..(939)
atgaagaatatcgagacaaaatggttatacgatttcctgacactggaagcctgtcgccatttttctcaggcggcaaaagagcgtaatctttcgcaacccgcattcagccgacgaattaaggcgctggaggcagcgatcggcgttgttttattcgatcgcacgaccacccctttacaattaaccgaagagggcaagctctttcattcccagactcgcagcttattacagcagcttgaatgcaatttgggggagttaaacggccagagtttactcggcgttcccaacattaaaattgcagccgcgcactcactatccctgagcgtattacccaaactggtgcattcacttaccgcctatggcggagaatttgtctatcatgttgaagccattgatgttgtccaggccgtaaatacgttacgcgaaggcaagagtgactttattatttcgtttcgcgatgaagatcttatgcaatcgcctttttgctgcctgaaactgtttgaatctgagttgtacccggtatgtgccgccgacgcacaggggcaccctgtattcgatatcactcagccccaggttcctttgctcaactataccgccacatcttatatgggcaggttggtcaatcgtcatctggcagaggttggaggtattaccgggcgcacgatatttatctcttcgatgagcgagttattaaagaatatggcgctcaacggatacggcattgcctggttaccgatctggtcgatcgtcgatgaactacagaccaaacgtctgatatgccttgatgctgctaaattgacagtccccattcaggcttatatttaccgaatgaacacccgactgaatagaaccgccgagaacctctggcgtattttacaggaacatatgccagacgatttaatccagcagatatcaatggaagagccagcacgccgcaattga

SEQ ID NO: 33226 - protein, 312 aa, Shigella flexneri 2a
MKNIETKWLYDFLTLEACRHFSQAAKERNLSQPAFSRRIKALEAAIGVVLFDRTTTPLQLTEEGKLFHSQTRSLLQQLECNLGELNGQSLLGVPNIKIAAAHSLSLSVLPKLVHSLTAYGGEFVYHVEAIDVVQAVNTLREGKSDFIISFRDEDLMQSPFCCLKLFESELYPVCAADAQGHPVFDITQPQVPLLNYTATSYMGRLVNRHLAEVGGITGRTIFISSMSELLKNMALNGYGIAWLPIWSIVDELQTKRLICLDAAKLTVPIQAYIYRMNTRLNRTAENLWRILQEHMPDDLIQQISMEEPARRN

SEQ ID NO: 33227 - DNA, 867 bp, Acinetobacter sp
  CDS (1)..(867)
atgaaatctacggtagaagaactgcttgcttttatgaccatcgtcgatacaggttcatttattgccgctgctgaacgactgggacagacggcatctgggctcagtcgctcgctcagccgtttagagtccaagctcgaagtgaccttactagaacggaccacgcgaaaattaaagctcacccaagaaggccagcagtttttacaacaggcccgtaaaatcctgagtgatttgaatgccgccgaagaagcattacaaaaatcagatcaagatacttcgggggtgattcggattgactcagccacaccttttattctgcatgtgattacgccattggtacataagtttcggcagtgttatcccaatattgaggtcgagttgaatagtaatgatttggtgattgatctactcgaacataaaaccgatgtggcgtttcgttttggtgaattacatgattccagcttacacgctaaattggtgtgtaaaagtcgtatctatattgttgccagtcccgaatatttacaacgcaagggcacgcctttacagcctcaagcattgcctgaacatgatgttattggttttacccgtccaacctatatcaacacttggccgattaaaattgagggtgagtattttcaagcacaacctaaagtaagagcgtccagtggtgaaaccgtccgacaactctgtttacgtgggcagggcattgctcggttatctgaatttgaaatttggcaggacattcgagaagggcgtcttgaggccctatttgaagatcaaatcgaacattcttatcaaagcatccatgctgtttattatcaacaagagcacttgccgaaaccgtgttccgtttatttattgagtttttga

SEQ ID NO: 33228 - protein, 288 aa, Acinetobacter sp
MKSTVEELLAFMTIVDTGSFIAAAERLGQTASGLSRSLSRLESKLEVTLLERTTRKLKLTQEGQQFLQQARKILSDLNAAEEALQKSDQDTSGVIRIDSATPFILHVITPLVHKFRQCYPNIEVELNSNDLVIDLLEHKTDVAFRFGELHDSSLHAKLVCKSRIYIVASPEYLQRKGTPLQPQALPEHDVIGFTRPTYINTWPIKIEGEYFQAQPKVRASSGETVRQLCLRGQGIARLSEFEIWQDIREGRLEALFEDQIEHSYQSIHAVYYQQEHLPKPCSVYLLSF

SEQ ID NO: 33229 - DNA, 909 bp, Legionella pneumophila
  CDS (1)..(909)
atgataaatttttcacaaatccaggtgtttattgcaattgttgaatctggtggatttattgctgctggagagaagatgcatcgttcacagccggcaataactaatgccataaaaaaattggagtccagcctgggcttcgaactgtttgatagaaaagtataccgacctcaactcactgcgaaaggtaaagctttttatcaaaaagcaagagaagtggccgctcaatttatgcaactggaaaatagtgctgaaacattgagatccggagtagaaacacaattttctatagatctcgatattgctttaccattgccaggatatgctccgcttattcaatctttcataagacaatatcccgaaacttgtttttcactaagtaacaatacttttgttcgatgtcttgagcgcctggaaagaagagagtgccatttatgtatagctgcaagccatattcgttctccacagatagaatatttgcgtatgccttccatacgaatgattcctgttgcgagcagggactattatgaccagcataaagaacgaataaataatcccaagctgggaatatactgcatgcaaattatgatagctggcacgcaacaggaattatatcaactcaagattgagccattaagtaattctatgcccaaatggttcgtgggtgatatgtatattcgtaaacaactgattttatcaggtatgggtattggccgtttaccggatcatctggttgaaaaggagttggcagagggctctttggttcagttaaataccagggattatgtagccgttactatggatatttatgctatgcggttaaataatcaagagcatggcatagtctccaattatgcttggcaatcactaaaaagttatgctgatgacacagtatctcccgaattgaaataa

SEQ ID NO: 33230 - protein, 302 aa, Legionella pneumophila
MINFSQIQVFIAIVESGGFIAAGEKMHRSQPAITNAIKKLESSLGFELFDRKVYRPQLTAKGKAFYQKAREVAAQFMQLENSAETLRSGVETQFSIDLDIALPLPGYAPLIQSFIRQYPETCFSLSNNTFVRCLERLERRECHLCIAASHIRSPQIEYLRMPSIRMIPVASRDYYDQHKERINNPKLGIYCMQIMIAGTQQELYQLKIEPLSNSMPKWFVGDMYIRKQLILSGMGIGRLPDHLVEKELAEGSLVQLNTRDYVAVTMDIYAMRLNNQEHGIVSNYAWQSLKSYADDTVSPELK

SEQ ID NO: 33231 - DNA, 864 bp, Oenococcus oeni
  CDS (1)..(864)
atggattcggaatatctgaaaacatttgtaactttggcaaaaagaaaaaactatacacaggtagcggattcgctttacatttcgcaatcatcgataacaaagagaattcaaaaaatcgaaaagcaattaggcgttaacttgttcaatcgaaatacgaaatctgtcgaactcagtaagtacggttatatatatttagaatacgccgaaaaaattcttcaattagaacaagaatgccttaaaaaaatcgatcaggcagtcgtccatgacaactctttaatcatcggctcgattccttcaattggacagtatggtatttctaaagaaattaccaactttataaaagataccggagttgaaatcaaaataattaccgagccgtccggaaaattggaaaatctgcttcactccaatcagtgcgattttgcatttattcgtgaagttaaagatcgaaaatatttcaagcgaataccttatgcaaaagaccaaatgatggctgttttaccgaaaaatcatcacttagctaatttaagaaaaatttcaatatcccaactggaaaaaagagttctttctattggagccgaaagatcgcgtccctataatctttgcgtaaatttatgcaaaagttccggctttcttccaaatgttgtatataccgatagacagatcgaaaatattgttgatctggtagctgatggaatgggaatatctctattaatgagtaaacttgttccaaaggagtcatcgagaatcgttgcaataccagtcgaaccaactgtatcgacaagcatatcgctatgctacatgtcagatgaaaatttaaccgatttgaagagaaaattcattgcctatataaaaaacaggtaa

SEQ ID NO: 33232 - protein, 287 aa, Oenococcus oeni
MDSEYLKTFVTLAKRKNYTQVADSLYISQSSITKRIQKIEKQLGVNLFNRNTKSVELSKYGYIYLEYAEKILQLEQECLKKIDQAVVHDNSLIIGSIPSIGQYGISKEITNFIKDTGVEIKIITEPSGKLENLLHSNQCDFAFIREVKDRKYFKRIPYAKDQMMAVLPKNHHLANLRKISISQLEKRVLSIGAERSRPYNLCVNLCKSSGFLPNVVYTDRQIENIVDLVADGMGISLLMSKLVPKESSRIVAIPVEPTVSTSISLCYMSDENLTDLKRKFIAYIKNR

SEQ ID NO: 33233 - DNA, 912 bp, Zymomonas mobilis
  CDS (1)..(912)
atgaaattacccgattttgaagcatgggcgatttttgccaaggtagctgaattaggctcttttgcgcgggcagccgaagcaatccagctttccaaacccacggtttcaaaggcggtaagtcgccttgagcagtccttaggcagtgcgctattcaatcgcaattcccgtcatatttctttgaccgatctcgggcggtcacttctgggacatgctaataaaattattgccgaagccgaaatggccgaaactgaagcccgtggtggtatccagcgcccttcggggcttatcaaaatagctgcaccaacgacttttggcctatggcatttatcaccgattctgccagattttttggcgcaatatccagaaatagatatctcaattgatttcagtgatgcgctcgttgatcttgtgggggagggctatgatatcgctcttagaatagcttctcttgcggattcagctttacgggcgcggcggctttgtccggtgcgccttttattggtggcaaccagcgattatctcgatcgcattggtcggccacagcatcccaaggcgctcgagaagcaaaaaagttttgtctataccaacagtcgggcatcaggcatgattcgtctgcggcataaagagagcggcaaggaatatgttctctcgcaatcttcccgtttcagggctgataatgccgaagcttttctacctgccttagaagccggattgggctttggaatatttcctgattttatggtctgggaaggcctaaaatccggcaaattggaacagatgttgccagaatgggacgccggttcaattgcgctttatctcgttacttctgccaatccactaagaccaatgcgcgtgaatgtattacttgattatctgaccaaagcgtttaaaaatccaccttggacaaaataa

SEQ ID NO: 33234 - protein, 303 aa, Zymomonas mobilis
MKLPDFEAWAIFAKVAELGSFARAAEAIQLSKPTVSKAVSRLEQSLGSALFNRNSRHISLTDLGRSLLGHANKIIAEAEMAETEARGGIQRPSGLIKIAAPTTFGLWHLSPILPDFLAQYPEIDISIDFSDALVDLVGEGYDIALRIASLADSALRARRLCPVRLLLVATSDYLDRIGRPQHPKALEKQKSFVYTNSRASGMIRLRHKESGKEYVLSQSSRFRADNAEAFLPALEAGLGFGIFPDFMVWEGLKSGKLEQMLPEWDAGSIALYLVTSANPLRPMRVNVLLDYLTKAFKNPPWTK

SEQ ID NO: 33235 - DNA, 954 bp, Brucella abortus
  CDS (1)..(954)
atgtttacagtccgtcaaatacgctatttcgatgcgcttgcctctaccctgcattttcgcaaggccgccgaactggcccatgtttcacaaccagcactctccgcccagattgcagaaatggaggcaatcgcgggtgcaccgcttttcgagcgctcgcagcggcaggttatcatgaccgagcttggaaagcacctttatcctggcatcaaggccatcctgcgcgaattacagaagctggaggaaatagccgcacaaagccgtggcctgctgcaaacgggcataaagctcgggatcattcccaccgtcgcgccctatctcgtgccggttctcattcccctgctgcacgaacagcatccatctttccgcctacagttgcgcgagagcgtcacggcaaaattgctggaagaactgcacgctggcgatctggacgccattgttgccgccttgccgatcgatgacgagaagcttagccaccagaagcttttcgacgaccgttttctcatcgccacctccaccaacgaccatacggttctcgcctcgccgatgacgcagaaccatgccgcgctggaacgacttctgctgctggaggaaggccattgcatgcgcgaccaggcgctcgccgtttgcaccctgccctcccagcggcaactggtgaaatacggcgcaaccagcatgagcacgcttttgcagatggtcagccatggcatggggctgacgctgatccccgaaattgccgttcgtgccgaagcgcgcagcaaccatatgcgcatcgtgcctttcgagggggaacaacccaagcgcgagattgcacttttctggcggcggcaaagcatgcgcgggaaagattttcgagcgctcgccgaatgtattgcagaaagtgctaataaactaaagatagatccttccaagattgatactttattagataacccttctaccccttcatattcttaa

SEQ ID NO: 33236 - protein, 317 aa, Brucella abortus
MFTVRQIRYFDALASTLHFRKAAELAHVSQPALSAQIAEMEAIAGAPLFERSQRQVIMTELGKHLYPGIKAILRELQKLEEIAAQSRGLLQTGIKLGIIPTVAPYLVPVLIPLLHEQHPSFRLQLRESVTAKLLEELHAGDLDAIVAALPIDDEKLSHQKLFDDRFLIATSTNDHTVLASPMTQNHAALERLLLLEEGHCMRDQALAVCTLPSQRQLVKYGATSMSTLLQMVSHGMGLTLIPEIAVRAEARSNHMRIVPFEGEQPKREIALFWRRQSMRGKDFRALAECIAESANKLKIDPSKIDTLLDNPSTPSYS

SEQ ID NO: 33237 - DNA, 927 bp, Bacillus subtilis
  CDS (1)..(927)
atggatttcaaatggcttcacacctttgtgaccgctgcaaaatatgagaacttccgaaaaacggcggaaacgcttttcttatctcagcctactgtgaccgtacatatcaagcaattagaaaaagaaatcagctgcaacgtgttcgacgtgaaaggcaggcaaatccagctgactgatgaaggcagggcgtatttgccgtatgcgctcaggcttcttgatgattatgaaaacagcatggcagagcttcacagagtgagacaaggctactctcaaaccttacagctcgcggtttctccgcttattgcagatacagtgcttccttctgtcatgaagcggtacacagcaatgaatacggaaacagaaatggcggttacgattttcgaatcagcggaaatcgcgtcactgattaaagccggggaagcagatatcggactaagctgtttaaaggtacagtcttcttctttaagctgccactgcttatacaaagaccctgtcgtccttgttgccccgcccgataagcgtttcatagaagacaacgaaattgatgccaaagaggtgctcgaacaatacctgcttttgacccacaatcatcctgattactgggacgacttgctccgtcaagtcagaatgacatttccatttgtgagaacaatgaaggtcactcaaacacatataacgaaacggtttatcaaggaaggactcggagtttcatttctgcctttatctacagtaaagcgtgagttagcagagaaacagatgatcagaattccttatcagtctgtacagctgccctatgccgggcttacgcgattgccctttatgaaaataagaaagaaaaaaagttcttggattttttatcacattttcatttttaggagcaaccaaaacgcctgtgctccgtctaatgaaaaaaacccgttccaatga

SEQ ID NO: 33238 - protein, 308 aa, Bacillus subtilis
MDFKWLHTFVTAAKYENFRKTAETLFLSQPTVTVHIKQLEKEISCNVFDVKGRQIQLTDEGRAYLPYALRLLDDYENSMAELHRVRQGYSQTLQLAVSPLIADTVLPSVMKRYTAMNTETEMAVTIFESAEIASLIKAGEADIGLSCLKVQSSSLSCHCLYKDPVVLVAPPDKRFIEDNEIDAKEVLEQYLLLTHNHPDYWDDLLRQVRMTFPFVRTMKVTQTHITKRFIKEGLGVSFLPLSTVKRELAEKQMIRIPYQSVQLPYAGLTRLPFMKIRKKKSSWIFYHIFIFRSNQNACAPSNEKNPFQ

SEQ ID NO: 33239 - DNA, 24 bp, Primer
atggatgactgtggtgcgattttg

SEQ ID NO: 33240 - DNA, 25 bp, Primer
ttagctaagcacaatctccagctcg

SEQ ID NO: 33241 - protein, 56 aa, consensus
  MISC_FEATURE (1)..(56): consensus for the disclosure of xaa see table XV
XXXXXXXXXXXXXXXXXXXXXXXXXXXXXXXXXLEXXXXXXXXXRXXXXXXXXXXX

SEQ ID NO: 33242 - DNA, 2063 bp, Saccharomyces cerevisiae; identical to SEQ ID NO: 16128
  CDS (301)..(1872)

SEQ ID NO: 33243 - protein, 523 aa, Saccharomyces cerevisiae; identical to SEQ ID NO: 16129

SEQ ID NO: 33244 - DNA, 27 bp, Primer
atgtaccaaaataatgtattgaatgct

SEQ ID NO: 33245 - DNA, 25 bp, Primer
tcaatagtgcattaactctcccatt

SEQ ID NO: 33246 - DNA, 1128 bp, Saccharomyces cerevisiae; identical to SEQ ID NO: 4128
  CDS (1)..(1128)

SEQ ID NO: 33247 - protein, 375 aa, Saccharomyces cerevisiae; identical to SEQ ID NO: 4129

SEQ ID NO: 33248 - DNA, 1962 bp, Candida albicans; identical to SEQ ID NO: 4130
  CDS (1)..(1962)

SEQ ID NO: 33249 - protein, 653 aa, Candida albicans; identical to SEQ ID NO: 4131

SEQ ID NO: 33250 - DNA, 1050 bp, Plasmodium falciparum (isolate 3D7); identical to SEQ ID NO: 4132
  CDS (1)..(1050)

SEQ ID NO: 33251 - protein, 349 aa, Plasmodium falciparum (isolate 3D7); identical to SEQ ID NO: 4133

SEQ ID NO: 33252 - DNA, 24 bp, Primer
atgaatatggcagaacgtgcagaa

SEQ ID NO: 33253 - DNA, 26 bp, Primer
ctacaatttggaattatcaatcacct

SEQ ID NO: 33254 - protein, 365 aa, consensus
  MISC_FEATURE (1)..(365): consensus for the disclosure of xaa see table XV
NXXXXVXXXXXXXXXXXXXXXXXXXXXXXXXXXXXXXXXXXXXXXXXXXXXXXXXXXXXXXXXXXXXXXXXXXXXXXXXXXFXXGLXGXXXQFEXXXXXXXXXXXXXXXXDXXGXGXSXXXXXXXXXXXXXXXXXXXXXXXXXXXXXXXXXXXXXXXXXXXXXXXXXXXXXXXXXVXXGXSMGXXXXXXLXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXPXXXXXXXXXXXXXXXXXXXXXXIXXXXXXH

SEQ ID NO: 33255 - protein, 38 aa, consensus; identical to SEQ ID NO: 4386
  MISC_FEATURE (1)..(38): consensus for the disclosure of xaa see table XV

SEQ ID NO: 33256 - protein, 15 aa, consensus
  MISC_FEATURE (1)..(15): consensus for the disclosure of xaa see table XV
VXXGXSMGXXXXXXL

SEQ ID NO: 33257 - protein, 38 aa, consensus; identical to SEQ ID NO: 4388
  MISC_FEATURE (1)..(38): consensus for the disclosure of xaa see table XV

SEQ ID NO: 33258 - DNA, 309 bp, Saccharomyces cerevisiae
  CDS (1)..(309)
atgttcgcattgataatatcatcgaaaggcaaaacttctgggttttttttcaattcctcttttagctcgtcagctctggttggaatagctcctcttacagcatattctgccttagtgacacctgtattcaaatcttttttagtaatcttgccagcgggcttaaaatccaaatcctttgcggtgaacacacctttcaaatcctgttggtgtgtcattgtcatgtgttcttacttcttctgtgtttaccacttacaaaaacaacactactgtggcgctccttccctttattcttatcttttatgcctctag

SEQ ID NO: 33259 - protein, 102 aa, Saccharomyces cerevisiae
MFALIISSKGKTSGFFFNSSFSSSALVGIAPLTAYSALVTPVFKSFLVILPAGLKSKSFAVNTPFKSCWCVIVMCSYFFCVYHLQKQHYCGAPSLYSYLLCL

SEQ ID NO: 33260 - DNA, 26 bp, Primer
atgttcgcattgataatatcatcgaa

SEQ ID NO: 33261 - DNA, 27 bp, Primer
ctagaggcataaaagataagaataaag

SEQ ID NO: 33262 - DNA, 735 bp, Saccharomyces cerevisiae; identical to SEQ ID NO: 23715
  CDS (1)..(735)

SEQ ID NO: 33263 - protein, 244 aa, Saccharomyces cerevisiae; identical to SEQ ID NO: 23716

SEQ ID NO: 33264 - DNA, 1467 bp, Arabidopsis thaliana (mouse-ear cress); identical to SEQ ID NO: 23717
  CDS (1)..(1467)

SEQ ID NO: 33265 - protein, 488 aa, Arabidopsis thaliana (mouse-ear cress); identical to SEQ ID NO: 23718

SEQ ID NO: 33266 - DNA, 858 bp, Saccharomyces cerevisiae; identical to SEQ ID NO: 23719
  CDS (1)..(858)

SEQ ID NO: 33267 - protein, 285 aa, Saccharomyces cerevisiae; identical to SEQ ID NO: 23720

SEQ ID NO: 33268 - DNA, 735 bp, Schizosaccharomyces pombe; identical to SEQ ID NO: 23721
  CDS (1)..(735)

SEQ ID NO: 33269 - protein, 244 aa, Schizosaccharomyces pombe; identical to SEQ ID NO: 23722

SEQ ID NO: 33270 - DNA, 717 bp, Debaryomyces hansenii CBS767; identical to SEQ ID NO: 23723
  CDS (1)..(717)

SEQ ID NO: 33271 - protein, 238 aa, Debaryomyces hansenii CBS767; identical to SEQ ID NO: 23724

SEQ ID NO: 33272 - DNA, 753 bp, Yarrowia lipolytica CLIB99; identical to SEQ ID NO: 23725
  CDS (1)..(753)

SEQ ID NO: 33273 - protein, 250 aa, Yarrowia lipolytica CLIB99; identical to SEQ ID NO: 23726

SEQ ID NO: 33274 - DNA, 795 bp, Kluyveromyces lactis NRRL Y; identical to SEQ ID NO: 23727
  CDS (1)..(795)

SEQ ID NO: 33275 - protein, 264 aa, Kluyveromyces lactis NRRL Y; identical to SEQ ID NO: 23728

SEQ ID NO: 33276 - DNA, 729 bp, Candida glabrata CBS138; identical to SEQ ID NO: 23729
  CDS (1)..(729)

SEQ ID NO: 33277 - protein, 242 aa, Candida glabrata CBS138; identical to SEQ ID NO: 23730

SEQ ID NO: 33278 - DNA, 783 bp, Candida glabrata CBS138; identical to SEQ ID NO: 23731
  CDS (1)..(783)

SEQ ID NO: 33279 - protein, 260 aa, Candida glabrata CBS138; identical to SEQ ID NO: 23732

SEQ ID NO: 33280 - DNA, 714 bp, Ashbya gossypii; identical to SEQ ID NO: 23733
  CDS (1)..(714)

SEQ ID NO: 33281 - protein, 237 aa, Ashbya gossypii; identical to SEQ ID NO: 23734

SEQ ID NO: 33282 - DNA, 801 bp, Neurospora crassa; identical to SEQ ID NO: 23735
  CDS (1)..(801)

SEQ ID NO: 33283 - protein, 266 aa, Neurospora crassa; identical to SEQ ID NO: 23736

SEQ ID NO: 33284 - DNA, 723 bp, Dictyostelium discoideum; identical to SEQ ID NO: 23737
  CDS (1)..(723)

SEQ ID NO: 33285 - protein, 240 aa, Dictyostelium discoideum; identical to SEQ ID NO: 23738

SEQ ID NO: 33286 - DNA, 1815 bp, Oryza sativa; identical to SEQ ID NO: 23739
  CDS (141)..(1616)

SEQ ID NO: 33287 - protein, 491 aa, Oryza sativa; identical to SEQ ID NO: 23740

SEQ ID NO: 33288 - DNA, 1038 bp, Caenorhabditis elegans; identical to SEQ ID NO: 23741
  CDS (1)..(1038)

SEQ ID NO: 33289 - protein, 345 aa, Caenorhabditis elegans; identical to SEQ ID NO: 23742

SEQ ID NO: 33290 - DNA, 828 bp, Mortierella alpina; identical to SEQ ID NO: 23743
  CDS (1)..(828)

SEQ ID NO: 33291 - protein, 275 aa, Mortierella alpina; identical to SEQ ID NO: 23744

SEQ ID NO: 33292 - DNA, 651 bp, Drosophila melanogaster; identical to SEQ ID NO: 23745
  CDS (1)..(651)

SEQ ID NO: 33293 - protein, 216 aa, Drosophila melanogaster; identical to SEQ ID NO: 23746

SEQ ID NO: 33294 - DNA, 1260 bp, Mus musculus; identical to SEQ ID NO: 23747
  CDS (12)..(1025)

SEQ ID NO: 33295 - protein, 337 aa, Mus musculus; identical to SEQ ID NO: 23748

SEQ ID NO: 33296 - DNA, 25 bp, Primer
atgactgtggttgaaataaaaagcc

SEQ ID NO: 33297 - DNA, 26 bp, Primer
ttactgtagagcatgttggaaatatt

SEQ ID NO: 33298 - protein, 77 aa, consensus; identical to SEQ ID NO: 24069
  MISC_FEATURE (1)..(77): consensus for the disclosure of xaa see table XV

SEQ ID NO: 33299 - protein, 72 aa, consensus; identical to SEQ ID NO: 24064
  MISC_FEATURE (1)..(72): consensus for the disclosure of xaa see table XV

SEQ ID NO: 33300 - protein, 86 aa, consensus; identical to SEQ ID NO: 24065
  MISC_FEATURE (1)..(86): consensus for the disclosure of xaa see table XV

SEQ ID NO: 33301 - protein, 227 aa, consensus; identical to SEQ ID NO: 24066
  MISC_FEATURE (1)..(227): consensus for the disclosure of xaa see table XV

SEQ ID NO: 33302 - protein, 33 aa, consensus; identical to SEQ ID NO: 24067
  MISC_FEATURE (1)..(33): consensus for the disclosure of xaa see table XV

SEQ ID NO: 33303 - protein, 44 aa, consensus; identical to SEQ ID NO: 24068
  MISC_FEATURE (1)..(44): consensus for the disclosure of xaa see table XV

SEQ ID NO: 33304 - protein, 19 aa, consensus
  MISC_FEATURE (1)..(19): consensus for the disclosure of xaa see table XV
KXEXXXXXXSXKXRXXXXX

SEQ ID NO: 33305 - DNA, 2430 bp, Saccharomyces cerevisiae
  CDS (1)..(2430)
atggtagattcaattcaccgtattgcatcggcgttggatacggccaaagtaataacgagggaagctgccgcggtagccacctctaagctgggtgaatcctcctatacttattattctcaaaacatcaatcctcaacagttagtcaccttgttaaattctaggaactctagagaagttagagatgcaatgaagagaataatatctataatggcttccgatgatgactctattgacgttcaattatactttgctgatgttgtaaagaatatcaccactaatgacaccaaagtgaaaagacttattcacctgtatttacttagatttgcagaaaatgacccaaacctgaccctgttatctattaattctcttcaaaaatcattgtctgattcgaattccgaactgagatgctttgctttgagtgccctttctgacatgaaaatgtcatcattagcacctataattttgcatactgtcaagaaattggttacagatccatctgcaatggttcgtggtgaagtcgccttggccattatcaaattatatagggctggaaagaatgactatcatgaagaattgttggatattctgaaagaattaatggcagatacagatcctaaggtgatatcctgtgctgtcctagcttacaaagaatgttatgcggatcacttggagctattgcatggacattttcgcagatattgtagaataattaagcaactagattcgtggtcacaatcatatttaattgagctgctaatcaagtactgtaagcagtatttaccaaaaccaactgtggtcgataaatcatcagaaggttccccaaggagttgtcctttaccagataaatacaacgagattgaatacccatcttacgaggtggtaaatgaccctgatttagatttatttctacagagtttgaattgcttaatttatagttccaaccctacagtgattttatcgtgttgcaatgcgctatatcagttagcttcaccattgcagatgaaaaatactaaatttattgaagcattggttagaacggtaaccatgacagaaaaccaaggtaacaaagaaatgcttttacaagcaattcacttcttatcgatcttagaccagacactatttttaccctacaccaagaaattttacgttttccccaaagatcctattgtggcatcaatttggaagatccaaattttgtccacgttaataaatgaatcaaacgttaaagaaatattcaaagaattgaaatattatgttgccagtgctcatttcccagaaaatgttgttattatggcggttaagtcattatctcgatgtggccaattgtcaacgagttgggaatcacatgtaatgaagtggttaattgatcatatggaatcccacaacctctctgcttctgtcctagatgcatacgtgaatgttatcaggatgctggtgcaaaaaaatcctacaaaacatcttcgcataatcttcaagcttgcagatttattaacagttcaaacgagtttggctgataatgctcgtgcaggtattgtttggttatttggtgaaattgcctcgattgaatttaagatatgtccggacgttttgaggaggctaatccagaatttttcaaatgagggtcctgagacaagatgtcagatcttagtgttatcagcaaaactgttgtcatatgacattgataattttaagcaagcgcaagttactggaagcgaagaaaataaccaaaatcccccatactatgattttagtggttcaagaatctctcaaatgtacaatgcggtcctttacttggcaaaatatgatgacgaatttgatattagggatagagccaggatgatttcatccttgtttgattcagggaaatatgaaattgtgtcactactattacaagcacctaaacctacggcaagaagtgacgattttatcgtttctgcaagattggaaacacataccccagaaataaaagaattttttagaatgcttccttggaatactgaaattactgaggttggcgagacaggtaacgatattagagaaggcgcagaattgaaagactataacaaatacaaaaaaagtttttcatcgcagtcttttattaccaacaactcagcaagatctttcacatctagctccaacgcaaaattgactgggatcaatgacggcgatagcaatagcatctcaggtaaaggtaacgtaaacaccttcacatctcaaaacgggaagaaatatcgtttgcaaagcctggacgagtttttttccgacattccagaaaggaagagtaaaccaaggaaaattataaaggtggtggaagaaagcagtgacgaggatgaagacgaatcggaagagagcagtgacgatgatgagtatagtgactcttctttgggaacgtcttcttcgggaacgtcttcttcgcatctggagctttag

SEQ ID NO: 33306 - protein, 809 aa, Saccharomyces cerevisiae
MVDSIHRIASALDTAKVITREAAAVATSKLGESSYTYYSQNINPQQLVTLLNSRNSREVRDAMKRIISIMASDDDSIDVQLYFADVVKNITTNDTKVKRLIHLYLLRFAENDPNLTLLSINSLQKSLSDSNSELRCFALSALSDMKMSSLAPIILHTVKKLVTDPSAMVRGEVALAIIKLYRAGKNDYHEELLDILKELMADTDPKVISCAVLAYKECYADHLELLHGHFRRYCRIIKQLDSWSQSYLIELLIKYCKQYLPKPTVVDKSSEGSPRSCPLPDKYNEIEYPSYEVVNDPDLDLFLQSLNCLIYSSNPTVILSCCNALYQLASPLQMKNTKFIEALVRTVTMTENQGNKEMLLQAIHFLSILDQTLFLPYTKKFYVFPKDPIVASIWKIQILSTLINESNVKEIFKELKYYVASAHFPENVVIMAVKSLSRCGQLSTSWESHVMKWLIDHMESHNLSASVLDAYVNVIRMLVQKNPTKHLRIIFKLADLLTVQTSLADNARAGIVWLFGEIASIEFKICPDVLRRLIQNFSNEGPETRCQILVLSAKLLSYDIDNFKQAQVTGSEENNQNPPYYDFSGSRISQMYNAVLYLAKYDDEFDIRDRARMISSLFDSGKYEIVSLLLQAPKPTARSDDFIVSARLETHTPEIKEFFRMLPWNTEITEVGETGNDIREGAELKDYNKYKKSFSSQSFITNNSARSFTSSSNAKLTGINDGDSNSISGKGNVNTFTSQNGKKYRLQSLDEFFSDIPERKSKPRKIIKVVEESSDEDEDESEESSDDDEYSDSSLGTSSSGTSSSHLEL

SEQ ID NO: 33307 - DNA, 3276 bp, Canis familiaris
  CDS (1)..(3276)
atgtccggcaacagcttcgcttacagtgagcaggccggcggcggggaggcgacggagctgggccaggaggcgacctcgaccgtttccccctccggcgccttcggcctcttcagcagcgatttgaagaagaatgaagatctaaagcaaatgttggagagcaacaaagattctgctaaattggatgctatgaaacggattgttgggatgattgcaaaagggaaaaatgcatctgaactgtttcctgctgttgtgaagaatgtggccagtaaaaatattgagatcaagaagttagtatatgtttacctggtccggtatgctgaagaacagcaggatctggcactcttgtccataagcacttttcagcgagctctgaaggatccaaatcaactaatccgtgcaagtgctttgagagttctgtcaagtattagagtaccaattatcgtacccattatgatgcttgctattaaggaggcttctgctgatttatcaccatatgttaggaagaatgcagcccatgcaatacagaaattgtacagccttgatccagagcagaaggaaatgttaattgaagtaattgaaaaacttctaaaagataaaagcacactggtagctggcagtgttgtgatggcatttgaagaagtatgcccggatagaatagatctgattcacaagaattaccgcaagctctgtaatttactagttgatgtagaagagtggggacaagttgtcataatccacatgctaactcgatatgctcgtacacaatttgtcagtccttggaaagaggatgatggtttagaagacaatgaaaagaacttctatgaatctgatgatgaacagaaggaaaagactgaccaaaagaagaagccatatgctatggatccagaccatagacttttaattcggaatacaaagcctttgcttcagagcaggaatgcagcggtggttatggcagttgcacagctgtattggcacatatcaccaaaatctgaagttggcattatttctaaatcactagtgcgtttacttcgtagtaatagggaggtgcagtatattgtcctacagaatatagcaactatgtcaattcagagaaagggtatgcttgaaccttatctgaagagtttctatgttaggtcaactgatccaactatgatcaaaatactgaagcttgaaattttgacaaacttggcaaatgaagccaacatatcaactctgcttcgagaatttcagacctatgtgaaaagtcaggataaacagtttgcagcagccactattcaaacgataggcagatgtgcaaccagcatctcagaagtcactgacacatgcctcagtggcctggtatgtctcttatccaacagagatgaaatagttgttgctgaaagtgtggttgttattaagaaattactgcaaatgcaacctgcacaacatggtgaaattattaaacatatggctaaactcttggacagtataactgttcctgtggctagagcaagtattctttggctaattggagaaaactgtgaacgagttcctaagattgcccctgatgttttaaggaagatggctaaaagttttactaatgaagatgatctggtaaaactgcagattttaaatctgggagcaaaattgtacttaaccaactccaaacagacaaaattgcttacccagtacatattaaatctcggcaagtatgatcaaaactacgatatcagagaccgtacaagatttattaggcagcttattgttccgaatgagaagagtggagctttaagtaaatatgccaaaaaaatattcctagcgcaaaaacctgcaccactgcttgaatctccctttaaagatagggatcatttccagcttggcactttatctcatactctcaatactaaagctatcgggtacctggaattatctaattggccagaggtggcgccggacccatcagttcgaaatgtagaagtaatagagttgcaggcaaaagaatggactccagcaggaaaagcaaagaaagagaatcctgctaggaaattttattctgattctgaggaggaagaggactcttctgatagcagcagtgacagtgagagtgaatctggaagtgcaagtggagaacaagacgaagagggagacagcagtgaggacagcagtgaggactcctccagtgagcataggagtgacagtgaaagtgtgtcagaagtaggagacaaaagaacagccaagaggaactccaaaagtaaagggaaaagtgattctgaagatgaagagaaagaaaatgaaaaatctaaaacttcggattcttccagcactgattctagttcagtagaagaaagttcatcagattctgaatcagaatcagaatctgaaagtgaatctgaatccaaaaaagttactatggagaaagaaaaaaaaacaaaggaagatagaaatcttaccaaagatgtttcacttctagacctggatgattttaacccagtatccacaccagttgtacttcccacaccagctctttctccaagcttaatagctgatcttgaaggtttaaacttgtcaacttcttcatcagtcatcagtgtcaatactcctgtctttgtaccagtgaaaactcatgtgctgcttcatcgaatgagtggaagaggactagctgcccattatttctttccaagacagccttgtatttttggtgataagatggtctccatacaaataacattgaataatactactgatcgaaagatagagaatatccacatagaggggaaaaaacttcctatgggcatgcaaatgcatgtttttaatccaatagaatctcttgagcctgagggatccatcactgtttcaatgggtattgacttttgtgattccactcagactgccagtttccagttgtgtaccaaggacgattgcttcaatgttaatattcagccacctgttggagaactgcttttacctgtggccatgtcagagaaagactttaagaaagagcaagggatgctaacaggaatgaatgaaacttctactgtaatcattgctgcaccacagaatttcactccctctgtgatccttcagaaggttgtaaatatagccaatgtaggtgtagtcccttctggccaagataatatatacaggtttgcagctaaaactgtgcacagtgggtcattgatgctcgtcacagtagagctgaaggaaggctctacagcccagcttatcatcaacactgagagaaccgtgatcggttctgttctgctgcgggagttgaagcctgtcctgtcccaggggtaa

SEQ ID NO: 33308 - protein, 1091 aa, Canis familiaris
MSGNSFAYSEQAGGGEATELGQEATSTVSPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEDDGLEDNEKNFYESDDEQKEKTDQKKKPYAMDPDHRLLIRNTKPLLQSRNAAVVMAVAQLYWHISPKSEVGIISKSLVRLLRSNREVQYIVLQNIATMSIQRKGMLEPYLKSFYVRSTDPTMIKILKLEILTNLANEANISTLLREFQTYVKSQDKQFAAATIQTIGRCATSISEVTDTCLSGLVCLLSNRDEIVVAESVVVIKKLLQMQPAQHGEIIKHMAKLLDSITVPVARASILWLIGENCERVPKIAPDVLRKMAKSFTNEDDLVKLQILNLGAKLYLTNSKQTKLLTQYILNLGKYDQNYDIRDRTRFIRQLIVPNEKSGALSKYAKKIFLAQKPAPLLESPFKDRDHFQLGTLSHTLNTKAIGYLELSNWPEVAPDPSVRNVEVIELQAKEWTPAGKAKKENPARKFYSDSEEEEDSSDSSSDSESESGSASGEQDEEGDSSEDSSEDSSSEHRSDSESVSEVGDKRTAKRNSKSKGKSDSEDEEKENEKSKTSDSSSTDSSSVEESSSDSESESESESESESKKVTMEKEKKTKEDRNLTKDVSLLDLDDFNPVSTPVVLPTPALSPSLIADLEGLNLSTSSSVISVNTPVFVPVKTHVLLHRMSGRGLAAHYFFPRQPCIFGDKMVSIQITLNNTTDRKIENIHIEGKKLPMGMQMHVFNPIESLEPEGSITVSMGIDFCDSTQTASFQLCTKDDCFNVNIQPPVGELLLPVAMSEKDFKKEQGMLTGMNETSTVIIAAPQNFTPSVILQKVVNIANVGVVPSGQDNIYRFAAKTVHSGSLMLVTVELKEGSTAQLIINTERTVIGSVLLRELKPVLSQG

SEQ ID NO: 33309 - DNA, 2217 bp, Mus musculus
  CDS (1)..(2217)
atgccataccttggctctgaggacgtggtgaaggaactgaagaaggctctgtgtaaccctcatattcaggctgataggctgcgctaccggaatgtcatccagcgagttattaggcacatgactcagggcttggacatgtctgatgttttcatggaaatggtaaaggccagtgccactgtagatattgttcagaaaaagttggtttatctgtatatgggcacatacgcacctttaaaaccagatctagcactcttggccatcaatacgctctgcaaagactgctcagaccccaacccaatggttcgaggactggcactacggagtatgtgtagccccaggatgcctggtgtgcaggaatatatccagcagcctgttgttaacggtctgcgtgataaagcttcatatgtcagaagagtagcagtcctcggctgtgccaaaatgcataatcttcacggagactctgaagtggatggtgctctcgtcaatgagttgtacagtcttctgcgtgaccaggatccaattgtggttgtgaactgtctgaggtctctagaggaaattttaaagcaggaaggaggtgttgtcattaataagcccattgcccaccatctcttaaatagaatgtcaaaactggaccagtggggccaggctgaagtactgaactttctgctccgctaccaaccccgcagtgaggaggaactgtttgatattctcaatttgttggacagctatctcaagagcagcagtactggcgtggtgatgggagccaccaaactctttctgattttggcaaaaaagttcccccacgtgcagactgatgtgcttgtgcgagtcaaggggcccttgctggccgcctgctcttcagagagccgtgagctctgttttgctgctctctgccatgtccgccaggtcttgcacagtttgccaggtcactttagcagtcactacaaaaagtttttttgctcttactcggaaccccactacatcaagctccagaaggtggaggtgctgtgcgagctggtgaatgacgagaacgtgcagcaggtgctggaagagctgcgtggctactgcactgacgtggctgctgactttgcacaggctgccatcttcgccataggtagcattgccaagacttacacagatcaatgtgtgcagattctaacagagttgctgggacttcgacaagaacatatcactactgtggtcgtgcagactttccgagacctggtctggttatgccctcagtgtactgaagctgtgtgtcaggctctgcccggctgtgaggagaacattcaagacagtgaggggaaacaggcacttatttggttacttggggtccacggggaaaaaatccccaatgctccttatgtgttggaggactttgtagacaacgtgaagtcagagacatttcccgctgttaagatggagctactgaccgcactgatgcgccttgtcctctcgcgcccggctgagtgccaggacatgctgggacggctgctgcattactgcatagaggaagaaaaggatatggctgtacgggaccggggtctcttctattaccgcctcctgttagttggcattgataaagttaagcagatcctgtgtagtcctaagtctgacccttctcttggacttttggaggatcagccggaacgaccagtaaatagctgggcttcagacttcaacacactggcgccagtgtatggcagagcccactgggcaactatctctaaatgccagcaggtagagcggcatcgccttgagcttccccacaatgcatcctttgccacatcagggcacttgatttccgaggagaacaaagaaggtgcacaagaacctgattctgacactctcatgctggtccccaatctccagcttactgctgagtattttgagaagacgtggcttagcctcagagttagttaccagcaggtgtttccttggcagggagaagtccagcctgacactctacaaatggctctaaaagtagtgaacattcagaccatcgcaatgagcagagctggggcacagccctggaaagcctacctcagtgctcaggatgatactggcggccttttcttagctgaattgctactgaagcctgagaactcagagatgcaaatctctgtgaagcaaagtaaggcaaggactgaatccctgcatggttttgtttctgtcctggaaactgtgattggaacagttggagacataaaatcttaa

SEQ ID NO: 33310 - protein, 738 aa, Mus musculus
MPYLGSEDVVKELKKALCNPHIQADRLRYRNVIQRVIRHMTQGLDMSDVFMEMVKASATVDIVQKKLVYLYMGTYAPLKPDLALLAINTLCKDCSDPNPMVRGLALRSMCSPRMPGVQEYIQQPVVNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSYLKSSSTGVVMGATKLFLILAKKFPHVQTDVLVRVKGPLLAACSSESRELCFAALCHVRQVLHSLPGHFSSHYKKFFCSYSEPHYIKLQKVEVLCELVNDENVQQVLEELRGYCTDVAADFAQAAIFAIGSIAKTYTDQCVQILTELLGLRQEHITTVVVQTFRDLVWLCPQCTEAVCQALPGCEENIQDSEGKQALIWLLGVHGEKIPNAPYVLEDFVDNVKSETFPAVKMELLTALMRLVLSRPAECQDMLGRLLHYCIEEEKDMAVRDRGLFYYRLLLVGIDKVKQILCSPKSDPSLGLLEDQPERPVNSWASDFNTLAPVYGRAHWATISKCQQVERHRLELPHNASFATSGHLISEENKEGAQEPDSDTLMLVPNLQLTAEYFEKTWLSLRVSYQQVFPWQGEVQPDTLQMALKVVNIQTIAMSRAGAQPWKAYLSAQDDTGGLFLAELLLKPENSEMQISVKQSKARTESLHGFVSVLETVIGTVGDIKS

SEQ ID NO: 33311 - DNA, 2685 bp, Arabidopsis thaliana
  CDS (1)..(2685)
atgagtggtcacgattcgaaatacttctccacgacgaagaagggagagatccctgagctcaaggaagagcttaattcccagtataaggataagagaaaagatgcagttaagaaggttattgcggcgatgactgttggaaaggatgtttcatcacttttcactgatgtagtcaattgtatgcaaacggaaaatttggagttgaagaagcttgtttacttgtatctcataaattatgcgaaaagccagccagatcttgctattcttgcagtaaatacctttgtaaaggattcacaggatccaaatccgctgattcgtgctttggctgtgcggacaatgggctgcattcgtgttgataaaatcacagaatatctatgtgatcctcttcaaaagtgcctaaaggatgatgacccatatgtcaggaagactgcggctatttgcgtcgctaagcttttcgacataaatgctgaattagttgaggacagaggtttccttgaagccttgaaggatttgatatcagataacaatccaatggttgttgccaatgctgtagcagcccttgcggagattcaagagaacagtagtagccccatctttgagatcaatagtaccactcttacaaagctccttactgctctaaatgaatgcactgagtggggtcaagtttttatactagatgctttatcgaagtataaagcagctgatccccgtgaggctgaaaatattgttgagagagtaacaccaaggttgcaacatgccaactgcgctgttgttctttcagctgttaagatgatccttcaacaaatggaacttattactagtacagacgtgattagaaatctttgtaagaagatggctccaccccttgttacattgctttctgccgaacctgagatacaatatgttgcacttcgtaacattaatcttattgtgcaaaaacgacccactatccttgcccatgaaattaaggttttcttctgcaagtataacgacccaatttatgttaagatggagaagttggagattatgattaaacttgcctctgacagaaacatagaccaggttcttctggaattcaaagagtatgccacagaagtagacgttgattttgttagaaaggctgttcgtgcgataggccgatgtgctatcaaactagagagagcagctgaacggtgcatcagtgttttgctcgagttgatcaagattaaagtgaattatgttgtccaggaggccattattgtcatcaaagatatcttcagaagatatccaaacacgtatgagtccataattgcaacactctgtgagagtttagacactttggatgaaccagaagctaaggcatctatgatatggatcattggtgaatatgctgaaagaattgacaatgccgatgagcttcttgaaagctttctggagaattttcctgaggaaccagcacaggtccagttgcagctcctaactgctactgttaagctattcctgaagaagccaactgaaggccctcaacaaatgattcaggttgtcttgaataatgctactgtggagacggataatcctgatctcagagatcgtgcatacatatactggcgtcttctatccactgatcctgaggctgccaaggatgttgtcttagctgaaaagcccgtgatttctgacgactcaaaccagctagacccatcacttcttgatgagcttcttacaaatatttcgaccttgtcctctgtgtaccacaaacccccagaggcttttgttacccgcttgaaaacgacagttcagaaaacagaagacgaggactttgcggaaggaagcgaagcaggatactcatctagtaatccggttgatagtgcagcttctcctccaggtaatatcccacagccttccggaagacaaccagcaccagcggtcccagctcctgtacctgatctgctaggtgacctgatgggattggataatgccgctattgtcccggttgatgatcccataactcaatctggtcctcctctgcccgttgtcgtcccagcttcaagtggtcaaggtctgcagataagcgctcaattatcccgaaaagatggacaagtattttacagtatgctcttcgagaacaactcgcagtcggttcttgatggtttcatgattcagttcaacaaaaacacattcggccttgcagctgctggatctcttcagattccgcctttgcatcccgcaacatccgccaggacaatgctacctatggtcttgttccaaaacatgtctgctgggcctccaagctcgctcttacaagtcgctgtcaaaaacaaccagcagcccgtgtggtacttcaccgataagattatacttcatgctcttttcggtgaagacggtagaatggaacgtggaaccttccttgagacatggaggtcgttaccggactcaaatgaagtcctgaaagaattccccgggatcaccatcacgagcgtcgaatcaactatcgaattgctcacagcattcaacatgttctttatagcaaagcgcaagaacgggaaccaagacgtgatctacttatcagccaaagatccacgagatgtaccgtttttgatcgagctcactgcaatggtgggccaaccaggtctcaaatgcgcagtgaaaactcccactcccgagattgcgcctctcttcttcgaagctttggagcttctcttcaaggcttga

SEQ ID NO: 33312 - protein, 894 aa, Arabidopsis thaliana
MSGHDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQKCLKDDDPYVRKTAAICVAKLFDINAELVEDRGFLEALKDLISDNNPMVVANAVAALAEIQENSSSPIFEINSTTLTKLLTALNECTEWGQVFILDALSKYKAADPREAENIVERVTPRLQHANCAVVLSAVKMILQQMELITSTDVIRNLCKKMAPPLVTLLSAEPEIQYVALRNINLIVQKRPTILAHEIKVFFCKYNDPIYVKMEKLEIMIKLASDRNIDQVLLEFKEYATEVDVDFVRKAVRAIGRCAIKLERAAERCISVLLELIKIKVNYVVQEAIIVIKDIFRRYPNTYESIIATLCESLDTLDEPEAKASMIWIIGEYAERIDNADELLESFLENFPEEPAQVQLQLLTATVKLFLKKPTEGPQQMIQVVLNNATVETDNPDLRDRAYIYWRLLSTDPEAAKDVVLAEKPVISDDSNQLDPSLLDELLTNISTLSSVYHKPPEAFVTRLKTTVQKTEDEDFAEGSEAGYSSSNPVDSAASPPGNIPQPSGRQPAPAVPAPVPDLLGDLMGLDNAAIVPVDDPITQSGPPLPVVVPASSGQGLQISAQLSRKDGQVFYSMLFENNSQSVLDGFMIQFNKNTFGLAAAGSLQIPPLHPATSARTMLPMVLFQNMSAGPPSSLLQVAVKNNQQPVWYFTDKIILHALFGEDGRMERGTFLETWRSLPDSNEVLKEFPGITITSVESTIELLTAFNMFFIAKRKNGNQDVIYLSAKDPRDVPFLIELTAMVGQPGLKCAVKTPTPEIAPLFFEALELLFKA

SEQ ID NO: 33313 - DNA, 2682 bp, Arabidopsis thaliana
  CDS (1)..(2682)
atgagcggtcatgattctaaatatttttcgactacgaagaagggagagatccctgagctcaaggaagagctgaattcacagtacaaggataagaggaaagatgctgttaagaaggttattgcggcaatgactgttggaaaggatgtttcatcacttttcactgatgtagtcaattgcatgcaaactgagaatctggagttgaagaagcttgtttacttgtatctgataaactatgcaaaaagccagccagatcttgctatcctcgctgtaaatacttttgttaaggattcacaagacccaaatccattgatccgggctttggctgtgcgaacgatgggctgtattcgtgttgataagattacagaatatttgtgtgatcctcttcagaaatgcctaaaggatgatgatccatatgtccgcaagacagcagctatttgtgttgctaaactgtttgacataaatgctgaattagttgaggatagggggttcctggaagccttaaaggatttaatatcagacaataatccaatggttgtggcaaatgctgtagctgcccttgcagagatccaagagaatagtactagtcccatatttgaaatcaatagtaccatcctcacaaagctccttacagctttgaatgaatgtactgaatggggtcaagtttttatattagatgctttgtcgaggtataaggcatctgatcctcgtgaagctgaaaatattgttgagagagtcactccaaggttgcaacatgccaactgtgctgttgtgctttcagctgttaagatgatccttcagcagatggagcttattactagcacagatgtgattcgaaatctttgcaagaagatggctcctcccctagttacattgctttctgcagaacctgagatacagtatgttgcacttcgtaacattaaccttattgtccaaaagagacccactattcttgcccatgaaatcaaggtgttcttctgcaagtataatgatccgatatatgttaagatggagaagttagagattatgataaaacttgcttctgacagaaacatagaccaggttcttctggagttcaaagaatatgccacggaagtagatgttgattttgttcggaaggctgttcgtgctataggccgatgtgccatcaaactagaaagagcagctgaacggtgcatcagtgttttacttgagctgatcaagatcaaagtaaactacgttgtgcaggaggccattatagtcatcaaagatatctttagaagatatccaaatacgtatgagtccataatcgcaacactctgtgagagtctagacacattggatgaaccagaagctaaggcatctatgatttggatcattggtgaatatgctgaaagaatcgacaatgcggatgaacttcttgaaagcttcctggagaatttccctgaggaaccagcacaagtccaactgcagcttcttacagctacagtcaaactatttctgaagaagccaactgaaggcccacaacaaatgattcaggttgtcttgaataatgctactgttgaaacagataatcctgatctcagggatcgtgcatacatctactggcgtcttctatcgactgatcctgaggcggccaaggatgttgttttagctgaaaagcctgtgattactgatgactcaaaccaacttgatccgtcgctcctggatgagctacttgcaaatatatccaccttgtcctctgtgtatcacaagccgccagaggcttttgtaacccgcttgaaaaccacagttcagaaaacggaggatgaggattatgtagaagggagcgaaacaggatatcccgaggcatctggtaatccggttgatggtgcagcttccccgtcagctaccacaggctatgtcacaaagctagctgctgccccagctcctgtacccgatctgctaggtgacctaatggggtcagataatgctgcaatcgtccctgtagatgaacccacaactccgtcaggtcgtccactgcctgttgtcctaccagcatcaaagggtcaaggtctgcagattagcgctcaattaacccgacaagatggtcaagtattctacagtatgctcctcgagaacaactcgcagtcacttcttgatggcttcatgattcagttcaacaaaaactcattcggccttgcagctgtcggatcacttcaggttccgcctctgcaacccggagcatctgccaggacaatgatgccaatggtattgtcccaaaacatgtctactggctccaccagctcggtattgcaagttgccgtcaaaaacaaccagcagcctgtctggtacttcgaggataagattgtacttaacgctcttttctcagaagatggtcggatggagcgcggaaccttcctcgagacatggaaatcgttaccggattcaaacgaggtgcagaaagaattccccgggataaccatcacgagcgtggagtcaacacttgatttactcgccgcatcaaacatgttcttcatagcaaagcgtaagaatgggaaccaagacgtcctctatctttcggccaaggtaccaagaggcataccgttcctgatcgaactaacggccatagtgggtcaacctggtctgaaatgtgcagtcaagactccaacccctgagatcgctcctctcttctttgaagcagtcgaaattctcttcaaggcttga

SEQ ID NO: 33314 - protein, 893 aa, Arabidopsis thaliana
MSGHDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQKCLKDDDPYVRKTAAICVAKLFDINAELVEDRGFLEALKDLISDNNPMVVANAVAALAEIQENSTSPIFEINSTILTKLLTALNECTEWGQVFILDALSRYKASDPREAENIVERVTPRLQHANCAVVLSAVKMILQQMELITSTDVIRNLCKKMAPPLVTLLSAEPEIQYVALRNINLIVQKRPTILAHEIKVFFCKYNDPIYVKMEKLEIMIKLASDRNIDQVLLEFKEYATEVDVDFVRKAVRAIGRCAIKLERAAERCISVLLELIKIKVNYVVQEAIIVIKDIFRRYPNTYESIIATLCESLDTLDEPEAKASMIWIIGEYAERIDNADELLESFLENFPEEPAQVQLQLLTATVKLFLKKPTEGPQQMIQVVLNNATVETDNPDLRDRAYIYWRLLSTDPEAAKDVVLAEKPVITDDSNQLDPSLLDELLANISTLSSVYHKPPEAFVTRLKTTVQKTEDEDYVEGSETGYPEASGNPVDGAASPSATTGYVTKLAAAPAPVPDLLGDLMGSDNAAIVPVDEPTTPSGRPLPVVLPASKGQGLQISAQLTRQDGQVFYSMLLENNSQSLLDGFMIQFNKNSFGLAAVGSLQVPPLQPGASARTMMPMVLSQNMSTGSTSSVLQVAVKNNQQPVWYFEDKIVLNALFSEDGRMERGTFLETWKSLPDSNEVQKEFPGITITSVESTLDLLAASNMFFIAKRKNGNQDVLYLSAKVPRGIPFLIELTAIVGQPGLKCAVKTPTPEIAPLFFEAVEILFKA

SEQ ID NO: 33315 - DNA, 2526 bp, Arabidopsis thaliana
  CDS (1)..(2526)
atggctcctccggccgcttcacagcgttatccgtcaccgtcccaaccttcagggaaaagcgaagtgtcagatctgaaaacccagcttcgccagctagctggaagcagagctccaggagttgatgattccaaacgtgacctctacaagaaagtaatatcgtacatgactattggcattgacgtctcatctgtatttggagagatggtcatgtgctcggcaacatcagacattgtcctgaagaagatgtgttatctttacgttggaaactatgcaaagggcaatcctgatctttctcttttgacgattaattttctgcaaagggattgcaaagatgaggaccctatgatccgtgggcttgcattgaggagcttgtgttctttacgagtgccaaaccttgtggagtatctggttggtcccttggggagcgggctcaaggacaataatagctatgttagaactatcgctgttactggagtactaaagctttatcacatctcaccctcaacatgcattgatgccgattttcctgcaacgttgaaaagtttgatgcttcatgattcagatgctcaggtagttgccaattgcctgtctgcacttcaagaaatttggagtttagaagcaagccactctgaggaagcatgccgggaaaaggagtccttgctcagcaagccagttatatattatttcttgaatcggatcaaggaattcaatgaatgggcacaatgtcttatacttgagttggcagtaaaatatgtgccgtcagatagtaatgatatttttgacattatgaatctgttggaagacagactgcagcatgccaatggagctgttgtcttggcaacagtcaaagtgtttttacaattaactctctccatgactgatgttcatcaacaggtatatgagcgtattaaatccccacttctaactcttgtcagttctggaagtccagagcaatcgtatgcaatcttgagccaccttcatcttttggttgttcgtgcgccattcatctttgctgcagactataagcatttctactgccagtacaatgaaccatcatatgtcaaaaagttgaagcttgagatgttgactgctgttgcaaacgagagcaacacttacgaaatcgtgacggaactgtgtgagtatgctgcaaacgttgatattgcaattgcgagagagtcaattcgagcagttggaaagattgctttgcaacagtatgatgtaaatgcgattgttgatagacttcttcaatttctggagatggaaaaggactatgtgaccgctgaaactttggttcttgtaaaggaccttctaaggaagtatccacaatggagccatgactgcatttctgttgttgggggtatcagcagcaaaaatatccaggaaccgaaagccaaggcggctcttatatggatgttgggtgagtatgcacaggacatgagtgatgctccttatgttttggagaatctgatagaaaactgggaggaagagcattcagccgaggttcggttacatctcttaactgcggcaatgaaatgctttttcaagagggcacctgagactcagaaagccctaggaacagctctagctgcaggcattgctgattttcaccaggatgttcatgaccgagccttgttctactatcgggttctgcaatacgatgtacacgtggcagaacgtgttgttagtcctccaaaacaggcggtttcagtctttgctgacactcaaagcagtgaaatcaaagaccgtgtatttgacgagtttaacagcctttctgtgatataccagaagccatcttacatgtttacggataaggaacaccgaggaccctttgagttttctgacgaagttggaaatatttccatcacacctgaagcctccagcgacattgttccagctcagcaatatgaggcaaatgacaaggacctgcttctaggtattgacgagaaggatgaaaataaaggagtttccaataacaatggttctgcttacacggccccttcattagaaagctcctctaatataacctcacaaatgcaagagcttgcaatctccggccctgccacatccgcaactaccccacaatcatttggttttgatgatctctttggtttgggtttatcaaccgctcctgctccaacaccatcaccgcctcttttgaaacttaacgcaagagctgctttagatccaggcgccttccaacaaaaatggcgccaattgccaatatcactaacacaggagtgttctgtgaatccccagggaatcgcggccttaacagttccacaatcacttatcaaacacatgcagagtcattccattcactgtatcgcatcgggcggtcaatctccaaacttcaagttcttctttttcgctcaaaaggaatcagaaccatcgaactatctcactgagtgtatcataaacacttcatcagccaaagctcagataaaagtgaaagcagacgagcagagtacgtgtcaagcattcacaaccgtatttgaaacagccttgtccaaatttggtatgccttga

SEQ ID NO: 33316 - protein, 841 aa, Arabidopsis thaliana
MAPPAASQRYPSPSQPSGKSEVSDLKTQLRQLAGSRAPGVDDSKRDLYKKVISYMTIGIDVSSVFGEMVMCSATSDIVLKKMCYLYVGNYAKGNPDLSLLTINFLQRDCKDEDPMIRGLALRSLCSLRVPNLVEYLVGPLGSGLKDNNSYVRTIAVTGVLKLYHISPSTCIDADFPATLKSLMLHDSDAQVVANCLSALQEIWSLEASHSEEACREKESLLSKPVIYYFLNRIKEFNEWAQCLILELAVKYVPSDSNDIFDIMNLLEDRLQHANGAVVLATVKVFLQLTLSMTDVHQQVYERIKSPLLTLVSSGSPEQSYAILSHLHLLVVRAPFIFAADYKHFYCQYNEPSYVKKLKLEMLTAVANESNTYEIVTELCEYAANVDIAIARESIRAVGKIALQQYDVNAIVDRLLQFLEMEKDYVTAETLVLVKDLLRKYPQWSHDCISVVGGISSKNIQEPKAKAALIWMLGEYAQDMSDAPYVLENLIENWEEEHSAEVRLHLLTAAMKCFFKRAPETQKALGTALAAGIADFHQDVHDRALFYYRVLQYDVHVAERVVSPPKQAVSVFADTQSSEIKDRVFDEFNSLSVIYQKPSYMFTDKEHRGPFEFSDEVGNISITPEASSDIVPAQQYEANDKDLLLGIDEKDENKGVSNNNGSAYTAPSLESSSNITSQMQELAISGPATSATTPQSFGFDDLFGLGLSTAPAPTPSPPLLKLNARAALDPGAFQQKWRQLPISLTQECSVNPQGIAALTVPQSLIKHMQSHSIHCIASGGQSPNFKFFFFAQKESEPSNYLTECIINTSSAKAQIKVKADEQSTCQAFTTVFETALSKFGMP

SEQ ID NO: 33317 - DNA, 2691 bp, Caenorhabditis elegans
  CDS (1)..(2691)
atggaaattgctgagggcggagtcatcttggataataggacacgattcgctgacctaaaagccatgctggatagtaataaagataacctaaaagttgatgcaatgaaacgaataattaacctgatagcgaaaggaaaagatgtcagtgaactatttgctgcagttgtgaagaacgtagcagcaaaaaatgtggagctgaaaaagttggtatttgtttatcttgtacgatatgccgaagaacaacaagatcttgcacttctctcgatatcaactttccaacgggctctcaaagatccgaatcaactgattcgtggaagtgctctccgagttttaacatcaatccgtgttccgatggtcgcaccaatcatgcttttagccatcaaagatgcagtacgtgatatgagtccatacgtgaggaaagttgctgcacatgccataccaaaactatactcactggaacctgaactcgaacctcagcttgtcgattgcatagattttcttctcgctgatcgaagaagtttagtactcggtagtgctgtttacgcatttgatgagatctgtccacaccgactcgatcttcttcataaacacttcagagcattatgtcgtggtttggcagatgtcgacgaatggggtcaaattgtgatgatcaacatgttgactagatatgcaagacatgaattggcggatccagatagaggaccacccgatacggatgttgtacttcttctcaactcagctcgtcctctacttcaatcaagaaattgttcagttgtcatggcagtcgtacaattattttatcatgttgcgccgaaagctcaactctctcagatcgcccgtgcacttgtccgacttctacgtggtccacgggagacccaatacgtagttctcaccaacattgcaacaatatgcgaacgaaatccgacgatgttcgacccgttcctaaaatcattcttcgtacgatcctgtgacagttctctcgttaagaaactaaaacttcatgtgctcacaagtttggtttcagaagcgaatgttcatatcattttgagagagttacagacctatgttcatatgtctgatttagcttctccagctgttgaggcaattggaagatgtgcagttcgcgtcggagcagtatcagatcaatgtatgactggacttgtccaattgatttcttcttccgatgagaaagtcgtatgctctgctgtagttgtcatcaagagacttttgcatgcttctgcccctctgaatcttctttcaaggcttatgaggctcatgccgaatatgattgcagcacaagcgcgagcttgtgtcatttggctcgtcgccacccatgtcgaacaagttctacacatggctccagactttttgaggcttattgcaaagaaattttcgacggaaaatgagctggttaaactagaagctctgaaacttgcagtgaagttgtggcttgtgaagcgtgatgactctgaaaagattgtacaatacgtattccaacttgcccgattcgatctcagttatgacgttcgtgatcgatgccgatttttacggaatctaatgttcaatacggagattctttcacagcatatggaagagattttcatgtcgaaaaagccagcaccagagcttattagtagtttcaaggaaccaacatcaagtgattcgttattaagaaaagaagcacatgcaccgaatgaattgaaattggatgatagtgacgaagaagaagatgatgatgatgaagatgaagaagaagacgaagatgaagaagaggaggatgaagatgaagaagatgaggaagaggaagaaaatgaatcagaagaagaagaggaagatgatgaggatgaagaaagtgaagaggaatctgatgaagaagatgaagaggaggaagaagaggatgatagtgagccagaggagaagcctaacccaaaaccatctactaagaaacaagcactcattctcaataaatcaaaaccaatgaatggtaagccaaaaacagaaagaaatgatctcgatttgctgattgacgttgatttctcggccgcgggaagtcgtcaaataatggatgcaactcatatcgaagaaaaagaaattgaacttttgaatgtaattgaaggaaacgggctaatattatcaattagttatccgcgtattaatgatggacaatacacggctattcgatttggaatcacaaacaaaaccgatggagatttgttaggagttgaattaaaaactgaagaaggtctcgatgtgaagggaaactcgattattggagatattccgtctggagcacgagtttctgttgatttgctcgtagattttggagatagtgcgacaagtagagaatggatacttacaagagatgatggtcatgagaagcatttcagatttgaggtcccatatggtgagcaagttcaaccaattcgtctgtctccagaagatatttcaaaagaaagaagtcgtcttggaggtctcaatcggcatgtgatacaactcgaaaatcccattaatccttcgtcaattgctctatttgttaacgcattttcttcggatttgaccattttcacttgccagacacgttcacgaaaggatgtttgtattctgacagtttcagaaaaatcgattgagtgctgttgtgacaactcggtgataggacgaatgctggcgttctctgtctccaaaaattgctag

SEQ ID NO: 33318 - protein, 896 aa, Caenorhabditis elegans
MEIAEGGVILDNRTRFADLKAMLDSNKDNLKVDAMKRIINLIAKGKDVSELFAAVVKNVAAKNVELKKLVFVYLVRYAEEQQDLALLSISTFQRALKDPNQLIRGSALRVLTSIRVPMVAPIMLLAIKDAVRDMSPYVRKVAAHAIPKLYSLEPELEPQLVDCIDFLLADRRSLVLGSAVYAFDEICPHRLDLLHKHFRALCRGLADVDEWGQIVMINMLTRYARHELADPDRGPPDTDVVLLLNSARPLLQSRNCSVVMAVVQLFYHVAPKAQLSQIARALVRLLRGPRETQYVVLTNIATICERNPTMFDPFLKSFFVRSCDSSLVKKLKLHVLTSLVSEANVHIILRELQTYVHMSDLASPAVEAIGRCAVRVGAVSDQCMTGLVQLISSSDEKVVCSAVVVIKRLLHASAPLNLLSRLMRLMPNMIAAQARACVIWLVATHVEQVLHMAPDFLRLIAKKFSTENELVKLEALKLAVKLWLVKRDDSEKIVQYVFQLARFDLSYDVRDRCRFLRNLMFNTEILSQHMEEIFMSKKPAPELISSFKEPTSSDSLLRKEAHAPNELKLDDSDEEEDDDDEDEEEDEDEEEEDEDEEDEEEEENESEEEEEDDEDEESEEESDEEDEEEEEEDDSEPEEKPNPKPSTKKQALILNKSKPMNGKPKTERNDLDLLIDVDFSAAGSRQIMDATHIEEKEIELLNVIEGNGLILSISYPRINDGQYTAIRFGITNKTDGDLLGVELKTEEGLDVKGNSIIGDIPSGARVSVDLLVDFGDSATSREWILTRDDGHEKHFRFEVPYGEQVQPIRLSPEDISKERSRLGGLNRHVIQLENPINPSSIALFVNAFSSDLTIFTCQTRSRKDVCILTVSEKSIECCCDNSVIGRMLAFSVSKNC

SEQ ID NO: 33319 - DNA, 2766 bp, Drosophila melanogaster
  CDS (1)..(2766)
atgactgattccaagtacttcaccaccaccaagaagggcgagatcttcgagctcaagtcggagctgaataacgacaagaaggagaagaagaaggaggcggtgaagaaggtgatcgccagcatgaccgtgggcaaagacgtgtccgccctcttcccggacgtggtcaactgcatgcagacggacaacctggagctgaagaagctggtctacctttatctgatgaactacgccaaatcgcagccggacatggccatcatggcggttaatacgttcgtgaaggactgcgaggactccaatccgcttatccgggcgctggccgtgcgcaccatgggctgcattcgggtggacaagatcaccgagtacctgtgcgagccgctgcgcaagtgcctgaaggacgaggatccgtatgtgcgcaagacggccgcagtgtgcgtggccaagctgtacgacatttcagccacaatggtggaggaccaaggctttctggaccaactgaaggatctgctatctgactcgaatcccatggtggtggccaatgcggtggccgctcttagcgagattaacgaggcaagtcagtccggccagcccctcgtggagatgaactcggtcaccattaacaagctgctgacggcgctcaacgagtgcaccgagtggggccaggtctttatcctggactcgctggccaactacagcccgaaggatgagcgcgaggcgcagtccatctgcgagcgaatcactccgcgtctggctcacgccaacgccgccgtcgttttgagcgccgtcaaggtgctgatgaagttgctcgagatgctgtccagcgacagcgacttttgcgccacgctcaccaagaagctggctccgccattggttacgttgctctcctcagagccggaggtgcagtatgtggccctgcgcaacatcaatctgattgtccagaagcggccagacattctcaagcacgaaatgaaggtgttcttcgtgaaatacaacgatcccatttacgtgaaactggagaagctagacattatgatccgcctggccaaccagagcaacatcgcccaggtgcttagcgagctgaaggagtacgccaccgaggtggacgtggattttgtgcgcaaggcagtccgcgccatcgggcgatgcgccattaaggtggagccctcagccgaacgctgcgtgtccacgctgcttgatcttatccagaccaaggtcaactacgtggtgcaggaggccattgtggtcatcaaggacatcttccgcaagtaccccaacaagtacgagagcattatcagcacgctgtgcgagaatctggacactctggacgagccggaggcacgcgcatcaatggtttggatcattggcgagtacgcagagcgcattgacaacgcggacgagctgcttgacagcttccttgaaggattccaggatgaaaatgcacaggtgcagttgcagctgctgacggccgtggttaagttgttcctcaagcgcccgtcggacacccaggagctggtgcagcacgtactatcattggctacccaggattcggacaaccccgatctgcgtgaccgtggcttcatctactggcgtctcctgtccacggacccggccgccgccaaggaggtggtgctggccgataagccactcatctcagaggagaccgaccttttggagccgacattgctggacgagctcatctgccacattagctcgctggccagcgtttatcataagcctcccaccgcgttcgtggagggtcgcggagccggtgtgcgcaagtcgctgcccaaccgagccgctggatctgcagctggtgcagagcaagcagaaaacgcagccggctcagaggcaatggtcattcccaaccaggagtcgctcattggagatctgctctccatggatatcaacgcacccgccatgccatctgctccggccgccaccagcaatgtggaccttctgggcggcggtcttgatatactcctcggtggaccgccagcagaggcggctcccggcggtgccaccagcctgctaggcgacatttttggactgggcggagcaacgctatcggtgggtgttcagattcccaaggtcacatggctgccagcggagaagggcaagggactcgaaatacaaggaacgttctcacgccgcaacggcgaggtgttcatggacatgactctgaccaacaaagccatgcagccgatgactaacttcgccatccaactgaacaagaacagcttcggcctggtgcccgcgtcgcccatgcaggctgctccccttccacccaaccaatcgatcgaggtcagcatggccttgggcaccaacggacccattcagcgcatggagccgctcaacaacttgcaggtggccgtgaagaacaacatcgacatcttctacttcgcgtgcctggtgcacggcaacgtgctgttcgccgaggatgggcagttggacaagcgcgtgttcctcaacacctggaaggagatccccgccgccaacgaactgcagtacaccctgagcggtgtaattggcactaccgacggcatcgcctccaagatgaccaccaacaacatcttcaccatcgccaagcgtaacgtcgagggccaggacatgctctaccagtcactcaagctgaccaacaacatttgggtgctgctggagctaaagctgcagccgggcaatccggaagccactctcagcctcaaatcgcgctccgtggaggtggccaacataatcttcgccgcctacgaggccatcatccgttctccataa

SEQ ID NO: 33320 - protein, 921 aa, Drosophila melanogaster
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDSNPLIRALAVRTMGCIRVDKITEYLCEPLRKCLKDEDPYVRKTAAVCVAKLYDISATMVEDQGFLDQLKDLLSDSNPMVVANAVAALSEINEASQSGQPLVEMNSVTINKLLTALNECTEWGQVFILDSLANYSPKDEREAQSICERITPRLAHANAAVVLSAVKVLMKLLEMLSSDSDFCATLTKKLAPPLVTLLSSEPEVQYVALRNINLIVQKRPDILKHEMKVFFVKYNDPIYVKLEKLDIMIRLANQSNIAQVLSELKEYATEVDVDFVRKAVRAIGRCAIKVEPSAERCVSTLLDLIQTKVNYVVQEAIVVIKDIFRKYPNKYESIISTLCENLDTLDEPEARASMVWIIGEYAERIDNADELLDSFLEGFQDENAQVQLQLLTAVVKLFLKRPSDTQELVQHVLSLATQDSDNPDLRDRGFIYWRLLSTDPAAAKEVVLADKPLISEETDLLEPTLLDELICHISSLASVYHKPPTAFVEGRGAGVRKSLPNRAAGSAAGAEQAENAAGSEAMVIPNQESLIGDLLSMDINAPAMPSAPAATSNVDLLGGGLDILLGGPPAEAAPGGATSLLGDIFGLGGATLSVGVQIPKVTWLPAEKGKGLEIQGTFSRRNGEVFMDMTLTNKAMQPMTNFAIQLNKNSFGLVPASPMQAAPLPPNQSIEVSMALGTNGPIQRMEPLNNLQVAVKNNIDIFYFACLVHGNVLFAEDGQLDKRVFLNTWKEIPAANELQYTLSGVIGTTDGIASKMTTNNIFTIAKRNVEGQDMLYQSLKLTNNIWVLLELKLQPGNPEATLSLKSRSVEVANIIFAAYEAIIRSP

SEQ ID NO: 33321 - DNA, 3483 bp, Drosophila melanogaster
  CDS (1)..(3483)
atgcagcagaactcggccagcaatcccttcgccatgtccacatatgtggagcggccccaaatgggactggacgtcgaattcggagcggatcctgccagcggagcagctttcttccaatccgatggacgcaagcatgatgatctcaagcaaatgttggacagcaacaaggatggactaaagctggaggccatgaagcgcatcattggcatgattgcccgcggacgggatgccagtgatctgttcccggcagtcgtcaagaatgtggtgtccaagaatatcgaggtcaagaagttggtctacgtctatttggtgcgatacgccgaggagcagcaggacttggccctgctatccatttccacatttcagagggcgctcaaggatcccaatcaacttattcgcgcctcggctctgcgagtgttatcctccataagggtcagcatgattgtgccaatcgtaatgctggccattcgggatagcgccgccgatttgagtccatatgtgcggaaaacagcggcacatgccatccccaagttgtattctctggacgcggatcaaaaggatgaactggtcatggtcattgagaagcttttatcggatcgcactactctagtggtgggatcagcggtgatggccttcgacgaggtttgtccggaacgtgtagatttgatacacaagaactaccgcaagctgtgcaatttcctgctggatgtggacgaatggggtcaggtgatcatcattaatatgttgacccgctatgcgcgcactcagttcgttgatcccaatgcggatgatgaggatctggtcaacgatggcctgggcgaaacgcccgttagtgaacgcttctacgacgaatcctcgcactcctcttcccacagcgatgatggcagtagcgatgacgaaaaaaacaagtcgagtacgaacaataaaaacaatggcggaggaaatggcagtagaacacccagttctccgagcaacagctaccacatcgatgtggatcaccgcctgctgttgaggcaaacgaaaccattgctccaatcgcgaaatgcctccgtggtgatggcagtggcgcagctctatcatcatgtggctcccaagaacgaagtgcaattgattgccaaggcgctgatacgactgctgcgatcgcataaggaggttcagagcgtggtcctcaattgcattgcctcgatgtccaccaaacgaaaggcgatctttgagccgcacctcaagtcgttctttgtgcgcaccagcgatcccacgcacataaagcttctcaagctggatattctcaccaatctggcctcggcgggcagtatttcgctcattctgcgcgaatttcaaacctacatctccagcagcgatcgttcgtttgtggcggccacgattcaggccattggacgatgtgcatctagcattaaggaggttaccgagacctgcttgagtggcctggttcatctgctgtccaatcatgacgaacacgtggtggccgagagcgtggtggtgattaagcgtcttctgcaaacgaaagccgccgagcactttgagattatcacccaaatggccaaactgatcgattatatcaatgtgcccgcagctagggcagccatcatttggcttataggcgaatacaacgagaaggtgccgctgattgccccggatgtgctgcgcaaaatggccaaatcgtttgtcgatgagcaggatgtggtgaagctgcaggtcctaaacttaggcgttaagctctatctgaccaatccggagcagacatcgttgctgtgtcagtacgtctttacgctggctcgctatgatcccaactacgatgtacgcgatcgtgcccgttttctgcggcaaatcatctttccggcgagcggaacgagctcggtgctcagccagcatgcccgccaagtatttctcgccagcaaaccggctccggtgccggagagtaaataccgggatggcaataacttccagttaggatcgttgtctcactacctgaacatgccagcggctggctacaaggaactgcccgcctttccggtgattccaccggattcatcggtacgcaatatagctggatttatgcaggacaagctgccgggtgaagactcgccatccggacattcaaaggataaatccggccgtgaaggcggtaaggaaaagggtgctggtggcgagaagggcttcctctctgagtcggacgacaagtcttccgcttactcggaatcaggcagcagcagtggcagtggcaccagcgacagtgaatccgatagcgatggcagcgggagcagcgatgaggaggaggaggaggtgcaaaagcagcagccgaccaaggtttcctcggtgaaggagcggcttatcgatgctggaagcaatgagctggccgctacttcttcgcctgtaaaagcaactataaacaacaataacaatgcgagaggttcgtcaggaacatcggacagcgaggattcatcagcgtacagtggcagtagtagtgatgacagcgcttccggtagcgataatgaagtgaaaaagaacgaaacgaaaacggacacaggcacaaagccggagaagttgaaagagaagcacgagaaacagccggagcaaacggctgtcaagagcaatctggacctgctactcgatctggatgacattccgcccattggtcccgtgatgacgccctcgttgggaggattcctgacgcctggcacaccaatgatggctggacaggcggcgccactgcagccgcagcacgcccgcaatcgggtggaattggtgggtccctcgcacatcgagttcaagcacaaggagctgcttaacaaggtcagtggccatggactgcatttggcctaccgtttcacccgctccccgcatctgtactcctcgagcatgtgctccattgagctgcagttccagaatcgtggcgaaaaagagattacggccattcgtctcgggcaaacaactctgccggcgggcatgcaattgaatgagtttgcgccaatcactgttctccagccccaacaaacagcgagtggtgtgctgggcgtcgatttcaatgattcgacgcatgctgtagacctggagcttctgtcaagtgcgggcagttcacgactgcaattgaaaccgccggtgggcgagctggtgagatccgtccagatcggcgagagctgtcatcgcgaggagcgggccaagctgcgtggaatgaatgagcatcagtgcgagttgcgtggcctgaggcaggacctaatcgatgtggtcgcattgcggcaaaaggttttcgagtccatcaacgtggcgcatacgcacagctcttccagcggtcagctacactgtttcgccggccaaaccctgagctccaaaagcctcgtgctactcaccctcgattggaaaacagaggatgccctcacgctgctggtaaactgcgagaaaatggtcattggatccatggtgctcaacgagctgcgcaatgctctgcagctcagtttcgccatgtga

SEQ ID NO: 33322 - protein, 1160 aa, Drosophila melanogaster
MQQNSASNPFAMSTYVERPQMGLDVEFGADPASGAAFFQSDGRKHDDLKQMLDSNKDGLKLEAMKRIIGMIARGRDASDLFPAVVKNVVSKNIEVKKLVYVYLVRYAEEQQDLALLSISTFQRALKDPNQLIRASALRVLSSIRVSMIVPIVMLAIRDSAADLSPYVRKTAAHAIPKLYSLDADQKDELVMVIEKLLSDRTTLVVGSAVMAFDEVCPERVDLIHKNYRKLCNFLLDVDEWGQVIIINMLTRYARTQFVDPNADDEDLVNDGLGETPVSERFYDESSHSSSHSDDGSSDDEKNKSSTNNKNNGGGNGSRTPSSPSNSYHIDVDHRLLLRQTKPLLQSRNASVVMAVAQLYHHVAPKNEVQLIAKALIRLLRSHKEVQSVVLNCIASMSTKRKAIFEPHLKSFFVRTSDPTHIKLLKLDILTNLASAGSISLILREFQTYISSSDRSFVAATIQAIGRCASSIKEVTETCLSGLVHLLSNHDEHVVAESVVVIKRLLQTKAAEHFEIITQMAKLIDYINVPAARAAIIWLIGEYNEKVPLIAPDVLRKMAKSFVDEQDVVKLQVLNLGVKLYLTNPEQTSLLCQYVFTLARYDPNYDVRDRARFLRQIIFPASGTSSVLSQHARQVFLASKPAPVPESKYRDGNNFQLGSLSHYLNMPAAGYKELPAFPVIPPDSSVRNIAGFMQDKLPGEDSPSGHSKDKSGREGGKEKGAGGEKGFLSESDDKSSAYSESGSSSGSGTSDSESDSDGSGSSDEEEEEVQKQQPTKVSSVKERLIDAGSNELAATSSPVKATINNNNNARGSSGTSDSEDSSAYSGSSSDDSASGSDNEVKKNETKTDTGTKPEKLKEKHEKQPEQTAVKSNLDLLLDLDDIPPIGPVMTPSLGGFLTPGTPMMAGQAAPLQPQHARNRVELVGPSHIEFKHKELLNKVSGHGLHLAYRFTRSPHLYSSSMCSIELQFQNRGEKEITAIRLGQTTLPAGMQLNEFAPITVLQPQQTASGVLGVDFNDSTHAVDLELLSSAGSSRLQLKPPVGELVRSVQIGESCHREERAKLRGMNEHQCELRGLRQDLIDVVALRQKVFESINVAHTHSSSSGQLHCFAGQTLSSKSLVLLTLDWKTEDALTLLVNCEKMVIGSMVLNELRNALQLSFAM

SEQ ID NO: 33323 - DNA, 2964 bp, Arabidopsis thaliana
  CDS (1)..(2964)
atggctgggattcgcttacatgttattgcacctcttgcacttgcagctgtgagtaaatgtgctagagatccagctgtttatgttcggagatgtgctgcaaacgctcttccgaagttgcatgatttgcggctggaagaacatgcttctgcgattgaagagctagttgggatactgttgaatgaccattctccaggagtagttggagctgcggcagcggcattcacctctatctgtccaaataacttcaaactgattgggaagaactataagaagttgtgccagattctccctgacgttgaagagtggggtcagatattactcataggaactcttttgcgctatgtggttgctaggcatggacttgtacgggaatctttgatgttgtccatacatggtacgaatagtaatggcttctgtgagaaggatggcctaggcagagatcttacattggataaagaagatggtggtaaaagtgattcatttgatgttaatctggtcagtcttgtatctaaatgttacattcaaggtccagatgagtatctatcaagatccagttgcaccgatacagtgtcatctgctttcgataccaaagagaccacatctattgcacataatgaagatgttaagatcctgcttcagtgtacatctccattgttatggagtaataacagtgcggttgtactagcagcagctggcgttcaatggataatggcgcctctggaagatgttaagaaaattgttaaaccgctcttgtttttgcttaggtcatctagcgcctccaaatatgtggtcctctgcaatatcctagtttttgccaaagcagtcccttctctctttgctccacacttcgaaaatttctttatttgttcctcagatgcatatcaagtgaaagcatacaagctggaaatgctttctctcattgctaccacttcatctatcgcttcaattttgagagagtttgaggattatattaaagatccagacaggagatttgcggctgatacagttgcagcaattggtttgtgcgcaaaaagactgatgacaattccaactacatgtcttgatggattgttagcactagttcgacaggaatcttttgctggcgattttgagtccgcggatggagaagctggagtattggtgcaagccgtgatgtcaattcagactatgatagagcgagacccccttcgtcatgagaaagtgttaattcagctgtttcgtagtctggattcaatcaaggtagctgctgctcgtgcaactattatttggatggtgggggtctactgctctttgggtcatatcattcctaggatgctgaccacaataaccaagtaccttgcatggagctttaaatcagaggcatcagagacaaaactacagattcttaatactattgctaaggttctaataagtgcagaggctggtgactttcatatgttgaaaaggattgtggtctatgtgtttgaattgggcgaatatgacttaagctatgatattcgtgatcgaactcgtttcctgaagaaactgctgtcatgcaaattagctagtcatgagccggcagaagacagtgttgcatcacaagaaaatattgctgcgcatgttgtggaacatgtctttggaagaaaactgaaatctgtttcacctataaccctgcacaatcgtttttatcttcctggatctctgtcacagatagttcttcatgcagcccctggatatgaacctcttccaaagccctgcagttttgtgtatgaagaacaggaccagctgtcagatttagataaacaaagagaggccgcagctgatttagatggttctgaggaatcctctgaaacaggggatgagaatggctcctctgattatgactctgaatcttctaatggttcggattttagcagtgaaggtgatgaaagaacagtgtctaatgacgccaatgacccagctgctcctttaattcaaatttcagagacttctgtttccgctgaccaggaagaactaaggtccagaagggccctggatttgtggttagatgatcagcctagtacatcaaaccaaactccatctgcattaaatagtaatcagagctcttatgcgaagatatccattggtgatgtaggaagccgagttaagcctaaaagctatagtctcgtagaccctggaaatggcagtggcttgaaggtagactatgcctttttatctgaagtctctaatgtatctccattacatgtttgcgtagaagttctgtttgagaacagttctgctgaacctatcctggaggtgaatttggaagatgaagaatcaatgaaggtagcagactcttctgaacagacattggttggtaaagcaaatgcatcttacaacaatataccaaccctaattccaatggaggaaattagctgccttgaaccacatcagagcacaaagaggcttatccaggttcggtttcatcaccacctgcttcccatgaggttaaccttacattacaatgaaaagaaagttcctgtcaagttacgacctgatcttggataccttgtgaaaccattttcaatgagcatcgaggaattcttagctacagaatctcgattacctggaatgtttgagtatagtcgaaggtgtacttttgacgatcatgttaaagattcaagaacggagaatgggaaagacaaatttcttagcatctgcgagagtataacactaaaggtgcttagcaactcaaatctacaccttgtatctgtggatttaccagttgcaaactcactcgaagatgcaactggtctgcgattaagattcagcagcaaaatcttgagcagtgagatccctcttttgattaccatcacagtcgaaggcaaatgcaccgaagttctgaatttaacagtcaagatcaattgcgaagaaacggtttttggtttaaacctgttgaacaggatagctaatttcatggttgagccgtcttcttcagccacttga

SEQ ID NO: 33324 - protein, 987 aa, Arabidopsis thaliana
MAGIRLHVIAPLALAAVSKCARDPAVYVRRCAANALPKLHDLRLEEHASAIEELVGILLNDHSPGVVGAAAAAFTSICPNNFKLIGKNYKKLCQILPDVEEWGQILLIGTLLRYVVARHGLVRESLMLSIHGTNSNGFCEKDGLGRDLTLDKEDGGKSDSFDVNLVSLVSKCYIQGPDEYLSRSSCTDTVSSAFDTKETTSIAHNEDVKILLQCTSPLLWSNNSAVVLAAAGVQWIMAPLEDVKKIVKPLLFLLRSSSASKYVVLCNILVFAKAVPSLFAPHFENFFICSSDAYQVKAYKLEMLSLIATTSSIASILREFEDYIKDPDRRFAADTVAAIGLCAKRLMTIPTTCLDGLLALVRQESFAGDFESADGEAGVLVQAVMSIQTMIERDPLRHEKVLIQLFRSLDSIKVAAARATIIWMVGVYCSLGHIIPRMLTTITKYLAWSFKSEASETKLQILNTIAKVLISAEAGDFHMLKRIVVYVFELGEYDLSYDIRDRTRFLKKLLSCKLASHEPAEDSVASQENIAAHVVEHVFGRKLKSVSPITLHNRFYLPGSLSQIVLHAAPGYEPLPKPCSFVYEEQDQLSDLDKQREAAADLDGSEESSETGDENGSSDYDSESSNGSDFSSEGDERTVSNDANDPAAPLIQISETSVSADQEELRSRRALDLWLDDQPSTSNQTPSALNSNQSSYAKISIGDVGSRVKPKSYSLVDPGNGSGLKVDYAFLSEVSNVSPLHVCVEVLFENSSAEPILEVNLEDEESMKVADSSEQTLVGKANASYNNIPTLIPMEEISCLEPHQSTKRLIQVRFHHHLLPMRLTLHYNEKKVPVKLRPDLGYLVKPFSMSIEEFLATESRLPGMFEYSRRCTFDDHVKDSRTENGKDKFLSICESITLKVLSNSNLHLVSVDLPVANSLEDATGLRLRFSSKILSSEIPLLITITVEGKCTEVLNLTVKINCEETVFGLNLLNRIANFMVEPSSSAT

SEQ ID NO: 33325 - DNA, 2238 bp, Schizosaccharomyces pombe
  CDS (1)..(2238)
atgtctaatctatcgttctttcagactttaagcgggcttgcggaaaatgcaaagcagatagcaaaaagctcgagtctttctttcgaagaaaatgagctttcccactccgatttattacgcctcttgaactccaactctgatgctggcaaattagaggcgattaacttcattttagctcaaatgatgcacggcgaaaatatgtcgttatacttcccagatgttgtgaagttagttgcttcagaaaatccggaaatacgacgcctggtccatatttatttactccagtatgctgagttcaatccagatcttgctttgctgtctgttaatactgttcaaaaaacactgtatgataaaaacccgttaactagatctaccgcaattagagttatgagcagtatcagggtgcctgccattaatggaatcgttcttttagcaattcagcaatgcattactgatacagctgatcgcgttcgccaaagtgcggcattggcaattacaaagtgctattctcttgacccttcatataaatcgcaattggaagagcacatcaaaacgcttttatctgataatagtcctattgtagtcccagctgcattatttacttttgaagtcgtttgtcctgagaaattagaaattattcatccatattatcataggatatgtactcttttcccgcaaatgaatgactgggacaaagtagtggctttgaaaacattggttagatatgccagacttacattacccgagccttcaactccttcaacacattcagatttaaaggaactacttgagtcaataaagtcttgctttttctctcttcttccgagtactattatagcaggtgctcgtgctttttactatctagctccttcaaatcaaatgcacttaatcgttgaaccattgttgcagcttttgctcgaaaagccaattgttaggacgacaactttacgatatatttctcaaattgtatataaaacaccggaattatttaaaaaccatataaagagtttctttctaattgcttctgacagtgacgatacgtgccttttaaaaatcaacatattgtcgcgtttattggatgctcaaaattcatcgcaaatccttcccgaattattgtattacattaacagtcatccgaatccttctgttgcatcaacggcggtaaaggcattgggtgattttgctagtgctaacatttctatggccccctcttgtcttaacactttattgctgttacttaaatcacataatagccttatcgtgacagaagctgcctcttcacttcggcttctcattcataatgatcctaaagaaatatatctgcagtatttagctgcaacgtatgaaactttggaagtaccgcgggccaaatccgttacactatggcttatttcggagcatatactaatcataccgcgactagtccctgatgtgctacgcattgctgttaaaacttttgctgatgagacattagaagtgaagtatcaaattctcgaattatcggtaagactatatgttttgtctcattctgaagagaagcaaaacgatttagagtcaagagatgatgtcgtgtcactactttttaattatgttttatctttgatacactttgacatgagttacgatttacgagatagagctaggttttacaaagaactagctagtacaccgagttctgaatttactaggcgcatcgtattggaaagcaaggggaatagtcaaaaagaaattattgcttctcgggactactgcattggtaccgctagtttatgtttgaatgaagacgtgatgggatatgagccaatccctaactgggctgatgtctctgatttaccgcctgattctgtccgagaaggtatcaaggatgttttgccaataaaccctcatacgggaaatatttattcaaacaattcaccgggtgtgaaagcattatcttctgataactttaaacgtgattttggagatactaacgcaattaaccgtccaaaatttgttggccagcaaacgcttgaagaattttatgctagtgaaacttctgaaagttctgaaggagaatatgaaacatcaaccagtgaaagtgaagatgaagaaacggatgatacttctcaagaggaagacaacgaaaaaaatagtacacctgatgaagatacagagaacaacaataccagttctatatctactaaaagtataatggataggccgctcacagaacctgaacctaactattggcaatcataa

SEQ ID NO: 33326 - protein, 745 aa, Schizosaccharomyces pombe
MSNLSFFQTLSGLAENAKQIAKSSSLSFEENELSHSDLLRLLNSNSDAGKLEAINFILAQMMHGENMSLYFPDVVKLVASENPEIRRLVHIYLLQYAEFNPDLALLSVNTVQKTLYDKNPLTRSTAIRVMSSIRVPAINGIVLLAIQQCITDTADRVRQSAALAITKCYSLDPSYKSQLEEHIKTLLSDNSPIVVPAALFTFEVVCPEKLEIIHPYYHRICTLFPQMNDWDKVVALKTLVRYARLTLPEPSTPSTHSDLKELLESIKSCFFSLLPSTIIAGARAFYYLAPSNQMHLIVEPLLQLLLEKPIVRTTTLRYISQIVYKTPELFKNHIKSFFLIASDSDDTCLLKINILSRLLDAQNSSQILPELLYYINSHPNPSVASTAVKALGDFASANISMAPSCLNTLLLLLKSHNSLIVTEAASSLRLLIHNDPKEIYLQYLAATYETLEVPRAKSVTLWLISEHILIIPRLVPDVLRIAVKTFADETLEVKYQILELSVRLYVLSHSEEKQNDLESRDDVVSLLFNYVLSLIHFDMSYDLRDRARFYKELASTPSSEFTRRIVLESKGNSQKEIIASRDYCIGTASLCLNEDVMGYEPIPNWADVSDLPPDSVREGIKDVLPINPHTGNIYSNNSPGVKALSSDNFKRDFGDTNAINRPKFVGQQTLEEFYASETSESSEGEYETSTSESEDEETDDTSQEEDNEKNSTPDEDTENNNTSSISTKSIMDRPLTEPEPNYWQS

SEQ ID NO: 33327 - DNA, 2052 bp, Schizosaccharomyces pombe
  CDS (1)..(2052)
atggttccaaagttgtttcaatcgagccgttttaaggcatttaaaaaaagcgaaacaagtgaattacaaaagggactagtttctcagtatgcctacgagagaattgatgctgtgaaacggactattgccgcaatgactgttggcaaggatgtgtctagtctgtttcccgatgttttaaagaacctagctactcgcgatatcaccttgaaaaaactggtttatttatatctaattaactatgccaaaacacaccctgatctttgtattttagccgttaatacttttgtaaaggattctgaggaatataatcctactttacgagctctggcaattagaactatgggttgcattcgggtaaataaaatcattggctatttggcagatccgttgcgaaaagctttgaaggatgagcatccctatgttcgtaaggctgcagcggtttgtgttgtaaagatgtatgaccttgatcgagaatactgtgcatcaaatggtttcatcgaacaattgcaggcgttggtatctgatccgaatcctgtggttgtggctaatgcagtccgctcacttgctgaaattcatgatcaggaccctgaaaagggatattttaatgtagtttacacgatgacagacaggctaatggttgctttgagtgagtgtaatgagtggggtcggattactattttgaattctttagctagatttcgcacttctgatatcaaggaagctgaatatgtttgtgaaagggtggttcctcaattccaacatgcaaatagtggtgtcgttttgtccgctgtgaaagtcataatggtacatatccctctcttttccagtgactttacagactttctgtacaaaaaaatggctcctcctcttttgacgctactttctacggactcagaaatccagtatgtagccttacggaacattaatttaatattacaaaagaggccttctatttttgatgtcaaaactcgggtttttttctgcaaatataatgatcctctttatattaaaatggagaaactaaagataattacaatgcttgcatgtgacgaaaacattaacgagaccatttccgagcttcgagcgtacgtttccgaagttgaactagaatttgtgaaacaaacgattaaatgccttggagacgttgcattgaaagttccaagcgtcatcaatgattgcatctccatatttcttgaaatctatgagttaaatattagttatatggttcaagaagtcacggtggtgatggaaacggttttgcgcaaataccctcaaaagattgacttattacttccatatctttctcgtgtcattgaggagcttggtgaccctagagcccgtagtagtatggcttggattttaggggaattttcacacgttatacctacttcttctaaactattatccgaaatgatttctactatggcggatgaagatttacagattcaattggctttactgacggctgttgtaaaattgagtttgatgaacggcaaaggaaacgatgaagaactcgtacagaaagtattaaattatgcaattaatcaatcaagcaatcaggatttaagggatcgtgcctttgcatatcagcggttgttgacacctgaaaatgttcgtaaagctcaaaaaattgtttgttgcgaaaagccttccgtatcttataataacaatctacctgaggcacttttggatgctctgttgtgtgaaatcacaactcttgcttctgtataccataaattaccggaatcctttattggccagggcaagtttggcgcagacgcaatacagcgtcgagctgttgaagaattgaacattgaagaagccaatgttcatgaagctattgaaaaaggagccaacgttgaaaatttgcttgaccttgattttactgatccaggcgcaacgtctgccagtgattctccaataaccagcgcacaacctcagtcgggctcaaatagtgcaatggatttgttcatggcttttgaggcaccgagcacaaataacgctgaacctgtaaaggctagatcggcaacagatgatctgttagggctttaa

SEQ ID NO: 33328 - protein, 683 aa, Schizosaccharomyces pombe
MVPKLFQSSRFKAFKKSETSELQKGLVSQYAYERIDAVKRTIAAMTVGKDVSSLFPDVLKNLATRDITLKKLVYLYLINYAKTHPDLCILAVNTFVKDSEEYNPTLRALAIRTMGCIRVNKIIGYLADPLRKALKDEHPYVRKAAAVCVVKMYDLDREYCASNGFIEQLQALVSDPNPVVVANAVRSLAEIHDQDPEKGYFNVVYTMTDRLMVALSECNEWGRITILNSLARFRTSDIKEAEYVCERVVPQFQHANSGVVLSAVKVIMVHIPLFSSDFTDFLYKKMAPPLLTLLSTDSEIQYVALRNINLILQKRPSIFDVKTRVFFCKYNDPLYIKMEKLKIITMLACDENINETISELRAYVSEVELEFVKQTIKCLGDVALKVPSVINDCISIFLEIYELNISYMVQEVTVVMETVLRKYPQKIDLLLPYLSRVIEELGDPRARSSMAWILGEFSHVIPTSSKLLSEMISTMADEDLQIQLALLTAVVKLSLMNGKGNDEELVQKVLNYAINQSSNQDLRDRAFAYQRLLTPENVRKAQKIVCCEKPSVSYNNNLPEALLDALLCEITTLASVYHKLPESFIGQGKFGADAIQRRAVEELNIEEANVHEAIEKGANVENLLDLDFTDPGATSASDSPITSAQPQSGSNSAMDLFMAFEAPSTNNAEPVKARSATDDLLGL

SEQ ID NO: 33329 - DNA, 2034 bp, Schizosaccharomyces pombe
  CDS (1)..(2034)
atgtcgagtagttcaagtcatttttcgtctaccgctgctgatttgctagcagtcttcagctcagataataaggacaaatctgcaaacaaacgaatttctgctttaaagaaagcaattgcaggcatatcttatggatatgatatgagttcactgtttccatcggtgatatcttctatggaatctaataatctagaattaaaaaaactatgctatttgtacttgaaaatttacgcgagcgtgaaacccacagaggcgaagagagctgttaaacttattttgaatgacatttattcttccaaccctatgattaggtccttagctttaagaacattgacatcggtaaacatcaaaaacttttgggttgctgctatggatccaattgtaaggttattagatgatacagatccttacgttcgaaaaactgcagccattgggattgcaaaattgtactcctatgataaaaaaatggtggagtcatcaggattaatcgatcatttgaaagaaatgcttagtgatgaatcttcggttgttgttgccaactctttagccgctttaatgaatatcgtaaattcatctactggatttaaactcacattcagtagggaaatatctaataaacttgttaagagcctcactgattgttcggagtggctgcaagttgccattttggatgctttaattttttatgttccccaaaagcctggcgaggccgaaagcttcgctgaacgtattagtccttggttacaacacggcaatgcagctgtgtgcatgggggctgtaaaggttattctttatttaactaattacatgaaagatgacaatcgagttaaagaatactttatgaagacccaacctcctcttgtcacattgctagctagaaaatcatctgcaacacaatatgtaattctgaggaacattcagataatattggaacaatgcccagaaatgtttgcaaatgatatacattttttttactgtaactttgatgacccaatttacgttaagcttgaaaaattggatatcctaaccaaaattgctgatattcacaacttagatcaaattcttcctgagttcgtcgagtacgcctcggagattgacgtcgaacttgttcgaaaatcagtgaaatgtattggttaccttgccataaaaattgaggaacgaaaaaatgactgcatagatagcttaattgaattgatgaatacgaaagtcacctatgtgattcaagaagcagttattgtcattagagatattcttagaaaatacccaggaagctacaaatcattggttccgattctttacgaaaatttggattcccttgatgaacctgatgcaaagtctgcggtaatttggatacttggccaatatgccgaagaaattgaagattctataacgctattgaatgattatctaaagggtttttttgatgaacccttggagattcaactcactttgcttactgcggtgattaaagtattcttaaaaaaaccaactgctgcagccgatatggttaccaatgtcctccagtggtgcactgatgaagttaatgaccccgatttgcgcgacagaggtataatatactcccgaatgttgtcagccaatcctgaattagcaaaaaaagtcatacttgctaacatgcctccagtgaatgttggaactggaatgtacgatcccgataccacggagcaactaatgctgaatatttccacactttcatctatatatcataagccccctaatcgtttcgtaaaaggggctcaagttgcatattgtgagcctagtccagtgttacgattgcgtactcgtgactctaatcctagtaatacggattcacgagagtctaatcataagaaatacaatcattttcatcagaaatcacaaactagaagggtaatggaacaatacgatcgtaattcttggaatccttctccattttcagatgaatccaattcaaatacattctcgggcaagtttgatagtgcagatcaagaaaacctaggtatgccaatgactcctgaaacacatttaatggattaa

SEQ ID NO: 33330 - protein, 677 aa, Schizosaccharomyces pombe
MSSSSSHFSSTAADLLAVFSSDNKDKSANKRISALKKAIAGISYGYDMSSLFPSVISSMESNNLELKKLCYLYLKIYASVKPTEAKRAVKLILNDIYSSNPMIRSLALRTLTSVNIKNFWVAAMDPIVRLLDDTDPYVRKTAAIGIAKLYSYDKKMVESSGLIDHLKEMLSDESSVVVANSLAALMNIVNSSTGFKLTFSREISNKLVKSLTDCSEWLQVAILDALIFYVPQKPGEAESFAERISPWLQHGNAAVCMGAVKVILYLTNYMKDDNRVKEYFMKTQPPLVTLLARKSSATQYVILRNIQIILEQCPEMFANDIHFFYCNFDDPIYVKLEKLDILTKIADIHNLDQILPEFVEYASEIDVELVRKSVKCIGYLAIKIEERKNDCIDSLIELMNTKVTYVIQEAVIVIRDILRKYPGSYKSLVPILYENLDSLDEPDAKSAVIWILGQYAEEIEDSITLLNDYLKGFFDEPLEIQLTLLTAVIKVFLKKPTAAADMVTNVLQWCTDEVNDPDLRDRGIIYSRMLSANPELAKKVILANMPPVNVGTGMYDPDTTEQLMLNISTLSSIYHKPPNRFVKGAQVAYCEPSPVLRLRTRDSNPSNTDSRESNHKKYNHFHQKSQTRRVMEQYDRNSWNPSPFSDESNSNTFSGKFDSADQENLGMPMTPETHLMD

SEQ ID NO: 33331 - DNA, 2682 bp, Plasmodium falciparum 3D7
  CDS (1)..(2682)
atgtctgatttacgctactttcaaacgactaaaaaaggagaaatccatgagcttaaagaagaattacattcttctcataaggaaaaaaaaaaggaagctattaaaaagattattgctgctatgactgttgggaaagatgtctcgacattattttctgatgttgtgaattgcatgcaaacatcgaatatagaattaaagaagcttgtttatttatacgttataaattatgctaaggtacaacctgaactagctattttagctgttaatacatttcgaaaagattcctcagacccaaatccccttataagagctttagctattcgaacaatgggatgtatacgactagaacaaataacagaatatttaatcgaaccattgaggagatgtttaaaagatgaagatccatacgtaagaaaaacagctgttatatgtatagccaaattatatgatatatcaccgaaattagtagaagaagaaggttttatagatacgcttttagatatattagatgataataatgccatggttgttgctaatgctgttatatcgttaacggatatttgtgagaattcaaacaagagcatattaaaagatgttataaacaaagatgaaaataatgtgaataaacttttaaatgctattaatgaatgtgtagaatggggacaagtttttattttagatgcattagttttatatgaacctaaaactagtaaagatgctgaacgtgttttagaaagaatattaccaagattatcacatgctaattcagcagtagttctatcatctattaaagttatcttatgcttattagataaaatcaatgataaagaatttattaaaaatgtacataagaaattaagcccatctttagtcacacttttatctgcggaaccagaaattcaatatattgcattaagaaatattaatttaataacacagaaattacccaacatgctctctgataaaatcaatatgtttttctgtaaatataatgaacctgcttatgtaaaaatggaaaaacttgatattattataagacttgtatcagataaaaatgtagaccttgttctatatgaattaaaagaatattctacagaagtagatgtcgaatttgttaaaaaaagtgtaagagctataggtagctgtgcaataaaattaccacaatcaagtgaaaaatgtattaatatattattagatttaatagataccaaaattaattatgttatacaagaatgtatagttgtaattaaagatatttttagaaaatatccaaataaatatgaaagtataataaccattctatgtgaaaatctagaatctttagatgaatcaaatgcaaaagcatccttaatatggataataggagaatatgtagaacgtattgataatgctgatgaattaatagattcctttttagaaaattttagtgatgaaccatataatgttcaattacaaattctaacggctagcgtcaaattatttttaaaatgttcaaaaaacacaaaagatattataaccaaagtcttaaaattatccacagaagaaagtgataatcctgatttaagagatagggcttatatttattggagattgttatctaaaaatattgatgttgccaaaaaaattgtacttgccgataaacccccaatacaagaagagaataaaattactgataccaaagtattaaataaattaattaaaaatatatccatgttatcatctgtatatcataaattaccagaaacttttatatcaaaaaaaaattcctattccttaaattctgataataataatgatcatatgcaagatgatcactatgatgatgacgattatgataaagataatcatgttctaaaaattaaaaaacaaatggacaaacaaaaatatgatagttattctagtgataataaaaaatcaaaccattctaaatcatccagtgattcttataataactcttcggatgaattcaataatgatatcgatgatgcagatgatagtaaaaaatctatggacttgataggattaaatgatgatgaaagcaaaccccaaaaaacaattccaccggtcaaaatggttcaggtattatcatcagaggatgctggtttgaagggacagacgggtctctccatttttgcctcaataaatcgtattgacagaaaaattcaactcaaaatatcagtaacaaatcaaacccagaacgaaatcgtagtatcaggagttcaaataaataaaaattcatttggattatcgtcaccgaacaatttggatgtacagaatattggctttggagaaacaaaagaaatgctcatatatttaattccaaatacgttaaattcgaatacacctccagcaacccccttatttttacaagttgccataagaacaaatttagatatattttatttcaatgtaccgtacgacatttttgtcgtttttgtcgaaaattttcatatggaaaaagacatatttaaaaagaaatggcaaattatagaagaagcaaaagaggaattatattattttgcttgtataaccacaaacaatctagtaatattaagtgaagtcacaattcaacctgagaaaaagaacgtgaaattgtgcattcgtacagattcctcatctgtgataccactttataagcttttatttgttaaggcattttccttaagtgtaactcagacataa

SEQ ID NO: 33332 - protein, 893 aa, Plasmodium falciparum 3D7
MSDLRYFQTTKKGEIHELKEELHSSHKEKKKEAIKKIIAAMTVGKDVSTLFSDVVNCMQTSNIELKKLVYLYVINYAKVQPELAILAVNTFRKDSSDPNPLIRALAIRTMGCIRLEQITEYLIEPLRRCLKDEDPYVRKTAVICIAKLYDISPKLVEEEGFIDTLLDILDDNNAMVVANAVISLTDICENSNKSILKDVINKDENNVNKLLNAINECVEWGQVFILDALVLYEPKTSKDAERVLERILPRLSHANSAVVLSSIKVILCLLDKINDKEFIKNVHKKLSPSLVTLLSAEPEIQYIALRNINLITQKLPNMLSDKINMFFCKYNEPAYVKMEKLDIIIRLVSDKNVDLVLYELKEYSTEVDVEFVKKSVRAIGSCAIKLPQSSEKCINILLDLIDTKINYVIQECIVVIKDIFRKYPNKYESIITILCENLESLDESNAKASLIWIIGEYVERIDNADELIDSFLENFSDEPYNVQLQILTASVKLFLKCSKNTKDIITKVLKLSTEESDNPDLRDRAYIYWRLLSKNIDVAKKIVLADKPPIQEENKITDTKVLNKLIKNISMLSSVYHKLPETFISKKNSYSLNSDNNNDHMQDDHYDDDDYDKDNHVLKIKKQMDKQKYDSYSSDNKKSNHSKSSSDSYNNSSDEFNNDIDDADDSKKSMDLIGLNDDESKPQKTIPPVKMVQVLSSEDAGLKGQTGLSIFASINRIDRKIQLKISVTNQTQNEIVVSGVQINKNSFGLSSPNNLDVQNIGFGETKEMLIYLIPNTLNSNTPPATPLFLQVAIRTNLDIFYFNVPYDIFVVFVENFHMEKDIFKKKWQIIEEAKEELYYFACITTNNLVILSEVTIQPEKKNVKLCIRTDSSSVIPLYKLLFVKAFSLSVTQT

SEQ ID NO: 33333 - DNA, 2574 bp, Plasmodium falciparum 3D7
  CDS (1)..(2574)
atgtatgcaaatagtgaaattaacaaattaaaagacgttttaaaaaaattacctcaagaaaaaaatgatgataaaaaaagagaagtgttaaaaaaggtaatagcctatatgactttaggtgtggatgtatccaagttatttccagatatcataatgatatctagtacaaatgatataatacagaaaaaaatgatatatttatatttaaacaattatgcagaaacaaactcagaattgtccctactaacgataaatacacttcaaaaagacagcaaagacgatgatcctataatacgtggtttagccctacgtacattttgtaatctaagaattaataatttatttgaatatattgaaggtcctttatttaatggtttaaatgataaaaattcatatgtgagaagaattgcaattattagttgtgtaaaattaattaaaatgaatcctgatttatcgataagaaatgatattataaaaattttaaaaaataaattattagataaagatcctcaatgcattatcaattctgtacatgctctaaatgaaatattgattgatgaaggtggattgaaagtaaataaagaaattgtatttaatatgttaaataaattatctcattttaatgaatgggggaaaagtgtaattttatatatagtaagtacatatataccagagaatgaagatgaaatgtatgatattatgaatatattagaaaatcatataagagatttttcttcaactgtctttctagcttgtttgaaatgctttcttaatttttctattaatgatacaaatttacaaatacagatttttcaaagaatgaaagatccattacttacattaatttcaacttcgtccaatgaaattgcttatattgttttgttacataccaatttattattgcatgaagctaataaattgaattataaaatttttgattatgactataagcactttttctttagatataatgatttaacatatataaaagatattaagttggacattcttgtatcagtagcatcaaagaataatgtagttttaataatcaacgaattgagtgaatacatttcagatgctaatgttgagattgctcaaaaagccatagaatccataggatccattgcattaaaaattcctaaatgcatttcaagggtagtagaattatctttgtcaaattttatgacaatgaattattcgtatatatgtagtgctacaataaaaatacttgtgaatattttaagaaaatatgaagaatatacaaaattaattatcgaagaaataataaaacatggtaatagattaattgataatggtggtattatatcttatatatggataataggtgaatactgtgaatatattgaagaagctccatatcttttagaagaatatataaatttaagaaattgttcttatttattcatgttagaattattaacggcttgtgttaaagttttatacagaagacctgctgaaatgaaaaacatcgtttctacattatttgataatatattaaaaaattataaatatcctgaacttacagataaaatgttcttttattataaactcttaagttataattataaagaagcatttcatatcattgcttgtaaaaaaaaaattgtcaaaaatttctctgaatcgaatgaaaatttattattagataagttatataatgaatttaataccttatctgtattatataaacaacctctaaataaatttgttgaatattcaaaaatagctttcggagccgtgtacgatccagaagaaaatagtgacataacaaaagattccactagccaattaaatggttgtgataatacagaagatattcatttaaataatcattatacagctgatcaaatgtacaataatgtaatagatcataagcacgcaatacatgacaaaaatgaaaataataataataataacaacaataataacaataataatgataataacaatttgcttaatattaatgaagatatattaattatggatgaacaaaatgctataacaaatcaaaataataaatatagtaataataataataataataataataatacattaacaaatcaagaacaaaaaacaaataaaaatgtttcaacaaatttacatgatgtaataataaatacagaaaataataatggaataataaatttggatcatatatataatacatctacctttaaaaaattaaaaaatattataatcgatgttgatagtataaaccctgaagtatatcaaacacaatggaatgcattacctgaacaaaataatgaaaaaatttttttaagaaaaaattattataatttacaattagatactattgatcaattaatatccaaatataatttaataacacttgcttcaggagaaattgatcaatgtcttaaattttatatgtactctcagttatataccaaacattatatctttattgaattaatttttaacaaaagagataattcaattaattggattttcaaatctgaatgtaatgacgaaaatttaattgaacaatttaccgactgttttagagatatttttttagattttatgtaa

SEQ ID NO: 33334 - protein, 857 aa, Plasmodium falciparum 3D7
MYANSEINKLKDVLKKLPQEKNDDKKREVLKKVIAYMTLGVDVSKLFPDIIMISSTNDIIQKKMIYLYLNNYAETNSELSLLTINTLQKDSKDDDPIIRGLALRTFCNLRINNLFEYIEGPLFNGLNDKNSYVRRIAIISCVKLIKMNPDLSIRNDIIKILKNKLLDKDPQCIINSVHALNEILIDEGGLKVNKEIVFNMLNKLSHFNEWGKSVILYIVSTYIPENEDEMYDIMNILENHIRDFSSTVFLACLKCFLNFSINDTNLQIQIFQRMKDPLLTLISTSSNEIAYIVLLHTNLLLHEANKLNYKIFDYDYKHFFFRYNDLTYIKDIKLDILVSVASKNNVVLIINELSEYISDANVEIAQKAIESIGSIALKIPKCISRVVELSLSNFMTMNYSYICSATIKILVNILRKYEEYTKLIIEEIIKHGNRLIDNGGIISYIWIIGEYCEYIEEAPYLLEEYINLRNCSYLFMLELLTACVKVLYRRPAEMKNIVSTLFDNILKNYKYPELTDKMFFYYKLLSYNYKEAFHIIACKKKIVKNFSESNENLLLDKLYNEFNTLSVLYKQPLNKFVEYSKIAFGAVYDPEENSDITKDSTSQLNGCDNTEDIHLNNHYTADQMYNNVIDHKHAIHDKNENNNNNNNNNNNNNDNNNLLNINEDILIMDEQNAITNQNNKYSNNNNNNNNNTLTNQEQKTNKNVSTNLHDVIINTENNNGIINLDHIYNTSTFKKLKNIIIDVDSINPEVYQTQWNALPEQNNEKIFLRKNYYNLQLDTIDQLISKYNLITLASGEIDQCLKFYMYSQLYTKHYIFIELIFNKRDNSINWIFKSECNDENLIEQFTDCFRDIFLDFM

SEQ ID NO: 33335 - DNA, 3111 bp, Oryza sativa (japonica cultivar-group)
  CDS (1)..(3111)
atgtttgggctgcaggcgagcggcgccgcggcgtcgtgggtggtggggcggatgggcaccgacgcccacctctacgacgaccccgacgacgcctccatccccaccctgctcgactcccgcttcgatgccgacaagctcgacgccctcaagcgcctcctcgccctcatcgcccagggcgtcgatgtcgcccacttcttcccgcaggttgtcaagaacgtggcctcgcaatcgctggaggtcaagaagctcgtctatctatacctcctccactacgctgagaagcgccaaaatgaagctcttctttcaattaacatatttcagaaggacttatctgatataaacccattagtgagggcctgggcactacgaactatggctggcattagactacacgtcgttgctccacttgtgttagtggctgtaaagaaatgtgccagggatccatcagcatacgttcgaaaatgtgctgcctatgcactttgtaagctgcacgacttacttccagatgaaactacatctttggaggaccatttccaaaggctatgtgagacactcccagatattgaagaatgggctcagattcttctaatcgatatcatcttgcgatatgtaatagctagacatggattggtgaaggattcttcaatttttgcttcaaatttgactttgaagagccagggcagtggagattcagcccttattggcaatgaaacttgtggcactacatcaaccatcacattgttccgacattacattgaagaatattcggaatgtttagaaggtgacataatcaactgttcatccgtgaccagtagcacaaacaatgatgttgcactacttttgaaatgtacatcgcctcttctgtggagccgaaacagtggagtcatacttgcagcagcaagtgttcattggatcatggctccagttgaccaactgaatagagttgttgggccaattttatttactctacgctcatctcctgatgcaacatatgtgatgcttggcaacatactagtttttgccaagacagccccacaattgtttgctccgttctatgaagatttcttcatatgcacttcagatccatatcaaactaaggctttgaagcttgaaatactgaccaccatagccacagagtcctctattccagcaatttttgaagaatttcaggattatattaaagaaccggataggagatttgtggcagatacagttgctgctattgcgctgtgtgcccagaagcttccctctatcactaccagttgccttgaatcatctataagtgattctgctaactttgatggagaagctgctgttttagttcaagcaattttgtctatcaaagcaatagtgagaacagatccagcatctcatgaaaaggtgattgtacgcttggtccacagcctggacaaaattaaggagcctgcagcacgatccctgattatttggatatttggagagtatagttccataggaaatatcattccaaagataactcctgctgttctcaagtatcttgcatggtcctttgctgctgaaatgcttgagacaaagcttcagatcttaaatgctgctgcaaaggttatcatacattctcctgaagaacacttagaagaattcaaaaagataatggcccatgtcattaagctggctacatgtgatttgagttatgacgtccgtgatcgtgcccgttttatatcaagacttttgccatacagcacaacctatttaaatggaaacaactcctcatgtcaatcacataatgaagatatgtttaaggaactggctaatcatatatttgatgggaagatgccatcaacattccatccaaccaataactaccggatttatcttcctggttccttgtcacaggtgattcttcatgcagctcctggttacgcaccacttccaaagcctcagagtatggaattaattcataagaccatggaaccaaccagaggagtaggcaattcttctgaaagcattaattctgatgctgaatctggatcttcaacatatgatggtggttctgtttatgattcagagagtgaagttgatggctcatctgacaggaatgctgctgattctaacacaaaagataatcaagaagatcccctggtccatgtttatgatgcaagtgtagatcaaggtcagacggctagggatgtcgaggataattttgcatctctcatcactactgatttgactgaattaatgtctaagtcagccttggaaacatggcttgatgaagctcctgctgaaccagttcaggtttctacacaagcatcctctgctagagtgtcttttaccaatcggagctttgagcgaaaacctaaattgcacatgttgttagacccatctaatagtaatggtctaagtgttctttatgccttttcatctgaggtttcacccgtatcacgcttgctagtgtgtgtagacttgttatttgagaatgtttcaacaaaccaactggcagatataacaattaaatccgaggaggcttctggtagtgaggatggcttggaccaaacattacaaggatctgcaagtgttccaactattgttcttgataaagagatacaattattggctcccgaacaaacggaaaagatggttcttcagttgtctgtgctctgcaatgggaaaaggcatccagcaaaacttcatcctgacattgcttattttgtgcggccactgcccatggacctaaatgcttttctatgcaaggaaaaccaactgaggggaatgtttgagtatgctagaaggtgcactttcaaagatcatcttcagaagcttgagcacaacgatgatagtgaagagcacactgataagaaccttctgatagcccagagcctcgcgtcaaaaatactcagcaatgccaacttccacttggtttcaatggatatgccagtgaccttcagcattgaggatgcttctggcttatgctggcgattcagcagtgagatcctgagcacttcaaacccttgcctaattaccatcctcgcggaagggcatatctcggaaccacttgacctcactgctaaggtgaactctgaagatacagcgtttggcctaaacctcctaaacagagttgtagcaatcatagaatga

SEQ ID NO: 33336 - protein, 1036 aa, Oryza sativa (japonica cultivar-group)
MFGLQASGAAASWVVGRMGTDAHLYDDPDDASIPTLLDSRFDADKLDALKRLLALIAQGVDVAHFFPQVVKNVASQSLEVKKLVYLYLLHYAEKRQNEALLSINIFQKDLSDINPLVRAWALRTMAGIRLHVVAPLVLVAVKKCARDPSAYVRKCAAYALCKLHDLLPDETTSLEDHFQRLCETLPDIEEWAQILLIDIILRYVIARHGLVKDSSIFASNLTLKSQGSGDSALIGNETCGTTSTITLFRHYIEEYSECLEGDIINCSSVTSSTNNDVALLLKCTSPLLWSRNSGVILAAASVHWIMAPVDQLNRVVGPILFTLRSSPDATYVMLGNILVFAKTAPQLFAPFYEDFFICTSDPYQTKALKLEILTTIATESSIPAIFEEFQDYIKEPDRRFVADTVAAIALCAQKLPSITTSCLESSISDSANFDGEAAVLVQAILSIKAIVRTDPASHEKVIVRLVHSLDKIKEPAARSLIIWIFGEYSSIGNIIPKITPAVLKYLAWSFAAEMLETKLQILNAAAKVIIHSPEEHLEEFKKIMAHVIKLATCDLSYDVRDRARFISRLLPYSTTYLNGNNSSCQSHNEDMFKELANHIFDGKMPSTFHPTNNYRIYLPGSLSQVILHAAPGYAPLPKPQSMELIHKTMEPTRGVGNSSESINSDAESGSSTYDGGSVYDSESEVDGSSDRNAADSNTKDNQEDPLVHVYDASVDQGQTARDVEDNFASLITTDLTELMSKSALETWLDEAPAEPVQVSTQASSARVSFTNRSFERKPKLHMLLDPSNSNGLSVLYAFSSEVSPVSRLLVCVDLLFENVSTNQLADITIKSEEASGSEDGLDQTLQGSASVPTIVLDKEIQLLAPEQTEKMVLQLSVLCNGKRHPAKLHPDIAYFVRPLPMDLNAFLCKENQLRGMFEYARRCTFKDHLQKLEHNDDSEEHTDKNLLIAQSLASKILSNANFHLVSMDMPVTFSIEDASGLCWRFSSEILSTSNPCLITILAEGHISEPLDLTAKVNSEDTAFGLNLLNRVVAIIE

SEQ ID NO: 33337 - DNA, 2541 bp, Oryza sativa (japonica cultivar-group)
  CDS (1)..(2541)
atggctccgacggcgcccacggcggcgaagtccgcctccccgtcccagccatccgggaagagcgaggtggcggatctgaagcagcagctgcggcagctggcggggagccgcgcgcccgacgccgacgaccagcggagggacgtcttcaagcgggtgatctcctgcatgacggccggcatcgacgtgtcggcggcgttcggggagatggtgctctgctccgccacctccgacgtcgtgctgaagaagatgtgctacctctacgtcggcgtccacgcgcgcaaccacccggacctcgcgctcctcaccatcaacttcctccagcgcgactgccacgaccaggaccccaccatacgcggcctggcactccgcagcctctgctccctccgcgttcccaacctcgtcgagtaccttgtctcgccgctcgccactgggctcaaggaccccagtgcttacgtccggatgatcgctgctgttggtgctgcgaagctgtatcacatatctgccaccgcctgccttgatgctgacttgcctgcggcgctcaaagcgcttatgctctctgatcctgatgcacaggtagttgcgaattgcatgcatgcattacaggagatctggaccctagaagcagctaagtcagaggaagctgcaagggagattgagacactatatagcaagccagtagtattttaccttcttaacaggatcaaagagttcagtgagtgggcacagtgcctcgttctagaattagtgtcaaacttcctaccatctgataacaacgaaatttttgacatcatgaaccttcttgaggacagacttcagcatgcaaatggagctgttgttttggcaacaatcaaagtttttctccacttgacaatgtcaatgactgatgttcaccagcaggtttatgagcgtataaaagcaccactgcttactcttgtaggagctgggagtcctgaacaatcatattctgtgctatgccatttgcatcttttggtgatgcgtgctccaatgctattttcctccgactacaaaagtttctactgccagttcagtgatccttcatatgtcaagaagcttaaacttgagatgctgactgctatagcaaacgagagcaacacctatgaaattgtaactgagttgtgtgaatatgctggaaatgttgatgtaccaatcgcacgtgagtctattcgagcagttgggaaaatagcgctgcagcagtatgatgtgaatgctattgttgacaggcttctgcaattccttgaaatggacaaggaatatgtgacggctgaaactcttgtcttggtgaaagatcttttgaggaaatatcctcaatggagccatgattgtatagcagttgttggaaacatcagtagcaaaaatattcaggagccaaaaggcaaagcagctcttatatggatgttaggagaatattcacaagacatgcatgatgctccatacattcttgagagtctcgttgaaaattgggaggaagagcactctcctgaggttcgcttgcatctcctgactgcggtgatgaaatgtttctttaagaggccaccagagacacaaatggcactaggagctacattaaccgctggtctatctgacactcaccaggatgttcatgaccgagcacttttctactataggcttttgcagtatgatcctgctgttgctgaacgtgttgtaaaccctcccaagcaagctgtctctgtatttgcagatacgcagagcagtgaaatcaaagatcggatatttgatgaattcaacagcctatcagtggtatatcagaagccatcttacatgtttactgacaaggagcatcgtggaccatttgagtactcggaggatcttacgaatttggctgtcggggcagaaacgacggaaaacaccatctcagcccaaagatatcaagaaagtgataatgatcttttgctaagtacttcggataaagaggacaatgcaacagctaccagcaatggttcttctgcctctacctacaatgctccttcagacttgagtggtccttcattgcttagttcacaaataccgtctgaaacttcactaataaatcctggtgcacctacatattcgtcacagtccaacttcagtcttgatgaccttcttgggcttggtgttccacaatcctctgcacctccaccagctccagcattgaccctcaactcaaaacctgtgctggatcctggtactttccagaagaaatggggccagctggccttatccttgtctcaggaatgttcattaagtccacaaggagcagcatcattgatgaatcctcaatcactcattcgacatatgcaaaacaactacattcagtgtattgcttcaggtggccagcccccaaactacaagttctttttctatgctcaaaaggatggtgctaccgctttcttccttgtagaatgtatcgtcaacacagcatcagcgaaggcacagatcaaagtgaaggctgatgatgggaccgctgcagaggcattttcaacgttgtttcagtcagctttgtccaaatttgggctttcttga

SEQ ID NO: 33338 - protein, 846 aa, Oryza sativa (japonica cultivar-group)
MAPTAPTAAKSASPSQPSGKSEVADLKQQLRQLAGSRAPDADDQRRDVFKRVISCMTAGIDVSAAFGEMVLCSATSDVVLKKMCYLYVGVHARNHPDLALLTINFLQRDCHDQDPTIRGLALRSLCSLRVPNLVEYLVSPLATGLKDPSAYVRMIAAVGAAKLYHISATACLDADLPAALKALMLSDPDAQVVANCMHALQEIWTLEAAKSEEAAREIETLYSKPVVFYLLNRIKEFSEWAQCLVLELVSNFLPSDNNEIFDIMNLLEDRLQHANGAVVLATIKVFLHLTMSMTDVHQQVYERIKAPLLTLVGAGSPEQSYSVLCHLHLLVMRAPMLFSSDYKSFYCQFSDPSYVKKLKLEMLTAIANESNTYEIVTELCEYAGNVDVPIARESIRAVGKIALQQYDVNAIVDRLLQFLEMDKEYVTAETLVLVKDLLRKYPQWSHDCIAVVGNISSKNIQEPKGKAALIWMLGEYSQDMHDAPYILESLVENWEEEHSPEVRLHLLTAVMKCFFKRPPETQMALGATLTAGLSDTHQDVHDRALFYYRLLQYDPAVAERVVNPPKQAVSVFADTQSSEIKDRIFDEFNSLSVVYQKPSYMFTDKEHRGPFEYSEDLTNLAVGAETTENTISAQRYQESDNDLLLSTSDKEDNATATSNGSSASTYNAPSDLSGPSLLSSQIPSETSLINPGAPTYSSQSNFSLDDLLGLGVPQSSAPPPAPALTLNSKPVLDPGTFQKKWGQLALSLSQECSLSPQGAASLMNPQSLIRHMQNNYIQCIASGGQPPNYKFFFYAQKDGATAFFLVECIVNTASAKAQIKVKADDGTAAEAFSTLFQSALSKFGLS

SEQ ID NO: 33339 - DNA, 2856 bp, Danio rerio
  CDS (1)..(2856)
atgactgactcaaagtatttcaccaccaacaaaaaaggagaaatctttgagctgaaggccgagctgaataatgagaagaaggagaagaggaaagaggcagtgaagaaagtcatcgccgccatgacggtgggcaaggatgtcagttcgttgtttccagatgtggtgaactgcatgcagacggacaacctggagctgaagaagctggtttacctgtaccttatgaattatgccaagagtcagccggacatggccatcatggcagttaacagctttgtcaaggactgtgaggatccaaaccctctgatccgtgctctggctgtgcgcacgatgggttgtatccgcgtggacaagatcactgagtacctctgtgaacctctgcgaaagtgtctgaaggatgaagacccgtacgtgaggaagactgcagccgtgtgtgtggccaaactgcatgacatcaatgctcagatggtggaggaccagggcttcctggactctctccgggacctgatcgctgactccaatcccatggttgtggccaatgcagttgctgctctgtctgagatcagcgagtctcaccccaacagcaaccttctggacctgaaccctcagaacatcaacaagcttctgacggctcttaatgagtgcactgaatggggccagatcttcatcctggactgcctctccaactacaaccccaaagacgagcgggaggcccagagtatctgtgagcgggtgacgccacgtctctcgcatgctaattcagctgtggtgctttcggcggtaaaggtactgatgaagtttttggagctcctgcccaaagactctgattactacaacactcttctgaagaagctctctcctcccctcgtcacactgttatctggcgaaccagaggtccaatatgtggcgctcaggaatatcaaccttattgtgcagaaacggcctgagattttgaagcaagagattaaagtgttctttgtcaagtacaatgaccctatatatgtcaagttggagaaactggacatcatgatccgactagcctctcatgccaacatcgcccaggtcctggctgagctgaaggaatatgccactgaggtggatgtagactttgttcggaaagccgtgcgagccattggtcgctgtgccatcaaagtggagcaatccgctgagcgctgtgttagcaccctgctggaccttatccagaccaaagtcaactacgtcgtgcaggaagccattgtggtcatcagggacatcttccgcaaatatcccaacaagtatgagagcataatcgccactctgtgtgaaaacctggactctctggatgaacctgacgctcgaggagccatgatctggattgttggcgaatatgcagagcgtatcgacaacgctgatgagctactggagagtttcctcgagggcttccatgatgaaagcactcaggtccagttgactctgctgacagccatagtgaagctgttcctgaagaagccctctgagactcaggagctggttcagcaggtgctcagtctggccactcaggactctgataaccctgacctgcgtgaccgcggctacatctactggcgtctgctgtccactgatcctgtcaccgctaaagaggtggtgctgtctgagaaacctctgatctcagaggagacggacctgattgagcccaccctgctggacgagctcatctgccacattggctcgctggcctcagtctaccacaagcccccaaatgcctttgtggagggaagccatggcattcatcgcaaacatctgcccatccagcacggcagtatcgacaccggggagagtcccgtcagtaccggcccggctgcttccattgatcaaccccaggtcatcccatctcagggtgaccttctgggagacctgcttaatctggacctcgggccaccggtcaatgtgccccaggtgtcctccatgcagatagcggctgtggatctcctgggaggtggtcttgacagtttgctcgggggagatctgggaggaggtgttgggggcagtcctgcagtgggccagaacttcatcccatcatcggtgcccaacacctttgcaccatctccgacacctgccgctcttagcagcggactcaatgacctgtttgagttgtccacaggaatggccactgctacaggaggatatgtggctgctaaaactgtgtggctgccagcagtcaaggccaaaggactggagatttctggaaccttctctcggcgtcaagggcacatgtatatggacatgaccttcaccaataaagcattgcagcatatgactgactttgccatccagttcaacaagaacagttttggtgtaatccccaccacacctctccccgtccacactccactgatgcccagtcagagcatcgacatctccctcccgctcaacaccatcggccctgtgatgaaaatggatccactcaacaacctacaggtggccgtgaaaaacaatattgatgtcttctactttagcacgctgatccctctcaatgtcttcttcgtggaggatggcaaaatggagcgtcaggtgttcttggccacatggaaggacattcctaatgagaatgagctgcaataccagatcaaagactgccacttaaacgcagatacggtgtcgggcaaactgcagagcaacaatgtctacaccatcgcaaagaggaacgtggaaggccaggacatgttgtaccagtcgctcaaactcaccaacgggatctggattctcgccgagctccgcatacaacccggcaatcccaattacacgctgtctctgaagtgcagggctccagaggtttctcagtacgtgtaccagatgtacgatgccactctgaagaactga

SEQ ID NO: 33340 - protein, 951 aa, Danio rerio
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDEREAQSICERVTPRLSHANSAVVLSAVKVLMKFLELLPKDSDYYNTLLKKLSPPLVTLLSGEPEVQYVALRNINLIVQKRPEILKQEIKVFFVKYNDPIYVKLEKLDIMIRLASHANIAQVLAELKEYATEVDVDFVRKAVRAIGRCAIKVEQSAERCVSTLLDLIQTKVNYVVQEAIVVIRDIFRKYPNKYESIIATLCENLDSLDEPDARGAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIQHGSIDTGESPVSTGPAASIDQPQVIPSQGDLLGDLLNLDLGPPVNVPQVSSMQIAAVDLLGGGLDSLLGGDLGGGVGGSPAVGQNFIPSSVPNTFAPSPTPAALSSGLNDLFELSTGMATATGGYVAAKTVWLPAVKAKGLEISGTFSRRQGHMYMDMTFTNKALQHMTDFAIQFNKNSFGVIPTTPLPVHTPLMPSQSIDISLPLNTIGPVMKMDPLNNLQVAVKNNIDVFYFSTLIPLNVFFVEDGKMERQVFLATWKDIPNENELQYQIKDCHLNADTVSGKLQSNNVYTIAKRNVEGQDMLYQSLKLTNGIWILAELRIQPGNPNYTLSLKCRAPEVSQYVYQMYDATLKN

SEQ ID NO: 33341 - DNA, 2346 bp, Eremothecium gossypii
  CDS (1)..(2346)
atggctgaatcgatgcaacgtatagcgtcggcctttgagtctgccagagacctcactttggaagctgcagcagtggcttcttcaaggctaggggaatcttcatatttccactactcaaagtcaattgactccgaatcacttccggggttactcaactcgagatacacccgcgaagtgcgcgatggtatgaagcgcgtaatgtccctcatggggagtggtgactcgtcaattgaactggagacccattttgcggatattgtcaagaacatagggtcggacgatgtaaaagtcagacgtatggtctccgtctatctgttgagatatgcagagacaaatccaaacctagcactgttatcgattaattctatccaacgcagcttatcagactcgaaccctgatgtccgtgcgctggccttgaaaacgctctccgatatcaatattgcgtccctgtaccccatcatcttgcactctctgaaaaagacagtgatagattccagcgaagtggttcggtgtcaggtggcaatgacgcttttgaagctattcaaggaacaggggatatcgattaaggatgatgtcatgccgatgctgaaaagtttgctagctgattcggagccaagtgttgtctcagcggccctcttacttttccagaaggcattcgcacaagaacttcaacttctacatggacattaccgcaggtattgttctatcttaaaccagcttactgaaaacgcacaggccatcatgattgacatatttattgcttatgctaaagaataccttccaaggccaatggtaagagatacatcatcagatgcggaagcaattcaacttccggatagctttaatcaaattccattccctgtttatgatgtagaatatgaccatgatctgaacttattcttatcatccctgaagaaactactacattctccaaatgccatggtaattgtggcagtatcaaaagcattttatcagctttcgtcaccaaaaacattcaaggattcaggaatagttgattcactattacggctgcctgtatcatcatacatatgttccgagataaaggagcttgttttgcaatcgattcttgtctactgttgtagcgatccttcattattccgttctcattacaaaaggttcttcctgatgccctcggatacagagaatatttcgatatttaaactcaaaatcctttcaatactggtctctgatagcaactgtaagcacatcgtgaatgagttaaaattcgttgctggcacagaacaatccgcatccattttggtagaagtttcaaacaccctatccgtatgcgcccaaatctcatctaagtggtcgtcacagattattagttggctgttagatcgaatcagctctaatacaccgatagataaggaagtaactgcgtcacaaatcaatgttcttcgttcactgatacaaaaagatccaattaagcacatagctaccgtggtgaagttgtcaaaaatgctttctaatcatgatttgctgccaagtgccaaggcacctattatttggttgcttggtgaatacgttcaagtagagccacgcatctgtccagatgtcttgcggcggttgttaccacaattttcaaaggagcatgcccatgtgaggctacagatattaaacttggctgcgaagttactctcacatgatgttgacagctatagtggagacatggaatatgatattggaacttcgcgaattgggcaaatgtttgaagctgcactacaattggcaaagtttgatgatgaatatgacgttagagatagggctcggatgctagcatcaatatttgagcaaaagcgctatgaaatagctacattgttgcttcaagcacctaaaccatacccaatggcatccttaaattactgccgtgattcatttaatctctccgcgttgaatttataccccgatatggaaaattactatgaacttctgccatggaatgcagacccgcaagcttctgatagaacaccatgcgaagttaaggattatagcaaactgaagaacagtttttcctcctcatcctattttggtaggaatgaagttgaatttacgaataaacccaaaagaagtgcatccgtatcctcggtgccctcgaacacgtttacatcctcacatggaaagaaatatcaactacaaagtctagatgagttcttttctgacgtgtctgcaagacaaagtgttccgaaggcgaagagagtaattatagaagaaagcactagcgaagaaacagaccatactgatgacgagtctggaagtagctctggcgatgaatctacggaaagttcatatgtttcatcaagcgaagaagaaacaacagaatag

SEQ ID NO: 33342 - protein, 781 aa, Eremothecium gossypii
MAESMQRIASAFESARDLTLEAAAVASSRLGESSYFHYSKSIDSESLPGLLNSRYTREVRDGMKRVMSLMGSGDSSIELETHFADIVKNIGSDDVKVRRMVSVYLLRYAETNPNLALLSINSIQRSLSDSNPDVRALALKTLSDINIASLYPIILHSLKKTVIDSSEVVRCQVAMTLLKLFKEQGISIKDDVMPMLKSLLADSEPSVVSAALLLFQKAFAQELQLLHGHYRRYCSILNQLTENAQAIMIDIFIAYAKEYLPRPMVRDTSSDAEAIQLPDSFNQIPFPVYDVEYDHDLNLFLSSLKKLLHSPNAMVIVAVSKAFYQLSSPKTFKDSGIVDSLLRLPVSSYICSEIKELVLQSILVYCCSDPSLFRSHYKRFFLMPSDTENISIFKLKILSILVSDSNCKHIVNELKFVAGTEQSASILVEVSNTLSVCAQISSKWSSQIISWLLDRISSNTPIDKEVTASQINVLRSLIQKDPIKHIATVVKLSKMLSNHDLLPSAKAPIIWLLGEYVQVEPRICPDVLRRLLPQFSKEHAHVRLQILNLAAKLLSHDVDSYSGDMEYDIGTSRIGQMFEAALQLAKFDDEYDVRDRARMLASIFEQKRYEIATLLLQAPKPYPMASLNYCRDSFNLSALNLYPDMENYYELLPWNADPQASDRTPCEVKDYSKLKNSFSSSSYFGRNEVEFTNKPKRSASVSSVPSNTFTSSHGKKYQLQSLDEFFSDVSARQSVPKAKRVIIEESTSEETDHTDDESGSSSGDESTESSYVSSSEEETTE

SEQ ID NO: 33343 - DNA, 2085 bp, Eremothecium gossypii
  CDS (1)..(2085)
atggacaagaagataaagcggttcttgaaagatgcggtgcgtgttgcgccgaagatatccaacaaaggggagctgtttgaattaaagaatggtctcgtttccaaatacccgcaaaccaggaaggacgcgatcaagaagaccattcagcagatgacgctcggaaaggatgtgtcttctctgtttcctgatgtgctgaagaacattgcgacgtcggacattgagcagaagaagcttgtgtacttgtacgtgatcaactacgcgcagacacacccggagctgtgtatcttggccgtgaacacgtttgtcacagacgcacaggaccccaatccgctgatacggtgcatggcaatccggacgatgtccatgatccgtgtggacaagattctggagcacgtggaaattccgttgcgcaagacgctgcaggacgacaacccttatgttcgcaaaactgcagtgatatgtgtggcaaagctgttccaactgaaccgggagctgtgcatggagctggacgtgctaacagatctcatgtctgcccttgacgacagcaaccccatggtggtagcgaactctattgcagcactgactgagatctacgaactagaccgatcagctgtgccacttccattgctgatccagtcgcatgtgacccaatttttgaatgcactgaacgaatgtactgaatgggcgcggattacaattcttggtgcacttgcccagtacgaggcgaaagatgccatggaggcacaagacacaatcgtgcgcgtaacaccgcatttgcagcacgtgaccgctgccgttgtgttggcttccgtgaaggtgattgtcaagaacctggactttttgcctcgggaaatgcagaagcagcccagcgagaaaatatcgacagccctcgtctctctaatgtctacgcctcctgagatgcaatatgttgcgctaaagaccatcagaattctactccagaagtacccaactctgcttgagaaggaattgaggatattctacgtcaagtttaacgatcccatgtacgtgaagctcgagaagttagacatcatggtgcgcctagtcactacctcgaacttgaagcaatgcagcacgcttctgcttgaattgcgcgagtacgctttagagtttgagcccgagtttgtttccaaggcgatccttgctatttcgcagttggcgatcaagtttgcacatggtgccgatgctgtcaacgcttccaagttcatcgccaaggccatagatatcctgagtaccctcatccaggataggaatacattccaggacgaatgtttgatatccatatgtgacctcctaagatacgatccgcagctttccggcatgccactgtcaatcatttcctcctggactgatgcagaatctcggctggtcacagaccagggcaaatgcaattacatttggttgttggggcagtaccaattccccaacgcagaggagaagctcatgcagtttgtcgacacatatccgcagcagggccagtctacgcagatgtccatcctcgtgacagtggtgaagctcagccaacagctgccgggccatgttctgcaacgcgtgctcgagctggctacgacgcaagcacaggatattgacatcagagatatggcaatgctatactggcgttgtctatcgcttccaaacccggagtcgttgatcaacgaactctgcaataccaagctaccccagctcaccaacacccttgactacttttcgccggaacttctgcatacgctgctcaacgagctctccacattgtcgtccatatattacaaaccactctcgcagttcaagtaccgcgcgcctcaacagagtgaagtccagtcaaaggcactcgatgagcttacgtccctcgcgcacgcggagatcgccaaaaacatgaataacgagaccctactgaatatggacgacgcacaggcagccccaaagcccggaaacacgcttgcagagctcagcgacctcttcggaaacactggaggttcgttgctggacaagcccatgcaagacatgtcgctccatgccgacagccgtactgtacaaggcgcctcgaaggacctgctcgatctgttctaa

SEQ ID NO: 33344 - protein, 694 aa, Eremothecium gossypii
MDKKIKRFLKDAVRVAPKISNKGELFELKNGLVSKYPQTRKDAIKKTIQQMTLGKDVSSLFPDVLKNIATSDIEQKKLVYLYVINYAQTHPELCILAVNTFVTDAQDPNPLIRCMAIRTMSMIRVDKILEHVEIPLRKTLQDDNPYVRKTAVICVAKLFQLNRELCMELDVLTDLMSALDDSNPMVVANSIAALTEIYELDRSAVPLPLLIQSHVTQFLNALNECTEWARITILGALAQYEAKDAMEAQDTIVRVTPHLQHVTAAVVLASVKVIVKNLDFLPREMQKQPSEKISTALVSLMSTPPEMQYVALKTIRILLQKYPTLLEKELRIFYVKFNDPMYVKLEKLDIMVRLVTTSNLKQCSTLLLELREYALEFEPEFVSKAILAISQLAIKFAHGADAVNASKFIAKAIDILSTLIQDRNTFQDECLISICDLLRYDPQLSGMPLSIISSWTDAESRLVTDQGKCNYIWLLGQYQFPNAEEKLMQFVDTYPQQGQSTQMSILVTVVKLSQQLPGHVLQRVLELATTQAQDIDIRDMAMLYWRCLSLPNPESLINELCNTKLPQLTNTLDYFSPELLHTLLNELSTLSSIYYKPLSQFKYRAPQQSEVQSKALDELTSLAHAEIAKNMNNETLLNMDDAQAAPKPGNTLAELSDLFGNTGGSLLDKPMQDMSLHADSRTVQGASKDLLDLF

SEQ ID NO: 33345 - DNA, 3375 bp, Anopheles gambiae str. PEST
  CDS (1)..(3375)
atgctttcctctgggtcggctgcaatcggggtgagtgctctggcctcaacggcttacggcaatgagcgtaccgaggtggcagaatacgcgaacgagggaggcttcttccacgcagattacaaaaagcacgatgacttgaagcaaatgctggacagcaacaaggacagcctgaagctggaggcgatgaaacgaatcatcgggatgatagcgaagggccgcgacgcgtccgacctgtttccggccgtggtaaagaatgtggtgtcgaaaaacatcgaagtaaagaagctggtgtacgtttatctggtgcgatacgccgaggagcagcaagatctggccctgctttccatctccaccttccagcgggcgttgaaggatccgaatcagctgatccgagccagcgcactgcgcgtgctgtccagcatccgggtgtcgatgattgttccgatcgtgatgcttgcgatccgggactccgcctccgacatgagcccgtacgtgcgcaaaacggctgcccatgccattccgaagctgtaccatctcgacccggaacagaaggacgagctgatcgtggtgattgagaagctgctggccgaccgtacgacgctggtggtcggttcggcggtcatggcgttcgaggaggtgtgcccggagcggaccgaactgatccacaagaactatcgcaagctgtgcaatctgctcgcggacgtggacgagtggggccaggtgctcatcatcaatatgctgacgcggtacgcacgaacgcagtttctggatcctaacgctgatgatgactatgactaccaggaagcagaaaataaacctttctacgaggacgagtccgattccgatgcttcagacggcaaacgaaaggagagtgcggcggtggcttcgcctcggaaaacctacacgctcgacatcgaccatcggatgctactgcggcagacgaaaccattgctgcaaagccgtaacgcgtccgtcgttatggccgtcgcccagttgtatcaccatgtggcaccacgcaacgaggtggaaatagtggcgaaagcgttaatacgcttactgcgcagctacaaggaggtgcagagtatcgtgctcacctgcattgcctcgatgacgatcgagcggaagtccatcttcgagccgtttatcaaatcgttcttcgtgcgcactagcgaccagacgcatataaagctgctgaagctggaaattctgacgaacctagcgacgggaagcaacatttccgtgattttacgcgagtttcaaacgtacatcagtagcaacgataaagagtttgtggcttccacgattcaggctatcgggcggtgtgcggtttcgatttcggaagtgacggaaacgtgcctgagcggtttggtgcatctactatcgaacaaggatgagtacgtggtggcggaaagtgtggtcgtgatcaaaaagctgctgcagacaaagaaggaggaacatttcgaaatcatctcgcagatggccaagctgctcgatttcatccaggtaccggcggcgcgtgcctccatcctgtggcttatcggcgagtacaacgaaaaggtgccgaagattgcacccgacgtgctgcgcaaagcggtcaaaagcttcatcgaggagcaggatattgtgaagctgcaggtactgaatctggcagtgaagctgcacatcaccaacccgcagcagacgtccctgctgtgtcagcatctgcacaatctcgcccgctacgatcctaactatgacatacgcgaccgggcgcggttcttgaaaccattcctgctggcctcgccggacgggtcggatgctgccggatcgattctggtggcaaaggcaaggaaaatcttcctctccgagaagccggctccaacgctcgaaagcatgtaccatggcagacggcaatatcagctgggatcactgtcgcactatctgaatatgcccacgaacggctatcaagatttgcccgcctggccaacggaggcgcccgacagctcggtaagaaacgtggaaccaccggcgtcgatgggtggaggagagtatccgggacggccgggcaacgatcgtgctggaagtggaaattctgtcggggaagctgaccggcgcaagaaaaaggcgaaatctttctactccggctcggaggatggcacccggtcgagcactacggagggtgcatcgaccgcttctggttcgtcttcgtcgggttccggatcgggctcgggatcgggatcatcatcgtctggttcgtcaagctccggcagtgcagcaaagaacaaccgtcggaaggaggatagaccgacgaaaacggcttacaacgaggtggacggtacgagtcgatccaataagcaaagctcgatggatgagagcgatagtgatagcagcggaagctatgagtcatccacgtcttcagcttcgtcttcgggaggcaagaaaaaatcatcttccaaaccccaaactagcaagccgaacaacaaatcccggggaggggagaaaaagtccgcaacgaatgctccgggtaaaagcaacctggaccttttgctcgatctcgacgacattccgccgatcggtccagtgatgacaccctcgttgggaggattccttacgccgatggcagcaacgaacacggcaggcgctggcaccggcattgagctggtcggtccgagcttcataccgatcaaaaagcacgagctgctcaacaaggtgaacgggttcgggctgggaatcgagtatcgtttcgtacgctcgccccatctgtactcgtcgcgcatggtttcggtggagctgacgttcacgaaccatggcaacgtagagctggttgacatcgagatgggcaagaaagggaacctcccggccgggatggctgtgaacgatttcgccccgatcggtcggctgaatccgggacagagcgtgacgggaatgctgggcgtggactttaacgattctacccagcccgtgcggctggaaatctgttcagcgagtgggtcgagcacggtaacgctgaaggctccggtcggcgagatggtacgatcggtagccatcgcggagagtacgttcgacagcgagcggggcaagcttcgtggcatgacggaacattcctgcacactgcagctcagtgatgcactttccccggacgataagagtttgcatcggaccgtgtttgaggcgagcaatgtggcgtgcgtaccagtcgatgatgggaaggacgattccggcaagcgaatgcttttcgccggacaaacgatgagctccaaaagtttggtgctcgttgtgctggagcgaaccagcacgtccgacggaaaaaatgcatactcattgaccgtgaactgcgaaaagttggtcgtcggatcgatgctgctgaacgagctgaaggcggtgctgaagcagtag

SEQ ID NO: 33346 - protein, 1124 aa, Anopheles gambiae str. PEST
MLSSGSAAIGVSALASTAYGNERTEVAEYANEGGFFHADYKKHDDLKQMLDSNKDSLKLEAMKRIIGMIAKGRDASDLFPAVVKNVVSKNIEVKKLVYVYLVRYAEEQQDLALLSISTFQRALKDPNQLIRASALRVLSSIRVSMIVPIVMLAIRDSASDMSPYVRKTAAHAIPKLYHLDPEQKDELIVVIEKLLADRTTLVVGSAVMAFEEVCPERTELIHKNYRKLCNLLADVDEWGQVLIINMLTRYARTQFLDPNADDDYDYQEAENKPFYEDESDSDASDGKRKESAAVASPRKTYTLDIDHRMLLRQTKPLLQSRNASVVMAVAQLYHHVAPRNEVEIVAKALIRLLRSYKEVQSIVLTCIASMTIERKSIFEPFIKSFFVRTSDQTHIKLLKLEILTNLATGSNISVILREFQTYISSNDKEFVASTIQAIGRCAVSISEVTETCLSGLVHLLSNKDEYVVAESVVVIKKLLQTKKEEHFEIISQMAKLLDFIQVPAARASILWLIGEYNEKVPKIAPDVLRKAVKSFIEEQDIVKLQVLNLAVKLHITNPQQTSLLCQHLHNLARYDPNYDIRDRARFLKPFLLASPDGSDAAGSILVAKARKIFLSEKPAPTLESMYHGRRQYQLGSLSHYLNMPTNGYQDLPAWPTEAPDSSVRNVEPPASMGGGEYPGRPGNDRAGSGNSVGEADRRKKKAKSFYSGSEDGTRSSTTEGASTASGSSSSGSGSGSGSGSSSSGSSSSGSAAKNNRRKEDRPTKTAYNEVDGTSRSNKQSSMDESDSDSSGSYESSTSSASSSGGKKKSSSKPQTSKPNNKSRGGEKKSATNAPGKSNLDLLLDLDDIPPIGPVMTPSLGGFLTPMAATNTAGAGTGIELVGPSFIPIKKHELLNKVNGFGLGIEYRFVRSPHLYSSRMVSVELTFTNHGNVELVDIEMGKKGNLPAGMAVNDFAPIGRLNPGQSVTGMLGVDFNDSTQPVRLEICSASGSSTVTLKAPVGEMVRSVAIAESTFDSERGKLRGMTEHSCTLQLSDALSPDDKSLHRTVFEASNVACVPVDDGKDDSGKRMLFAGQTMSSKSLVLVVLERTSTSDGKNAYSLTVNCEKLVVGSMLLNELKAVLKQ

SEQ ID NO: 33347 - DNA, 2181 bp, Neurospora crassa
  CDS (1)..(2181)
atgtcggccgcacaaggaggaggagactccaagctgttcgcgaggggcaaagtagctgagctacgcctcgagctgaacagcggcagcaagaaggacaagaactttacccaaaagaagattgccctcaagaagattgtcgccaacatgaccatgagtaacaatgacatggtcggtttgtttcccgatattgtcgcctgcatggccatccagagcttggaaattaaaaagatgtgcttcttgtatctggtcaactatgcgaggatgaagccagagattgcggtaaaagcaattccggttctggaacatgacatggaagatccaaaccccctggtgcgcgcccttgccctacggaccatgtcttatatccacgtgcgcgagttcgtcgaggctactgtgccactagtcaagcacctcctccgcgatatcgacccctacgttcgcaagacggcggctttctgcgtggccaagctctacgatcacgatcgacacatggttgaggcttcggaccttattgacagactcaacaacctcttgagagacgacaacccgacagtggtggccagtgccctggcgagcttgatggatatctgggagaggacaagcagatggggccaaacctacatcctcgaagccctcatgtcttatatcccccaagaatccggcgaagctctccttctcgccgagcgtattgccccacgcctctcacattccaactcgtcggtagtcctcacctgtatccgtgtgatcctttacctcatgaactacatctccgaccaaaagcaaatctcggccctctgccggaaactctccccaccactggtcaccctcctcgccaagggtcccgaagtgcaatacctcgccctgcgcaacgccctcctcatcctccaacgccgccccgaagtcctccgcaacgacatccgcgtcttcttctgcaagtacaacgaccccatctacgtcaaggtcaccaagctcgaactcatcttcatgctcgccaatgagaagaacattgacgaggtcttgacggaactccgcgagtacgccaccgaaatcgacgtccactttgtccgcaaggctgtccgcgccatcggcaaactggccattaagattgagccagcggccaagcgatgcatcaacctgctgctcgagttggtctccacaaaggtcacctacatcgtgcaagaagccacggtagtgatccgcaacatcttccgcaagtacccgaaccagtacgagtccattatcggcaccctctgcgagcacctggactcgctcgacgagcccgaagccaaagcagccatggtgtgggtcattggccagtacgcctcgcgtatcgagaactcggacgccctcctcgaagactttttgtactccttcgccgaagagcccgtcgaagtccagctcgccctgctcacagcaaccgtcaagctcttcatccaacgtcccaccaagggccaggacctcgtcccgcgcgtgctcaaatgggccaccgaagaaaccgacaaccccgacctccgcgaccgcgcctacatgtactggcgtctcctctcgactgacatggaatccgccaagcgcatcgtcatgggcgagaaacccgccatcaccgccgagtcggagcgtctcgaccccgtcaccctcgaggaaatgtgtctcaacgtcggcaccctcgccaccgtctacctcaagcccgtccagaccgtgtttcgtaacgcccgcccacgcaaactcccagactccccgtgcctccaacgccccgactatcttgactactcaacagcccaccaactgcccaaccccaaatcgctctcccagttcggccaaggccaccaaccgtctgactttgatccccgcgtgcctgggtcccgacctgctccccctacttcttcgagcaacactcagagtcaacaaggagggaacttggctcaagcggtacatgatgcggacgcctactttacgcagcaagcgaaccagcaggcggcggtcaatgatgcggatgcgtactttgcgcagcagatgaggcagatgcagatacagcagcccggcgacagttttggtggggatgcgggacattatgggtatggacaggggtacgtggtcagtcagagctcggcgtaccagccggggatgggggggatgaatggcatgggagggatgaatggggctcagggggatttgttgttgtga

SEQ ID NO: 33348 - protein, 726 aa, Neurospora crassa
MSAAQGGGDSKLFARGKVAELRLELNSGSKKDKNFTQKKIALKKIVANMTMSNNDMVGLFPDIVACMAIQSLEIKKMCFLYLVNYARMKPEIAVKAIPVLEHDMEDPNPLVRALALRTMSYIHVREFVEATVPLVKHLLRDIDPYVRKTAAFCVAKLYDHDRHMVEASDLIDRLNNLLRDDNPTVVASALASLMDIWERTSRWGQTYILEALMSYIPQESGEALLLAERIAPRLSHSNSSVVLTCIRVILYLMNYISDQKQISALCRKLSPPLVTLLAKGPEVQYLALRNALLILQRRPEVLRNDIRVFFCKYNDPIYVKVTKLELIFMLANEKNIDEVLTELREYATEIDVHFVRKAVRAIGKLAIKIEPAAKRCINLLLELVSTKVTYIVQEATVVIRNIFRKYPNQYESIIGTLCEHLDSLDEPEAKAAMVWVIGQYASRIENSDALLEDFLYSFAEEPVEVQLALLTATVKLFIQRPTKGQDLVPRVLKWATEETDNPDLRDRAYMYWRLLSTDMESAKRIVMGEKPAITAESERLDPVTLEEMCLNVGTLATVYLKPVQTVFRNARPRKLPDSPCLQRPDYLDYSTAHQLPNPKSLSQFGQGHQPSDFDPRVPGSRPAPPTSSSNTQSQQGGNLAQAVHDADAYFTQQANQQAAVNDADAYFAQQMRQMQIQQPGDSFGGDAGHYGYGQGYVVSQSSAYQPGMGGMNGMGGMNGAQGDLLL

SEQ ID NO: 33349 - DNA, 2418 bp, Neurospora crassa
  CDS (1)..(2418)
atggaatcgatagccaggatttcgtcgctgctagaaagcgcccgagagctcaccctcgatgccgcctcggccgcccgcagcgcccgcagctcgtccaagcctctcgatcgcgttcaggttaagaaactcctcgacagtcgcaatgaacgagaagtgctggacggtctgcgtcgggtcatctcgatgatgtaccgctcgcaaaggacacaccctctgttctcctccgtcgtcaagaacgtcgcctctccgaatatcgagatcaagaagctggtctacatctatttgatccaccatgccgaggaggaccccgaccttgccttgctatccatcaacaccatccagaagtcgctttccgattccaaccctcaagtgcgcgccttggctctacgcacaatgtccaacatacgggttcccgttatcagccagattgtgtcgttggccatcaagaagggcgccggagacatcaacccctatgtgcgccgagccgctgccttggccatccccaagtgttaccgactcgacccatcccaaatgccctcactgctcgaatatctctcgactctcttaggcgacaagcagtattatgtggcaggtgccgccgttacagcctttctggagatctgtccggacagattggacttgatacacaagcattacaggcagttagtcaagatggtggtggatatggatgaatggagccagctctcgacactgcggcttatgacagtttatgcgcgaaaatgcttccctcgacgaacccggatggtgaaagcccaggacaaggcggccgatcttcaggacttttacggtgataacgccgccgccagctcgaataatgacgccgagggccaggaggttattgttctcgaccctgatctcgagctgctcctcaacagcatcaaacccctcctccaatcacgaaactcaggcgttgtggtttcagtagcacgctgttacgatgcagtaggcacgcccgagtatgtcaagacagccatcgggccattgatagctttgctacgaggcgctcaggatatccaacaggttgcactctacaacatcgtatccatttgccttacccggcctgccgatttcgtgcgctatgcctcgcatttcctagtgcgtgcaacggatacacaacccatatgggaactcaagctggagcttttgacactcatcttcccacatgctcctctccatgtcaagagccttattctcaacgagcttgagcacttcagccgaggaaccgataaggcgctggttagggaggcagttagggctattggccgctgcgcggtaacagacacaacagctgcacctaggtgtctgcggttgcttctcagtcaaatcactagcttggacggcacgctggccgcagagagcttgacagtgatacgacatctaatccagcaggacccaactgcacacgtcgctacggtcataaggctggcaaagaacttggactcggccaccgacccacacgctcgtgccaccattatctggctcgtaggcgagttctccggtctcaacggagaagagaacatcgcccctgacgtgcttcggattctgctcaaggactttccctccgagtccgaaatcgccaaacgacaaatcatccttctcggcgccaaggtctacctacactacctcaaccgacagattgaagcatcacaaaatgccgatggcgaaccgggtcctccacccaagcttctcgaagacgatgaccatccaattgcaaagctatggagttatgtgctcctcctggctcgctacgatacctcttacgatctccgtgatcgcactcgtctctacaaagcattgctcggcgtaccccagctcgcaaccctcatgctgctcgcgcctaagcctgcgccccaagcgcaaagtccctcggagatgaggcgtgggtatacccttggctcttcagccctggtcctcgccgatgccgccggtgttcacggcgtcaggggctacgaggacttgcccgattgggtcgaagagggcaagcagccggatccgagactgagagagacaggtgtgccaccaaccgcgacgtacggcgagaagagagtcgtaccagctttggagattttggacggtgggtcgtctagatcagtgcctacgaagtctaatggtctgggtgagggagtagggaccaagacacttgatgattggcttgcggaggaggaggatatcagtaagaaggcggtgccagtgtcagcacctgtgcaacggcaggttgtggaggagagtgaagaggaggatgaggaaggggaaaccactgaggaagaagaagatgatgatgaagaagaagaagaagaagaggaggaagacgatgaagaagaagaggaagagagttcatcggaagaggaggagtctgatgatgacgaggccgaagacgcgaggctgatgggggcatga

SEQ ID NO: 33350 - protein, 805 aa, Neurospora crassa
MESIARISSLLESARELTLDAASAARSARSSSKPLDRVQVKKLLDSRNEREVLDGLRRVISMMYRSQRTHPLFSSVVKNVASPNIEIKKLVYIYLIHHAEEDPDLALLSINTIQKSLSDSNPQVRALALRTMSNIRVPVISQIVSLAIKKGAGDINPYVRRAAALAIPKCYRLDPSQMPSLLEYLSTLLGDKQYYVAGAAVTAFLEICPDRLDLIHKHYRQLVKMVVDMDEWSQLSTLRLMTVYARKCFPRRTRMVKAQDKAADLQDFYGDNAAASSNNDAEGQEVIVLDPDLELLLNSIKPLLQSRNSGVVVSVARCYDAVGTPEYVKTAIGPLIALLRGAQDIQQVALYNIVSICLTRPADFVRYASHFLVRATDTQPIWELKLELLTLIFPHAPLHVKSLILNELEHFSRGTDKALVREAVRAIGRCAVTDTTAAPRCLRLLLSQITSLDGTLAAESLTVIRHLIQQDPTAHVATVIRLAKNLDSATDPHARATIIWLVGEFSGLNGEENIAPDVLRILLKDFPSESEIAKRQIILLGAKVYLHYLNRQIEASQNADGEPGPPPKLLEDDDHPIAKLWSYVLLLARYDTSYDLRDRTRLYKALLGVPQLATLMLLAPKPAPQAQSPSEMRRGYTLGSSALVLADAAGVHGVRGYEDLPDWVEEGKQPDPRLRETGVPPTATYGEKRVVPALEILDGGSSRSVPTKSNGLGEGVGTKTLDDWLAEEEDISKKAVPVSAPVQRQVVEESEEEDEEGETTEEEEDDDEEEEEEEEEDDEEEEEESSSEEEESDDDEAEDARLMGA

SEQ ID NO: 33351 - DNA, 2250 bp, Neurospora crassa
  CDS (1)..(2250)
atgtcagctatcaaccgcattaggggtgcgtttgcgccgccgcgcaagggcgaaaccttcgagctgcgagccggccttgtgtcccaatatgcctacgagcggaaggaagccatccagaagaccatcatggccatgaccctgggcaaggatgtttcggcgctcttcccggacgtcctcaaaaacattgcgacctccgaccttgaccagaagaagctggtgtatctctacttgatgaactacgccaaatcacatcccgatctctgcattctagccgtcaacacattcgtacaagactcggaagacccgaaccccctcattcgagcgctggcgattcgaacaatgggctgcatccgtgtcgacaaaatgatcgattacatggaggagccgctacgaaagacgctacgagacgagtccccctacgtacgcaagaccgccgccatctgtgtcgccaaactgttcgatctcaaccccacaatgtgcatcgagaacggcttcctggagacactgcaagagatgattggtgatcccaatcccatggttgtggccaactccgtccaggccctgtccgaaatccacgaaactgcccccgagaccagggcgcttgtcctcacacccgcgaccctaaagaagctgcttatggcgttgaacgagtgcacggaatgggggagggtcaccattttgacaacactagccgagtacactgcccatgacgtcaaggaatcggaacacatttgcgaaagagtagcgccccagttccaacacgtcaaccccagcgtggttttggctgccgtcaaggtcgtctttacccacatgaaggctctcaaccccaagacagtgagcgcttacctgaagaagatggctcctcctctggtaacgctcatcgcttctgctcctgaggttcagtatgtcgcgctgcgcaacattgaccttctgctgcaagccaatcccgatattcttagcaaggagctgagggtattcttctgcaaatacaacgaccccccgtacgtcaagctccagaagcttgaaatcatggtcaggatagcaaacgacaagaactttgatcaactactttccgagctcaaggagtatgcccttgaagtcgacatggatttcgtccggagagctgtcaaggccatcggtcaggtcgccatcaagattgaggccgctagcgaaaagtgcgtcaacgcgttgcttgatctaatctccaccaaggtcaactatgttgtgcaagaggttattgtcgtcatcaaggacatcctccgcaagtatcccggatatgaaggtgtcattccgactctctgcaagtacatcgacgagttagatgagcccaacgccaggggtgccttgatctggattgttggagagtatgctgagaaaatcaacaacgccgatgaaattctggaagggttcgtcgagggtttcttggaagagttcacgcagacccaattgcagattcttaccgctgtggtcaagctgttcctgaagaaacccagcaacacccaaggcctagtacagaaggtcctccagcaagccacggcagacaacgacaaccccgatatcagagaccgtgcttatatctactggcgtctcctctctggcgatctcgatgttgccaagagcattattctctctcaaaagcccgccatcacgacaacagtaacatccctccctcccgtcctcctcgagcaacttctttccgagctttccactctcgcctccgtctaccacaagcctcccgagtcgttcgtcggcaagggccgtttcggcgccgacgagatccagcgcgccgccatccaagaacagcgccaaaacgccgccgagaaccccattgccgcgtcagtcgctgctgctgccaaaggtggccagcagaacaacgttgagaatcttctcgacatcgattttgacggcggcgctcctgccagcgcagagcacggtggcggtgtcggcacaccagatcggtttggcagcccggccaacgtcggtggtcttcccggtgcgccaccgcaacccagtggcggcatggcggatatcatggggcttttcgatgcaccaccgcccatgccgtcggcgtctgctgcaacttcgccggctgctgcaggcgggatgggtgacatgatgagctcgtttgcaggcatggatcttagcgggacgagtgcgccgccgccgcctggtcagcagctggggcatccggctagtcagactcctcccaagagtggtggaggtagcgaggatctgcttgggttgttctga

SEQ ID NO: 33352 - protein, 749 aa, Neurospora crassa
MSAINRIRGAFAPPRKGETFELRAGLVSQYAYERKEAIQKTIMAMTLGKDVSALFPDVLKNIATSDLDQKKLVYLYLMNYAKSHPDLCILAVNTFVQDSEDPNPLIRALAIRTMGCIRVDKMIDYMEEPLRKTLRDESPYVRKTAAICVAKLFDLNPTMCIENGFLETLQEMIGDPNPMVVANSVQALSEIHETAPETRALVLTPATLKKLLMALNECTEWGRVTILTTLAEYTAHDVKESEHICERVAPQFQHVNPSVVLAAVKVVFTHMKALNPKTVSAYLKKMAPPLVTLIASAPEVQYVALRNIDLLLQANPDILSKELRVFFCKYNDPPYVKLQKLEIMVRIANDKNFDQLLSELKEYALEVDMDFVRRAVKAIGQVAIKIEAASEKCVNALLDLISTKVNYVVQEVIVVIKDILRKYPGYEGVIPTLCKYIDELDEPNARGALIWIVGEYAEKINNADEILEGFVEGFLEEFTQTQLQILTAVVKLFLKKPSNTQGLVQKVLQQATADNDNPDIRDRAYIYWRLLSGDLDVAKSIILSQKPAITTTVTSLPPVLLEQLLSELSTLASVYHKPPESFVGKGRFGADEIQRAAIQEQRQNAAENPIAASVAAAAKGGQQNNVENLLDIDFDGGAPASAEHGGGVGTPDRFGSPANVGGLPGAPPQPSGGMADIMGLFDAPPPMPSASAATSPAAAGGMGDMMSSFAGMDLSGTSAPPPPGQQLGHPASQTPPKSGGGSEDLLGLF

SEQ ID NO: 33353 - DNA, 2217 bp, Magnaporthe grisea 70-15
  CDS (1)..(2217)
atgtcggcggtgaacaggatacgcggggctcttgccggcccgagaaagggtgaaactttcgagttgcgcgccggcctggtctcgcaatatgcgtacgagcgcaaggaagctatacagaagaccatcatggccatgacgttaggcaaggacgtgtcggcgttgtttcctgatgtgctcaagaacattgccacggcggatctggaccaaaagaagctcgtgtatctgtacttgatgaactacgccaagtcacatccagacctttgtattttggcagtcaacacgtttgtgcaggactcggaggacccaaaccccctgatcagggccttggcgatacggactatgggctgtatcagggttgacaagatggtggactacatggaagagcccctgcgcaagacattacgggacgagtcaccatacgtgagaaaaaccgcggccatctgcgttgccaagcttttcgatctcaaccctacaatgtgtattgaaaacggcttcttggagacgttacaagagctcattggggatccgaatccgatggttgtggccaactcggtccaggcgctctcggaaattgcagagacggcacccgagacccgggcgctggtcatcacgccagcaacgctcaagaagctgctgatggccctcaacgagtgtactgagtggggacgcgtgactatcctttctacgcttgcggactaccctccgtcagacgtgaaggagtcggagcatgtgtgcgagagagttgcaccgcagttccaacacgtcaacccgagtgtggtcttggcggctgtcaaggtggtgttcatacatatgaaagtcatcaaccccgactccgttaggcaatacctgaagaagatggcgcctccgctggtgacccttgttgcttctgcccctgaagttcagtatgtcgcattgaggaacatcgatcttcttttgcaggcaaaacccgatattctcagcaaagaattgagggtattcttctgcaagtacaacgaccctccatacgtcaagatgcaaaaactggagattatggtgcggatagcaaacgacaagaactttgagcagcttcttgccgagttgaaggaatacgcgctcgaggtagacatggacttcgtgaggcgagccgtcaaagcgattggccaggtcgccattaagatcgagagcgccagcgaaaagtgtgtcaacgctttgctagatttgatggcaaccaaggtcaactatgttgtccaggaggtcgtcgtggtcatcaaggacatcttgcgcaaatatcctggatatgagggcgttatccccaccctgtgtgaacacattgatgaactggacgagccaaacgcaaggggttcgctgatatggatcgtgggcgagtatgcagagaagatcagcaatgcagatgagataatatcaacatttgttgacggatttatggaggagttcacacagacacaactgcaaattctcacagccgctgtcaagctcttcttgaagaagccgagtaataaccaaggtctggtccaaaaggtcttgcaacaagcaacagcagacaatgacaacccggacattcgagaccgcgcatatgtctactggcgtttgttgtcaggcgacttggatatagccaagaatattatcacatctcaaaagcccgccatcaccacaacgatgacttctcttccttcgtcactcttggagcagttgttgactgagctctcaactttggcatcagtataccacaagccaccagagtctttcgtcggcaagggccgtttcggcgccgacgctatccagagggcagctatccaggagcagcggcgtgatgcggccgagaaccccatcgcagccgctgttgcagctgcagcgaatggagcacctccccagagcaacgtcgaaaaccttttggacatcgatttcgatggcgccgcgccggccagcgcggaggcgtctggaacgccagaccgcgttgcaagccctggcgtgcctgcagccccgagtggaggcatggcagacatgatgggtctctttggagacatgggcggcggctcatcggcacctgcaccatctgcagccgcgccgtctagtggcatggatgacattatgggcggatttgcgggtctggacatgggtggttcgagtgcgccgcctccggcaacacagcagctgcaaggtggtgccggcgcgggagccaagaagaacgacaacgaagacttattgggtctgttttaa

SEQ ID NO: 33354 - protein, 738 aa, Magnaporthe grisea 70-15
MSAVNRIRGALAGPRKGETFELRAGLVSQYAYERKEAIQKTIMAMTLGKDVSALFPDVLKNIATADLDQKKLVYLYLMNYAKSHPDLCILAVNTFVQDSEDPNPLIRALAIRTMGCIRVDKMVDYMEEPLRKTLRDESPYVRKTAAICVAKLFDLNPTMCIENGFLETLQELIGDPNPMVVANSVQALSEIAETAPETRALVITPATLKKLLMALNECTEWGRVTILSTLADYPPSDVKESEHVCERVAPQFQHVNPSVVLAAVKVVFIHMKVINPDSVRQYLKKMAPPLVTLVASAPEVQYVALRNIDLLLQAKPDILSKELRVFFCKYNDPPYVKMQKLEIMVRIANDKNFEQLLAELKEYALEVDMDFVRRAVKAIGQVAIKIESASEKCVNALLDLMATKVNYVVQEVVVVIKDILRKYPGYEGVIPTLCEHIDELDEPNARGSLIWIVGEYAEKISNADEIISTFVDGFMEEFTQTQLQILTAAVKLFLKKPSNNQGLVQKVLQQATADNDNPDIRDRAYVYWRLLSGDLDIAKNIITSQKPAITTTMTSLPSSLLEQLLTELSTLASVYHKPPESFVGKGRFGADAIQRAAIQEQRRDAAENPIAAAVAAAANGAPPQSNVENLLDIDFDGAAPASAEASGTPDRVASPGVPAAPSGGMADMMGLFGDMGGGSSAPAPSAAAPSSGMDDIMGGFAGLDMGGSSAPPPATQQLQGGAGAGAKKNDNEDLLGLF

SEQ ID NO: 33355 - DNA, 2175 bp, Magnaporthe grisea 70-15
  CDS (1)..(2175)
atgtcggcccctcagggaggtgactctaagctctttgctcgaggcaaagttgcggagctccgtctcgagctgaacagcggtggcaaaaaagacaagaacttcacggcgaagaagattgcgttgaagaagatcgtggccaacatgaccatgagcaataatgacatggtcgccctgtttccagatgtgataggctgcatgcatatagagagtcttgagatcaagaagatgtgttttctcttcctcgttaactacgccaggatgcgaccggagattgccataaaggcgattcccgtattggaatatgatatgcgagattcaaatcctttggtcagggctctagcattacggaccatgtcttacatccacgtgcgggaatttgtcgaggcgacggtaccgattgtgaagcaaatgttgaaggattcagatccatacgtcaggaaaacggcagcattctgtgttgcaaagctttacgaccacgacaagcagatggtggagcagtcagacctcattgaccggctcaatggtttactgcgcgacgacaacccgaccgtcgtggcaagtgctcttgcttcgctcatggatatttgggagcgaagcgacgctatcaagcttaccatcgactatggcaacgcttcgaaaatggttgctattttgccggactgctcagaatggggacaaacgtacattttggaagcgttgatgtcgtacctacccgtagactcaggggaggctctgctgcttgcagagagaatagcccctcggctctcccattctaattcggcagttgtgctcacctgcatcagggtcatactctacctaatgaactacatctcagaccaaaagcaaatttctgcgctttgcagaaaattgtcaccgccactggtcacattgctggccaagggccccgaggtgcagtacctagctctgagaaatgcgctgctcattctgcagcggcgtcccgaggtgttgcgcaacgacatcagggtcttcttttgcaagtacaacgatccaatttacgtcaaggtcaccaagctggagctcattttcatgctcgccaacgagagaaacattgacgaggttcttacagagctgcgggagtacgcaaccgagattgatgtccactttgttcgcaaggcagtccgcgcaatcggcaagttggccatcaagatcgagccagcagcaccgcgatgcatcgaccttctgctggagcttgttgcaacaaaagtaacttacattgtacaagaggcgacagtggtcatccggaatatcttccgcaaatatccaaaccagtacgagtcgatcattggcactctgtgtgaacatctcgactcactggacgagcctgaggccaaggctgcaatggtttgggttattggccagtatgcatctcgaattgagaatagcgacgctctacttgaggatttcctatactcatttgcagatgagcccgtggaggtacagctagcgctgttgactgcaacggtaaagctcttcatacaacgccccacaaagggacaggagctggtccccaaggttcttaaatgggctacagaggagactgataacccggatttgcgcgaccgggcatacatgtactggagactgctatcaaccgatattgctatggcgaagcaaatcgtcatgggcgagaagcctcccattacggcagagtcagagcgcctcgatccggccacgcttgaagagatgtgtctaaacgttggcacgctagctactgtctacttgaagccagtacagaccgtcttccgctcagcgcgaccgagacgtctccttgactcgcctgctttacagcggcagctactgccccctggatcgggaccgctcgcgccaccgggtccttatgagaacaataagagcctcagcatgttcgggcaagggggcaggcccgccaatgttgaccccagagacgggagccggggcaacgctctcgattctagcggcggaaacctagcccaggcagtcagtgatgccgatgcatactttgcgggcgttggggctcaagcgatggccaacatgagagtcgaggagagggatacctttgggggaactagcggtgtcgacatgggtggcggaggatatgtggtcaaccagtacacgcctcagactgtgctgcaaccgggacaagataataggaacggggacttgttgatgctctga

SEQ ID NO: 33356 - protein, 724 aa, Magnaporthe grisea 70-15
MSAPQGGDSKLFARGKVAELRLELNSGGKKDKNFTAKKIALKKIVANMTMSNNDMVALFPDVIGCMHIESLEIKKMCFLFLVNYARMRPEIAIKAIPVLEYDMRDSNPLVRALALRTMSYIHVREFVEATVPIVKQMLKDSDPYVRKTAAFCVAKLYDHDKQMVEQSDLIDRLNGLLRDDNPTVVASALASLMDIWERSDAIKLTIDYGNASKMVAILPDCSEWGQTYILEALMSYLPVDSGEALLLAERIAPRLSHSNSAVVLTCIRVILYLMNYISDQKQISALCRKLSPPLVTLLAKGPEVQYLALRNALLILQRRPEVLRNDIRVFFCKYNDPIYVKVTKLELIFMLANERNIDEVLTELREYATEIDVHFVRKAVRAIGKLAIKIEPAAPRCIDLLLELVATKVTYIVQEATVVIRNIFRKYPNQYESIIGTLCEHLDSLDEPEAKAAMVWVIGQYASRIENSDALLEDFLYSFADEPVEVQLALLTATVKLFIQRPTKGQELVPKVLKWATEETDNPDLRDRAYMYWRLLSTDIAMAKQIVMGEKPPITAESERLDPATLEEMCLNVGTLATVYLKPVQTVFRSARPRRLLDSPALQRQLLPPGSGPLAPPGPYENNKSLSMFGQGGRPANVDPRDGSRGNALDSSGGNLAQAVSDADAYFAGVGAQAMANMRVEERDTFGGTSGVDMGGGGYVVNQYTPQTVLQPGQDNRNGDLLML

SEQ ID NO: 33357 - DNA, 2508 bp, Magnaporthe grisea 70-15
  CDS (1)..(2508)
atggagtccatctcgcgcatttcctcgcttcttgagagcggtaagcaaaagagaagaaaagaacagggaggaagatcaacaccctacacaaaagagaaccagaacgctgacgccacctttgtgccgttcctatgtttagcccgagagctcaccctcgatgctgcctcggccgccgcgtcccggggctcacgcacctccacaaggccaccggacaaggcgcaaataaagaggcttctggacagccgcaatgagagggaggttctggatggactacgaaaggtcatcgcgttcttctcttccgtggtaaaaaatgtcgcatccccgaacctggagatcaagaagctggtctacatctacctccttcaccatgccgaacaagagccggacctggcattgttgtccatcaacacgatccaaaagtcactgtcggacggcaacccgcaggtcagagcgctcgctctacgcacaatgtcaggcatccgcgtccccgtgatcagccaaatcgtctccctggctatcaagaaaggggtcggtgacatgagcccgtatgtgcgccgggctgccgccctagcgattccgaaatgtcatcgtctcgatcccactcagctgccacagctccttgaatatctcaccactctgctcggtgataagcagtactacgttgcaggtgctgcagtcactgccttcctggaggtctgcccagaccggctggatctgatacataaacattacagagccctagtacgaaaagtcgtagacatggacgaatggtcacagctttcgactttacggttgatgacggtctatgggaggaaatgtttcccgaggcggacgcgcacagtaaagatcaaaaccgtcaagaaccatactccggatctacaggacttctacggggaaggggacggaactaacagtccagataaggaaggtacagacggcgaaaaggttgtcatacttgatccggaccttgagttatttcttaatagcatcaagccgttattacacagccgcaactcggctgtaattgtctccgtagcgcggagtttcattgcgctagggacagactcacacatcagctccgcgatcggccccttgatcgccctcctccgtgggccacaggacacccagcaggccgccctttacagcattgtatccgtgtgcctatctcgaccggccgaatttgcgcgttatgcgacgcactgtctcgtgcgcggcaccgacacaccggaagtgtgggagcttaagctggaggtgcttacgctcatctttccgcacgccacccctcacgttaagtcgttgatcctgtcggaactggaacatttttcccgaggaggctttggctcacagcaggacagggagctcatgcgcgctgccgtgcgagccatcggacgttgtgcacaggcagacgcggcagcatctcgccggtgtttacgacttttacttgggcaaatcacgagtttggatggtacacttgccgccgagagcttaactgtcatacggcatctgatccagcgtgatccaagctctcacctctccaccgtagtcaggctggcgagaaatctcgactctgccactgacccattagcgcgcgcaactatcgtctggctggttggtgagtttgctggtatcaacgatggcgacaacgttgcggccgatgttttgcgtattctactcaaggatttcgcaaatgaggccgaggtcaccaagcgacagatcctgctgttagctgccaaggtccacttgcaccgtcttaacagaactgctgggaatgactctgccaaaaaggagcaaaagccattagtatcaggtgaacccctggagaccgaaggatggggagctcctgatgagtcggaggcgcagtcacccaaggagccagaggaggctcatccaaccgcaattctatgggattatacactagtattagtccggtacgacacatcctacgacctccgcgaccgcgcgaggatgtacagggccctgcttggagtgccccagctggcgacactgatgctactcgcaccaaagccggcgccacaggcaccaagcccgtcagaagtacgtaaggggtacactctcggatcggcagcgctcgtgctcgctaggggcggcggagttcatggcctcagaggttacgagccgttgcccgactgggtcgaggatggcaaggaaccggatccgatgctgcgcgagggagatggggcggtcaagagtacatatggcgagacgcgatcagtaccggctgctgagagtcttgacagcgctgtcgggtcgtcaatgccaacctcgaaggccgtcaaggcttctaatggaatgggcgaaaagtcactggatgactggctcgccgagagtgaacatgaagaggaagaagacgatgatagtggtgagagtgaggaggagagctccgatgaagaggaggaagaggaagaggaggacgacgaggatgattcggatgaggaagaaagtaacgacgatcagggggaaggagatagacttgttggtcggtcttag

SEQ ID NO: 33358 - protein, 835 aa, Magnaporthe grisea 70-15
MESISRISSLLESGKQKRRKEQGGRSTPYTKENQNADATFVPFLCLARELTLDAASAAASRGSRTSTRPPDKAQIKRLLDSRNEREVLDGLRKVIAFFSSVVKNVASPNLEIKKLVYIYLLHHAEQEPDLALLSINTIQKSLSDGNPQVRALALRTMSGIRVPVISQIVSLAIKKGVGDMSPYVRRAAALAIPKCHRLDPTQLPQLLEYLTTLLGDKQYYVAGAAVTAFLEVCPDRLDLIHKHYRALVRKVVDMDEWSQLSTLRLMTVYGRKCFPRRTRTVKIKTVKNHTPDLQDFYGEGDGTNSPDKEGTDGEKVVILDPDLELFLNSIKPLLHSRNSAVIVSVARSFIALGTDSHISSAIGPLIALLRGPQDTQQAALYSIVSVCLSRPAEFARYATHCLVRGTDTPEVWELKLEVLTLIFPHATPHVKSLILSELEHFSRGGFGSQQDRELMRAAVRAIGRCAQADAAASRRCLRLLLGQITSLDGTLAAESLTVIRHLIQRDPSSHLSTVVRLARNLDSATDPLARATIVWLVGEFAGINDGDNVAADVLRILLKDFANEAEVTKRQILLLAAKVHLHRLNRTAGNDSAKKEQKPLVSGEPLETEGWGAPDESEAQSPKEPEEAHPTAILWDYTLVLVRYDTSYDLRDRARMYRALLGVPQLATLMLLAPKPAPQAPSPSEVRKGYTLGSAALVLARGGGVHGLRGYEPLPDWVEDGKEPDPMLREGDGAVKSTYGETRSVPAAESLDSAVGSSMPTSKAVKASNGMGEKSLDDWLAESEHEEEEDDDSGESEEESSDEEEEEEEEDDEDDSDEEESNDDQGEGDRLVGRS

SEQ ID NO: 33359 - DNA, 2331 bp, Gibberella zeae PH-1
  CDS (1)..(2331)
atggagtcaatagcacgcatctcggctctcatggagactgcgagggagctcaccctcgatgcagcccaggcgacgcgcggtgcgcgcacgagctcaaagcctctggataggaaccagatgaaaaagttactggatagtcgaaacgagcgtgaggttctcgacggtttacggcgtgttatcgcgatgatgtaccgcaaccacaagaccttgccattcttctcatccgttgtcaagaacgttgcatccccgaatatagagatcaagaagcttgtctacatttacctcatacaccatgccgaacaggaacccgacctcgccctactgtccatcaacactattcagaaatccctatccgaccagaaccctcaagtccgagctcttgccctcaagaccatgtcgggaatccgagtccccgtcatcagccagatcgtatctcttgccatcaagaagggtgttgccgatatgagcccctacgtgcggaaagccgctgcccttgcgatcccaaagtgccatcgattagacccgagtcaagcaccgcagctaatcgaaaacctgtcgactttgttgggcgacaagcaatattacgtcgctggagctgccgtgtcagctttcctggagatttgccctgaccaaatagatcttatacataaacattatcgcgcgctgataaagcaagtggtggacatggacgaatggagccaactggcgacactgcggctcatgacgtattatgcacgaaagtgcttcccacgaaagtcaaagtcaccggacgaacctaccgaaaccgtccaggaacagaaagtagacgacttttacggtgaatcacgacagggcaatcgaggtcaaggttcttcttcagttctggatccagacctcgcattgctactgaatggaatcagacctcttctacaaagccgaaacgctggtgttgttgtcgctgttactagatgctacgttgacattggcacaccggaatatgtaaagcaggctatcggcccattgattgctttgctacgtggagcacaggacatacagcagactgctctctttaatattgtttctgtgtgtcttattcgacccgcagactttgttaaatatgctagccacttccttgttcgggccactgacactgcccctatatgggaattaaagttggagatcttgaccatcatcttcccccacagtccttcgcatgtcaagagtcttattctaaaggaattagaacacttctctcaaggaacaaacaaagcattggttcgtgaggcggtgcgtgccattggccgctgcgcccagaccgacactactacagctcctcgatgcttgaagctactattgggccaaatcacaagtctagatggtacccttgctgccgagtcattgactgtaatccgtcacctgatacaacaggatgttcagggacatgttggaaccgtcgtacggctagcgaagaatctcgactcagcaacagatccccaggcgcgcgcaacgattatttggctggtgggtgaattctcaggcctccatggagaggacaacatcgcgccggatgttcttcgaatccttctcaaagagttcacaaacgaatcaccagttgccaagcaacagattctgctcttggctgccaaggtgtaccttcatcacatcaatcgcaagagcgaagcggaaaaggagcaggatgcagaggaagatccacccatggagacagacactcatcctattgtgagactatgggagtatgcccttctccttgtcagatacgatacgtcattcgaccttcgtgatcgtgcgaggatgtatcggtcgcttcttgcggtgcctcagctggctactttgatgttgcttgctgagaaacctgccccccaggctccaagtccatctgaatctcgaaagggattcttactgggctcttccacactggtacttgcgggtggcggtggtattcatggtctcaggggatatgaacccttaccagactgggtcgaggaagggcagcagcctgaccgtcgacttcgagagcctgaaggcggccaaagttctaggtacgatgtcgaaagaagcacacttcctgctagtgacagactggatgaggctgcaaagacagccatgcccacaaaggccaacggtacaggcgaagcggtgggtacaaagacgttggacgattggctcggagaagagaaggaaagtgaggagtcatcagaagagacagaagaagaatcatcagaagaggaggacgatgaggatgatgatgatgacgacgacgatgaggaggaagaagacgaggaaacagacagtgacgatgatggggaggccgatagactggtaaagtcctaa

SEQ ID NO: 33360 - protein, 776 aa, Gibberella zeae PH-1
MESIARISALMETARELTLDAAQATRGARTSSKPLDRNQMKKLLDSRNEREVLDGLRRVIAMMYRNHKTLPFFSSVVKNVASPNIEIKKLVYIYLIHHAEQEPDLALLSINTIQKSLSDQNPQVRALALKTMSGIRVPVISQIVSLAIKKGVADMSPYVRKAAALAIPKCHRLDPSQAPQLIENLSTLLGDKQYYVAGAAVSAFLEICPDQIDLIHKHYRALIKQVVDMDEWSQLATLRLMTYYARKCFPRKSKSPDEPTETVQEQKVDDFYGESRQGNRGQGSSSVLDPDLALLLNGIRPLLQSRNAGVVVAVTRCYVDIGTPEYVKQAIGPLIALLRGAQDIQQTALFNIVSVCLIRPADFVKYASHFLVRATDTAPIWELKLEILTIIFPHSPSHVKSLILKELEHFSQGTNKALVREAVRAIGRCAQTDTTTAPRCLKLLLGQITSLDGTLAAESLTVIRHLIQQDVQGHVGTVVRLAKNLDSATDPQARATIIWLVGEFSGLHGEDNIAPDVLRILLKEFTNESPVAKQQILLLAAKVYLHHINRKSEAEKEQDAEEDPPMETDTHPIVRLWEYALLLVRYDTSFDLRDRARMYRSLLAVPQLATLMLLAEKPAPQAPSPSESRKGFLLGSSTLVLAGGGGIHGLRGYEPLPDWVEEGQQPDRRLREPEGGQSSRYDVERSTLPASDRLDEAAKTAMPTKANGTGEAVGTKTLDDWLGEEKESEESSEETEEESSEEEDDEDDDDDDDDEEEEDEETDSDDDGEADRLVKS

SEQ ID NO: 33361 - DNA, 2244 bp, Gibberella zeae PH-1
  CDS (1)..(2244)
atggcagtaaatcgcattaagggcgcctttgccgtgcctcgaaagggtgagacttttgaactgcgcgctggtctggtctcgcagtatgcatacgagcgcaaggagtcgatccaaaagaccatcatggccatgacgctgggcaaagatgtgtcagcactctttcccgacgtgctcaagaacattgcgaccggcgatctcgatcaaaagaagcttgtatacctttacctgatgaactacgccaagtcacatcccgatctctgtattctcgccgtcaataccttcgttcaggattccgaagacccaaatccgctgataagagcactcgcgatccgaacaatggggtgcatcagagtggacaaaatggtggattatatggaagagcccctgagaaagacgctacgagacgaatcgccatacgtacgcaagacagccgccatttgcgtcgccaaattgtttgatctcaacccacagatgtgtattgaaaatggatttttggaggctcttcaggaattgattggcgaccccaaccctatggttgtcgccaactcggtgaccgctctgtctgagattaccgagaccgcgcctgagacgagggcattgattgttacccctgtgacgttgaagaagctgcttatggctcttaacgagtgtaccgaatggggacgtgttactattttgacaaccttggcagactactctgcgtcagaccagaaggagtcggagcacatttgtgagcgtgtagcacctcaattccagcatgttaaccctagtgtggttcttgctgccgttaaggttgtcttcattcacatgaaggctctgaaccctgactccgtgaggtcatacctcaagaagatggcacctcctcttgttactttggtcgcttcgcaacccgaggttcaatatgttgccctgcgaaacattgatctcctactccaagccaagccagatattctcagcaaggaaatgcgcgttttcttctgtaaatacacagacccaccatacgtcaagctgcaaaagctggaaatcatggtcaggatagcgaacgaacacaactacgagcaacttcttgccgagttaaaggagtatgccctggaagtggatatggatttcgtccgaagagctgtcaaggctatcggccaggtggccatcaagatcgagaacgctgctgagaagtgtgttgcggccctcgaggacctcatttctaccaaagtcaactacgttgtacaggaagttattgtggtcatcaaggatattctccgaaaataccctggatatgaaggtgttatccccacgctctgcaagcacattgatgagttggatgagcctaccgctcgtggatctcttatctggatcgtcggtgagtatgccgagaagatcaacaatgccgacgagatcttggagagttttgttgagtctttcatggaggagtttacacagacacaattgcaaatattgacggctgtggtaaagttgttcttgaagaagcccggtagcaaccaaaatctggttcaaaaggttctccaagcggctacagcggagaacgataaccccgatatccgcgatagggcatatgtgtactggcgtcttctttcttcagaccctgaagttgccaagaatattgtcctgtcccagaagcccaccatcacaactaccatgacaagtctcccacccgctctcttggagcagcttctcaccgaactatctactcttgcttcagtctaccacaagcctccggagtcatttgttggtaagggccgttttggtgccgatgagatccagcgagctgctattcaggagcagcgacaaaacgccgccgaaaaccccatcgcagcttcagtggccacggcttcatccaacggatctggcggcggtgcccagaacaacatcgaaaacttgctcgatattgattttgatggtgccgcgcctgcttctcatgagcagaacagtgcttccgcaacccctgacagagtggccagcccatctgcgagtggaccttcaggggctatggccgacatgatgagcatgttcgatgcgccggcgcagccttcgggcgtaggagctcccacatcagctgcgggacctagcaacaacatgaatgacttgatgaatggatttgagggcttgaactttggcggtgcaacaacgagcgagcctctaccagcagcgatgcaattgcagcaggcacaggggggtgcacctcagcagcccaagaaggacagcgacgacttgctgggtctgttgtag

SEQ ID NO: 33362 - protein, 747 aa, Gibberella zeae PH-1
MAVNRIKGAFAVPRKGETFELRAGLVSQYAYERKESIQKTIMAMTLGKDVSALFPDVLKNIATGDLDQKKLVYLYLMNYAKSHPDLCILAVNTFVQDSEDPNPLIRALAIRTMGCIRVDKMVDYMEEPLRKTLRDESPYVRKTAAICVAKLFDLNPQMCIENGFLEALQELIGDPNPMVVANSVTALSEITETAPETRALIVTPVTLKKLLMALNECTEWGRVTILTTLADYSASDQKESEHICERVAPQFQHVNPSVVLAAVKVVFIHMKALNPDSVRSYLKKMAPPLVTLVASQPEVQYVALRNIDLLLQAKPDILSKEMRVFFCKYTDPPYVKLQKLEIMVRIANEHNYEQLLAELKEYALEVDMDFVRRAVKAIGQVAIKIENAAEKCVAALEDLISTKVNYVVQEVIVVIKDILRKYPGYEGVIPTLCKHIDELDEPTARGSLIWIVGEYAEKINNADEILESFVESFMEEFTQTQLQILTAVVKLFLKKPGSNQNLVQKVLQAATAENDNPDIRDRAYVYWRLLSSDPEVAKNIVLSQKPTITTTMTSLPPALLEQLLTELSTLASVYHKPPESFVGKGRFGADEIQRAAIQEQRQNAAENPIAASVATASSNGSGGGAQNNIENLLDIDFDGAAPASHEQNSASATPDRVASPSASGPSGAMADMMSMFDAPAQPSGVGAPTSAAGPSNNMNDLMNGFEGLNFGGATTSEPLPAAMQLQQAQGGAPQQPKKDSDDLLGLL

SEQ ID NO: 33363 - DNA, 2142 bp, Gibberella zeae PH-1
  CDS (1)..(2142)
atgtcgagcgccgccggtggaggggactccaaattgtttgctcgaggcaaagttgctgagctgcgtctcgagctaaacagtggaggaaagaaagataaaaattatgcgggcaagaagatcgcactcaagaagattgtcgcaaacatgaccatgagcaataacgacatggtggccttgttccccgacattattgggtgcatgggcatccagagtctggaaatcaagaagatgtgtttcttgtttctggtcaactacgctaggatgaggcctgagattgctgttaaggcaatccccgttttgcaacatgacatggaagatcacaaccctttggtgcgagcgttggctctcaggacaatgtcttatatccatgttagagaattcgtcgaggctactgtaccaatagtcaagcacatgctgaaagatggcgacccttatgtgcgaaaaacggctgcattctgcgtagcgaagctctacgaccacgatcgaaacatggtagagagctccgacctcattgatcggctaaactcacttctaagggatgataaccctaccgttgttgcgagtgctttggctggtctaatggatatctgggagcgcagcgatgccatcaaactcaccattgactatagcaatgcttccaaaatggtggctatccttcccgactgctccgaatggggtcagacatatattctagaggctctcatgtcctatgtaccacaagaatccggagaggcggtactcctggcggagcggatatcaccgcgattgtcgcattctaattcgtccgtcgtgttgacctgcattcgggtgattctgtatctgatgaactatattgccgatcagaagcagatctcggccttgtgcagaaagctctcaccacctcttgtcacacttctcgcaaagggtcccgaggtacaataccttgccctccgaaacgctttgttgattcttcagcgacgaccagaagtgctgcgaaacgatatccgcgtctttttctgtaaatacaatgatcccatctacgtcaaggtcacaaagctggagctcatcttcatgcttgctacagaggataatattgatgaggtattgacggaactgcgagagtatgctactgaaatcgacgttcactttgtgcgcaaggcggtgcgcgccattggtaagctggcgatcaagattgaaccagcggcacgacggtgcatcaacctacttctcgagcttgtggcaaccaagatcacatacatcgtgcaggaagccacggttgttatccgaaacatcttccgaaaataccccaaccaatacgaatccatcatcagcactttgtgcgagcacctcgattctttggatgagcccgaagccaaggcagcaatggtttgggtcattggtcagtacgcagaccgaatagagaacagcgatgctttgttggaagacttcttgtactcatttgcggaggagcctgtcgaggtccaacttgctttgctcactgccacggtaaagctcttcattcagcgacctaccaagggacaggagttggtcccgaaggtgctgaagtgggcgacagaggagaccgacaaccccgatcttcgagatagagcttatatgtactggcgtctcttgtcgacagacatgaatgcagccagacaaatcgtcatgggagaaaaaccagctatcacagccgagtcggagagactcgactcggctacactagaggagatgtgcctgaacgtgggaacactagcgacggtctatctgaagccggtgcagactgtctttagatctgcccgaccacgcaaactccaagactccccggcgttgcagaagcaaaatcttcttgttgccggagacagccagaagagcatcagcatgtttggtaacgctggagcagcgacggatatcgacccaaggagccgaaacccaatgtcgggtgatggtcaagggaacatcgcacaggcagtcagtgacgctgatgcctacttctcaggcattggaacgcagcagatgacgccgatgcatggtgatcaaggagacgatgtctttggaggaggtaatggccactcgacgggatacgtggtgagcgcgcatgcgcctcaagccgttcttcagccaacgcaaggtgctggcagcaacggtgatttgttaatgctataa

SEQ ID NO: 33364 - protein, 713 aa, Gibberella zeae PH-1
MSSAAGGGDSKLFARGKVAELRLELNSGGKKDKNYAGKKIALKKIVANMTMSNNDMVALFPDIIGCMGIQSLEIKKMCFLFLVNYARMRPEIAVKAIPVLQHDMEDHNPLVRALALRTMSYIHVREFVEATVPIVKHMLKDGDPYVRKTAAFCVAKLYDHDRNMVESSDLIDRLNSLLRDDNPTVVASALAGLMDIWERSDAIKLTIDYSNASKMVAILPDCSEWGQTYILEALMSYVPQESGEAVLLAERISPRLSHSNSSVVLTCIRVILYLMNYIADQKQISALCRKLSPPLVTLLAKGPEVQYLALRNALLILQRRPEVLRNDIRVFFCKYNDPIYVKVTKLELIFMLATEDNIDEVLTELREYATEIDVHFVRKAVRAIGKLAIKIEPAARRCINLLLELVATKITYIVQEATVVIRNIFRKYPNQYESIISTLCEHLDSLDEPEAKAAMVWVIGQYADRIENSDALLEDFLYSFAEEPVEVQLALLTATVKLFIQRPTKGQELVPKVLKWATEETDNPDLRDRAYMYWRLLSTDMNAARQIVMGEKPAITAESERLDSATLEEMCLNVGTLATVYLKPVQTVFRSARPRKLQDSPALQKQNLLVAGDSQKSISMFGNAGAATDIDPRSRNPMSGDGQGNIAQAVSDADAYFSGIGTQQMTPMHGDQGDDVFGGGNGHSTGYVVSAHAPQAVLQPTQGAGSNGDLLML

SEQ ID NO: 33365 - DNA, 2895 bp, Ustilago maydis 521
  CDS (1)..(2895)
atgagtgcagcttactcgaactcgtcgcgagcgcttgccttcctctcggaaacctcggaggatgccatcgccgcgctcaaaggcttggtcggaggcgttggctcagccaagtatctcgacacttcagaggataagctttctaccatcgcaacccaaatcgactcgagtagggatgaagaccgtattgctgcgctcactcgcatcgtagccatggtctccaagggtcgcgatgcttcatccttcctacccgctgtcttgaaacttacctcttcatccaacctcgacgttcgcaagctcgtttacattgttctcctgcgctatgcgaatagcaatcctgatctgacgctcctcagcatcaacagcttccaacgagacctgtccgacccaagtccactcatccgtgccatggcacttcgtgtactcagcagcatcaaggtagccatggtggcgcccatcgtcatcatggcagtcaccaaagcttctcgcgaccccaacctctacgtacgcaaaattgctgctctggcgattcccaaatgctaccagatcgaccgatcccagttcgacagtctccaggacgttctggcgatcctgttgtcggatcgctctccattcgttttgggcgctgcgctctccgcattccagcgcatatgcccgacaaattggcaattgctacatcagagctaccgcaagatctgccatgcactttccgacatggatgagtggggtcagaatgttgcgcttcaggttctctcgcgatacgcaagaacgaatttaacccagcccagcgttaaagaagtaggacacttttcgtccacaactttgacatctagcacgcaggcagcatcagaggctaggacgcccgaacttgaaccaagcagtcaggcccacctaagtgcgagcaaagcaggcgatgtcgatagtctcgaagcattcctttccagcgatgcaaccagctcctccgctcccaccaacagcaccagtattggcaaggtggagtcgttctcaaatccaggttcaatcaaactctcatcgaatcttgaccgtgatctggaactgctcctcagcaaatcgcgaggcctgctgcacagtcgaaaccccgccgttgtacttgcagtggcacgcttgatcctctatctggcgcctacatccgaccacgtcatgctcgtcagaccactcgtaaagttacttaagtcgcctcccgatgtcagttatttggtcttgctcaacattctcacgatagcccgccgagacaattcgctttttgctccctttgcgacatcctttttcttgggcgcatctcacgaggagcccatcttcctgtcgctcctgaagctcgacactatggtcgtcatctgcaaccctgcaaatcttgatctgatcttgaccgaaattgccagccacatgcgatctgcagacgcagccatcgctgctcatgccgtatcgggtcttggcgagctcgctctcaggacggacctgacggcaagctcgaggtgtctcgccatcctacttgacttgctccgtaagcgcaagtccgggcctcgagttcacgactcaaccatcgcgcgtgcggtgctggtgatcaagaacctattacagctggatcaagaaccaatcagcggagaaagcgcgaccgagtcgaagaggatttctgccatcgtttatcgtctagcggctttgctttttggttcaggatccaagaacactgctgatgacaaatcgaagcgaaagtccaagtcaacgaccctcggcaagggggccatcctttatccagaagcaagagcaagcatcctctggcttctcggtcaatatgcacgtcataccatctcgatctctgatcctagcatggctgtcctctcgaacggtgcaggccaagagagcaagacgcttgccgaacttatcgtgccagacgtccttcgacgatgtgctatcaacttcaccaacgagacatcggctgtcaaattgcagatgctcaccacgtcgagcaaagcttttgcgtttttgccgactgtgctcacttccacgccggctctggaccaaggtcatgagggaagatcggagcagttgatatctgcggtgacggtgctgcatttctacatgttgaagttggctcgttacgatgccgatttcgacgttcgagatcgcgcacgattcttaaaaggcttgactgcgtcactgaccacaactaagaggtcggttggtaccggcggtgatgaaggcactgaaggtgtgccttcaagcaagaaggtgcaaggggatacaatccaggcagcgatagagagggcggcacatatgatcggcgaaggggttagcgaggaaggggatacagatctgaaaggcgtacgtctgcgaagggagcaagtcatacatgtcctgtttgacggtaaagcagtttcccccccgaccatcgatgtgccaaagtccaatcctgagatgaacaccgactcgccctccactcccgagattgcatcgctctcgctcgtactgggaggaaaactcatcaaaggctggctagacgctgcacttcccccttggacttctgacccaaccccatcgagcacacgcgaacctcccgcggtcacacaaacacccacccacccgacactgcaaaacaccacgctggcgaacctcaaatccttttcctcgtccgacttcgcctcttcgccactcgctgcttcctccccgatcgtcttgacgcccgcaaaaggcaacgcaactccaacctctcgcggcagtgcgactccaattgacctcgaagcaaatccaacatcgacacaggcgcaacaaaagtacaaagacctggattcattcttggacgacagcgacgatgacgacgacgagagcggacacgacgatggtcggtatctggacgactcggctcctgaagacgatgaatga

SEQ ID NO: 33366 - protein, 964 aa, Ustilago maydis 521
MSAAYSNSSRALAFLSETSEDAIAALKGLVGGVGSAKYLDTSEDKLSTIATQIDSSRDEDRIAALTRIVAMVSKGRDASSFLPAVLKLTSSSNLDVRKLVYIVLLRYANSNPDLTLLSINSFQRDLSDPSPLIRAMALRVLSSIKVAMVAPIVIMAVTKASRDPNLYVRKIAALAIPKCYQIDRSQFDSLQDVLAILLSDRSPFVLGAALSAFQRICPTNWQLLHQSYRKICHALSDMDEWGQNVALQVLSRYARTNLTQPSVKEVGHFSSTTLTSSTQAASEARTPELEPSSQAHLSASKAGDVDSLEAFLSSDATSSSAPTNSTSIGKVESFSNPGSIKLSSNLDRDLELLLSKSRGLLHSRNPAVVLAVARLILYLAPTSDHVMLVRPLVKLLKSPPDVSYLVLLNILTIARRDNSLFAPFATSFFLGASHEEPIFLSLLKLDTMVVICNPANLDLILTEIASHMRSADAAIAAHAVSGLGELALRTDLTASSRCLAILLDLLRKRKSGPRVHDSTIARAVLVIKNLLQLDQEPISGESATESKRISAIVYRLAALLFGSGSKNTADDKSKRKSKSTTLGKGAILYPEARASILWLLGQYARHTISISDPSMAVLSNGAGQESKTLAELIVPDVLRRCAINFTNETSAVKLQMLTTSSKAFAFLPTVLTSTPALDQGHEGRSEQLISAVTVLHFYMLKLARYDADFDVRDRARFLKGLTASLTTTKRSVGTGGDEGTEGVPSSKKVQGDTIQAAIERAAHMIGEGVSEEGDTDLKGVRLRREQVIHVLFDGKAVSPPTIDVPKSNPEMNTDSPSTPEIASLSLVLGGKLIKGWLDAALPPWTSDPTPSSTREPPAVTQTPTHPTLQNTTLANLKSFSSSDFASSPLAASSPIVLTPAKGNATPTSRGSATPIDLEANPTSTQAQQKYKDLDSFLDDSDDDDDESGHDDGRYLDDSAPEDDE

SEQ ID NO: 33367 - DNA, 2154 bp, Ustilago maydis 521
  CDS (1)..(2154)
atggcggactcaggcaaggatgccaagttcttccagcgaggcaaagtcgacgagctgcgcaccgagctcaatgccgacaagaaggacaagggctgggtgcgcaaaaaggcggtgctcaaaaaaatcattgccaacgccaccatgggcaacgacatgtctgcacttttcccggacgtagtgcagtgcatgaacatccaggtgctcgagatcaagaagatggtgtacctctacctcatcaactacgcacgtgccaaaccggatctcgtatccaacgcagtgcccgggtttctttcggattgcaacgatcgaaatccgctcatccgcgcgctcgccatccgaaccatgtcctacatccacgtacccaccgtgctagcagcgttgatcgatcctttgaggcattcactcaaagatgcagatccatacgtgcgcaaaacggcggccatctgcgtcgcaaagctctacatgcacgacaagcgattgatggaaaagcattcctttattggtatgcttcgtgacctgctcgccgatgccaatcccaccgttgttgccaacgccgtcgctgcgctcgtcgagatctcggaaaggtcggacaacatccagctcaagctcaacctcaccatcgcttccaaactcgtctccgctttggcagagtgttccgaatggggccagacgtacattctcgaagcactcatgttctttgtcccttcggactttgccgatgccgagatattggccgaacgcatcgctgttcgtctgcaacacgccaattccgcggttgtgctcactgccactaaagtcatcctttatctgatgaactacattgccagtgctgagttcaaggagtcgctctgtcggaagctctctccaccgctcgtcacgttgctttcttcggggccagaggtgcagtacgtagcgctgcgaaacattttgctcgtgatccagaggagacctttggttctacagaacgaagtcaaagtatttttttgcaagtacaacgatcccatctacgtcaagatggccaagctcgagatcatctatcggcttgccaacgagcgcaatgtcgagcaggtgcttgccgaactgcgcgagtacgcttccgaggtagacgtcgattttgcgcggaaagcggtgcgcagcatcggacgcttggcgatcaagatcgagtcttcagcggaccgatgcatccaggcgctgctgacactcatccagaccaaggtgaactacgtggtgcaagaagcgatcgtggtgatcaaggacatcttccgaaaatatccgaaccggtacgagagcgtaatcggtacgttgtgcgacaacctggataatttggacgagagcgaagccaaggcggcgatgatctggatcatcgggcagtatgcggatcgcatcgagaactcggatgagctgttggaagatttcttgtatacttttctcgaagagccagtggatgtgcagttggcgctgttgacggcaacggtcaagctgtttctcaagcggcctacggcgggaggcgagttggtgccgaaagtgttgaagtgggctacagaggaggttgagaatccggatttgagggatcgaggattcatgtattggcgactgctctcgaccgatccggaagcggcgaggggggtggtgttgggtgctaaaccggccattagtaccgagacggatcggatggatcgtcaattgctcgaccaattgcttctgcacggtgccagcttggcgagcatctttcatcggcaaccgcagacgtttatccgcaacgccaaggcgaggtacattccggattcgtctgcgctcgatgagagtgcacgtcggtacgctagcgctcatctttacagcaagccactcgctcgagcacctgttctcaacacaacgctcgagaccaagcccgacgaaaaactgcccctctacgaccatgcttccacatcccgcgcgctcgctgaacgcgacaaatcacatggcccggaccacgaccatctcccagaccaccaaccaaatcatttgtcctcgtcgaaatcctcgtacaccccgctcggcgtcgacgacacccaagacgctgacccttacgctatgctcgccgacaacttcggctcctcttccaatacgacgtatctacccgatccgccaacacccaagccgtccttcctcgattag

SEQ ID NO: 33368 - protein, 717 aa, Ustilago maydis 521
MADSGKDAKFFQRGKVDELRTELNADKKDKGWVRKKAVLKKIIANATMGNDMSALFPDVVQCMNIQVLEIKKMVYLYLINYARAKPDLVSNAVPGFLSDCNDRNPLIRALAIRTMSYIHVPTVLAALIDPLRHSLKDADPYVRKTAAICVAKLYMHDKRLMEKHSFIGMLRDLLADANPTVVANAVAALVEISERSDNIQLKLNLTIASKLVSALAECSEWGQTYILEALMFFVPSDFADAEILAERIAVRLQHANSAVVLTATKVILYLMNYIASAEFKESLCRKLSPPLVTLLSSGPEVQYVALRNILLVIQRRPLVLQNEVKVFFCKYNDPIYVKMAKLEIIYRLANERNVEQVLAELREYASEVDVDFARKAVRSIGRLAIKIESSADRCIQALLTLIQTKVNYVVQEAIVVIKDIFRKYPNRYESVIGTLCDNLDNLDESEAKAAMIWIIGQYADRIENSDELLEDFLYTFLEEPVDVQLALLTATVKLFLKRPTAGGELVPKVLKWATEEVENPDLRDRGFMYWRLLSTDPEAARGVVLGAKPAISTETDRMDRQLLDQLLLHGASLASIFHRQPQTFIRNAKARYIPDSSALDESARRYASAHLYSKPLARAPVLNTTLETKPDEKLPLYDHASTSRALAERDKSHGPDHDHLPDHQPNHLSSSKSSYTPLGVDDTQDADPYAMLADNFGSSSNTTYLPDPPTPKPSFLD

SEQ ID NO: 33369 - DNA, 2412 bp, Aspergillus nidulans FGSC A4
  CDS (1)..(2412)
atgttttggacggcctgcgacgcattatctctgtacgaaaccaaaggccttcgccagcattctagcgccgctgacctgccacagctcatgtaccgctctgaaccctccgtcccattcttttccgccgttgtgaaaaacgtcgccagcgcgaacctcgaagtcaagaagttggtctacatatatcttgttcatcatgcggaggcggaacccgacctcgctctcttgtctatcaatgcaatccagaaatcgctcacggaccaaaatcctcaggcccgggctatggcgctccgcacgatggctagcattagggtgccggtcattaaccagatcgtgtcgttggccattaaacgtggctgcggtgacatgagtccgcacgtccggaaagcagccgcccttgctatcccgaagtgctataggctggatcccagcacccagccgcaactgattgggtacatcgaaacacttctgggcgatacccagtattttgttgctggtcctgcggttgctgcgtttcttgaggtttgcccggataggatcgatttgatccataagcattaccggagcttagtcaagaaactcgtggacatggatgaatggggccaattggcgactttgcgtcttctgactttctacgctcggaaatgcttccctctgaagacacgaaaagtgcagaagaatcccactaagtcaaaaggattctatgacgatgacgatggggaagctaacgagggcgagggggaaacgtatgatgtcccagttctggacccagatcttgagctctttttacgatcttgcaggctacttttgcagagtcgtaatgccgcagttatcgtcgctgtcgttcgatgttacttttaccttgctccgacggaatatcttggtgctgccgttggtcctttggtcgctttgcttcgaagcccccaagacatgcagcacatagcgttgtacaatattgttgtcgtcgctctacgatatccgaaaccgtttacgaaatatgtgtcgcatttcttggtgcacgcgtcagacccacctcacatctggcgtctgaagcttgaagcacttacgatactctttccccactgcggtaatcactttaaaaacttgatcatcagcgagctcgaacattttgctcagggcgctgatcccgacttagtacgggagagcgtacgcgccctgggacgttgtgcacaaggtgaccctaatgcggctgataagtgtctacgtatcctactcaaccaaatcacaagccttgatgacactcttgtgtcagaatcactgactgttatccgacatctcattcaacatgatccgggctcgcatgagcggacagttattcagttggtgaagtacctcgggctgaccacaaatcccgacgcgagggcaaccattgtatggttggttggcgaatacgcgggacttgaacctgagaggaattttgcacctgacgttttacgggttttggtacagaatttcgccgaagagtcggaggctgtgaagcaacagatcctgctcttaggagctaaagtttatctccaccatattctacgcaatcctgtcaaggaagagtctgactcagaagagcctctatcgaagccggtggatcaaacccagctgaggaacgattgggcagatgccgatggcgagaaacaacacgacaggaatagtttagaggaaaaaaaagaagcacctggggaagaagatacaatgactcttctctggcggtatatactacttctggccagatacgacacatcttacgacctccgggaccgtgctcgtctatataaggcccttctttcttcgccctcgtcgactcaaatagcgaatttgcttctccttgccccaaagccggttccgcatgctcctagcccgtctgaaaccaggaaagacctattgattggctcatcaacgcttgttctgggaaacgacgctgggatccacggtttgcagggttacgaaaatataccagactgggtggaagcaggccacgagccggaccccagccttcgcgtgtcggatgttaaagccgataaaactaccacggtggcgactactgcaggtgagcagcttgacagagctctcaaggagcatgaagcgaacatagctgcctcaagccgagcgcacgcggttcgcgggagagtagccgctcctgctgcaaagaacaagacccttgatcagtggctcgatgaacccgagcccgaaacggacgaggagactgagtatgaagaggtaacagattctgaggagggagatgaagagtattcaacggaatacgaaacagactctgaggcaggagatgaggacgaggaagaggaagaggaagaagaggaggaagaagaagaagaagaagaagaagaagaagaggacgctgactccgaagagcgccgacaaactcaacagcttctaagatag

SEQ ID NO: 33370 - protein, 803 aa, Aspergillus nidulans FGSC A4
MFWTACDALSLYETKGLRQHSSAADLPQLMYRSEPSVPFFSAVVKNVASANLEVKKLVYIYLVHHAEAEPDLALLSINAIQKSLTDQNPQARAMALRTMASIRVPVINQIVSLAIKRGCGDMSPHVRKAAALAIPKCYRLDPSTQPQLIGYIETLLGDTQYFVAGPAVAAFLEVCPDRIDLIHKHYRSLVKKLVDMDEWGQLATLRLLTFYARKCFPLKTRKVQKNPTKSKGFYDDDDGEANEGEGETYDVPVLDPDLELFLRSCRLLLQSRNAAVIVAVVRCYFYLAPTEYLGAAVGPLVALLRSPQDMQHIALYNIVVVALRYPKPFTKYVSHFLVHASDPPHIWRLKLEALTILFPHCGNHFKNLIISELEHFAQGADPDLVRESVRALGRCAQGDPNAADKCLRILLNQITSLDDTLVSESLTVIRHLIQHDPGSHERTVIQLVKYLGLTTNPDARATIVWLVGEYAGLEPERNFAPDVLRVLVQNFAEESEAVKQQILLLGAKVYLHHILRNPVKEESDSEEPLSKPVDQTQLRNDWADADGEKQHDRNSLEEKKEAPGEEDTMTLLWRYILLLARYDTSYDLRDRARLYKALLSSPSSTQIANLLLLAPKPVPHAPSPSETRKDLLIGSSTLVLGNDAGIHGLQGYENIPDWVEAGHEPDPSLRVSDVKADKTTTVATTAGEQLDRALKEHEANIAASSRAHAVRGRVAAPAAKNKTLDQWLDEPEPETDEETEYEEVTDSEEGDEEYSTEYETDSEAGDEDEEEEEEEEEEEEEEEEEEEEDADSEERRQTQQLLR

SEQ ID NO: 33371 - DNA, 2301 bp, Aspergillus nidulans FGSC A4
  CDS (1)..(2301)
atggcgatgaacagaattcgcggcgcctttgcggtgcccagaaaaggagagacgttcgagttgcgagccggtcttgtctcacagtacgcctacgagagaaaggaggcgattcagaagacgatcatggccatgactctaggaaaggatgtatccgctcttttccccgatgtcctcaagaatattgcgacctccgacttggagcagaagaagctggtatacctttatctgatgaattacgccaaatcacatcctgacctctgtatccttgccgtaaacaccttcgtacaagactccgaggacccaaatccgctcattagggcactcgccatccggacaatggggtgtatccgagtggataagatgattgattatatggaagagccacttcgaaagacgctgcgggacgagtcgccgtacgtacgaaagaccgctgctatctgtgttgccaagctattcgacttgggaccagccatgtgcttggagaatggattccttgaaatgcttcaagagatgattggcgacccgaatccaatggttgtggccaattcggtaacggctctttctgagattcatcatgctgcaccggagactcaggcccttcaagtaaccccaaacactctacggaagctcctgatggcgttgaacgagtgcactgagtggggccgagtcacaatcctcacgacactgtctgagtacagaaccagcgctgtaaacgaagcagagcagatctgcgagcgagttgcaccccagttccagcacgcaaaccctagtgtggttctcgctgctgtcaaaacagtcttcttgcatatgaaaataatcaatgcggagctatcgaaaaactacctcaagaagatggcccctccgctagtgaccttagtatcatctgctcccgaagtgcaatatgtcgccttacgcaatatcgatcttttgctccaaaagcagccggacatccttaacaaagagctccgcgtttttttctgcaagtacaacgacccaccttatgtcaagtttcaaaagctcgaaatcatggtgcggatagccaacgaccgaaacttcgaccagctactagcagaactgagggagtacgccctggaggtggacatggatttcgtccgccgcgcggtcaaggcgattggccaggttgcaatcaagatcgaaagcgcttgtgagaagtgtgtcaatactttgctcgatctgatcaacaccaaggtcaactacgtggtgcaggaagccattgtggtgatcaaggatatcttccgtaaataccccggctacgaaggaatcattccaacgctttgcaagtgcatcgatgaattagatgagccgaatgcccgggccgccctcatctggattgttggggagtatgctgaaaaaattagcaatgcaggcgatatcttggcgggattcgtcgaaggtttcaatgaggaattttctcaggtttgttcaatccacatcttgcgcaagccgagcagtcatattaacggacaatggcagactcagctgcaaatcctgactgctgtcgtgaagctgttcctgaaacgccctgataaggctcaagggctagtgcagaaagttcttcaggcggcaacggcggagaacgacaaccccgatgtccgtgaccgagcctatgtctactggcgcttattatcaaataccagtgacccagatgctgctaggaacattgtgctctccaaaaagcctccaattgttaccactatccattcccttcctcctgctcttctcgagcaacttcttactgagctttccacattggcttctgtttaccacatgcctcccgagcagttcgttggccagggccgttttggtgcggacgctgttcagaaggctgccattgaggaacaactccagaatgcgcgcgaaaacccgctggctgctgccgcggcggcggcagttgatggcacggccgctccgcagcagcagaacaatgtggagaaccttctggatatcgatttcgatggcactgcgcctgcatctgctcacaaggaaccaggcggtggtgtgtctggtctggatggtttagctggcacccccgtccgtgttgactctcctgcaggtggtgcaccttcagggagcaataacctggacgacctccttggcgtttttggggacaatgtccagtcctctacaggcgcacatgcgcctcccactggtggtgcgggcgctgaccttctcaatggcttttctgggttggatctttccggcaacatgtcttcaccgccacctgcgtcacagtccagccagccgaagaaaactaatgaggacatcttatcattgttctaa

SEQ ID NO: 33372 - protein, 766 aa, Aspergillus nidulans FGSC A4
MAMNRIRGAFAVPRKGETFELRAGLVSQYAYERKEAIQKTIMAMTLGKDVSALFPDVLKNIATSDLEQKKLVYLYLMNYAKSHPDLCILAVNTFVQDSEDPNPLIRALAIRTMGCIRVDKMIDYMEEPLRKTLRDESPYVRKTAAICVAKLFDLGPAMCLENGFLEMLQEMIGDPNPMVVANSVTALSEIHHAAPETQALQVTPNTLRKLLMALNECTEWGRVTILTTLSEYRTSAVNEAEQICERVAPQFQHANPSVVLAAVKTVFLHMKIINAELSKNYLKKMAPPLVTLVSSAPEVQYVALRNIDLLLQKQPDILNKELRVFFCKYNDPPYVKFQKLEIMVRIANDRNFDQLLAELREYALEVDMDFVRRAVKAIGQVAIKIESACEKCVNTLLDLINTKVNYVVQEAIVVIKDIFRKYPGYEGIIPTLCKCIDELDEPNARAALIWIVGEYAEKISNAGDILAGFVEGFNEEFSQVCSIHILRKPSSHINGQWQTQLQILTAVVKLFLKRPDKAQGLVQKVLQAATAENDNPDVRDRAYVYWRLLSNTSDPDAARNIVLSKKPPIVTTIHSLPPALLEQLLTELSTLASVYHMPPEQFVGQGRFGADAVQKAAIEEQLQNARENPLAAAAAAAVDGTAAPQQQNNVENLLDIDFDGTAPASAHKEPGGGVSGLDGLAGTPVRVDSPAGGAPSGSNNLDDLLGVFGDNVQSSTGAHAPPTGGAGADLLNGFSGLDLSGNMSSPPPASQSSQPKKTNEDILSLF

SEQ ID NO: 33373 - DNA, 2172 bp, Aspergillus nidulans FGSC A4
  CDS (1)..(2172)
atgtttattgcgccttatgtacaatctagcttaccaccatgggttcgcacttcacagggcaaagttgccgagctccggcaggaactcaacagcggcggcaagaaggacaagaactattcggccaagaagattgcgttgaagaagatcgttgccaacatgaccatgagcaacaacgatatgatcgccttgttcccggatgttatcgactgtatgaatttgccgagcttggagatcaagaagatgtgctttctattcctggtcaactactcaaggatgaagcctgacatcgcactaaaggctcttcctatattaattaatgatatggaggcgacgaacccgcttgtccgcgctttggcgcttcgaacaatcgcgtatatccatgttcgagaatatgtcgaggccactgtacaaccgctcaagaggctgatgggagatatggatccctatgttcgcaagacggccgctttttgcgtagccaaactctacgagcatgataggaagatggtggaggcatccgatttgattgaccggctgaatgcgatgctgaaggatgaaaacccaacggttgtttcaagcgtcctggcttcattagtggatatctggggacgaagcgaaacaatatctttgacgattgattacgcaagcgcgtctaaactggtatcaatcttaccagactgttcagaatggggtcaatcctatatactggaagccctaatgtcctatgttccacaagattccgcagaagccctccttttggcggaacgtatcgctcctcgactctctcatcagaactccgccgttgtcctcacttccatccgcgtcatcctctaccttatgaactatatcgccgaagaacggcatctcacatcactctcaaagaaattatcaccacctctcgtgacgcttctgtccaaaccgccagaggtgcaatatcttgtcctccgcaatgccattcttatcctgcagaagcggcccgaagttctgcgtaacgacattcgggtcttcttctgcaattacaatgacccaatctacgtcaaggtgaccaagctcgagttgatattcatgttgaccactaaggagaacatctcagttgtgctggcagaactgagagagtacgcaactgagatcgatgtccactttgtgcgcaaggcagtccgggcgattgggaaactggccatcaagatcgagtccgctgccaaacagtgtatcgattgtctcctggacttggtaaacgccaagattccgtatatcgtgcaagaggcaaccgtcgtcatccgtaatatcttccgcaaataccccaaccagtacgaaagcatcatcggccaagtcatccaaaacatcgatgacctggacgaaccagaagccaaggcggccgtaatctggatcattggccagtacgcagaccgcatcgagaactcagccgacctcttgcaagactatctcgctacattccacgacgagacaattgaagtgcaactctcccttcttacagcaactgtcaagctcttcatccagcgcccaacgaaggcccagcaactcgttccgcaagtcctaaaatggtgtacagaggaaacagatgatccggatctccgtgacagaggatacatgtactggcgtcttctttcatctgacccaacaaccgcccgccaagtcgtcatgggccagaaaccacccatctccgctgagagcgagaaactcgacaaccgcaccctcgaggaactctgcctcaacgtcggaaccctcgcaacggtctatctaaagcctgtacaacaagttttcaggtccgcgcgtacccgtcgtctccagtacagtccggctcttcaaaaacgggttgaagaatacggctcaaactcctggcaattcccggcaccacctctaagcctaaaccccgttacttcgcccactgcggcaaccgcaacgtcagcgaacggatccgcttcgacgccaacggggaacacgagcgccgccattagtgcagcggataactacttcaatagcgttgccgtaggaacacagcagatggccgccttggatttgggcgggcgggaggatggagggttcggtggtggtggcgcgccgcagacgcagtatgttgttaatcagagccagcagcaggcgtatcagccgcatttagcagggggagcggcgacgggggagctgttgctgctgtga

SEQ ID NO: 33374 - protein, 723 aa, Aspergillus nidulans FGSC A4
MFIAPYVQSSLPPWVRTSQGKVAELRQELNSGGKKDKNYSAKKIALKKIVANMTMSNNDMIALFPDVIDCMNLPSLEIKKMCFLFLVNYSRMKPDIALKALPILINDMEATNPLVRALALRTIAYIHVREYVEATVQPLKRLMGDMDPYVRKTAAFCVAKLYEHDRKMVEASDLIDRLNAMLKDENPTVVSSVLASLVDIWGRSETISLTIDYASASKLVSILPDCSEWGQSYILEALMSYVPQDSAEALLLAERIAPRLSHQNSAVVLTSIRVILYLMNYIAEERHLTSLSKKLSPPLVTLLSKPPEVQYLVLRNAILILQKRPEVLRNDIRVFFCNYNDPIYVKVTKLELIFMLTTKENISVVLAELREYATEIDVHFVRKAVRAIGKLAIKIESAAKQCIDCLLDLVNAKIPYIVQEATVVIRNIFRKYPNQYESIIGQVIQNIDDLDEPEAKAAVIWIIGQYADRIENSADLLQDYLATFHDETIEVQLSLLTATVKLFIQRPTKAQQLVPQVLKWCTEETDDPDLRDRGYMYWRLLSSDPTTARQVVMGQKPPISAESEKLDNRTLEELCLNVGTLATVYLKPVQQVFRSARTRRLQYSPALQKRVEEYGSNSWQFPAPPLSLNPVTSPTAATATSANGSASTPTGNTSAAISAADNYFNSVAVGTQQMAALDLGGREDGGFGGGGAPQTQYVVNQSQQQAYQPHLAGGAATGELLLL

SEQ ID NO: 33375 - DNA, 2130 bp, Candida glabrata CBS138
  CDS (1)..(2130)
atgccaccattggacaagaggattaaaaagttcctgaaggactcggtacgagttgcacctaaaatatccagcaaaggtgaactggctgaattgagggccggactggtgtcaccatactcgcagaccagaaaggatgctatcaagaagaccatacagcagatgactctgggtaaggatgtctcctcgttgttcccggatgtgctaaagaacattgctaccaatgatgtggaacaaaagaagctggtgtacttatacgtgatgaactacgcagagacgcacccagagctttgtatcctggctgtcaatacgtttatccaggatgcccaagaccctaacccattgatccgttgtatggcgatcaggaccatgtccctgattagagtggaaaaaatcctagagtatatcgagacaccactgaggaagacgttgcaggatgataacccgtacgttagaaagactgcagtcatctgtgttgccaagctgttccaattgaacaaacaactatgtgtcgaactgggcgtgttagaagatcttcagagtgccctagatgattccaacccaatggtggtggccaatgccaccgccgcactagtggaaataaacaatatggacccaacggccgtgaaattacctcaactaattcaaagccatgtctctcagtttttgttagcactaaatgaatgtactgagtgggccagaatcacaatactgacagcattggcagagtacagcgcaagagatggtgttgaagcacaggatattattgatagagttactgcacatttacaacacgtaaatccagctgttgtgctggccacaattaaagttatcattcagaacctgccactaatcattgccgataacagtagcaagagggcatcaataatgaagaaactctcctctgcacttgtttctctaatgtctactcctccagagatgcaatatgtagcattgaagaatattaggattgtattggaaaaatacccagaactattgaccaaggaattgagaatattctatattaagttcaatgacccattatatgttaaagttgagaagattgatattctagttagactggttgatccatctaacttgaaacaatgtaatctactattggccgaactgaaggagtatgctatggattttgaaccagaattcgttagcagagttatcctagctttgtctcaattagcaatcaagtattcagatttgccgtttattcagaaagtaatggatattctagtggaactactagaagtacgggaaaagtccaaggatgattgctgttctgcagcaattgatctgttaagacacacgaataacaatgccgagctcgcaaagcaactttgctcagtgcttaatagttgggagtctcctgaaatagaactgacaacagatgcagctaaatgtaaatatatttggatcatgggtcagtatcctaggctgttctcatcactggaaagtaaaatgaagggttttgtagataattttgtcaatgagaacacgtccacacaaatgtcaatattaattacaacggtcagattacataatatgttgccgagtgacttacttcaatctgttttagatacatctactaaagaaacaaaggaattggatgttagagatatggccatggtgtactggagaaccctttctctaccaaatgttgatgaactaataaattctttgtgctccagtcaagtacctcagataaattctactatagaccaattctctcctgagctattagaaaagttgctaagacagctgggcaatatcagctccataaatttcaaactagactcgggcaacaaaagagtgaagtacgtgcaaaatattgttaacaacaaacagctagaagagttgcaagacatagctaagaatgaattagaaaataaagctaacgatgatgttttgttggatttcggtgacgaagatgatgatatgatgtctacaagtaacaataacaacagtacaccgcaaccgtcggcactttctgagctcgatgacttgtttggttttagttctacaaatgctactgtgggtagcgtttcacagaaagttgagaatctaaacattaatgagaaaaagagcacgacgacgcaagatttacttgatctgttttaa

SEQ ID NO: 33376 - protein, 709 aa, Candida glabrata CBS138
MPPLDKRIKKFLKDSVRVAPKISSKGELAELRAGLVSPYSQTRKDAIKKTIQQMTLGKDVSSLFPDVLKNIATNDVEQKKLVYLYVMNYAETHPELCILAVNTFIQDAQDPNPLIRCMAIRTMSLIRVEKILEYIETPLRKTLQDDNPYVRKTAVICVAKLFQLNKQLCVELGVLEDLQSALDDSNPMVVANATAALVEINNMDPTAVKLPQLIQSHVSQFLLALNECTEWARITILTALAEYSARDGVEAQDIIDRVTAHLQHVNPAVVLATIKVIIQNLPLIIADNSSKRASIMKKLSSALVSLMSTPPEMQYVALKNIRIVLEKYPELLTKELRIFYIKFNDPLYVKVEKIDILVRLVDPSNLKQCNLLLAELKEYAMDFEPEFVSRVILALSQLAIKYSDLPFIQKVMDILVELLEVREKSKDDCCSAAIDLLRHTNNNAELAKQLCSVLNSWESPEIELTTDAAKCKYIWIMGQYPRLFSSLESKMKGFVDNFVNENTSTQMSILITTVRLHNMLPSDLLQSVLDTSTKETKELDVRDMAMVYWRTLSLPNVDELINSLCSSQVPQINSTIDQFSPELLEKLLRQLGNISSINFKLDSGNKRVKYVQNIVNNKQLEELQDIAKNELENKANDDVLLDFGDEDDDMMSTSNNNNSTPQPSALSELDDLFGFSSTNATVGSVSQKVENLNINEKKSTTTQDLLDLF

SEQ ID NO: 33377 - DNA, 2421 bp, Candida glabrata CBS138
  CDS (1)..(2421)
atgagccagtttgcttctgcgttagagtcagcccgcacactgacattggaggctgcagccgttgcgtcctccaaattgggtgaatcctcatataagcaatattcaaaaacaatctcgccgaggcaattgaagaccttgttgaactcgagaaatacaagagaggtaaaggatggtttgaaatgtttaattagtgcgatggccctaggcgacaacacaattgatgctaaatcctatttgcctgatgtagtaaaaactgttcataccgatgatatgcgtataagaaggcttgtggccttgtatctagtacgatatgcggagattgatcaagatgttgcattactagtagtaaattcacttcagaaattagttaatgacaccttaagtgaaacaagggccttttcaataaagtctctcgttgatatgagactaaagtccctcgaacctataataattcatggtatgcgcaaaagtgtttctgatccatcagcaattgtgcgatctgaagttgcatatacaatcgctaagatctacacatctgcctatgaggattttcaagatgaacttgaaatcacattgaaggaattactggctgatagcgatcccacagtaatttcttccgtgatagttgttttttatcgacacttcttggatcatttagactggctccatggtcatttcagaaggtattgtaatatacttcatgaactggactcgaacgctcagatatatatgataacttcattgacgctgtattccaagaggtatattccaaagccactattaagaaactctgaaaatgaaaaggagagcatgccattaccagatgacatccaagaaattatatatacggcatttacgattgaaaatgatcctgaccttgatctacttctatctggaataagaaagctgatatattctgataattttgctgttttgcttacatgctgtcaggctattttacaactttcgacaccaggctccttgagaaggaccaaattcccagaagttattgccaatctgattaataactcgagaactaatggcagtatcaaaagtttaatattgcagaatatattattgatgtcaactgtggatccgcaaatatttacaccatactttaggcagttttttctttatccaactgataacattgttacagcagagttcaaacttaaggtcttatcatctttggtaacggaggaaacgattgatagcgttgcaacagagattaggcgctacgtttacgacgacttagcacagaatataaaaaaggaagctatgattgctcttgggatatgtggtcaactctcagaactttgggaatcaaaaatactaaagtggcttctgagattcttaacatatcaaaaattagataaaaatttaatggatacagccgttgatgtgattagagtacttcttcattctaatccaaggtctcatatcaaaacagtattggaactaagtacattattagagtcacaggataccctacatgataaagctagatctggaataatatggctttttggagaaattgctagggttgaattttcagtatgcccagatgtactacggaagttgacattaaactttgctcaagaagggagatattcaaggcatcaaattttactattggcagcaaaattactttcttatgatataagcgcgaacaccactggagatggggcatatgactattcaaaatcaagattgtatcagatattcaatacacttatttaccttgccaaatatgatgacgattttgatataagggatagagcgcgtatgcttggttcactttttcatgaagataagctacaaataggtactctacttcttcaaggcacaaagccggaaccgcagcttttcccatcaaattatagaaatagagatggaagtgaagatcagaatgtgaagagcctcatttcctatggggtttcatcatcgctaataaatgcctacctctttagaaagtgggaatactcacctgaccctgtatcagaaaatcaagatatcagagagcccacacctactaaagactaccgtaaatattatacaagcatatcctcagacagttttaaaggaagagatacaatttctaataatgcattctcatcatctattgataggaataaagactttgaggcaaaaccttccaaagattcaacttatgtttcgaaaaggggacaaaaatataagctacaaagtttagaggaatttttctcagatatacctgagcagccgaacaagaagtctctcaaccaaagtattgataattccacgggggacaagaagcctcatatttcatctgaagaagaggatactgaagaagaaagtgatgaaggtagtaattcagaatcagagactggagaagatgacttagacagttcagaggagtacacagatgactcttcagattga

SEQ ID NO: 33378 - protein, 806 aa, Candida glabrata CBS138
MSQFASALESARTLTLEAAAVASSKLGESSYKQYSKTISPRQLKTLLNSRNTREVKDGLKCLISAMALGDNTIDAKSYLPDVVKTVHTDDMRIRRLVALYLVRYAEIDQDVALLVVNSLQKLVNDTLSETRAFSIKSLVDMRLKSLEPIIIHGMRKSVSDPSAIVRSEVAYTIAKIYTSAYEDFQDELEITLKELLADSDPTVISSVIVVFYRHFLDHLDWLHGHFRRYCNILHELDSNAQIYMITSLTLYSKRYIPKPLLRNSENEKESMPLPDDIQEIIYTAFTIENDPDLDLLLSGIRKLIYSDNFAVLLTCCQAILQLSTPGSLRRTKFPEVIANLINNSRTNGSIKSLILQNILLMSTVDPQIFTPYFRQFFLYPTDNIVTAEFKLKVLSSLVTEETIDSVATEIRRYVYDDLAQNIKKEAMIALGICGQLSELWESKILKWLLRFLTYQKLDKNLMDTAVDVIRVLLHSNPRSHIKTVLELSTLLESQDTLHDKARSGIIWLFGEIARVEFSVCPDVLRKLTLNFAQEGRYSRHQILLLAAKLLSYDISANTTGDGAYDYSKSRLYQIFNTLIYLAKYDDDFDIRDRARMLGSLFHEDKLQIGTLLLQGTKPEPQLFPSNYRNRDGSEDQNVKSLISYGVSSSLINAYLFRKWEYSPDPVSENQDIREPTPTKDYRKYYTSISSDSFKGRDTISNNAFSSSIDRNKDFEAKPSKDSTYVSKRGQKYKLQSLEEFFSDIPEQPNKKSLNQSIDNSTGDKKPHISSEEEDTEEESDEGSNSESETGEDDLDSSEEYTDDSSD

SEQ ID NO: 33379 - DNA, 2157 bp, Candida glabrata CBS138
  CDS (1)..(2157)
atgtccgatcaaagagtcttctcaagatataaagctagtgaaatcaacgcggagttgcagagctatgaagtcaataaatttaagttgaacagtattaaacgaaagaatgcgcttagaaagattgttgcgaacctaacgttgggtaattacaatgaaatgtccttgttaggagacgccattcacaaattttggcagattgacgatgacttcgaagtgaaaagaatatgccatgagtatgtatccgtgattgggtccatgaaaccaaggctggtggtggatttccttcccagtatacaggatgatctaaaatcccgaaactctaaggtacaagttttagcattgagaacgctaatgcaaattccgagttctgaatttcttgatgaagcaatgaaattctcaaagttgatagtttcgagaaaaactactatgtctaaagatgttacaaaagcagccattcttaatttgatacaattagatgaaatgaatcatgaagaaatacttaaattagtaccgtacctatttgagatcagtgaagatcaaagcgaagcaataacaataagagttgctgcattacatacattatatttgatacacgagaaaaatcctcagatggctccgttgaatatcggcgttgacgctgcattcaacatcttggaaaacatagagaaagctaatgaatgggataaaggtctgataattgaaacattacctgtgactgtagtccccaatacgcatgatgatgcttatgatctgatagatctaattttaccacaactacagaacgttaatacgtacgttgcattaggtactctaaaattcattctttatttgctaaattacgtggattctatcagtgaaactgttatcaaaagaatttccaactcaattgttgcgttactagataaccctccagaaatacaattcctaattctgagaaatgtgatcttactactgttaagcagaggatcagacatgcttaagttagatatctcatattttttcatccaattcaacgatcctatttatataaaggatacgaaactagaatgcttgtatttactagcaaataagaataacttaattcaaattctagatgaattggaacaatatgcgactgatattgacattcagatgtcgaggaaggctataagagcagtcggtaatttggctgtgaaactggatgatagcgctgctgcgaactgttgtgatactcttgcagatctgttagacttcggagtcgattttgttatacaagaaataatatcagtttttaggaacattttccggaagtatccaaataactttaaagactacgtcccagacttgataaaatgcatagatatagtggaagaaccagagtctattaatgcaatgatctggataattacccactactacaacagtattcctaattatcttgatgagtttaaacaattttccgactctatcgaaggacaagcactagaagttcaatattcaattttgagctcaagcgttaagttttttcttcgctcaccatcagaagaaacggaagcaaattgtattaatattctcaaatattgtaccgagaaagcagataacattgacctaagaaatagagcgtttggctactggagattacttgccctaactaaatctgaaaaagccgaggaacaattacccattgatactgctctaaaaattatcgatggtgaattacctatgctagaactgaacacgaaactagattctgcagttctagaagagctggaactaaacatgggatctatagtatcggtatatttaaaacctgcatcccaaatattcaaaaacagtaaattaaaatcattaccaaagaattcaatacttattgagaatagggaacaactcgttattagacctgattcaaacaacagtatccctgaagatgttgaggtaaatgactatttcgcacctaggaaattcatgtcaggtaccggaactggaaactcaacacctggtacaccacattctggctcttcaagtcaacgtaaaaccatggcggattacgacagaccagctgagaaagttaatcaactaagcggtaagagaaaatccagcaccagtggcaccacaaacctatcacgtaaaccgtcgcagctgttgagaagaatttctttgaagaaaaccccattttaa

SEQ ID NO: 33380 - protein, 718 aa, Candida glabrata CBS138
MSDQRVFSRYKASEINAELQSYEVNKFKLNSIKRKNALRKIVANLTLGNYNEMSLLGDAIHKFWQIDDDFEVKRICHEYVSVIGSMKPRLVVDFLPSIQDDLKSRNSKVQVLALRTLMQIPSSEFLDEAMKFSKLIVSRKTTMSKDVTKAAILNLIQLDEMNHEEILKLVPYLFEISEDQSEAITIRVAALHTLYLIHEKNPQMAPLNIGVDAAFNILENIEKANEWDKGLIIETLPVTVVPNTHDDAYDLIDLILPQLQNVNTYVALGTLKFILYLLNYVDSISETVIKRISNSIVALLDNPPEIQFLILRNVILLLLSRGSDMLKLDISYFFIQFNDPIYIKDTKLECLYLLANKNNLIQILDELEQYATDIDIQMSRKAIRAVGNLAVKLDDSAAANCCDTLADLLDFGVDFVIQEIISVFRNIFRKYPNNFKDYVPDLIKCIDIVEEPESINAMIWIITHYYNSIPNYLDEFKQFSDSIEGQALEVQYSILSSSVKFFLRSPSEETEANCINILKYCTEKADNIDLRNRAFGYWRLLALTKSEKAEEQLPIDTALKIIDGELPMLELNTKLDSAVLEELELNMGSIVSVYLKPASQIFKNSKLKSLPKNSILIENREQLVIRPDSNNSIPEDVEVNDYFAPRKFMSGTGTGNSTPGTPHSGSSSQRKTMADYDRPAEKVNQLSGKRKSSTSGTTNLSRKPSQLLRRISLKKTPF

SEQ ID NO: 33381 - DNA, 2379 bp, Kluyveromyces lactis NRRL Y-1140
  CDS (1)..(2379)
atggtcgattcaatacaacgcatcacatcagtattgcaatctgcaagagatcttacattcggagcagcggcagttgcctcttccaggatcggtgaatcgtcatatacacaatactctaaatctattgatccagaagcgttgactcgtcttttaagttccaggaactcgcgtgaagttaaagatgcaatgaaaagagttatgtctttgatggcaacgaacgatccaacggttgatttgaaatctatgtttgccgacattttgaagaatatcagttcggaagatgttaaagttaagcgtatggtgtgtatatacttattacgtttcgctgaatccgatccgaatgtagctttgttgtccgttaataccattcagaagaatttacaggatagagatcccgaggcgaaagctcttgctttgaaagctttatcagatatcaatgttgcatctttatatcctataacgttacaatcggtgaagaaatgtgtttcagatgcaagcccattagttcgtgccacttctgctatgactctattcaagctattccaggattctaagagccatgacgaagaagacgacgtaaggagacacgatctggtgccattgttacaagaacttttagctgatcctgatccattggtgatatcttgtactttggtggtcttgcagaattgcctgcccgatagattggatcttttacacggtcatttccgcagatattgtgccgtgttaccttctttgtcgcactgggctcaatccttattggttgaaatgttcattcggtattctaaacactttatcaagagaccagtgtttgttaatagggaagatcgaagtgagactccgttgccggaaactcctgaattggtcgactcgtggtttctagaagcaaatgaccttattatcgatccagacctcgacctattcttaacttctttgaaacccttgttattttcatctaatgcatctgtgattatcagcgtgtcaagagcacttttcatgttggctccgttatccaaatttagagagtttggtatgccacactgtctagtcaaggcacttcagctaagttccactgaaaaccgctgtattatagtacagatgattgcttattatgcatcaattgacccagaagcatttgcttcattatacaggagtttcctaccgacagcagatgatgaccctatcgttggatcatacaaactaactataatatcccttttaattacagataagaacgtcaaggatatcatacacgaattgaagtactatatcacaacgtatcgtgatcctgctattgtcaagaaagcactaagtactttggttgtgtgtgctcataactccaatgcattttcagctcacatcatgaaatggctactcagtttcatggagaatgataatttgaccgacagcgaggttaccagtgagtatgtcaatgtgatacgccatttaattcaaattaatccctcgaagaacttatcagttatgctcaaattatcacaaatcatcacagaaacagataatttatcagcttatgcaaaagctggcatcatatggctctttggtgaatacatacatgtcgaaccaaggatagttcctgatgtattgagaaaattaattcctaaatttgctgatgagtccacggaagcaagactacagatattgattttggctgccaaacttctttcatttgatatcgatagatgtgagtcagattatgattttgagcaatcaaggatagcccacttatatgatgctgttatgtacctcgcaaagtttgatgacgattttgatataagagataaagttaggtccttgagttcattgttctcacacgaaaggtttgaaatactgaccttgttattgcaagctgcaaaaccatggccagctttgtcactattcacttacggagataaagcaagtgaccttgcacaccttgagctttccccagaagtattgaattcattaaaggttccccagtggtcaaccgaagtacctgaggtggacagaacgcctgttgaaactaacaatttcatgaagaataaatctagcatttcatctaatactttcttcgctagtaggactagggctaattaccagcaacctaaggcctcctcgccaatatccagcaaatcatcaagtccagagccaaaaactttcacatcctcaaaagggaaaacttacaaactacaaagtttggatgaattctttgcagatatcccagagaaaccgaagaaaacgaagatcgttatagaggaagaatcagaaacggaatctgatgttgcccaattagaagaatcaagcagcgatgaaagtgatgataccgatgatattgaagaaggtgaggaagacgacaggagttctacttcttccgatccttga

SEQ ID NO: 33382 - protein, 792 aa, Kluyveromyces lactis NRRL Y-1140
MVDSIQRITSVLQSARDLTFGAAAVASSRIGESSYTQYSKSIDPEALTRLLSSRNSREVKDAMKRVMSLMATNDPTVDLKSMFADILKNISSEDVKVKRMVCIYLLRFAESDPNVALLSVNTIQKNLQDRDPEAKALALKALSDINVASLYPITLQSVKKCVSDASPLVRATSAMTLFKLFQDSKSHDEEDDVRRHDLVPLLQELLADPDPLVISCTLVVLQNCLPDRLDLLHGHFRRYCAVLPSLSHWAQSLLVEMFIRYSKHFIKRPVFVNREDRSETPLPETPELVDSWFLEANDLIIDPDLDLFLTSLKPLLFSSNASVIISVSRALFMLAPLSKFREFGMPHCLVKALQLSSTENRCIIVQMIAYYASIDPEAFASLYRSFLPTADDDPIVGSYKLTIISLLITDKNVKDIIHELKYYITTYRDPAIVKKALSTLVVCAHNSNAFSAHIMKWLLSFMENDNLTDSEVTSEYVNVIRHLIQINPSKNLSVMLKLSQIITETDNLSAYAKAGIIWLFGEYIHVEPRIVPDVLRKLIPKFADESTEARLQILILAAKLLSFDIDRCESDYDFEQSRIAHLYDAVMYLAKFDDDFDIRDKVRSLSSLFSHERFEILTLLLQAAKPWPALSLFTYGDKASDLAHLELSPEVLNSLKVPQWSTEVPEVDRTPVETNNFMKNKSSISSNTFFASRTRANYQQPKASSPISSKSSSPEPKTFTSSKGKTYKLQSLDEFFADIPEKPKKTKIVIEEESETESDVAQLEESSSDESDDTDDIEEGEEDDRSSTSSDP

SEQ ID NO: 33383 - DNA, 2103 bp, Kluyveromyces lactis NRRL Y-1140
  CDS (1)..(2103)
atgggtgttgataagaagatcaagaagttcttaagagacgccatacgagtggctcctaagatttccaataaaggtgaattgtttgaactacgaaatggattagtatctcagtacccacagacccgaaaggacgcgatccgtaagattattcaacagatgacttccggcaaagatgtttcatctttgtttcccgacgttttgaagaatatagccactcaagacattgaacagaagaaattggtatacctttacgtggctaattatgcagaaactcatccggagttatgcatccttgtcgtgaacacattcgtcagcgatgcagctgatccgaacccattgattaggtctatggcaatccgtaccatgtcgatgatcagagttgataagatcttggaatacattgagattccgctaagaaagactctagtcgatgataatccgtacgtgagaagaaccgcggtactatgcgttgcaaaattgttccaattgaacccggacctatgccgtgaattgggcgtattgaacgatttgcaagacgctttgtctgacgataatccaatggttgttgccaacgcgcttgccgcactgcacgaaattaacgaattggaccctggttcaatagatatcaagaaattagtatctcaaaacgttaagaggtttttgaacgtgttgaacgaatgtacagaatgggcaagaatcactattttggagtcattgagcgaacacaaaccaattgaccctatggagtctcaagaaattatcgatagagttgttccacatttgcaacacgtaaatccatcagtggtcttgatcagtgttaaatgtatactcatacatctaccaaatttgaacacagtccatgactctatatacaacaagttatcaactgcattggtctcactaatgtcgaccccagtggagatccaatatgttgctttgagaaatataagaattattttggatgccttcccaaacttgttaaggaaagagttaagaatattctatgtcaaatttaatgatccattgtacgtgaagatagagaaattagacatcttgctcagattagtgcccgtggataatttgaaacattgccagatgcttttcaacgaattaaaagaatatgcaaaggactttgatcatgaattcgtgaccaaagctatccaatccatctcacaattggccattaaagtctcgaacggaggtgaagatacgaataacaagtttttgaatatggtcatggaagaattcgtttcgattgtccaggagagagaagagtttagggatatattgatgagatgcgtatgcgacatgttacgttatgacagtgacaacaatcttatcaaggaaacaagtaagaatgagttgggtgccataatttcctcatggcaagatatcgataccatatttacatctgatctaggcagttgtaactacatctggtttatcaccaactatacaaacgaaaatttggaaactaagcttgaaccactggtagaagttttcgatgaattaggatccctaactcaaatgtcccttctaatgggtgtagtgaaatgccataatgcagtctcaagtgctttcttacagaagatcttggaactttgtacgacagacgtccacgatttggacgttagagacatggccatgatgtactggcggtgtctatcgatcgacaacggtgatcaaatcatcaaccaattatttgacaagcatgaaattcctaaattgcattctaccttggaccacttctccaaggaaacattacaaagtctacttcaagagctctccactctatcctctgtgtatttcaaaccaatctcgcagatgcaacgccgtcccaacgaagttcacatcattaaggataaggatattgatgaattaaagggaatggccacgaacgagatcctgaaaaacatgaacgatgatgtactacttgacatgggtgatagctctgccacgagaagtacaggcgtcctggacgaactaaatgatcttttcgatatcactggtgatatggggaaagtaaacatttcacagaaaaccaataataacaacaacaacacctcgaattcccatgcaaccgatcttctagacttaatgtaa

SEQ ID NO: 33384 - protein, 700 aa, Kluyveromyces lactis NRRL Y-1140
MGVDKKIKKFLRDAIRVAPKISNKGELFELRNGLVSQYPQTRKDAIRKIIQQMTSGKDVSSLFPDVLKNIATQDIEQKKLVYLYVANYAETHPELCILVVNTFVSDAADPNPLIRSMAIRTMSMIRVDKILEYIEIPLRKTLVDDNPYVRRTAVLCVAKLFQLNPDLCRELGVLNDLQDALSDDNPMVVANALAALHEINELDPGSIDIKKLVSQNVKRFLNVLNECTEWARITILESLSEHKPIDPMESQEIIDRVVPHLQHVNPSVVLISVKCILIHLPNLNTVHDSIYNKLSTALVSLMSTPVEIQYVALRNIRIILDAFPNLLRKELRIFYVKFNDPLYVKIEKLDILLRLVPVDNLKHCQMLFNELKEYAKDFDHEFVTKAIQSISQLAIKVSNGGEDTNNKFLNMVMEEFVSIVQEREEFRDILMRCVCDMLRYDSDNNLIKETSKNELGAIISSWQDIDTIFTSDLGSCNYIWFITNYTNENLETKLEPLVEVFDELGSLTQMSLLMGVVKCHNAVSSAFLQKILELCTTDVHDLDVRDMAMMYWRCLSIDNGDQIINQLFDKHEIPKLHSTLDHFSKETLQSLLQELSTLSSVYFKPISQMQRRPNEVHIIKDKDIDELKGMATNEILKNMNDDVLLDMGDSSATRSTGVLDELNDLFDITGDMGKVNISQKTNNNNNNTSNSHATDLLDLM

SEQ ID NO: 33385 - DNA, 2223 bp, Debaryomyces hansenii CBS767
  CDS (1)..(2223)
atgtcattagaaaaaaagattcggaatttcttgcaaggtccaagaaagggtgaaacttttgaattaaagaatggattagtttcgcaatatagaggtgaacgaaaagatgccattcagcgggtaatccaagccatgacggttggcaaagatgtttctgcattatttccggatgtgttaaagaatatagcaacatatgacttggaacagaagaaattggtttacttataccttatgaattatgcaaagacacatcctgaattatgtatattagctgtgaatacatttgttcaagacacggaagatccaaatcccttaatcagagcattggcaatacgtactatgggatgtatcagagtagcgaagatggttgactatatggaaatcccattgctgaggacgttaaaggatgataacccatatgtgagaaagacagcagcaatttgtgtagccaaactatttgacttaaattctgaaatgtgtattgaatttggctttttaagtgagttatcgaagttgattaaagatcctaatccaatggttgttgctaatgcattgaatgcgttgtttgagataaaggatatgaataccaatccagatttagaaatcatcgaagttaataaagggatggtcagtaatttgttaatgtgtttgaatgaatgcacggaatggggtagaataacaattttaacaaccttaaatgattataaggctgaaacttccaatgaggcgaatcacatcattgaaagaattataccacaattgcaacacgttaatccttcagtggttttatcttcgattaaggcgatcatcaatcaattggactcaatttcagtaactgctcaaaggtcttcgattttgaaaaagttgtctgctccgttggtttcattagtctcatcctcaattcctgaagcgcaatacgtgggtttgaaaaatattagaattatcttagaaaaatatccacaaatcttatcaaaggaactccgtgtattcttcattaagtattctgatccattatacttgaagttagagaagttggaaattatggtaagattagccaacgacagtaatagtacattgttattgggagagttaaaagaatacgccatggaatttgaaagttccttggtagcaaaagcaatcaggtcaattggtacggttgcaatcaagttaactggatgtgttattaaatcagttaacttaatatgtagcttaattgaccaaagaggaggggatttaattatcaatgaatcaattattgttttaacaaacatattgagacgttatccaggtaaaaatgatttaattactctaattgttccaattatttcaaatcatacatcggaattaagcaagaacgaagccttatctggatacatttggctcttaggtgaatatccaaaatacttttcacaattaaagcaaaatttgctggacttaatcgatggctttttagattatgaatctttgttacaactaaatattttgaccacaattgtcaaaattaatttgtcgattgagaatcaaacgtattctaattatttgcaaaaagttttagaaatggctactaaagattgtgaaaatgcagatgttagagacaaagcatatatatactggcgtttgttgtcatcttcgtcgaaagaatctcagaaaaagatcgttttgtctaagttacctccaattaaaaccacaattgcttcattcaacccagtcgtattagaagctttggtgaaggaattatcgactttagcatcggtgtatcataaaccgtcgtttacctttattgaccctaacttatattcacctttatctagtgaccaagtgacaaccagaagatctaaatccctgaacaaagatgaaaatattgaagatttgactaatctagcaaaacaagagataattaataattctaaaaatgaaaatttgcttgattttgacgatgatgaagttaaacctgataatagttctagtaatggctctgcctcattgctagatgaactaaatgatttattttccgccccttctatgccttcgcaagcgcaaccaacgcaacctgtacagtcttcaacaaatgatatactagacttattcaagacatcagctccacaaagtagtcaacaaaatcaaaacttgacacaaggcattgataatttaaatatcgataatacttcgtcatcatctagtaatcaaaataaactaaacaatgatcttttagatcttttttaa

SEQ ID NO: 33386 - protein, 740 aa, Debaryomyces hansenii CBS767
MSLEKKIRNFLQGPRKGETFELKNGLVSQYRGERKDAIQRVIQAMTVGKDVSALFPDVLKNIATYDLEQKKLVYLYLMNYAKTHPELCILAVNTFVQDTEDPNPLIRALAIRTMGCIRVAKMVDYMEIPLLRTLKDDNPYVRKTAAICVAKLFDLNSEMCIEFGFLSELSKLIKDPNPMVVANALNALFEIKDMNTNPDLEIIEVNKGMVSNLLMCLNECTEWGRITILTTLNDYKAETSNEANHIIERIIPQLQHVNPSVVLSSIKAIINQLDSISVTAQRSSILKKLSAPLVSLVSSSIPEAQYVGLKNIRIILEKYPQILSKELRVFFIKYSDPLYLKLEKLEIMVRLANDSNSTLLLGELKEYAMEFESSLVAKAIRSIGTVAIKLTGCVIKSVNLICSLIDQRGGDLIINESIIVLTNILRRYPGKNDLITLIVPIISNHTSELSKNEALSGYIWLLGEYPKYFSQLKQNLLDLIDGFLDYESLLQLNILTTIVKINLSIENQTYSNYLQKVLEMATKDCENADVRDKAYIYWRLLSSSSKESQKKIVLSKLPPIKTTIASFNPVVLEALVKELSTLASVYHKPSFTFIDPNLYSPLSSDQVTTRRSKSLNKDENIEDLTNLAKQEIINNSKNENLLDFDDDEVKPDNSSSNGSASLLDELNDLFSAPSMPSQAQPTQPVQSSTNDILDLFKTSAPQSSQQNQNLTQGIDNLNIDNTSSSSSNQNKLNNDLLDLF

SEQ ID NO: 33387 - DNA, 2097 bp, Debaryomyces hansenii CBS767
  CDS (1)..(2097)
atgagtgatgggaaactatttgtcaagactaagtccgtcgagttaaggaccgagttggaacgagcacttaaaaaatcaaagccacaggctagaattaaagttgttttaaaaaaagtacttgccaatataatattgaataataatgaaattatcaaattctttccggatataatttcccttatgaagtttgatgacttcgaaattaggaagatgtgtttccaatacttgattacattcgccagttctagtccgaaggatgcccatgatgcgttaccgtttttggtccggtttgaagatgaaccggatcctttaatgaaagcgttagcactcaagacattatcatccattccaaataaagactacgttagcgtaacatttaacaaggtgattagtgctttacattctcccgatcctcatgtaagaaaagcggcagcttttgccgtgtcaagactttttcagcatgatcaggaaagagctacacaactgcatttacttgaagatttgaatgagcttttatatgactcaaatgaaacggttgtggcaaatgctctagcttcacttagctatattactgagaaagtgaaaactttatcattgaccattgataagaaacattcattagccttattgtcatatttggggaagacaaacgagtggtgtcacatatatatattaaattccttaatggcttatgttccacagacaacggaagaggccttggatttgattgaagctaccattccttcgttacaacatgaaaattccgctgtcattttgaatgcaattaagataattgtatacttcagccattacgttaaaaatccagaattagtgattccaacgttatcaaagaaattaggatcttcacttgtgtctcttctatctaaaccaccagaaacacagtttcttgctttgagaaatgttattcttctacttctaggtagaaaggaattactaagtttcgatattgaaatgttcttctgccgttacgatgaccctatttacattaaagatacaaagctagaaataatttacttagctgcaaatgaacaaaatgttcatgttgtcttgagagaattagaggaatatgctactgaggtagatgttgccatggctagaaaggcgattagagcttttggaaatttagctgttaaactaactggagcatcagacgaatgtgttgatgttatatgtgatttaatttctaatggaatctcttatattgtacaagaatctacaattgtaattaagaatattttgcggaaatatccaggaagatataatttcgcaattaaagagttaatgaaacattataaagttatcgatgaaccggaagccaaaactgcaatgatttggattttaggtcaatattgtgaacatattgaaaaggtggaatttattatgggagattttatttctacatttaaggatgatccgatagaagtacaatatgccattctcactgctgcaacgaaattatatttgaaattaccagaaagaggcgaaagcttgatattgaaagtcttgaagtgggcaacagaggaagtagataaccctgatattagagatagaggctttatatattggagattgctttccgccgaagatgctaacggagcagatggcgaatttcaagcaaatactaagaaagtcattttgaattctaatccagttatttcaacagatagtgataatattgatccaactatattagaagaacttgaattgaatattggaactttggcatcaatttatttgaagcctatactgcacgtatttcgtcttgcaaaaccaaaatccttaccatatagccctgctttacaaatgagacaacaaccaaacgcaccagtgtcaacaaatgcatcaaatgacaatgtacatcttactcattcgaccgccgcttcagctgaatatatttctccaagaagaataagttcgcctagcgtcagccattccagtaggccaagtcggcacttacctctccctagacaagagtctgacttatccagtaatgaagacaacacgccaaagaagagcagctttgctaagagactcactagacaggcttctattttgactggaagaaagaacaaatga

SEQ ID NO: 33388 - protein, 698 aa, Debaryomyces hansenii CBS767
MSDGKLFVKTKSVELRTELERALKKSKPQARIKVVLKKVLANIILNNNEIIKFFPDIISLMKFDDFEIRKMCFQYLITFASSSPKDAHDALPFLVRFEDEPDPLMKALALKTLSSIPNKDYVSVTFNKVISALHSPDPHVRKAAAFAVSRLFQHDQERATQLHLLEDLNELLYDSNETVVANALASLSYITEKVKTLSLTIDKKHSLALLSYLGKTNEWCHIYILNSLMAYVPQTTEEALDLIEATIPSLQHENSAVILNAIKIIVYFSHYVKNPELVIPTLSKKLGSSLVSLLSKPPETQFLALRNVILLLLGRKELLSFDIEMFFCRYDDPIYIKDTKLEIIYLAANEQNVHVVLRELEEYATEVDVAMARKAIRAFGNLAVKLTGASDECVDVICDLISNGISYIVQESTIVIKNILRKYPGRYNFAIKELMKHYKVIDEPEAKTAMIWILGQYCEHIEKVEFIMGDFISTFKDDPIEVQYAILTAATKLYLKLPERGESLILKVLKWATEEVDNPDIRDRGFIYWRLLSAEDANGADGEFQANTKKVILNSNPVISTDSDNIDPTILEELELNIGTLASIYLKPILHVFRLAKPKSLPYSPALQMRQQPNAPVSTNASNDNVHLTHSTAASAEYISPRRISSPSVSHSSRPSRHLPLPRQESDLSSNEDNTPKKSSFAKRLTRQASILTGRKNK

SEQ ID NO: 33389 - DNA, 2472 bp, Debaryomyces hansenii CBS767
  CDS (1)..(2472)
atgacggagtcattggccaaaatatcttcaatgttggaatccgctagggatttgactattgaagtggccgcgtctgcctcctcaaggctctcggaaacaccaagtgcattgagacctaaagagatttccaaattattgaattctagagtagacagagacaatctaagtggcatgaagtgtgtaatatcttcaatagcaaggggggaggatgggttgccctactttgctgatgttgttaagaatattacttctgccaacagtaaggtaaagaatttagtcttgatatatcttacgagatatgcagaggtggaacctgatacagcactcttgtcgattaattccatccaaaaatctttgaatgataagaatccaattgacagagctagtgctattagatcaatggctggtatcaggattgcatctatagctccaatattgctgttatgtattaagagaaccatttctgacccctctccattagtacgagcatcaacggcaattgctattgggaaagtttatgacatggaaaacacgaagaagaaacaattgtttgaatatttatcgaaattattagctgatagcaattcgcaagtggttggaactgctcttaagacatactttaaagtcatgccttatttgaaatcgtataagagaaaatgggagccaatacatgggaactttcgtcgcttttgtagtattatcagtgaattagatgaatggagtcaatcttttatgattgaaattttaacagaatactctagaatatttttacccagaccaaagctttatttgaaaaatgattcaagtcaagtaattgacctacctgatgattactcgaaaattccttatcataagtacgaggtatcaatggataaagatcttcaattgtttgttgattcattgagaacgttgatatactccagatcagaattcgttattttgagtatatcgaaagcaatattttcattgacagctccacgtatctataaagaccttcaaatagacgtggctctaactcgattagcatgctcattgaataatatccaggtttcattatacgccctacaaacaatttctttaatatctttgagtgaccaaactatcttttcacctcactttaaaaagttttatgtataccctatggatccaattccaattgccaaaataaagttacaaattttatcattgttagcgaatgaagataatgtgaaatatattttcgaagaattaaagtattactcagttaattcaatggaaaataagattgctaatgagtctatcagggccattggtagctgctcacaaatatctccgtattggaatgagaaaattttgaagtggtgtttgaaacaaataagaattgcaggtggttcatcgttgaatgaattactaactgttattagatatttaatacaacaaaaacaaaactttatggacgagaaggaaaagcaagatataattaaaagcacttacagattatcattagtattacaagatcagacatctaatttggaaagtgatgcgaaagctagtattatatggataattggagaattcaccgaagcagccaacaatactataggacctgatgtgctacgattattaataaaaacttttgcattcgaatcagaagtagttagatatcaaacactagtcttatctgcaaaaattttatcttttgaattagacaaagttaagaatgaagttggtgatgataattatctggcaattgaagagtttttacaagagaatattgtatctcaaatgtttcaacatgtcttacaattagcaaagtatgatccttcatatgatacgagggacagggctagaatgtttaacgttttgttaaatactggcagtaagcaatctcagttggcttcattgtttttgcgcgttcctaaacctgttccaatatcaacactattttcaaaaggaattcaaacagatgaagtattgacaaccagtatattgatgaaatatttcaatataacagaatgggctgacccttcaacgcaccccccaccttcaataagaaaggttgcacctattcagtccaataatttgggcggaaagattgtatctatttcgtcatcatcaatgcaaaataaatccacttctcctgaaccactatcagaacatgcaatttcttctcgacaataccagaatagtaatgttgataaaataattcctaaaccagtatatcagttacaaagtcttgacgaattctttggaagtgaagaggaagaaagtgaagaggaagagagtgaagaagagagtgaagaggaagggagtgaagaggaagggggtgaagaggaagggagtgaagagaaagatagtgaagaagaagagagcgaagaggaagagagtaacgaagaagaacatgaagacgatattgtgagtcgcagtgacgaagatgaaaatgactacttacagaagtctagggctgaaaagagcacggaaggaacaccatag

SEQ ID NO: 33390 - protein, 823 aa, Debaryomyces hansenii CBS767
MTESLAKISSMLESARDLTIEVAASASSRLSETPSALRPKEISKLLNSRVDRDNLSGMKCVISSIARGEDGLPYFADVVKNITSANSKVKNLVLIYLTRYAEVEPDTALLSINSIQKSLNDKNPIDRASAIRSMAGIRIASIAPILLLCIKRTISDPSPLVRASTAIAIGKVYDMENTKKKQLFEYLSKLLADSNSQVVGTALKTYFKVMPYLKSYKRKWEPIHGNFRRFCSIISELDEWSQSFMIEILTEYSRIFLPRPKLYLKNDSSQVIDLPDDYSKIPYHKYEVSMDKDLQLFVDSLRTLIYSRSEFVILSISKAIFSLTAPRIYKDLQIDVALTRLACSLNNIQVSLYALQTISLISLSDQTIFSPHFKKFYVYPMDPIPIAKIKLQILSLLANEDNVKYIFEELKYYSVNSMENKIANESIRAIGSCSQISPYWNEKILKWCLKQIRIAGGSSLNELLTVIRYLIQQKQNFMDEKEKQDIIKSTYRLSLVLQDQTSNLESDAKASIIWIIGEFTEAANNTIGPDVLRLLIKTFAFESEVVRYQTLVLSAKILSFELDKVKNEVGDDNYLAIEEFLQENIVSQMFQHVLQLAKYDPSYDTRDRARMFNVLLNTGSKQSQLASLFLRVPKPVPISTLFSKGIQTDEVLTTSILMKYFNITEWADPSTHPPPSIRKVAPIQSNNLGGKIVSISSSSMQNKSTSPEPLSEHAISSRQYQNSNVDKIIPKPVYQLQSLDEFFGSEEEESEEEESEEESEEEGSEEEGGEEEGSEEKDSEEEESEEEESNEEEHEDDIVSRSDEDENDYLQKSRAEKSTEGTP

SEQ ID NO: 33391 - DNA, 2352 bp, Yarrowia lipolytica CLIB99
  CDS (1)..(2352)
atgtccgatccgtttgcgaaaatcggagcggtgttggagtcagccaaagagctgactcttgaagctgcagtatcagcatcatcacgacttctggtagacgacgctcccctgtcagcggaggaaatcaaaaagcttcttaatgcgcgcagcgaccgtgacagattggcgggtatgcgccaggtcattggtttcatgtccaagggcagaggagaggaagctcagcagttctttccggacgtgatgcgaaacacggcgtcccagtctcttgacatgcgcaagctcgtgtttgtgtatctgatccgttacgctcccatggagcacgatctggctcttatgagcgtcaacaccattcaaaagtcgctctctgattcgtctcccactgtcagatctctcggagtccgagttcttagctccctgagggtcccggccatctcaggaattgttctctttgctatcaagaagggtgtgaccgatgtttcgccattagtccgaagagctgtcgcaggagctatcgccaagtgctacgacgtggatccttccacattcccacagttggtcgagttcttgcagcagctgctggccgacaagaacgttcatgttgtcgggtcggctatcatgtccatgcttctcatctgccccgaccgcctcgacctcatccatcccatctacaggcgtctctgcagaatcatcccccagctcgacacgttcgcagcagcttccgtcattgatctgctagtaagatacaaccgtaccaatattgcgccaccaaagggcaacaattctgtcgacgcggacacagctctgcttttgtcggctctttatccggccattgagaactcattgtcgcctgtcttcatcatgagtgcagtcagtgcagtctacgctctatgccctggacaagtccagccggtttaccaggagaccatcgaggtgggactcgtgagattgctcaagaatgagaccttggaagtcgctctgaccatgatcaagcaaattattcttcagagagaccaacccaacgcattttccacccatgttcatcggtttgtggtctttcccgacgacaccgcgtccgtggctctgctaaaaattgccatcatggcttcaatcaagggcccacgacagtttgtgttgtcggaactcaagcattatgctacctccacctcttacgagcgcgaggttcaagcagccgctgtctcggccattggatcctgcgcctctgggggaactaacaaggagtccgactctctggtcacgtggttgcttcgtcagattcgatctgaagcacccactttgtccgagtgtcttacctgtgtgcgtttgttgattcaacagcagcctcagaagcacgtcgccacggtgactaagctggccagaatttatactacgcttgacacatcggctgagacatctcctgctaaggcttctgtggtttggcttgtctccgagttcgtgtctgtcgcccccgaagttggagaggctcttctttactcggcattaaaaaacgttgcatatgaggacacacctgttcgagcccagattatggatctggcttccaaggtgtacctgttccgaatcaatgaggttggcaaggcagctgaaggagaactcactgaagaaaaacagattgagttttccaggtcgtttgttggacagttgtattcgcacgctctctactgtggtcgatttgatccttcatatgagatccgagataaggtgcgacgtctaggagcgttactcagcaatcctgcatctactgaactggctaccctaatgctccaggctcccaagcaggctcccaaggtggacagcacaaacaccgagggcggtttggagcttaacactgcttctgcggtacttggaacacctcttagtgggtatgtttccctgcctccttgggaaaaggatctctctgttcttcctgatgctcgtctacgagatgaacctgaggaggtggttcacatggacaccgagaaggtagttacaggtatcagtcacaaggaactgccgtcaatgtcttccaatggtactaatggtatgactgccaccaagcccaagctgcagaagcagacacttgatgagttcttcgctgatactgttgggagcgaagacagtagcgaggaggaggaatgcgacagtgatgacgatgatggtgaggaggaagacgaggaggagaaagacgaggaggaagaagacgaggaggaagaagacgagggggaagaagacgaagaggaggaggaagacgagagctcggaagaagattcatctgacgacgatcagcctgcttcccaatctccagtccccgcttctcagtcccttcttcatgaagaaaacccgttcgccaacagctag

SEQ ID NO: 33392 - protein, 783 aa, Yarrowia lipolytica CLIB99
MSDPFAKIGAVLESAKELTLEAAVSASSRLLVDDAPLSAEEIKKLLNARSDRDRLAGMRQVIGFMSKGRGEEAQQFFPDVMRNTASQSLDMRKLVFVYLIRYAPMEHDLALMSVNTIQKSLSDSSPTVRSLGVRVLSSLRVPAISGIVLFAIKKGVTDVSPLVRRAVAGAIAKCYDVDPSTFPQLVEFLQQLLADKNVHVVGSAIMSMLLICPDRLDLIHPIYRRLCRIIPQLDTFAAASVIDLLVRYNRTNIAPPKGNNSVDADTALLLSALYPAIENSLSPVFIMSAVSAVYALCPGQVQPVYQETIEVGLVRLLKNETLEVALTMIKQIILQRDQPNAFSTHVHRFVVFPDDTASVALLKIAIMASIKGPRQFVLSELKHYATSTSYEREVQAAAVSAIGSCASGGTNKESDSLVTWLLRQIRSEAPTLSECLTCVRLLIQQQPQKHVATVTKLARIYTTLDTSAETSPAKASVVWLVSEFVSVAPEVGEALLYSALKNVAYEDTPVRAQIMDLASKVYLFRINEVGKAAEGELTEEKQIEFSRSFVGQLYSHALYCGRFDPSYEIRDKVRRLGALLSNPASTELATLMLQAPKQAPKVDSTNTEGGLELNTASAVLGTPLSGYVSLPPWEKDLSVLPDARLRDEPEEVVHMDTEKVVTGISHKELPSMSSNGTNGMTATKPKLQKQTLDEFFADTVGSEDSSEEEECDSDDDDGEEEDEEEKDEEEEDEEEEDEGEEDEEEEEDESSEEDSSDDDQPASQSPVPASQSLLHEENPFANS

SEQ ID NO: 33393 - DNA, 2349 bp, Yarrowia lipolytica CLIB99
  CDS (1)..(2349)
atgtcgttggaaaaacggatccgaagcgtgttccaggcgcccaaaaagggcgagacgtacgagctgcggtccggactcgtgtcgcagtacgcgtccgagcgaaaggaggctattcaacgcacgatccaggccatgaccctgggcaaggatgtttctgctctgtttccggacattatgaaaaatctcgccacccacgacattgagcagaagaaactcgtctatctgtatctaatgaactacgccaagtcgcaccccgagctgtgcattcttgccgtcaacacctttgtgggagactccggcgaccccaatccgctggttcgagccctcgccatccgaacaatgggctgtattcgagttgacaagatggtcgactacatggatggacctctgcgaaagactttgggcgacgacaatccctacgtgcgaaaaactgccgccatctgtgtcgccaagttgtttgatttggctcccgaaacctgtgtggaggagggcttcctgcagacgctgcaaggactcatgagtgactccaaccccatggtagtggccaacgccgtcagcgccctggctgagattcaggacagagacccctcgacaaactgctttgttattaattcgcacattctcggcaagttgctcagtgctctcaacgaatgcaccgaatggggtcgagtcaccctgctgacctccctggccgactatactgccgatggcgacgagggcacccacattgtcgaccgtgtggtaccccaattccagcatgccaacccgtctgtcgttctggcagccgtcaagtgtgtgctggcacacctgcacacacaaacggaggagaaccgggagattctgctacgaaagatttctccccctctggtttcgctcgtaggctcgtcgtcacccccagaggtgcagtacgtatctctgcgaaacattcgactgattctgcaaaagtacccacagctgctgtcacgagacctccgagtcttctttgtcaagtacaatgaccccgcctacctcaagatggagaagctcgagattctcgtgcgagtggccaacgacaacaatgccagtcaactgcttgcagagctcaaggagtacgctcttgaagttgatatcgactttgtgcgacgagccgtgagagccattggccagctggctatcaagatcccctcgtcggctgaaaaatgcgtgtcgctgctacttgagctattggacaccaagatcaactacattctgcaggaggtggtcattgtcttcagggacattctgcgacgatacctgcctggtggagtggctgataaggccatctccaaccaggtgttcgcacccgtgatccccttgctgtgcgaaaacatggacgagattgatgaacctgaagccaaggccgccatcatctggattctgggcgaatacgtcgaccaggtccccaacgtggctgagattctgggctctataaccccccagtttctggaggagtccacacccgtgcagctgcagcttctcacagctgtggtcaagctgtacgtaaagaaacccgaccagggtcagcggctgatccaggaaaccctcaacactgctacctcgtcctcggacaatgctgacattcgagaccgagcctacatttactggcgtcttctgtcgtcagacacggccttcgcccagagtgtggttggagccgataagccccccattgcttctattatccctgaggttcagcctgctctcctagacgagcttctgagcgagctgggcactctcgcatcggtctaccacagacctgcctctactttcatgggtaagggcaagtttggcgctgatgctatacagaagcgagccatcgaggagcagcgagcgcttgctcaagacggtgccgccgcggctgctgttggagctgcttccggaggtgtcaacattgagaacctgttggacatcgattttgatggagccgctcccgcttctgctgctgccaacaccgacaacctgaacgacctcgacggtctgttttcgcacacagacggcaacacggacgctgctgctgccgcctctggtgcctctggtgccactggagcttcttccatgaacgacatcatgtcactgtttggaaattccagcagcatgggcggtggcatgagcggaatgggtggcatgggtggcatgggtggttctatggggtctcctgcacccatggctgcccctgccgacccgtttgcttcgttgtctgctgttaacaccgcagatgcctttgcctctctcaatattggcaacggttcggaaaaaccaaaggaacagcctgctcagcagcagcagcagcagggacagggaaaagccaatgatgatctacttggcttgttttag

SEQ ID NO: 33394 - protein, 782 aa, Yarrowia lipolytica CLIB99
MSLEKRIRSVFQAPKKGETYELRSGLVSQYASERKEAIQRTIQAMTLGKDVSALFPDIMKNLATHDIEQKKLVYLYLMNYAKSHPELCILAVNTFVGDSGDPNPLVRALAIRTMGCIRVDKMVDYMDGPLRKTLGDDNPYVRKTAAICVAKLFDLAPETCVEEGFLQTLQGLMSDSNPMVVANAVSALAEIQDRDPSTNCFVINSHILGKLLSALNECTEWGRVTLLTSLADYTADGDEGTHIVDRVVPQFQHANPSVVLAAVKCVLAHLHTQTEENREILLRKISPPLVSLVGSSSPPEVQYVSLRNIRLILQKYPQLLSRDLRVFFVKYNDPAYLKMEKLEILVRVANDNNASQLLAELKEYALEVDIDFVRRAVRAIGQLAIKIPSSAEKCVSLLLELLDTKINYILQEVVIVFRDILRRYLPGGVADKAISNQVFAPVIPLLCENMDEIDEPEAKAAIIWILGEYVDQVPNVAEILGSITPQFLEESTPVQLQLLTAVVKLYVKKPDQGQRLIQETLNTATSSSDNADIRDRAYIYWRLLSSDTAFAQSVVGADKPPIASIIPEVQPALLDELLSELGTLASVYHRPASTFMGKGKFGADAIQKRAIEEQRALAQDGAAAAAVGAASGGVNIENLLDIDFDGAAPASAAANTDNLNDLDGLFSHTDGNTDAAAAASGASGATGASSMNDIMSLFGNSSSMGGGMSGMGGMGGMGGSMGSPAPMAAPADPFASLSAVNTADAFASLNIGNGSEKPKEQPAQQQQQQGQGKANDDLLGLF

SEQ ID NO: 33395 - DNA, 2160 bp, Arabidopsis thaliana
  CDS (1)..(2160)
atgagcggtcatgattctaaatatttttcgactacgaagaagggagagatccctgagctcaaggaagagctgaattcacagtacaaggataagaggaaagatgctgttaagaaggttattgcggcaatgactgttggaaaggatgtttcatcacttttcactgatgtagtcaattgcatgcaaactgagaatctggagttgaagaagcttgtttacttgtatctgataaactatgcaaaaagccagccagatcttgctatcctcgctgtaaatacttttgttaaggattcacaagacccaaatccattgatccgggctttggctgtgcgaacgatgggctgtattcgtgttgataagattacagaatatttgtgtgatcctcttcagaaatgcctaaaggatgatgatccatatgtccgcaagacagcagctatttgtgttgctaaactgtttgacataaatgctgaattagttgaggatagggggttcctggaagccttaaaggatttaatatcagacaataatccaatggttgtggcaaatgctgtagctgcccttgcagagatccaagagaatagtactagtcccatatttgaaatcaatagtaccatcctcacaaagctccttacagctttgaatgaatgtactgaatggggtcaagtttttatattagatgctttgtcgaggtataaggcatctgatcctcgtgaagctgaaaatattgttgagagagtcactccaaggttgcaacatgccaactgtgctgttgtgctttcagctgttaaggtgacactttcaaaatatatacttctctctggaatcacagatgtgattcgaaatctttgcaagaagatggctcctcccctagttacattgctttctgcagaacctgagatacagtatgttgcacttcgtaacattaaccttattgtccaaaagagacccactattcttgcccatgaaatcaaggtgttcttctgcaagtataatgatccgatatatgttaagatggagaagttagagattatgataaaacttgcttctgacagaaacatagaccaggttcttctggagttcaaagaatatgccacggaagtagatgttgattttgttcggaaggctgttcgtgctataggccgatgtgccatcaaactagaaagagcagctgaacggtgcatcagtgttttacttgagctgatcaagatcaaagtaaactacgttgtgcaggaggccattatagtcatcaaagatatctttagaagatatccaaatacgtatgagtccataatcgcaacactctgtgagagtctagacacattggatgaaccagaagctaaggcatctatgatttggatcattggtgaatatgctgaaagaatcgacaatgcggatgaacttcttgaaagcttcctggagaatttccctgaggaaccagcacaagtccaactgcagcttcttacagctacagtcaaactatttctgaagaagccaactgaaggcccacaacaaatgattcaggttgtcttgaataatgctactgttgaaacagataatcctgatctcagggatcgtgcatacatctactggcgtcttctatcgactgatcctgaggcggccaaggatgttgttttagctgaaaagcctgtgattactgatgactcaaaccaacttgatccgtcgctcctggatgagctacttgcaaatatatccaccttgtcctctgtgtatcacaagccgccagaggcttttgtaacccgcttgaaaaccacagttcagaaaacggaggatgaggattatgtagaagggagcgaaacaggatatcccgaggcatctggtaatccggttgatggtgcagcttccccgtcagctaccacaggctatgtcacaaagctagctgctgccccagctcctgtacccgatctgctaggtgacctaatggggtcagataatgctgcaatccttcatgattcagttcaacaaaaactcattcggccttgcagctgtcggatcacttcaggttccgcctctgcaacccggagcatctgccaggacaatgatgccaatggtattgtcccaaaacatgtctactggctccaccagctcggtattgcaagttgccgtcaaaaacaaccagcagcctgtctggtacttcgaggataa

SEQ ID NO: 33396 - protein, 719 aa, Arabidopsis thaliana
MSGHDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQKCLKDDDPYVRKTAAICVAKLFDINAELVEDRGFLEALKDLISDNNPMVVANAVAALAEIQENSTSPIFEINSTILTKLLTALNECTEWGQVFILDALSRYKASDPREAENIVERVTPRLQHANCAVVLSAVKVTLSKYILLSGITDVIRNLCKKMAPPLVTLLSAEPEIQYVALRNINLIVQKRPTILAHEIKVFFCKYNDPIYVKMEKLEIMIKLASDRNIDQVLLEFKEYATEVDVDFVRKAVRAIGRCAIKLERAAERCISVLLELIKIKVNYVVQEAIIVIKDIFRRYPNTYESIIATLCESLDTLDEPEAKASMIWIIGEYAERIDNADELLESFLENFPEEPAQVQLQLLTATVKLFLKKPTEGPQQMIQVVLNNATVETDNPDLRDRAYIYWRLLSTDPEAAKDVVLAEKPVITDDSNQLDPSLLDELLANISTLSSVYHKPPEAFVTRLKTTVQKTEDEDYVEGSETGYPEASGNPVDGAASPSATTGYVTKLAAAPAPVPDLLGDLMGSDNAAILHDSVQQKLIRPCSCRITSGSASATRSICQDNDANGIVPKHVYWLHQLGIASCRQKQPAACLVLRG

SEQ ID NO: 33397 - DNA, 2772 bp, Mus musculus
  CDS (1)..(2772)
atgactgactcaaaatacttcaccacaaccaagaaaggggagatctttgagctgaaggcagagcttaacagtgacaagaaggagaagaagaaggaggcagtgaagaaagtgattgcatcaatgactgtgggcaaagatgtcagtgctctcttccctgatgtggtgaactgcatgcagacagacaacctggagctaaagaagctggtgtacctgtacttgatgaactatgccaagagtcagcctgacatggccattatggctgtcaacacctttgtgaaggactgtgaggaccccaatcctctcatccgggccctggctgtgaggactatgggctgcatccgagttgacaagattacagagtacttgtgtgaaccactccggaagtgcctgaaggatgaagacccatatgtgcgcaagacagcggctgtgtgtgtggccaagctccatgacatcaatgcccagctggtagaagaccagggcttcctggacacgcttaaagacctcatctcagactctaaccccatgtctatcaacaagctgctgacagcccttaatgagtgcactgaatggggccagatcttcattctggactgtctggccaactacatgcccaaggatgaccgtgaggcccagagcatctgtgagcgggtcactcctagactctcccatgccaactctgctgtggtgctgtctgcggtgaaggtgctgatgaagttcatggagatgctgtccaaggacctggactactatgccacactgctcaagaagctggcccctcccctggtcacactgctgtccgcagagccagagctgcagtatgtggccctgcgcaacatcaatctcattgtacagaaaaggccagagatcttgaagcatgaaatgaaggttttctttgtgaagtacaatgaccccatctacgtgaagctggagaaactggacattatgatccgcctggcctcccaggccaacattgcccaggtattggcagaactcaaagagtatgctacagaagtagacgtggatttcgtacggaaggcagtgcgtgccattggccgctgtgccatcaaggtggagcaatctgcagagcgctgtgtgagcacattgcttgatctcatccagaccaaggtcaactatgtggttcaggaagccattgtggtcattaaggacatcttccgcaagtaccccaacaagtatgagagtgtgatagctacactgtgtgagaatctggactctctggatgagcctgaggcccgagccgctatgatctggatagtgggcgagtatgccgagcggattgacaatgcagacgagctgctcgagagcttcctggaaggtttccatgatgagagcactcaggtccagctacagctactgacagccattgtgaaactcttcctgaagaagccaacagagactcaggagctggtgcagcaggtcctcagtttggccactcaggactcagacaatccagaccttcgggaccgtggctacatctactggcgcttgctctccacggaccctgtagctgctaaagaggtggtactggctgagaagcccctcatctcagaggagacagaccttattgagcctacacttctggatgaactcatctgctacattggcacgctggcctctgtctaccacaagcctcccaacgcctttgtggagggtggccggggagtggtacataagagcctgccaccccgcactgcctcgagtgagagcacagagagccctgagacagctcctgctggagcacctgctggtgatcagcctgatgtcattcctgcccagggtgacctgttaggtgacctcctcaacctggaccttgggcccccagtgagtggcccacccttagctgcctcctccgtgcaaatgggagctgtggatcttcttggtggtggcctcgacagcctgatgggggatgagtctgaagggattggagatagcaactttggggcaccttcagcatcagtggccgcagcaccagcaccagccagacttggagcacccatcagcagtggcttaagtgacctctttgacctgaccagtggtgtgggcaccctttcaggatcctatgtagctcccaaagcagtctggctccctgccatgaaggccaagggactggagatctctggcaccttcacccggcaggctggctccatctctatggacctgcagctgactaacaaggccctgcaggtcatgacagattttgctatccagttcaatcgtaacagctttggcttggcccctgctgcacctctccaggtgcacgtaccactcagccccaaccagaccgtggagatctccctgcctcttaacacagtgggctcagtcttgaagatggagcctctaaacaatcttcaggtggctgtgaagaacaacattgacgtcttctacttcagcactttgtacccactgcatgtcctcttcgtggaggatgggaagatggaccggcagatgttcctggccacatggaaggacattgccaacgagaacgaagcccagttccagatcagagactgcccgcttaacacagaggctgcgagcaacaagctacagagcagtaacattttcactgtcgccaagaggaacgtggagggccaggatatgctctaccaatctctgaagttgaccaatggcatctgggtgctggcggagctgcggatccagccaggcaaccccagcttcacgctgtccctgaagtgtcgagcaccggaggtgtcccagcatgtataccaggcctacgagactatcctcaagaactga

SEQ ID NO: 33398 - protein, 923 aa, Mus musculus
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMSINKLLTALNECTEWGQIFILDCLANYMPKDDREAQSICERVTPRLSHANSAVVLSAVKVLMKFMEMLSKDLDYYATLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPNAFVEGGRGVVHKSLPPRTASSESTESPETAPAGAPAGDQPDVIPAQGDLLGDLLNLDLGPPVSGPPLAASSVQMGAVDLLGGGLDSLMGDESEGIGDSNFGAPSASVAAAPAPARLGAPISSGLSDLFDLTSGVGTLSGSYVAPKAVWLPAMKAKGLEISGTFTRQAGSISMDLQLTNKALQVMTDFAIQFNRNSFGLAPAAPLQVHVPLSPNQTVEISLPLNTVGSVLKMEPLNNLQVAVKNNIDVFYFSTLYPLHVLFVEDGKMDRQMFLATWKDIANENEAQFQIRDCPLNTEAASNKLQSSNIFTVAKRNVEGQDMLYQSLKLTNGIWVLAELRIQPGNPSFTLSLKCRAPEVSQHVYQAYETILKN

SEQ ID NO: 33399 - DNA, 2484 bp, Caenorhabditis elegans
  CDS (1)..(2484)
atgaccgactccaaatatttcaccaccacaaagaaaggagaaatattcgaactgaaaaatgagctcaactctgacaaaaaggagaagaaaaaagaggctgtgaagaaggttatcgccagtatgacagtcggaaaagacgtcagcgctctatttcccgatgtggtgaattgtatgcagacggataatgttgaattgaagaaattagtctatctgtatttgatgaattacgcgaaatcgcagcctgatctcgcgattatggcggttaacacgtttgttaaggactgtgaagatccgaatcctctaatccgtgcacttgctgtccgtacaatgggatgtattcgcgttgaaaagatcaccgaatacctctgtgatcctctccgtcgatgtatgaaggatgaggatccatacgttcgaaaaaccgccgcagtctgtgttgcaaagcttcacgacatgaatccggctcttgtgaaggagcagggattcgttgagttgctcaacgatctactctccgatgccaatccgatggttgtggcgaatgcggttgccgcgttgactgaaatgaatgagcaacagactgtaattgaagtgaatagtcaaatggttaataaactattgactgcgttgaatgagtgtactgaatggggacaagtattcattttggatgctcttgcaggctacaccccacgagacgaacgtgaaactcaaaacatttgtgagcgaatctctccccgtctggctcacgccaacgccgccgtcgttctctccaccgtaaaagtgctcatgaagctgatcgacatgatgccagcagattcggactttatcacccaactcacgaagaagctcgcaccaccaatggttaccctgctctcggcggagcccgaaattcaatatgtcgcactgcgaaacatcaatttgatcgttcaaaaacgccccgacattttgaaacaagaaatgaaggtgttctttgtgaaatataatgatccgatttatgtgaaaatggagaagctggatattatgattcgactggctcaacagaataatatcgctcaagtgctcagtgagctcaaggaatatgccaccgaggttgatgtggattttgttcggaaatctgttagagcaattggaagatgtgctattaaagttgaagctagtagtgagcgatgtgttcagaccctgctggagctcattcagacaaaagtcaactatgttgtacaagaagccgtcgttgtgattaaggatatctttagaaaatatccgaatagatatgagagtattatttctgcactctgtgagaatctggacacgctggatgagcctgaagcccgggcttcaatgatttggattattggagaatatgctgagagaattgataatgctgatgagctcctcgagagttttgttgaaggattccatgatgagaatactcaggttcaactgcaacttctcaccgctgtcgtcaagcttttcctgaagcgtcccggagttgctcaggctcttgtacaacgtgtgctctcactggccactcaggatagtgataatccggatcttcgagatcgtggattcatctattggagacttctgtctgctgatccagctgcggcgaaaaatgttgtgctcactgagaagccgcttatttcggaggaaactgatctacttgagccatcgcttttggagcaacttgtttgtcatattggaacactggcttctgtctatcataagccaccatcggcgtttattgatccggcaaaggcaccgcttcggcagattaatccgattccggcggcgaaatttggatccagtcttctcgacacgtcatcaacaccaaatgctgcaagaaatggctcagcagctgctccaacagttattccatctcaagatcaagttattgcagatcttctgtcacttgatttaaatgctccagccgctagtgcaaatacaggagcttttggtggagcaatgagcggaacaacttctatgggtggcctcgatgatctactgggtcttggtggagatccgatgccagctgctccaacaaactcggcttcctataatccatttgatggtcttggtggacttggaggagctgctccagctgcaccaccttcccaacagccagcttcaattggaggactcgctgaaatttttggatctggtggattcggtggatcttctggaatcacttaccccaaggaattatggttggatgcttcgaaagcaatgggaatgcaagtggaaggaacatttgttcgacgtggtggaaaaatattcatggaaatgacaattacgaatcgagcaatgcaggcgatttctggatttgcactgcaatttaataagaattcgtttgggctgattccggtggaacaagtcaatccggcacctattttgccgaatcaatcgcaaaattacacaatcgcctgtgacacgacgggagcagttcaagtgacaactccactcacaaatcttcaagtaagttgtagtttgtag

SEQ ID NO: 33400 - protein, 827 aa, Caenorhabditis elegans
MTDSKYFTTTKKGEIFELKNELNSDKKEKKKEAVKKVIASMTVGKDVSALFPDVVNCMQTDNVELKKLVYLYLMNYAKSQPDLAIMAVNTFVKDCEDPNPLIRALAVRTMGCIRVEKITEYLCDPLRRCMKDEDPYVRKTAAVCVAKLHDMNPALVKEQGFVELLNDLLSDANPMVVANAVAALTEMNEQQTVIEVNSQMVNKLLTALNECTEWGQVFILDALAGYTPRDERETQNICERISPRLAHANAAVVLSTVKVLMKLIDMMPADSDFITQLTKKLAPPMVTLLSAEPEIQYVALRNINLIVQKRPDILKQEMKVFFVKYNDPIYVKMEKLDIMIRLAQQNNIAQVLSELKEYATEVDVDFVRKSVRAIGRCAIKVEASSERCVQTLLELIQTKVNYVVQEAVVVIKDIFRKYPNRYESIISALCENLDTLDEPEARASMIWIIGEYAERIDNADELLESFVEGFHDENTQVQLQLLTAVVKLFLKRPGVAQALVQRVLSLATQDSDNPDLRDRGFIYWRLLSADPAAAKNVVLTEKPLISEETDLLEPSLLEQLVCHIGTLASVYHKPPSAFIDPAKAPLRQINPIPAAKFGSSLLDTSSTPNAARNGSAAAPTVIPSQDQVIADLLSLDLNAPAASANTGAFGGAMSGTTSMGGLDDLLGLGGDPMPAAPTNSASYNPFDGLGGLGGAAPAAPPSQQPASIGGLAEIFGSGGFGGSSGITYPKELWLDASKAMGMQVEGTFVRRGGKIFMEMTITNRAMQAISGFALQFNKNSFGLIPVEQVNPAPILPNQSQNYTIACDTTGAVQVTTPLTNLQVSCSL

SEQ ID NO: 33401 - DNA, 2856 bp, Xenopus laevis
  CDS (1)..(2856)
atgacagattcaaagtatttcacaactaacaaaaaaggggagatctttgagctgaaagctgaactgaacaatgagaagaaagagaaacggaaggaagctgtaaagaaagttattgctgcaatgaccgtgggcaaagatgtcagctccctttttccagatgtggtgaactgcatgcaaacagacaatctggaactgaagaaacttgtttacctgtacctgatgaactatgccaaaagccagccagacatggcgatcatggctgtaaacagctttgtcaaggactgtgaggatccaaaccctctgatccgagccctggcagtgcgcaccatgggttgtatccgagttgataagatcactgagtacctctgtgagcctttgcggaagtgcctgaaggatgaggacccatacgtgcgcaagacagcagcagtgtgtgtagccaaactccacgacattaatgcccagatggtggaagatcagggctttttggactccctgagggatctgattgctgactccaatccaatggtggtagccaatgcagtagctgctctgtcagagatcagcgagtctcacccaaacagtaatctgttggacctgaatccccaaaacatcagcaaactgctaactgctcttaatgaatgcactgagtggggccagatcttcatcttggactgtctatcaaattataatcccaaggatgagagggaggcacagagtatctgtgagcgtgtcactcctcgactgtcccacgccaactctgctgtagtactgtctgctgttaaagtcttgatgaaattcatagagttactgcctaaagactctgactactataccatgttgttgaagaaactagctcctcctttggtcaccttgctgtcgggggagcctgaagtgcagtatgtagcacttcgtaacatcaaccttattgtgcagaaaagacctgaaattctaaaacaagaaattaaagttttctttgtaaagtacaatgatcctatttatgtcaaactggagaaactggacataatgattcgcctggcatcacaggctaacattgctcaggtcttggctgagctaaaggaatatgccactgaggtggatgttgattttgttagaaaggctgttcgtgccattggacgatgtgccattaaagttgagcaatctgcagagcgctgcgtgagcactctcttggacctcatccagaccaaggttaactatgtggttcaagaagccattgtcgttatcagagacatcttccgcaagtatcctaacaagtatgagagcataattgccacactgtgtgagaatctggattctttggatgagccagatgcccgtggtgccatgatctggattgttggtgaatatgcagaacgcattgacaatgcggatgaattactggagagcttcttggagggatttcatgatgagagtacacaggttcaactcactctacttactgctattgtcaaactctttctgaagaagccatcagaaacccaagagctggttcagcaggttctcagcctggctacacaggattctgataacccagacctgcgagacagaggctatatttactggcgattactttctactgatccagtaactgccaaagaagtggtgctctcagagaagccgctgatctctgaagagacagatttgattgagcccactctgctggatgaattaatttgccatatcggctcactggcttttgtctaccacaagccacctaatgcctttgtggaagggagtcacggagtacatcgcaagcaccttccaatccagcatggaagcattgatattggagacagccctgttggtcccactccttctgctggactcgaacagccccaggttattccatcacaaggtgacctccttggagatcttcttaatctcgatctgggccctccgggaaatgtgccacaagtgtccaccatgcagatgggagcagtggacctccttggtgggggtctggatagcttgctgggaagtgaccttggtggcggtattggtggaagtccagcggttgggcaaaccttcattccctcctcagtcccggcaacattcgctccatcccctacaccagcggtggttagcagtgggctaaatgacttgtttgaactctcttctggtattgggatggcacctggaggatatgtagccccaaaagctgtctggttaccagctgtaaaagccaaaggcttggaaatctctggtacattctcccacagacaatcacatatctacatggatatgactttcaccaacaaagctctgcagcacatgactgactttgcaatacagtttaataagaacagctttggtgtcattcccagtgcccctctggccattcatactcccctcatgcccaaccaaagtattgagatttctcttcctcttaatacccttgggcctgttatgaaaatggagccccttaacaaccttcaggtggccgtgaaaaataacattgacgtgttctacttcagttgccttatccctctacatgtactgtttgtggaagatggcaaaatggaacgtcaagtcttcctggccacatggaaggacatcccaaatgagaatgagctacagtttcagatcaaagattgccatttgaatgcagacacagtttccagcaaacttcagaataacaatgtgtataccattgccaagcggaatgtggaagggcaggacatgctgtatcaatccctcaaacttaccaatggtatttggatcctagctgagctgaggatccagcctgggaatcctaattatacgctttctttgaagtgccgtgcaccagaggtgtgtaactacgtttaccaagtgtatgattccatactgaagaactga

SEQ ID NO: 33402 - protein, 951 aa, Xenopus laevis
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNISKLLTALNECTEWGQIFILDCLSNYNPKDEREAQSICERVTPRLSHANSAVVLSAVKVLMKFIELLPKDSDYYTMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARGAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLAFVYHKPPNAFVEGSHGVHRKHLPIQHGSIDIGDSPVGPTPSAGLEQPQVIPSQGDLLGDLLNLDLGPPGNVPQVSTMQMGAVDLLGGGLDSLLGSDLGGGIGGSPAVGQTFIPSSVPATFAPSPTPAVVSSGLNDLFELSSGIGMAPGGYVAPKAVWLPAVKAKGLEISGTFSHRQSHIYMDMTFTNKALQHMTDFAIQFNKNSFGVIPSAPLAIHTPLMPNQSIEISLPLNTLGPVMKMEPLNNLQVAVKNNIDVFYFSCLIPLHVLFVEDGKMERQVFLATWKDIPNENELQFQIKDCHLNADTVSSKLQNNNVYTIAKRNVEGQDMLYQSLKLTNGIWILAELRIQPGNPNYTLSLKCRAPEVCNYVYQVYDSILKN

SEQ ID NO: 33403 - DNA, 2760 bp, Homo sapiens
  CDS (1)..(2760)
atgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctggtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtgggctccatctccatggacctgcagctgaccaacaaggccttgcaggtcatgaccgactttgccatccagttcaaccgcaacagctttggcctggcccccgccgcccccctccaggtccacgcaccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacgctgtccctgaagtgtcgagcaccagaggtgtcccagcacgtgtaccaggcctacgagaccatcctcaagaactga

SEQ ID NO: 33404 - protein, 919 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTLSLKCRAPEVSQHVYQAYETILKN

SEQ ID NO: 33405 - DNA, 2706 bp, Trypanosoma cruzi
  CDS (1)..(2706)
atgagtcgtgcgataattgcagagaaggctacattggcgtctgagcgggcgaaggagtttatcacgggtggtggtggcaacattgtgtcacgggcccgttcactcatctcaggggatgcacagttcttctcggtgcagccgaagttggaggatctgcgtcatcacctcgattctgactcacttcaagagaagcgaagcgcgatgaaacgtatcattgcgcagatgtgcaaagggaatgacatgtctaatctttttgccgatgtagtgaagaacatccacacctcgtcgattgaattacggaagcttatttatttatacatcacacactatgcagaggaccgccccaatgaggcacttctctccatctctgcctttcaaaaggatttgatggacccaagcatgcatgtacgctccctcgctctgcggatgcttagcacaatacgcattcctgctatccagccactggtgttgcttgcggtaacgaaatccgcctcggactcggagccattagtgcgaaagacggctgctatttctcttgctcaaatgcacgctattagtaccaatgatgaagatagtgagacggtgcataaacttctggggcaacttttggccgacaagtgtccagaagttacatcggcagctgcgctctcttttattgagatatgcccggataagatggaccttattcatgccgtttatcgtgatttctgccgctcacttttggactgtgacgagtgggggcaggtggtgcttcttcatgtgcttctacgttatgcacgaacacagtttatggaccctaacatttcttccaagccgtgtttaacgaagcatacacgcaaagaaaaggagaaggatagccttaaaaaacaaaaggctgatacgaagaagtcctcaacaacatcctcttcttcttcttcgtcttcttcctccttgtccttaacgtcttgtacggagtcttcgtccgatgcgctttctcggggaaatggccacggctctcaaaaaagtatcgattttcttttggacgccgatcatcgccttcttattgattctgtaaagccactttttatgagtctcaacagcgctgttgtagtggcggccacctcattgttttatcattgcgcccctagtgctgaattggatgtgtgtgttcgaccactgttacgtttacttgggggccctgaagagcaacatgccatcgttcttagtgccatatatactgttgtgctgtcacgtccagagccatttgttccgtacattaaagagttttatcttcttccacacgatgtgagtgatgtgcgggagctgaaactgcgcatcatttccaaactggctaccaaagataatttcatggaactttttcgggagttccgcgtgtatgttcgcagcttccatctggacaacgttgttgatgcggtacgagggcttggactaattgcgggacggttgccgaaatgcgccccacaagtgatgcggttgttggttcctctgatttcccaccataatgcagaggtggtgtcagagtgcatctcggttttacgtctgcttgtcattcagggaggtgacaagacccgcacaagtcaattggtgtatcggttgctgcagcaggtggtgaaggacgagattacggtggaatccgcaagggccagtattctttggcttgtgggggagaacattcagcgtcatgtggccattgctaccgcagcaccggagtgctttcgagtgtttgcgaagaggttttcacaggagggtttagatgtgaagaaacaggtcctaatgcttggctgtaagatttggctttttctagacggtagcagttcgatggccgatcgcttttgcaaacttttcttttatgtattggagcttgcccggtttgatgaggattacgaggtgcgggactgcggtcgtttcattcaatgcgctgtgaatcgtcagagtgacacatttgcggcgctgaagcacgtcttgctgagtgagaagccgttgccgcagtcgaatgacccgtacgtggagcgcacgcactatcagcttggcaccatgtcgcacctcttcggcaactccctctttggttaccgcaagctgccgccgtggtcggaggttccaacggacccaatgctgcgtggaccccaagctactgggtacgacgacgacgatgatggttcatcccgcgactttgacagtgatgcctcctcgacactgtacagcagctacagcgaaacgagtttatccgctgatggggagagtagtcgtgactcgttgcaatctgcgtcttctgcggaattttgtagtgaaaaggacgaggaagaggaatggggtgagaacacccagcgatcatcctcatcctcatcatcgcctgcctcctcggtgacatctggggctgatgtggccgtcgccgccgcgacgacggtgaaatgcgactctactaaacatgtgagttgccacgtcgatcccgtcacgatacccgtaacaggagaaaagacgatgggcgtgtgtgctcatcgcagcgctacgcctacgggaacggatgaactgaagcaggacgaagggatatccaccgcggatgttttgcaggtgacacccccacgtgacactgcgggggccgttagcacggaggcggacgcatcacacccttcgccacggccggagccgtcaatgaaggagctgcgaggaggcgagcacgaggagagaatgtcagcggatgaaatataa

SEQ ID NO: 33406 - protein, 901 aa, Trypanosoma cruzi
MSRAIIAEKATLASERAKEFITGGGGNIVSRARSLISGDAQFFSVQPKLEDLRHHLDSDSLQEKRSAMKRIIAQMCKGNDMSNLFADVVKNIHTSSIELRKLIYLYITHYAEDRPNEALLSISAFQKDLMDPSMHVRSLALRMLSTIRIPAIQPLVLLAVTKSASDSEPLVRKTAAISLAQMHAISTNDEDSETVHKLLGQLLADKCPEVTSAAALSFIEICPDKMDLIHAVYRDFCRSLLDCDEWGQVVLLHVLLRYARTQFMDPNISSKPCLTKHTRKEKEKDSLKKQKADTKKSSTTSSSSSSSSSSLSLTSCTESSSDALSRGNGHGSQKSIDFLLDADHRLLIDSVKPLFMSLNSAVVVAATSLFYHCAPSAELDVCVRPLLRLLGGPEEQHAIVLSAIYTVVLSRPEPFVPYIKEFYLLPHDVSDVRELKLRIISKLATKDNFMELFREFRVYVRSFHLDNVVDAVRGLGLIAGRLPKCAPQVMRLLVPLISHHNAEVVSECISVLRLLVIQGGDKTRTSQLVYRLLQQVVKDEITVESARASILWLVGENIQRHVAIATAAPECFRVFAKRFSQEGLDVKKQVLMLGCKIWLFLDGSSSMADRFCKLFFYVLELARFDEDYEVRDCGRFIQCAVNRQSDTFAALKHVLLSEKPLPQSNDPYVERTHYQLGTMSHLFGNSLFGYRKLPPWSEVPTDPMLRGPQATGYDDDDDGSSRDFDSDASSTLYSSYSETSLSADGESSRDSLQSASSAEFCSEKDEEEEWGENTQRSSSSSSSPASSVTSGADVAVAAATTVKCDSTKHVSCHVDPVTIPVTGEKTMGVCAHRSATPTGTDELKQDEGISTADVLQVTPPRDTAGAVSTEADASHPSPRPEPSMKELRGGEHEERMSADEI

SEQ ID NO: 33407 - DNA, 3483 bp, Drosophila ananassae
  CDS (1)..(3483): n means a or g or c or t/u
atgcaacagaacgcggccagcaatccgttctcgatgtccacgtacgtggagcgaccccaaatgggtctggacgtggagttcggagcagatccagccagcggagccgctttcttccagagcgacggccgcaagcacgacgaccttaagcagatgctggacagcaacaaggacgacctgaagctggaggccatgaagcggatcatcggcatgattgcccggggtcgggatgccagcgatctgttcccggctgtggtcaagaatgtcgtgtccaagaacatcgaggtgaagaagctggtctacgtctacctggtgcgctatgccgaggagcagcaggacctggccctgctctccatctccacgttccagcgcgccctgaaggacccaaatcagttgattcgcgcctccgccctccgggttctctcctccattcgggtcagcatgattgtgccgatcgtgatgctggcgatccgggacagcgccgccgacctaagtccctatgtgcgcaaaacggcagcccatgccattcccaagctgtactccctggacgccgaccagaaggacgaactggtgatggtgattgagaagctgttgtcggacaggaccaccttggtggtgggctcagcagtcatggccttcgatgaggtctgtcccgagcgggtggatctcatccacaagaactataggaagctctgcaacctgctggtggatgtggacgagtggggccaggtgatcatcatcaacatgctgacccgctacgcccgcacccagttcgtggatccgaatgcggacgatgatctggccgatggtgtggccgaaacgccgaccaacgagcgcttctacgacgagtcctcgcactcctcctcctcgaacagcgacgacggcagcagcgacgacgaggctaagaccaagtcgcgtcccaacaacggcggtggcggcagcaacaacaataacggcggcagtcgcacgcccagttccccaggaagcagttaccatatcgatgtggaccaccgcctgctcctgcggcagacgaagccacttctgcagtcgcgcaacgcctcggtggtgatggcggtggcccagttgtaccatcatgtggcgcccaagaacgaggtgcagctgatagccaaggccctgatccggctgctgcgctcgcacaaggaagtgcagagcgtggtgctcaactgcatcgcctcgatgtccaccaagcgcaaggccatcttcgagccccatctcaagtcgttctttgtgcgcaccagtgatccgacgcacctgaagctcctcaagctggacatcctcaccaacctggcctcggcgggcagcatctcgctaattctgcgtgagttccagacctacatctccagcagcgaccgttccttcgtggcggccaccatccaggccatcggacgctgcgcctccagcatcaaggaagtaaccgagacctgtctcagtggtctggtgcatctcttatcgaatcacgatgaacacgttgtggcggagagcgttgtggtcatcaagaggttgttgcaaaccaaggcagccgagcacttcgagatcatcacccagatggcgaagctgatcgattacatcaacgtgccggctgcccgggcggccatcatctggctgattggcgagtacaacgagaaggtgccactgatagcccccgatgtgctgcgcaagatggccaagtccttcgtggacgagcaggacgtggtcaagctgcaggtgctgaatctcggtgttaagctctacctgaccaatccgcagcagacctcgctgctctgccagtacgtcttcaccctggcccgctacgatcccaattacgatgtacgcgatcgcgcccgtttcctgcgccagatcatcttcccggccagcggcaatagcagcgttctcagccagaacgcccgccaggtttttctcgccagcaagccggctccggtgccggagagcaagtaccgggacggcaacaacttccaactgggcttcctgtcgcactacctgaacatgccggcggccgggtacaaggagctgccgcctttcccggccattgngccggactcctcggtgcgcaacattgccggtttcatgcaggaaaagctgccgggcgaggagtcgccggcagggcgctctaaagacgcctccggcggcgttccgggcaaagacaagagtaccggacgggagaagggtttcctctcggagtcggaggacaagtcctcggcctactcggagtccggcagcagcagtggcagcggcaccagcgacagcgagtcggacagcgaagacagcggcagcagcgagaggagagagcgaagcggaacagcccgccaaggtttccgcaagaaggagccaccgtcctcgggcgatctaatcgatgctggaagcaacgaggtggtggctcccgcgccggaaaaagcagccacgaacaataatagtaatgctgctggttattccggcacctcggagagcggcgactcctcctcgtatagcggcagcagcagtggcgaggacagcgactcgggaaccgacaacgacgccgtgcagaaggaagccaaaaagccggaggtggagaccaagtcgaagccgaaggagaaggagaagcagccctcgaagagcaatctggatcttttactcgatctggatgatattccgcccataggtcctgtgatgacgccctcgctgggaggtttcctaacgcccggtactcctctgatcagtggccaggcagctccactgcagccgcagcatgccaggaaccgggtggagctggtcggaccgtcgcacatcgagttcaagcacaaggagctgctgaataaggtgagcggccatggactccagctgggctaccgcttcacccgcgccccccacctcttctcctcgggcatgtgctccatcgagctgcagttccaaaaccggggcgagcaggagatcaccaacatacgcctaggccagaccaccttgccggcgggcatgcaactgaacgagtttgcgccggtgttggtcctgcagccgcaacaaacggccagcggtatcctgggccttgacttcaacgactccacccatgccgtggacctggaggtggtctccagtgcgggcagttcgcgggtgcagctgaagccgccggtgggcgagctggtgcggtccgtccagatcggggagagctgtcaccgcgaggagcgggccaagttgcgcggcatgaacgagcaccagtgcgagctgcgcggcctgaggagcgacctgatcgacgtgtccgccctgcgccagaaggtcgtcgaatgcatcaatgtggcgcacacgcacagctctccaaacggccagctgcactgcttcgccggccagacgcttagttcgaagagcctggtcctgctcacgctccagtggcagacggaggacgccctgacccttctggtcaattgcgagaagatggtcattggctccatggtgctgaacgagctgaggaacgccctgcagctcagctttgcgatgtga

SEQ ID NO: 33408 - protein, 1160 aa, Drosophila ananassae
  misc_feature (683)..(683): Xaa can be Ala or Glu or Gly or Val
MQQNAASNPFSMSTYVERPQMGLDVEFGADPASGAAFFQSDGRKHDDLKQMLDSNKDDLKLEAMKRIIGMIARGRDASDLFPAVVKNVVSKNIEVKKLVYVYLVRYAEEQQDLALLSISTFQRALKDPNQLIRASALRVLSSIRVSMIVPIVMLAIRDSAADLSPYVRKTAAHAIPKLYSLDADQKDELVMVIEKLLSDRTTLVVGSAVMAFDEVCPERVDLIHKNYRKLCNLLVDVDEWGQVIIINMLTRYARTQFVDPNADDDLADGVAETPTNERFYDESSHSSSSNSDDGSSDDEAKTKSRPNNGGGGSNNNNGGSRTPSSPGSSYHIDVDHRLLLRQTKPLLQSRNASVVMAVAQLYHHVAPKNEVQLIAKALIRLLRSHKEVQSVVLNCIASMSTKRKAIFEPHLKSFFVRTSDPTHLKLLKLDILTNLASAGSISLILREFQTYISSSDRSFVAATIQAIGRCASSIKEVTETCLSGLVHLLSNHDEHVVAESVVVIKRLLQTKAAEHFEIITQMAKLIDYINVPAARAAIIWLIGEYNEKVPLIAPDVLRKMAKSFVDEQDVVKLQVLNLGVKLYLTNPQQTSLLCQYVFTLARYDPNYDVRDRARFLRQIIFPASGNSSVLSQNARQVFLASKPAPVPESKYRDGNNFQLGFLSHYLNMPAAGYKELPPFPAIXPDSSVRNIAGFMQEKLPGEESPAGRSKDASGGVPGKDKSTGREKGFLSESEDKSSAYSESGSSSGSGTSDSESDSEDSGSSERRERSGTARQGFRKKEPPSSGDLIDAGSNEVVAPAPEKAATNNNSNAAGYSGTSESGDSSSYSGSSSGEDSDSGTDNDAVQKEAKKPEVETKSKPKEKEKQPSKSNLDLLLDLDDIPPIGPVMTPSLGGFLTPGTPLISGQAAPLQPQHARNRVELVGPSHIEFKHKELLNKVSGHGLQLGYRFTRAPHLFSSGMCSIELQFQNRGEQEITNIRLGQTTLPAGMQLNEFAPVLVLQPQQTASGILGLDFNDSTHAVDLEVVSSAGSSRVQLKPPVGELVRSVQIGESCHREERAKLRGMNEHQCELRGLRSDLIDVSALRQKVVECINVAHTHSSPNGQLHCFAGQTLSSKSLVLLTLQWQTEDALTLLVNCEKMVIGSMVLNELRNALQLSFAM

SEQ ID NO: 33409 - DNA, 3249 bp, Mus musculus
  CDS (1)..(3249)
atgtcggccgctccggcctacagcgaagacaagggcggctcagccggtcccggggagccagaatatggccacgacccggcgagcggcggtatcttctcctcggactacaagcggcatgatgacctgaaagagatgttggacaccaacaaggactccctcaagctggaggccatgaagaggattgtggcaatgatcgcccggggaaagaatgcctcggacctgttccctgcagtggtgaagaatgtggcctgtaagaacatagaggtgaagaagcttgtctacgtgtatctggtccgatatgccgaggagcagcaagacctcgctctactgtccatctctactttccaacgtggcctaaaggatcccaaccagctgatccgtgccagtgcgctccgggttctctctagcatccgtgtgcccatcatagtgcccatcatgatgctagccatcaaggaagctgcctcggacatgtcaccctacgttcggaaaacagctgctcatgccatccccaaactctacagtttggactccgatcagaaggaccagctgatagaagtcattgagaagcttttggcagataagaccacgctggtggcaggcagtgtagtgatggcctttgaagaggtatgtccagaacgtattgacctgattcacaaaaactaccggaagctctgcaacctgctcattgatgtggaggagtggggccaggtggtgattatcagcatgctcacgcgttatgcgcgaacgcaattcctgagccctacgcagaatgagtccttgctggaggagaatcccgagaaggccttctatggctccgaggaggacgaggccaaaggccctggatcagaggaggcagccactgcggcgctgcccgctcggaagccctatgtaatggacccagatcaccggctgctgctgcggaacaccaagcccctgctgcagagccgcagcgccgcggtggtcatggcggtggcgcagctttacttccacctagcgcctaaggcagaggtgggcgtcatcgccaaggcgctggtacgcctgctgcgcagccacagtgaggtgcagtacgtagtgctccagaacgtggccaccatgtccatcaagcgcaggggtatgtttgaaccctacctgaagagcttctacattaggtccacggatcctacccagatcaagatcctgaagctggaagtgctgaccaacctggccaatgagactaacatccccactgttctccgggaattccagacctacattcgcagcatggacaaagactttgtggcagccacgatccaggccattggacgatgtgcaacgaacataggccgagtccgtgacacctgtctcaatggcttggtgcagcttctgtccaaccgtgacgagcttgtggttgcagagtcagtggtggtcattaagaagctgctgcaaatgcagccagcgcagcacggtgagatcatcaaacacttggcaaagctcacagacaacatccaggtgcccatggcacgagccagcatcctctggctcattggagagtactgtgagcatgtccccaagatcgcacctgatgtcctgagaaaaatggccaagtccttcacagcagaggaggacatcgtgaagctgcaggtcatcaacctggcagccaagctgtacctgactaactcaaagcagaccaagctcttgacccagtatgtgctgagtctggccaagtacgaccagaactatgatatccgggatcgagcccgcttcacccggcagctcattgttccctctgagcagggtggtgccctcagtcgccatgccaagaaactcttcctggcccctaagccagcccctatcttggagtcatccttcaaagatcgtgaccatttccagctgggctcactgtcacacctgctcaatgcaaaggctacaggctaccaggagctcccggactggccagaggaagccccagatccatctgtgcgcaatgtggaggtacctgaatggaccaaatgttcaaatcgggagaagaggaaggagaaggaaaagcctttctattctgactccgagggggagtctggccccactgagtctgcagacagcgagcctgaatctgagagtgagtcagagagtaagagcagcagtgggagtggctccggggagtctagcagtgagtcggacaatgaagaagaggatgaggagaaaggcggaggcagcgagagtgaacagagtgaggaggaagatgagaagaagaagaagacaaagaagaagaaggcatcagagggacacagagaaggctcatcatcagaagagggcagtgactccagcagcagctcagagtctgaggtgacgtcagagtcggaggaggaacaggtggaacctgcctcctggaggaagaaaacgcctccaggcagcaagagtgcccctgtagccaaggagatttccctgctggacctagaggatttcacccctcctagtgtccagcctgtgtctcctcccatggttgtgtctaccagtctggctgctgacctggaagggctgacactcacagactcctctctggtgccttcgctgctgagtccagtgtccagcattgggaggcaggagctgctgcaccgggtagctggagaggggctgtctgtggactatgccttcagccgccagcctttctctggggatccccacatggtgtctctgcatatctacttctccaacaactcggagactcccatcaaggggctgcatgtgggcactcccaagctgcctgctggcatcagcattcaagaattccctgaaatcgagtccctggcacctggagaatccaccactactgtgatgggcattaacttctgcgactcaacccaggcagccaacttccagctgtgcacccaaacccgacagttctatgtctccattcagccacctgtcggggagctgatggcccctgtatttatgagtgagaatgagttcaagaaggaacagggaaagctgacaggcatgaatgagatcacagagaagcttacattgccagacacctgtcgaagtgatcacatggtggtgcagaaagtgactgccaccgccaacctaggtcgtgtcccatgtgggacatctgatgagtacaggtttgcagggaggacattaactagtgggagtctggtcctgctgactctggatgcccgggcagctggagccgcccagctgaccgtcaacagtgagaagatggtgattggcaccatgctggtgaaggatgtgattcaggctctgacccagtga

SEQ ID NO: 33410 - protein, 1082 aa, Mus musculus
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENPEKAFYGSEEDEAKGPGSEEAATAALPARKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPKIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPILESSFKDRDHFQLGSLSHLLNAKATGYQELPDWPEEAPDPSVRNVEVPEWTKCSNREKRKEKEKPFYSDSEGESGPTESADSEPESESESESKSSSGSGSGESSSESDNEEEDEEKGGGSESEQSEEEDEKKKKTKKKKASEGHREGSSSEEGSDSSSSSESEVTSESEEEQVEPASWRKKTPPGSKSAPVAKEISLLDLEDFTPPSVQPVSPPMVVSTSLAADLEGLTLTDSSLVPSLLSPVSSIGRQELLHRVAGEGLSVDYAFSRQPFSGDPHMVSLHIYFSNNSETPIKGLHVGTPKLPAGISIQEFPEIESLAPGESTTTVMGINFCDSTQAANFQLCTQTRQFYVSIQPPVGELMAPVFMSENEFKKEQGKLTGMNEITEKLTLPDTCRSDHMVVQKVTATANLGRVPCGTSDEYRFAGRTLTSGSLVLLTLDARAAGAAQLTVNSEKMVIGTMLVKDVIQALTQ

SEQ ID NO: 33411 - DNA, 2181 bp, Saccharomyces cerevisiae
  CDS (1)..(2181)
atgccaccattggataaaagaatcaagaagtttctaaaagactccattagaattgcgccaaaaatatccggtaagggtgaactaagtgaattaagaactggattagtatctcaatacccacagactcggaaagatgcaataaagaaaacgatccagcaaatgacgttgggaaaagatgtctcttcgctgttcccagacgtcttgaaaaacattgccacaattgacgttgaacaaaaaaaactggtttatctttatgtgatgaattatgctgagacgcatcccgaattatgtattcttgccgttaacacattcattactgatgcacaagatccaaatcccttaattcgctgcatggcaatcagaacgatgtcaatgataagagttgacaaaatcctggaatacattgaaacaccactccgccgtaccttgcatgatgataatgcatatgttagaaaaaccgcagtgatatgtgtcgcaaaacttttccaattaaacaaggatttatgcgttgagttgggtgtcgtcgaagatttggtcaatgccctagatgactcaaatcctttagtcattgcaaacgcaacagcagcattaattgaaattcacaatatggatatggatgccgttgatctttcaagtttgatccagtcccacgtttcacaattcttattagctttgaacgaatgtacggaatgggctagaattatcatactaggaactctttcggaatattcggcaaaagattctttagaggcacaagatatcattgatcgagtaactgcgcatttacaacacgttaatccagccgttgttttagctacaataaaggtaatcgtaaggaacttgcctcaaattgaatattcctcgaacagtctgataatgaaaagattatcatctgcttttgtatcactgatgtctacgccgcctgaaatgcaatatgttgctttgaaaaatattaggatcatattggagaaatatccagagctgttaaccaaagaattgagaatattttatgtcaagttcaacgatcctctttacgtcaagttagagaagatcgatatccttgtaagactagtcgatccttccaacttgaaacaatgtactttgttgttgacagaattaaaggaatacgcaatggaatatgaacctgagtttgtttcaagagctattcaagctttgtcccagttgggtattaaatatgcacaagaatcattcgtcagtaaagtcttggatattctcctagaattgttagaaagacaagacacaataaaagacgactgctgtatatcattatgtgatttattaagacattgccccggaaacgataagatggccaaacaagtttgtgcagtatttaatacttggtcaaatccagaggtgttattacaatcagatattgcgaagtgcaactatgtctggttgctaggacagcatcccaacaatttctcagatttggagtcaaaaatcaatatttttatagagaactttgttcaagaggaagctttaacacagatgtctttactaatgacaatagtcagactacatgctactttaacgggtagtatgctacaaagcgtcctagaattggccacacaacagacacatgaattagatgtgcgagatatggctatgatgtattggagatgcctttcgatgccaaataatgaaagtttggttaatgatctatgtcaaaataaacttccaatgatctccaatacactggagaagttttcaccagaagtgctagagaaactattaatggaattgggtactataagttccatttatttcaagcccgactcaaataggagaaaaggcaaaaagtatgttcaaaatatagttaaaggaaaacatatagaggaattagaaagcatggcaaaaaatgaaatttctagcaaggctaacgatgatgtgctattggattttgatgaaagagatgatgtaacaaatacaaatgcaggaatgctgaatactttaacaactttaggcgatttggatgatttatttgatttcggaccatctgaggatgccacacaaataaatacaaatgataccaaggctgtacaagggttgaaggagctgaaactaggtggcgactcaaacggtatatcttctggtggtaaaaacaatcccgatgtttcgggcggcaatatagtgtcacaggatctcctcgatttattctga

SEQ ID NO: 33412 - protein, 726 aa, Saccharomyces cerevisiae
MPPLDKRIKKFLKDSIRIAPKISGKGELSELRTGLVSQYPQTRKDAIKKTIQQMTLGKDVSSLFPDVLKNIATIDVEQKKLVYLYVMNYAETHPELCILAVNTFITDAQDPNPLIRCMAIRTMSMIRVDKILEYIETPLRRTLHDDNAYVRKTAVICVAKLFQLNKDLCVELGVVEDLVNALDDSNPLVIANATAALIEIHNMDMDAVDLSSLIQSHVSQFLLALNECTEWARIIILGTLSEYSAKDSLEAQDIIDRVTAHLQHVNPAVVLATIKVIVRNLPQIEYSSNSLIMKRLSSAFVSLMSTPPEMQYVALKNIRIILEKYPELLTKELRIFYVKFNDPLYVKLEKIDILVRLVDPSNLKQCTLLLTELKEYAMEYEPEFVSRAIQALSQLGIKYAQESFVSKVLDILLELLERQDTIKDDCCISLCDLLRHCPGNDKMAKQVCAVFNTWSNPEVLLQSDIAKCNYVWLLGQHPNNFSDLESKINIFIENFVQEEALTQMSLLMTIVRLHATLTGSMLQSVLELATQQTHELDVRDMAMMYWRCLSMPNNESLVNDLCQNKLPMISNTLEKFSPEVLEKLLMELGTISSIYFKPDSNRRKGKKYVQNIVKGKHIEELESMAKNEISSKANDDVLLDFDERDDVTNTNAGMLNTLTTLGDLDDLFDFGPSEDATQINTNDTKAVQGLKELKLGGDSNGISSGGKNNPDVSGGNIVSQDLLDLF

SEQ ID NO: 33413 - DNA, 25 bp, Primer
atggtagattcaattcaccgtattg

SEQ ID NO: 33414 - DNA, 24 bp, Primer
ctaaagctccagatgcgaagaaga

SEQ ID NO: 33415 - protein, 97 aa, consensus
  MISC_FEATURE (1)..(97): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXXXXXXXXXXXXXXXVRXXXXXXXXX

SEQ ID NO: 33416 - DNA, 1716 bp, Saccharomyces cerevisiae; identical to SEQ ID NO: 230
  CDS (1)..(1716)

SEQ ID NO: 33417 - protein, 571 aa, Saccharomyces cerevisiae; identical to SEQ ID NO: 231

SEQ ID NO: 33418 - DNA, 2817 bp, Neurospora crassa; identical to SEQ ID NO: 1285
  CDS (1)..(2817)

SEQ ID NO: 33419 - protein, 938 aa, Neurospora crassa; identical to SEQ ID NO: 239

SEQ ID NO: 33420 - DNA, 2658 bp, Mus musculus; identical to SEQ ID NO: 1287
  CDS (1)..(2658)

SEQ ID NO: 33421 - protein, 885 aa, Mus musculus; identical to SEQ ID NO: 245

SEQ ID NO: 33422 - DNA, 2583 bp, Xenopus laevis; identical to SEQ ID NO: 246
  CDS (1)..(2583)

SEQ ID NO: 33423 - protein, 860 aa, Xenopus laevis; identical to SEQ ID NO: 247

SEQ ID NO: 33424 - DNA, 2568 bp, Homo sapiens; identical to SEQ ID NO: 1291
  CDS (1)..(2568)

SEQ ID NO: 33425 - protein, 855 aa, Homo sapiens; identical to SEQ ID NO: 241

SEQ ID NO: 33426 - DNA, 2625 bp, Homo sapiens; identical to SEQ ID NO: 242
  CDS (1)..(2625)

SEQ ID NO: 33427 - protein, 874 aa, Homo sapiens; identical to SEQ ID NO: 243

SEQ ID NO: 33428 - DNA, 2076 bp, Caenorhabditis elegans; identical to SEQ ID NO: 1295
  CDS (1)..(2076)

SEQ ID NO: 33429 - protein, 691 aa, Caenorhabditis elegans; identical to SEQ ID NO: 235

SEQ ID NO: 33430 - DNA, 1782 bp, Schizosaccharomyces pombe; identical to SEQ ID NO: 1297
  CDS (1)..(1782)

SEQ ID NO: 33431 - protein, 593 aa, Schizosaccharomyces pombe; identical to SEQ ID NO: 237

SEQ ID NO: 33432 - DNA, 26 bp, Primer
atgaatgatcctcgtgaaattttagc

SEQ ID NO: 33433 - DNA, 25 bp, Primer
ttatattatctcaagatcgctggca

SEQ ID NO: 33434 - protein, 579 aa, consensus
  MISC_FEATURE (1)..(579): consensus for the disclosure of xaa see table XV
DXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXGXKXXXLXXXXXXXXXXXXXXXXXXXXXVXXXXXXXXXXXXXXXXXXXXXXXXXXXXXXXLXDXXXXXXXXLFXXXXXXXXWXXXXGXVXXXLNXXXXXXXXXXXXXXXXXXXLXXXXXXXXXLXXGXXXXLGXCXXXXXKXGXXCXXXXNXXXXXXCXXHXXXXXXXXXXXRXXXXXXXXXXXXXXXXXXXXXXXXXXXXXXXXXXXXXXXXXXXXXXXXXXXXXXXXXXXXXXXXXXT

SEQ ID NO: 33435 - protein, 60 aa, consensus; identical to SEQ ID NO: 1957
  MISC_FEATURE (1)..(60): consensus for the disclosure of xaa see table XV

SEQ ID NO: 33436 - DNA, 642 bp, Saccharomyces cerevisiae; identical to SEQ ID NO: 993
  CDS (1)..(642)

SEQ ID NO: 33437 - protein, 213 aa, Saccharomyces cerevisiae; identical to SEQ ID NO: 994

SEQ ID NO: 33438 - DNA, 543 bp, Caenorhabditis elegans; identical to SEQ ID NO: 995
  CDS (1)..(543)

SEQ ID NO: 33439 - protein, 180 aa, Caenorhabditis elegans; identical to SEQ ID NO: 996

SEQ ID NO: 33440 - DNA, 552 bp, Schizosaccharomyces pombe; identical to SEQ ID NO: 997
  CDS (1)..(552)

SEQ ID NO: 33441 - protein, 183 aa, Schizosaccharomyces pombe; identical to SEQ ID NO: 998

SEQ ID NO: 33442 - DNA, 822 bp, Neurospora crassa; identical to SEQ ID NO: 999
  CDS (1)..(822)

SEQ ID NO: 33443 - protein, 273 aa, Neurospora crassa; identical to SEQ ID NO: 1000

SEQ ID NO: 33444 - DNA, 636 bp, Oryza sativa (Rice); identical to SEQ ID NO: 1001
  CDS (1)..(636)

SEQ ID NO: 33445 - protein, 211 aa, Oryza sativa (Rice); identical to SEQ ID NO: 1002

SEQ ID NO: 33446 - DNA, 831 bp, Oryza sativa (Rice); identical to SEQ ID NO: 1003
  CDS (1)..(831)

SEQ ID NO: 33447 - protein, 276 aa, Oryza sativa (Rice); identical to SEQ ID NO: 1004

SEQ ID NO: 33448 - DNA, 633 bp, Arabidopsis thaliana (Mouse-ear cress); identical to SEQ ID NO: 1005
  CDS (1)..(633)

SEQ ID NO: 33449 - protein, 210 aa, Arabidopsis thaliana (Mouse-ear cress); identical to SEQ ID NO: 1006

SEQ ID NO: 33450 - DNA, 573 bp, Brugia malayi (Filarial nematode worm); identical to SEQ ID NO: 1007
  CDS (1)..(573)

SEQ ID NO: 33451 - protein, 190 aa, Brugia malayi (Filarial nematode worm); identical to SEQ ID NO: 1008

SEQ ID NO: 33452 - DNA, 612 bp, Drosophila melanogaster (Fruit fly); identical to SEQ ID NO: 1009
  CDS (1)..(612)

SEQ ID NO: 33453 - protein, 203 aa, Drosophila melanogaster (Fruit fly); identical to SEQ ID NO: 1010

SEQ ID NO: 33454 - DNA, 528 bp, Encephalitozoon cuniculi; identical to SEQ ID NO: 1011
  CDS (1)..(528)

SEQ ID NO: 33455 - protein, 175 aa, Encephalitozoon cuniculi; identical to SEQ ID NO: 1012

SEQ ID NO: 33456 - DNA, 558 bp, Homo sapiens (Human); identical to SEQ ID NO: 1013
  CDS (1)..(558)

SEQ ID NO: 33457 - protein, 185 aa, Homo sapiens (Human); identical to SEQ ID NO: 1014

SEQ ID NO: 33458 - DNA, 558 bp, Mus musculus (Mouse); identical to SEQ ID NO: 1015
  CDS (1)..(558)

SEQ ID NO: 33459 - protein, 185 aa, Mus musculus (Mouse); identical to SEQ ID NO: 1016

SEQ ID NO: 33460 - DNA, 558 bp, Xenopus laevis (African clawed frog); identical to SEQ ID NO: 1017
  CDS (1)..(558)

SEQ ID NO: 33461 - protein, 185 aa, Xenopus laevis (African clawed frog); identical to SEQ ID NO: 1018

SEQ ID NO: 33462 - DNA, 23 bp, Primer
atgtcactaccggcacatttgca

SEQ ID NO: 33463 - DNA, 29 bp, Primer
ttaaatattgaattcttcttcatcatttt

SEQ ID NO: 33464 - protein, 223 aa, consensus; identical to SEQ ID NO: 18705
  MISC_FEATURE (1)..(223): consensus for the disclosure of xaa see table XV

SEQ ID NO: 33465 - protein, 212 aa, consensus; identical to SEQ ID NO: 1948
  MISC_FEATURE (1)..(212): consensus for the disclosure of xaa see table XV

SEQ ID NO: 33466 - DNA, 2995 bp, Saccharomyces cerevisiae; identical to SEQ ID NO: 15848
  CDS (328)..(2568)

SEQ ID NO: 33467 - protein, 746 aa, Saccharomyces cerevisiae; identical to SEQ ID NO: 15849

SEQ ID NO: 33468 - DNA, 2298 bp, Saccharomyces cerevisiae; identical to SEQ ID NO: 15850
  CDS (1)..(2298)

SEQ ID NO: 33469 - protein, 765 aa, Saccharomyces cerevisiae; identical to SEQ ID NO: 15851

SEQ ID NO: 33470 - DNA, 2175 bp, Saccharomyces cerevisiae; identical to SEQ ID NO: 15852
  CDS (1)..(2175)

SEQ ID NO: 33471 - protein, 724 aa, Saccharomyces cerevisiae; identical to SEQ ID NO: 15853

SEQ ID NO: 33472 - DNA, 3923 bp, Saccharomyces cerevisiae; identical to SEQ ID NO: 15854
  CDS (1394)..(3634)

SEQ ID NO: 33473 - protein, 746 aa, Saccharomyces cerevisiae; identical to SEQ ID NO: 15855

SEQ ID NO: 33474 - DNA, 2040 bp, Schizosaccharomyces pombe; identical to SEQ ID NO: 15856
  CDS (1)..(2040)

SEQ ID NO: 33475 - protein, 679 aa, Schizosaccharomyces pombe; identical to SEQ ID NO: 15857

SEQ ID NO: 33476 - DNA, 2229 bp, Candida glabrata; identical to SEQ ID NO: 15858
  CDS (1)..(2229)

SEQ ID NO: 33477 - protein, 742 aa, Candida glabrata; identical to SEQ ID NO: 15859

SEQ ID NO: 33478 - DNA, 2469 bp, Candida glabrata; identical to SEQ ID NO: 15860
  CDS (1)..(2469)

SEQ ID NO: 33479 - protein, 822 aa, Candida glabrata; identical to SEQ ID NO: 15861

SEQ ID NO: 33480 - DNA, 2052 bp, Ashbya gossypii; identical to SEQ ID NO: 15862
  CDS (1)..(2052)

SEQ ID NO: 33481 - protein, 683 aa, Ashbya gossypii; identical to SEQ ID NO: 15863

SEQ ID NO: 33482 - DNA, 2169 bp, Ashbya gossypii; identical to SEQ ID NO: 15864
  CDS (1)..(2169)

SEQ ID NO: 33483 - protein, 722 aa, Ashbya gossypii; identical to SEQ ID NO: 15865

SEQ ID NO: 33484 - DNA, 2076 bp, Neurospora crassa; identical to SEQ ID NO: 15866
  CDS (1)..(2076)

SEQ ID NO: 33485 - protein, 691 aa, Neurospora crassa; identical to SEQ ID NO: 15867

SEQ ID NO: 33486 - DNA, 2286 bp, Candida albicans; identical to SEQ ID NO: 15868
  CDS (1)..(2286)

SEQ ID NO: 33487 - protein, 761 aa, Candida albicans; identical to SEQ ID NO: 15869

SEQ ID NO: 33488 - DNA, 25 bp, Primer
atgaatttgttttggccatcggaaa

SEQ ID NO: 33489 - DNA, 24 bp, Primer
tcaaggttgtactgtgtgatctag

SEQ ID NO: 33490 - protein, 774 aa, consensus
  MISC_FEATURE (1)..(774): consensus for the disclosure of xaa see table XV
GXXXXXXGXDXSXXXXXXXXXXXXXXXXXXXXXXXXXXXXXXXXXXXXXXXXNXFXXXDXXXXXXXXXXXXXXXXDXXXXXXXXXXXXXXXXXXXXXXXXXXXXXXXXXXXWXEXXXSXXXRXXXXXXXXXXXXXXXXXXXXXXXXXXXXXXXXXXXXXXXXXXXLXXXXXXXXXXXXXXXXXXXXXXXXNYLXXXLXXXXXXXXXXXXXXXXXXXXXLXXXXXXXXXXXXXXXXXXXXXXXXXEXXXXXXXXXXXXXXXXXXXXXXXXXXXXXXXXXXXXXXLXXQXXFLXXXXXXXXXXXXXXXXYXLAXXXXXXXXXXXXXXFXXWXXLXXXYXXXXXXXXALLXXNXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXLLXXXXXXXGWXXLLXXRXXXFVMXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRLCEXWLDXLFXXXYEDLXXXXXXXXXXXXXXXXXXXXXXXXXEWEXXGLXXXRXXXXXXXXXXXXAXXXXXXXXXXRFXXXXXXXLLXXXXXXXXXXXXXXXXXXXXXXXXXXXXXXXXXXXXXXXXXXXXXXXXXXXXXXXXXXXXXXXXXRXY

SEQ ID NO: 33491 - protein, 71 aa, consensus; identical to SEQ ID NO: 18644
  MISC_FEATURE (1)..(71): consensus for the disclosure of xaa see table XV

SEQ ID NO: 33492 - protein, 27 aa, consensus
  MISC_FEATURE (1)..(27): consensus for the disclosure of xaa see table XV
XLXXXXXXXGWXXXXXXXXXXFXXXXX

SEQ ID NO: 33493 - protein, 55 aa, consensus; identical to SEQ ID NO: 18646
  MISC_FEATURE (1)..(55): consensus for the disclosure of xaa see table XV

SEQ ID NO: 33494 - DNA, 474 bp, Saccharomyces cerevisiae; identical to SEQ ID NO: 13281
  CDS (1)..(474)

SEQ ID NO: 33495 - protein, 157 aa, Saccharomyces cerevisiae; identical to SEQ ID NO: 13282

SEQ ID NO: 33496 - DNA, 25 bp, Primer
atgatagaggcgttggaaatagttc

SEQ ID NO: 33497 - DNA, 26 bp, Primer
ttatatcgatcctgcgatataataac

SEQ ID NO: 33498 - DNA, 1992 bp, Saccharomyces cerevisiae; identical to SEQ ID NO: 1301
  CDS (1)..(1992)

SEQ ID NO: 33499 - protein, 663 aa, Saccharomyces cerevisiae; identical to SEQ ID NO: 1302

SEQ ID NO: 33500 - DNA, 28 bp, Primer
atgaagttactttttaaaagatattcgt

SEQ ID NO: 33501 - DNA, 27 bp, Primer
ttatttttgttgcatttgcttagatct

SEQ ID NO: 33502 - DNA, 1425 bp, Escherichia coli K12; identical to SEQ ID NO: 28717
  CDS (1)..(1425)

SEQ ID NO: 33503 - protein, 474 aa, Escherichia coli K12; identical to SEQ ID NO: 28718

SEQ ID NO: 33504 - DNA, 1401 bp, Haemophilus influenzae; identical to SEQ ID NO: 28719
  CDS (1)..(1401)

SEQ ID NO: 33505 - protein, 466 aa, Haemophilus influenzae; identical to SEQ ID NO: 28720

SEQ ID NO: 33506 - DNA, 1350 bp, Bacillus subtilis; identical to SEQ ID NO: 28721
  CDS (1)..(1350)

SEQ ID NO: 33507 - protein, 449 aa, Bacillus subtilis; identical to SEQ ID NO: 28722

SEQ ID NO: 33508 - DNA, 1545 bp, Xylella fastidiosa; identical to SEQ ID NO: 28723
  CDS (1)..(1545)

SEQ ID NO: 33509 - protein, 514 aa, Xylella fastidiosa; identical to SEQ ID NO: 28724

SEQ ID NO: 33510 - DNA, 1251 bp, Nostoc sp. PCC 7120; identical to SEQ ID NO: 28725
  CDS (1)..(1251)

SEQ ID NO: 33511 - protein, 416 aa, Nostoc sp. PCC 7120; identical to SEQ ID NO: 28726

SEQ ID NO: 33512 - DNA, 1428 bp, Salmonella enterica subsp. enterica serovar Typhi; identical to SEQ ID NO: 28727
  CDS (1)..(1428)

SEQ ID NO: 33513 - protein, 475 aa, Salmonella enterica subsp. enterica serovar Typhi; identical to SEQ ID NO: 28728

SEQ ID NO: 33514 - DNA, 1290 bp, Nostoc sp. PCC 7120; identical to SEQ ID NO: 28729
  CDS (1)..(1290)

SEQ ID NO: 33515 - protein, 429 aa, Nostoc sp. PCC 7120; identical to SEQ ID NO: 28730

SEQ ID NO: 33516 - DNA, 1206 bp, Nostoc sp. PCC 7120; identical to SEQ ID NO: 28731
  CDS (1)..(1206)

SEQ ID NO: 33517 - protein, 401 aa, Nostoc sp. PCC 7120; identical to SEQ ID NO: 28732

SEQ ID NO: 33518 - DNA, 1545 bp, Agrobacterium tumefaciens; identical to SEQ ID NO: 28733
  CDS (1)..(1545)

SEQ ID NO: 33519 - protein, 514 aa, Agrobacterium tumefaciens; identical to SEQ ID NO: 28734

SEQ ID NO: 33520 - DNA, 1446 bp, Yersinia pestis; identical to SEQ ID NO: 28735
  CDS (1)..(1446)

SEQ ID NO: 33521 - protein, 481 aa, Yersinia pestis; identical to SEQ ID NO: 28736

SEQ ID NO: 33522 - DNA, 1572 bp, Agrobacterium tumefaciens; identical to SEQ ID NO: 28737
  CDS (1)..(1572)

SEQ ID NO: 33523 - protein, 523 aa, Agrobacterium tumefaciens; identical to SEQ ID NO: 28738

SEQ ID NO: 33524 - DNA, 1407 bp, Agrobacterium tumefaciens; identical to SEQ ID NO: 28739
  CDS (1)..(1407)

SEQ ID NO: 33525 - protein, 468 aa, Agrobacterium tumefaciens; identical to SEQ ID NO: 28740

SEQ ID NO: 33526 - DNA, 1425 bp, Brucella melitensis; identical to SEQ ID NO: 28741
  CDS (1)..(1425)

SEQ ID NO: 33527 - protein, 474 aa, Brucella melitensis; identical to SEQ ID NO: 28742

SEQ ID NO: 33528 - DNA, 1362 bp, Aquifex aeolicus; identical to SEQ ID NO: 28743
  CDS (1)..(1362)

SEQ ID NO: 33529 - protein, 453 aa, Aquifex aeolicus; identical to SEQ ID NO: 28744

SEQ ID NO: 33530 - DNA, 1500 bp, Neisseria meningitidis; identical to SEQ ID NO: 28745
  CDS (1)..(1500)

SEQ ID NO: 33531 - protein, 499 aa, Neisseria meningitidis; identical to SEQ ID NO: 28746

SEQ ID NO: 33532 - DNA, 1170 bp, Pseudomonas aeruginosa; identical to SEQ ID NO: 28747
  CDS (1)..(1170)

SEQ ID NO: 33533 - protein, 389 aa, Pseudomonas aeruginosa; identical to SEQ ID NO: 28748

SEQ ID NO: 33534 - DNA, 1407 bp, Sinorhizobium meliloti; identical to SEQ ID NO: 28749
  CDS (1)..(1407)

SEQ ID NO: 33535 - protein, 468 aa, Sinorhizobium meliloti; identical to SEQ ID NO: 28750

SEQ ID NO: 33536 - DNA, 1332 bp, Helicobacter pylori; identical to SEQ ID NO: 28751
  CDS (1)..(1332)

SEQ ID NO: 33537 - protein, 443 aa, Helicobacter pylori; identical to SEQ ID NO: 28752

SEQ ID NO: 33538 - DNA, 1419 bp, Caulobacter crescentus; identical to SEQ ID NO: 28753
  CDS (1)..(1419)

SEQ ID NO: 33539 - protein, 472 aa, Caulobacter crescentus; identical to SEQ ID NO: 28754

SEQ ID NO: 33540 - DNA, 1446 bp, Xylella fastidiosa; identical to SEQ ID NO: 28755
  CDS (1)..(1446)

SEQ ID NO: 33541 - protein, 481 aa, Xylella fastidiosa; identical to SEQ ID NO: 28756

SEQ ID NO: 33542 - DNA, 1458 bp, Treponema pallidum subsp. pallidum (syphilis spirochete); identical to SEQ ID NO: 28757
  CDS (1)..(1458)

SEQ ID NO: 33543 - protein, 485 aa, Treponema pallidum subsp. pallidum (syphilis spirochete); identical to SEQ ID NO: 28758

SEQ ID NO: 33544 - DNA, 1380 bp, Thermotoga maritima; identical to SEQ ID NO: 28759
  CDS (1)..(1380)

SEQ ID NO: 33545 - protein, 459 aa, Thermotoga maritima; identical to SEQ ID NO: 28760

SEQ ID NO: 33546 - DNA, 1371 bp, Vibrio cholerae; identical to SEQ ID NO: 28761
  CDS (1)..(1371)

SEQ ID NO: 33547 - protein, 456 aa, Vibrio cholerae; identical to SEQ ID NO: 28762

SEQ ID NO: 33548 - DNA, 1961 bp, Pseudomonas aeruginosa; identical to SEQ ID NO: 28763
  CDS (496)..(1920)

SEQ ID NO: 33549 - protein, 474 aa, Pseudomonas aeruginosa; identical to SEQ ID NO: 28764

SEQ ID NO: 33550 - DNA, 1593 bp, Caulobacter crescentus; identical to SEQ ID NO: 28765
  CDS (1)..(1593)

SEQ ID NO: 33551 - protein, 530 aa, Caulobacter crescentus; identical to SEQ ID NO: 28766

SEQ ID NO: 33552 - DNA, 1536 bp, Rickettsia conorii; identical to SEQ ID NO: 28767
  CDS (1)..(1536)

SEQ ID NO: 33553 - protein, 511 aa, Rickettsia conorii; identical to SEQ ID NO: 28768

SEQ ID NO: 33554 - DNA, 1452 bp, Borrelia burgdorferi (Lyme disease spirochete); identical to SEQ ID NO: 28769
  CDS (1)..(1452)

SEQ ID NO: 33555 - protein, 483 aa, Borrelia burgdorferi (Lyme disease spirochete); identical to SEQ ID NO: 28770

SEQ ID NO: 33556 - DNA, 1494 bp, Chlamydia trachomatis; identical to SEQ ID NO: 28771
  CDS (1)..(1494)

SEQ ID NO: 33557 - protein, 497 aa, Chlamydia trachomatis; identical to SEQ ID NO: 28772

SEQ ID NO: 33558 - DNA, 1431 bp, Helicobacter pylori; identical to SEQ ID NO: 28773
  CDS (1)..(1431)

SEQ ID NO: 33559 - protein, 476 aa, Helicobacter pylori; identical to SEQ ID NO: 28774

SEQ ID NO: 33560 - DNA, 1302 bp, Clostridium acetobutylicum; identical to SEQ ID NO: 28775
  CDS (1)..(1302)

SEQ ID NO: 33561 - protein, 433 aa, Clostridium acetobutylicum; identical to SEQ ID NO: 28776

SEQ ID NO: 33562 - DNA, 2009 bp, Brucella abortus; identical to SEQ ID NO: 28777
  CDS (275)..(1816)

SEQ ID NO: 33563 - protein, 513 aa, Brucella abortus; identical to SEQ ID NO: 28778

SEQ ID NO: 33564 - DNA, 1185 bp, Synechocystis sp; identical to SEQ ID NO: 28779
  CDS (1)..(1185)

SEQ ID NO: 33565 - protein, 394 aa, Synechocystis sp; identical to SEQ ID NO: 28780

SEQ ID NO: 33566 - DNA, 1251 bp, Synechocystis sp; identical to SEQ ID NO: 28781
  CDS (1)..(1251)

SEQ ID NO: 33567 - protein, 416 aa, Synechocystis sp; identical to SEQ ID NO: 28782

SEQ ID NO: 33568 - DNA, 1359 bp, Synechocystis sp; identical to SEQ ID NO: 28783
  CDS (1)..(1359)

SEQ ID NO: 33569 - protein, 452 aa, Synechocystis sp; identical to SEQ ID NO: 28784

SEQ ID NO: 33570 - DNA, 1740 bp, Lactococcus lactis; identical to SEQ ID NO: 28785
  CDS (230)..(1456)

SEQ ID NO: 33571 - protein, 408 aa, Lactococcus lactis; identical to SEQ ID NO: 28786

SEQ ID NO: 33572 - DNA, 1383 bp, Rhodobacter capsulatus; identical to SEQ ID NO: 28787
  CDS (1)..(1383)

SEQ ID NO: 33573 - protein, 460 aa, Rhodobacter capsulatus; identical to SEQ ID NO: 28788

SEQ ID NO: 33574 - DNA, 1392 bp, Haemophilus influenzae; identical to SEQ ID NO: 28789
  CDS (1)..(1392)

SEQ ID NO: 33575 - protein, 463 aa, Haemophilus influenzae; identical to SEQ ID NO: 28790

SEQ ID NO: 33576 - DNA, 1800 bp, Yersinia enterocolitica; identical to SEQ ID NO: 28791
  CDS (244)..(1680)

SEQ ID NO: 33577 - protein, 478 aa, Yersinia enterocolitica; identical to SEQ ID NO: 28792

SEQ ID NO: 33578 - DNA, 2027 bp, Azotobacter vinelandii; identical to SEQ ID NO: 28793
  CDS (483)..(1904)

SEQ ID NO: 33579 - protein, 473 aa, Azotobacter vinelandii; identical to SEQ ID NO: 28794

SEQ ID NO: 33580 - DNA, 1905 bp, Brucella abortus; identical to SEQ ID NO: 28795
  CDS (333)..(1835)

SEQ ID NO: 33581 - protein, 500 aa, Brucella abortus; identical to SEQ ID NO: 28796

SEQ ID NO: 33582 - DNA, 1466 bp, Campylobacter jejuni; identical to SEQ ID NO: 28797
  CDS (48)..(1466)

SEQ ID NO: 33583 - protein, 472 aa, Campylobacter jejuni; identical to SEQ ID NO: 28798

SEQ ID NO: 33584 - DNA, 1191 bp, Pseudomonas aeruginosa; identical to SEQ ID NO: 28799
  CDS (14)..(1183)

SEQ ID NO: 33585 - protein, 389 aa, Pseudomonas aeruginosa; identical to SEQ ID NO: 28800

SEQ ID NO: 33586 - DNA, 1488 bp, Burkholderia mallei ATCC 23344; identical to SEQ ID NO: 28801
  CDS (1)..(1488)

SEQ ID NO: 33587 - protein, 495 aa, Burkholderia mallei ATCC 23344; identical to SEQ ID NO: 28802

SEQ ID NO: 33588 - DNA, 1209 bp, Burkholderia pseudomallei K96243; identical to SEQ ID NO: 28803
  CDS (1)..(1209)

SEQ ID NO: 33589 - protein, 402 aa, Burkholderia pseudomallei K96243; identical to SEQ ID NO: 28804

SEQ ID NO: 33590 - DNA, 1458 bp, Burkholderia pseudomallei K96243; identical to SEQ ID NO: 28805
  CDS (1)..(1458)

SEQ ID NO: 33591 - protein, 485 aa, Burkholderia pseudomallei K96243; identical to SEQ ID NO: 28806

SEQ ID NO: 33592 - DNA, 1557 bp, Burkholderia pseudomallei K96243; identical to SEQ ID NO: 28807
  CDS (1)..(1557)

SEQ ID NO: 33593 - protein, 518 aa, Burkholderia pseudomallei K96243; identical to SEQ ID NO: 28808

SEQ ID NO: 33594 - DNA, 1419 bp, Burkholderia pseudomallei K96243; identical to SEQ ID NO: 28809
  CDS (1)..(1419)

SEQ ID NO: 33595 - protein, 472 aa, Burkholderia pseudomallei K96243; identical to SEQ ID NO: 28810

SEQ ID NO: 33596 - DNA, 1566 bp, Bacteroides fragilis; identical to SEQ ID NO: 28811
  CDS (19)..(1566)

SEQ ID NO: 33597 - protein, 515 aa, Bacteroides fragilis; identical to SEQ ID NO: 28812

SEQ ID NO: 33598 - DNA, 2358 bp, Bacillus licheniformis DSM 13; identical to SEQ ID NO: 28813
  CDS (501)..(1871)

SEQ ID NO: 33599 - protein, 456 aa, Bacillus licheniformis DSM 13; identical to SEQ ID NO: 28814

SEQ ID NO: 33600 - DNA, 1470 bp, Mannheimia succiniciproducens MBEL55E; identical to SEQ ID NO: 28815
  CDS (1)..(1470)

SEQ ID NO: 33601 - protein, 489 aa, Mannheimia succiniciproducens MBEL55E; identical to SEQ ID NO: 28816

SEQ ID NO: 33602 - DNA, 1425 bp, Borrelia garinii PBi; identical to SEQ ID NO: 28817
  CDS (1)..(1425)

SEQ ID NO: 33603 - protein, 474 aa, Borrelia garinii PBi; identical to SEQ ID NO: 28818

SEQ ID NO: 33604 - DNA, 1224 bp, Lactococcus lactis; identical to SEQ ID NO: 28819
  CDS (1)..(1224)

SEQ ID NO: 33605 - protein, 407 aa, Lactococcus lactis; identical to SEQ ID NO: 28820

SEQ ID NO: 33606 - DNA, 1557 bp, Rickettsia typhi; identical to SEQ ID NO: 28821
  CDS (1)..(1557)

SEQ ID NO: 33607 - protein, 518 aa, Rickettsia typhi; identical to SEQ ID NO: 28822

SEQ ID NO: 33608 - DNA, 1485 bp, Onchocerca volvulus endobacterium; identical to SEQ ID NO: 28823
  CDS (1)..(1485)

SEQ ID NO: 33609 - protein, 494 aa, Onchocerca volvulus endobacterium; identical to SEQ ID NO: 28824

SEQ ID NO: 33610 - DNA, 1455 bp, Desulfotalea psychrophila; identical to SEQ ID NO: 28825
  CDS (1)..(1455)

SEQ ID NO: 33611 - protein, 484 aa, Desulfotalea psychrophila; identical to SEQ ID NO: 28826

SEQ ID NO: 33612 - DNA, 1467 bp, Erwinia carotovora; identical to SEQ ID NO: 28827
  CDS (1)..(1467)

SEQ ID NO: 33613 - protein, 488 aa, Erwinia carotovora; identical to SEQ ID NO: 28828

SEQ ID NO: 33614 - DNA, 1371 bp, Erwinia carotovora; identical to SEQ ID NO: 28829
  CDS (1)..(1371)

SEQ ID NO: 33615 - protein, 456 aa, Erwinia carotovora; identical to SEQ ID NO: 28830

SEQ ID NO: 33616 - DNA, 1404 bp, Acinetobacter sp; identical to SEQ ID NO: 28831
  CDS (1)..(1404)

SEQ ID NO: 33617 - protein, 467 aa, Acinetobacter sp; identical to SEQ ID NO: 28832

SEQ ID NO: 33618 - DNA, 1518 bp, Bartonella quintana; identical to SEQ ID NO: 28833
  CDS (1)..(1518)

SEQ ID NO: 33619 - protein, 505 aa, Bartonella quintana; identical to SEQ ID NO: 28834

SEQ ID NO: 33620 - DNA, 1395 bp, Bartonella quintana; identical to SEQ ID NO: 28835
  CDS (1)..(1395)

SEQ ID NO: 33621 - protein, 464 aa, Bartonella quintana; identical to SEQ ID NO: 28836

SEQ ID NO: 33622 - DNA, 1512 bp, Bartonella quintana; identical to SEQ ID NO: 28837
  CDS (1)..(1512)

SEQ ID NO: 33623 - protein, 503 aa, Bartonella quintana; identical to SEQ ID NO: 28838

SEQ ID NO: 33624 - DNA, 1518 bp, Bartonella henselae; identical to SEQ ID NO: 28839
  CDS (1)..(1518)

SEQ ID NO: 33625 - protein, 505 aa, Bartonella henselae; identical to SEQ ID NO: 28840

SEQ ID NO: 33626 - DNA, 1392 bp, Bartonella henselae; identical to SEQ ID NO: 28841
  CDS (1)..(1392)

SEQ ID NO: 33627 - protein, 463 aa, Bartonella henselae; identical to SEQ ID NO: 28842

SEQ ID NO: 33628 - DNA, 1368 bp, Photobacterium profundum; identical to SEQ ID NO: 28843
  CDS (1)..(1368)

SEQ ID NO: 33629 - protein, 455 aa, Photobacterium profundum; identical to SEQ ID NO: 28844

SEQ ID NO: 33630 - DNA, 1455 bp, Parachlamydia sp; identical to SEQ ID NO: 28845
  CDS (1)..(1455)

SEQ ID NO: 33631 - protein, 484 aa, Parachlamydia sp; identical to SEQ ID NO: 28846

SEQ ID NO: 33632 - DNA, 1563 bp, Rhodopseudomonas palustris; identical to SEQ ID NO: 28847
  CDS (1)..(1563)

SEQ ID NO: 33633 - protein, 520 aa, Rhodopseudomonas palustris; identical to SEQ ID NO: 28848

SEQ ID NO: 33634 - DNA, 1506 bp, Rhodopseudomonas palustris; identical to SEQ ID NO: 28849
  CDS (1)..(1506)

SEQ ID NO: 33635 - protein, 501 aa, Rhodopseudomonas palustris; identical to SEQ ID NO: 28850

SEQ ID NO: 33636 - DNA, 1200 bp, Rhodopseudomonas palustris; identical to SEQ ID NO: 28851
  CDS (1)..(1200)

SEQ ID NO: 33637 - protein, 399 aa, Rhodopseudomonas palustris; identical to SEQ ID NO: 28852

SEQ ID NO: 33638 - DNA, 1392 bp, Rhodopseudomonas palustris; identical to SEQ ID NO: 28853
  CDS (1)..(1392)

SEQ ID NO: 33639 - protein, 463 aa, Rhodopseudomonas palustris; identical to SEQ ID NO: 28854

SEQ ID NO: 33640 - DNA, 1572 bp, Rhodopseudomonas palustris; identical to SEQ ID NO: 28855
  CDS (1)..(1572)

SEQ ID NO: 33641 - protein, 523 aa, Rhodopseudomonas palustris; identical to SEQ ID NO: 28856

SEQ ID NO: 33642 - DNA, 1401 bp, uncultured bacterium 580; identical to SEQ ID NO: 28857
  CDS (1)..(1401)

SEQ ID NO: 33643 - protein, 466 aa, uncultured bacterium 580; identical to SEQ ID NO: 28858

SEQ ID NO: 33644 - DNA, 1476 bp, uncultured bacterium 106; identical to SEQ ID NO: 28859
  CDS (1)..(1476)

SEQ ID NO: 33645 - protein, 491 aa, uncultured bacterium 106; identical to SEQ ID NO: 28860

SEQ ID NO: 33646 - DNA, 1143 bp, uncultured bacterium 105; identical to SEQ ID NO: 28861
  CDS (1)..(1143)

SEQ ID NO: 33647 - protein, 380 aa, uncultured bacterium 105; identical to SEQ ID NO: 28862

SEQ ID NO: 33648 - DNA, 1395 bp, Rhizobium sp; identical to SEQ ID NO: 28863
  CDS (1)..(1395)

SEQ ID NO: 33649 - protein, 464 aa, Rhizobium sp; identical to SEQ ID NO: 28864

SEQ ID NO: 33650 - DNA, 1449 bp, Desulfovibrio vulgaris; identical to SEQ ID NO: 28865
  CDS (1)..(1449)

SEQ ID NO: 33651 - protein, 482 aa, Desulfovibrio vulgaris; identical to SEQ ID NO: 28866

SEQ ID NO: 33652 - DNA, 1167 bp, Leptospira interrogans; identical to SEQ ID NO: 28867
  CDS (1)..(1167)

SEQ ID NO: 33653 - protein, 388 aa, Leptospira interrogans; identical to SEQ ID NO: 28868

SEQ ID NO: 33654 - DNA, 1494 bp, Wolbachia pipientis wMel; identical to SEQ ID NO: 28869
  CDS (1)..(1494)

SEQ ID NO: 33655 - protein, 497 aa, Wolbachia pipientis wMel; identical to SEQ ID NO: 28870

SEQ ID NO: 33656 - DNA, 1482 bp, Treponema denticola; identical to SEQ ID NO: 28871
  CDS (1)..(1482)

SEQ ID NO: 33657 - protein, 493 aa, Treponema denticola; identical to SEQ ID NO: 28872

SEQ ID NO: 33658 - DNA, 1395 bp, Geobacter sulfurreducens; identical to SEQ ID NO: 28873
  CDS (1)..(1395)

SEQ ID NO: 33659 - protein, 464 aa, Geobacter sulfurreducens; identical to SEQ ID NO: 28874

SEQ ID NO: 33660 - DNA, 1416 bp, Geobacter sulfurreducens; identical to SEQ ID NO: 28875
  CDS (1)..(1416)

SEQ ID NO: 33661 - protein, 471 aa, Geobacter sulfurreducens; identical to SEQ ID NO: 28876

SEQ ID NO: 33662 - DNA, 1221 bp, Lactobacillus johnsonii; identical to SEQ ID NO: 28877
  CDS (1)..(1221)

SEQ ID NO: 33663 - protein, 406 aa, Lactobacillus johnsonii; identical to SEQ ID NO: 28878

SEQ ID NO: 33664 - DNA, 1425 bp, Wolinella succinogenes; identical to SEQ ID NO: 28879
  CDS (1)..(1425)

SEQ ID NO: 33665 - protein, 474 aa, Wolinella succinogenes; identical to SEQ ID NO: 28880

SEQ ID NO: 33666 - DNA, 1368 bp, Vibrio vulnificus; identical to SEQ ID NO: 28881
  CDS (1)..(1368)

SEQ ID NO: 33667 - protein, 455 aa, Vibrio vulnificus; identical to SEQ ID NO: 28882

SEQ ID NO: 33668 - DNA, 1497 bp, Porphyromonas gingivalis; identical to SEQ ID NO: 28883
  CDS (1)..(1497)

SEQ ID NO: 33669 - protein, 498 aa, Porphyromonas gingivalis; identical to SEQ ID NO: 28884

SEQ ID NO: 33670 - DNA, 1320 bp, Gloeobacter violaceus; identical to SEQ ID NO: 28885
  CDS (1)..(1320)

SEQ ID NO: 33671 - protein, 439 aa, Gloeobacter violaceus; identical to SEQ ID NO: 28886

SEQ ID NO: 33672 - DNA, 1467 bp, Chromobacterium violaceum; identical to SEQ ID NO: 28887
  CDS (1)..(1467)

SEQ ID NO: 33673 - protein, 488 aa, Chromobacterium violaceum; identical to SEQ ID NO: 28888

SEQ ID NO: 33674 - DNA, 1413 bp, Chromobacterium violaceum; identical to SEQ ID NO: 28889
  CDS (1)..(1413)

SEQ ID NO: 33675 - protein, 470 aa, Chromobacterium violaceum; identical to SEQ ID NO: 28890

SEQ ID NO: 33676 - DNA, 1158 bp, Prochlorococcus marinus; identical to SEQ ID NO: 28891
  CDS (1)..(1158)

SEQ ID NO: 33677 - protein, 385 aa, Prochlorococcus marinus; identical to SEQ ID NO: 28892

SEQ ID NO: 33678 - DNA, 1125 bp, Synechococcus sp; identical to SEQ ID NO: 28893
  CDS (1)..(1125)

SEQ ID NO: 33679 - protein, 374 aa, Synechococcus sp; identical to SEQ ID NO: 28894

SEQ ID NO: 33680 - DNA, 1299 bp, Synechococcus sp; identical to SEQ ID NO: 28895
  CDS (1)..(1299)

SEQ ID NO: 33681 - protein, 432 aa, Synechococcus sp; identical to SEQ ID NO: 28896

SEQ ID NO: 33682 - DNA, 1527 bp, Rhodopirellula baltica; identical to SEQ ID NO: 28897
  CDS (1)..(1527)

SEQ ID NO: 33683 - protein, 508 aa, Rhodopirellula baltica; identical to SEQ ID NO: 28898

SEQ ID NO: 33684 - DNA, 1530 bp, Rhodopirellula baltica; identical to SEQ ID NO: 28899
  CDS (1)..(1530)

SEQ ID NO: 33685 - protein, 509 aa, Rhodopirellula baltica; identical to SEQ ID NO: 28900

SEQ ID NO: 33686 - DNA, 1890 bp, Rhodopirellula baltica; identical to SEQ ID NO: 28901
  CDS (1)..(1890)

SEQ ID NO: 33687 - protein, 629 aa, Rhodopirellula baltica; identical to SEQ ID NO: 28902

SEQ ID NO: 33688 - DNA, 1188 bp, Prochlorococcus marinus; identical to SEQ ID NO: 28903
  CDS (1)..(1188)

SEQ ID NO: 33689 - protein, 395 aa, Prochlorococcus marinus; identical to SEQ ID NO: 28904

SEQ ID NO: 33690 - DNA, 1176 bp, Prochlorococcus marinus; identical to SEQ ID NO: 28905
  CDS (1)..(1176)

SEQ ID NO: 33691 - protein, 391 aa, Prochlorococcus marinus; identical to SEQ ID NO: 28906

SEQ ID NO: 33692 - DNA, 1434 bp, Helicobacter hepaticus; identical to SEQ ID NO: 28907
  CDS (1)..(1434)

SEQ ID NO: 33693 - protein, 477 aa, Helicobacter hepaticus; identical to SEQ ID NO: 28908

SEQ ID NO: 33694 - DNA, 1419 bp, Haemophilus ducreyi; identical to SEQ ID NO: 28909
  CDS (1)..(1419)

SEQ ID NO: 33695 - protein, 472 aa, Haemophilus ducreyi; identical to SEQ ID NO: 28910

SEQ ID NO: 33696 - DNA, 1386 bp, Candidatus Blochmannia floridanus; identical to SEQ ID NO: 28911
  CDS (1)..(1386)

SEQ ID NO: 33697 - protein, 461 aa, Candidatus Blochmannia floridanus; identical to SEQ ID NO: 28912

SEQ ID NO: 33698 - DNA, 1137 bp, Bordetella pertussis; identical to SEQ ID NO: 28913
  CDS (1)..(1137)

SEQ ID NO: 33699 - protein, 378 aa, Bordetella pertussis; identical to SEQ ID NO: 28914

SEQ ID NO: 33700 - DNA, 1116 bp, Bordetella parapertussis; identical to SEQ ID NO: 28915
  CDS (1)..(1116)

SEQ ID NO: 33701 - protein, 371 aa, Bordetella parapertussis; identical to SEQ ID NO: 28916

SEQ ID NO: 33702 - DNA, 1488 bp, Bordetella parapertussis; identical to SEQ ID NO: 28917
  CDS (1)..(1488)

SEQ ID NO: 33703 - protein, 495 aa, Bordetella parapertussis; identical to SEQ ID NO: 28918

SEQ ID NO: 33704 - DNA, 1467 bp, Chlamydophila caviae; identical to SEQ ID NO: 28919
  CDS (1)..(1467)

SEQ ID NO: 33705 - protein, 488 aa, Chlamydophila caviae; identical to SEQ ID NO: 28920

SEQ ID NO: 33706 - DNA, 1419 bp, Streptomyces avermitilis; identical to SEQ ID NO: 28921
  CDS (1)..(1419)

SEQ ID NO: 33707 - protein, 472 aa, Streptomyces avermitilis; identical to SEQ ID NO: 28922

SEQ ID NO: 33708 - DNA, 1491 bp, Nitrosomonas europaea; identical to SEQ ID NO: 28923
  CDS (1)..(1491)

SEQ ID NO: 33709 - protein, 496 aa, Nitrosomonas europaea; identical to SEQ ID NO: 28924

SEQ ID NO: 33710 - DNA, 1323 bp, Enterococcus faecalis; identical to SEQ ID NO: 28925
  CDS (25)..(1323)

SEQ ID NO: 33711 - protein, 432 aa, Enterococcus faecalis; identical to SEQ ID NO: 28926

SEQ ID NO: 33712 - DNA, 1356 bp, Coxiella burnetii; identical to SEQ ID NO: 28927
  CDS (1)..(1356)

SEQ ID NO: 33713 - protein, 451 aa, Coxiella burnetii; identical to SEQ ID NO: 28928

SEQ ID NO: 33714 - DNA, 1368 bp, Enterobacter cloacae; identical to SEQ ID NO: 28929
  CDS (1)..(1368)

SEQ ID NO: 33715 - protein, 455 aa, Enterobacter cloacae; identical to SEQ ID NO: 28930

SEQ ID NO: 33716 - DNA, 1545 bp, Xylella fastidiosa; identical to SEQ ID NO: 28931
  CDS (1)..(1545)

SEQ ID NO: 33717 - protein, 514 aa, Xylella fastidiosa; identical to SEQ ID NO: 28932

SEQ ID NO: 33718 - DNA, 1377 bp, Xylella fastidiosa; identical to SEQ ID NO: 28933
  CDS (1)..(1377)

SEQ ID NO: 33719 - protein, 458 aa, Xylella fastidiosa; identical to SEQ ID NO: 28934

SEQ ID NO: 33720 - DNA, 1368 bp, Vibrio parahaemolyticus; identical to SEQ ID NO: 28935
  CDS (1)..(1368)

SEQ ID NO: 33721 - protein, 455 aa, Vibrio parahaemolyticus; identical to SEQ ID NO: 28936

SEQ ID NO: 33722 - DNA, 1161 bp, Pseudomonas syringae; identical to SEQ ID NO: 28937
  CDS (1)..(1161)

SEQ ID NO: 33723 - protein, 386 aa, Pseudomonas syringae; identical to SEQ ID NO: 28938

SEQ ID NO: 33724 - DNA, 1440 bp, Pseudomonas syringae; identical to SEQ ID NO: 28939
  CDS (1)..(1440)

SEQ ID NO: 33725 - protein, 479 aa, Pseudomonas syringae; identical to SEQ ID NO: 28940

SEQ ID NO: 33726 - DNA, 1479 bp, Pseudomonas putida; identical to SEQ ID NO: 28941
  CDS (1)..(1479)

SEQ ID NO: 33727 - protein, 492 aa, Pseudomonas putida; identical to SEQ ID NO: 28942

SEQ ID NO: 33728 - DNA, 1524 bp, Bradyrhizobium japonicum; identical to SEQ ID NO: 28943
  CDS (1)..(1524)

SEQ ID NO: 33729 - protein, 507 aa, Bradyrhizobium japonicum; identical to SEQ ID NO: 28944

SEQ ID NO: 33730 - DNA, 1272 bp, Bradyrhizobium japonicum; identical to SEQ ID NO: 28945
  CDS (1)..(1272)

SEQ ID NO: 33731 - protein, 423 aa, Bradyrhizobium japonicum; identical to SEQ ID NO: 28946

SEQ ID NO: 33732 - DNA, 1578 bp, Bradyrhizobium japonicum; identical to SEQ ID NO: 28947
  CDS (1)..(1578)

SEQ ID NO: 33733 - protein, 525 aa, Bradyrhizobium japonicum; identical to SEQ ID NO: 28948

SEQ ID NO: 33734 - DNA, 1587 bp, Bradyrhizobium japonicum; identical to SEQ ID NO: 28949
  CDS (1)..(1587)

SEQ ID NO: 33735 - protein, 528 aa, Bradyrhizobium japonicum; identical to SEQ ID NO: 28950

SEQ ID NO: 33736 - DNA, 1536 bp, Bacteroides thetaiotaomicron; identical to SEQ ID NO: 28951
  CDS (1)..(1536)

SEQ ID NO: 33737 - protein, 511 aa, Bacteroides thetaiotaomicron; identical to SEQ ID NO: 28952

SEQ ID NO: 33738 - DNA, 1410 bp, Escherichia coli O6; identical to SEQ ID NO: 28953
  CDS (1)..(1410)

SEQ ID NO: 33739 - protein, 469 aa, Escherichia coli O6; identical to SEQ ID NO: 28954

SEQ ID NO: 33740 - DNA, 1392 bp, Yersinia pestis; identical to SEQ ID NO: 28955
  CDS (1)..(1392)

SEQ ID NO: 33741 - protein, 463 aa, Yersinia pestis; identical to SEQ ID NO: 28956

SEQ ID NO: 33742 - DNA, 1374 bp, Wigglesworthia glossinidia brevipalpis; identical to SEQ ID NO: 28957
  CDS (1)..(1374)

SEQ ID NO: 33743 - protein, 457 aa, Wigglesworthia glossinidia brevipalpis; identical to SEQ ID NO: 28958

SEQ ID NO: 33744 - DNA, 1128 bp, Synechococcus elongatus; identical to SEQ ID NO: 28959
  CDS (1)..(1128)

SEQ ID NO: 33745 - protein, 375 aa, Synechococcus elongatus; identical to SEQ ID NO: 28960

SEQ ID NO: 33746 - DNA, 1170 bp, Synechococcus elongatus; identical to SEQ ID NO: 28961
  CDS (1)..(1170)

SEQ ID NO: 33747 - protein, 389 aa, Synechococcus elongatus; identical to SEQ ID NO: 28962

SEQ ID NO: 33748 - DNA, 1353 bp, Shewanella oneidensis; identical to SEQ ID NO: 28963
  CDS (1)..(1353)

SEQ ID NO: 33749 - protein, 450 aa, Shewanella oneidensis; identical to SEQ ID NO: 28964

SEQ ID NO: 33750 - DNA, 1518 bp, Chlorobium tepidum; identical to SEQ ID NO: 28965
  CDS (1)..(1518)

SEQ ID NO: 33751 - protein, 505 aa, Chlorobium tepidum; identical to SEQ ID NO: 28966

SEQ ID NO: 33752 - DNA, 1461 bp, Rhizobium etli; identical to SEQ ID NO: 28967
  CDS (1)..(1461)

SEQ ID NO: 33753 - protein, 486 aa, Rhizobium etli; identical to SEQ ID NO: 28968

SEQ ID NO: 33754 - DNA, 1368 bp, Pasteurella piscicida; identical to SEQ ID NO: 28969
  CDS (1)..(1368)

SEQ ID NO: 33755 - protein, 455 aa, Pasteurella piscicida; identical to SEQ ID NO: 28970

SEQ ID NO: 33756 - DNA, 1437 bp, Xanthomonas campestris; identical to SEQ ID NO: 28971
  CDS (1)..(1437)

SEQ ID NO: 33757 - protein, 478 aa, Xanthomonas campestris; identical to SEQ ID NO: 28972

SEQ ID NO: 33758 - DNA, 1437 bp, Xanthomonas axonopodis; identical to SEQ ID NO: 28973
  CDS (1)..(1437)

SEQ ID NO: 33759 - protein, 478 aa, Xanthomonas axonopodis; identical to SEQ ID NO: 28974

SEQ ID NO: 33760 - DNA, 1578 bp, Xanthomonas axonopodis; identical to SEQ ID NO: 28975
  CDS (1)..(1578)

SEQ ID NO: 33761 - protein, 525 aa, Xanthomonas axonopodis; identical to SEQ ID NO: 28976

SEQ ID NO: 33762 - DNA, 2077 bp, Klebsiella pneumoniae; identical to SEQ ID NO: 28977
  CDS (374)..(1807)

SEQ ID NO: 33763 - protein, 477 aa, Klebsiella pneumoniae; identical to SEQ ID NO: 28978

SEQ ID NO: 33764 - DNA, 1536 bp, Xanthomonas campestris; identical to SEQ ID NO: 28979
  CDS (1)..(1536)

SEQ ID NO: 33765 - protein, 511 aa, Xanthomonas campestris; identical to SEQ ID NO: 28980

SEQ ID NO: 33766 - DNA, 1473 bp, Ralstonia solanacearum; identical to SEQ ID NO: 28981
  CDS (1)..(1473)

SEQ ID NO: 33767 - protein, 490 aa, Ralstonia solanacearum; identical to SEQ ID NO: 28982

SEQ ID NO: 33768 - DNA, 1518 bp, Ralstonia solanacearum; identical to SEQ ID NO: 28983
  CDS (1)..(1518)

SEQ ID NO: 33769 - protein, 505 aa, Ralstonia solanacearum; identical to SEQ ID NO: 28984

SEQ ID NO: 33770 - DNA, 1368 bp, Salmonella typhimurium; identical to SEQ ID NO: 28985
  CDS (1)..(1368)

SEQ ID NO: 33771 - protein, 455 aa, Salmonella typhimurium; identical to SEQ ID NO: 28986

SEQ ID NO: 33772 - DNA, 1512 bp, Rhizobium meliloti; identical to SEQ ID NO: 28987
  CDS (1)..(1512)

SEQ ID NO: 33773 - protein, 503 aa, Rhizobium meliloti; identical to SEQ ID NO: 28988

SEQ ID NO: 33774 - DNA, 1398 bp, Rhizobium meliloti; identical to SEQ ID NO: 28989
  CDS (1)..(1398)

SEQ ID NO: 33775 - protein, 465 aa, Rhizobium meliloti; identical to SEQ ID NO: 28990

SEQ ID NO: 33776 - DNA, 1551 bp, Rhizobium loti; identical to SEQ ID NO: 28991
  CDS (1)..(1551)

SEQ ID NO: 33777 - protein, 516 aa, Rhizobium loti; identical to SEQ ID NO: 28992

SEQ ID NO: 33778 - DNA, 1542 bp, Rhizobium loti; identical to SEQ ID NO: 28993
  CDS (1)..(1542)

SEQ ID NO: 33779 - protein, 513 aa, Rhizobium loti; identical to SEQ ID NO: 28994

SEQ ID NO: 33780 - DNA, 1515 bp, Rhizobium loti; identical to SEQ ID NO: 28995
  CDS (1)..(1515)

SEQ ID NO: 33781 - protein, 504 aa, Rhizobium loti; identical to SEQ ID NO: 28996

SEQ ID NO: 33782 - DNA, 1287 bp, Rhizobium loti; identical to SEQ ID NO: 28997
  CDS (1)..(1287)

SEQ ID NO: 33783 - protein, 428 aa, Rhizobium loti; identical to SEQ ID NO: 28998

SEQ ID NO: 33784 - DNA, 1446 bp, Pseudomonas syringae; identical to SEQ ID NO: 28999
  CDS (1)..(1446)

SEQ ID NO: 33785 - protein, 481 aa, Pseudomonas syringae; identical to SEQ ID NO: 29000

SEQ ID NO: 33786 - DNA, 1380 bp, Pasteurella multocida; identical to SEQ ID NO: 29001
  CDS (1)..(1380)

SEQ ID NO: 33787 - protein, 459 aa, Pasteurella multocida; identical to SEQ ID NO: 29002

SEQ ID NO: 33788 - DNA, 1362 bp, Aeromonas hydrophila; identical to SEQ ID NO: 29003
  CDS (1)..(1362)

SEQ ID NO: 33789 - protein, 453 aa, Aeromonas hydrophila; identical to SEQ ID NO: 29004

SEQ ID NO: 33790 - DNA, 1503 bp, Myxococcus xanthus; identical to SEQ ID NO: 29005
  CDS (1)..(1503)

SEQ ID NO: 33791 - protein, 500 aa, Myxococcus xanthus; identical to SEQ ID NO: 29006

SEQ ID NO: 33792 - DNA, 1476 bp, Shigella sonnei; identical to SEQ ID NO: 29007
  CDS (1)..(1476)

SEQ ID NO: 33793 - protein, 491 aa, Shigella sonnei; identical to SEQ ID NO: 29008

SEQ ID NO: 33794 - DNA, 1512 bp, Bartonella henselae; identical to SEQ ID NO: 29009
  CDS (1)..(1512)

SEQ ID NO: 33795 - protein, 503 aa, Bartonella henselae; identical to SEQ ID NO: 29010

SEQ ID NO: 33796 - DNA, 1437 bp, Buchnera aphidicola; identical to SEQ ID NO: 29011
  CDS (1)..(1437)

SEQ ID NO: 33797 - protein, 478 aa, Buchnera aphidicola; identical to SEQ ID NO: 29012

SEQ ID NO: 33798 - DNA, 1515 bp, Rhizobium meliloti; identical to SEQ ID NO: 29013
  CDS (1)..(1515)

SEQ ID NO: 33799 - protein, 504 aa, Rhizobium meliloti; identical to SEQ ID NO: 29014

SEQ ID NO: 33800 - DNA, 1377 bp, Bacillus subtilis; identical to SEQ ID NO: 29015
  CDS (1)..(1377)

SEQ ID NO: 33801 - protein, 458 aa, Bacillus subtilis; identical to SEQ ID NO: 29016

SEQ ID NO: 33802 - DNA, 24 bp, Primer
atgaaaaaaaccacattagcactg

SEQ ID NO: 33803 - DNA, 25 bp, Primer
ttactgcattaacaggtagatggtg

SEQ ID NO: 33804 - protein, 406 aa, consensus; identical to SEQ ID NO: 29019
  MISC_FEATURE (1)..(406): consensus for the disclosure of xaa see table XV

SEQ ID NO: 33805 - protein, 66 aa, consensus; identical to SEQ ID NO: 29020
  MISC_FEATURE (1)..(66): consensus for the disclosure of xaa see table XV

SEQ ID NO: 33806 - protein, 37 aa, consensus; identical to SEQ ID NO: 29021
  MISC_FEATURE (1)..(37): consensus for the disclosure of xaa see table XV

SEQ ID NO: 33807 - protein, 30 aa, consensus; identical to SEQ ID NO: 29022
  MISC_FEATURE (1)..(30): consensus for the disclosure of xaa see table XV

SEQ ID NO: 33808 - protein, 34 aa, consensus; identical to SEQ ID NO: 29023
  MISC_FEATURE (1)..(34): consensus for the disclosure of xaa see table XV

SEQ ID NO: 33809 - protein, 68 aa, consensus; identical to SEQ ID NO: 29024
  MISC_FEATURE (1)..(68): consensus for the disclosure of xaa see table XV

SEQ ID NO: 33810 - DNA, 681 bp, Escherichia coli K12; identical to SEQ ID NO: 30948
  CDS (1)..(681)

SEQ ID NO: 33811 - protein, 226 aa, Escherichia coli K12; identical to SEQ ID NO: 30949

SEQ ID NO: 33812 - DNA, 738 bp, Pseudomonas sp; identical to SEQ ID NO: 30950
  CDS (1)..(738)

SEQ ID NO: 33813 - protein, 245 aa, Pseudomonas sp; identical to SEQ ID NO: 30951

SEQ ID NO: 33814 - DNA, 678 bp, Salmonella enterica subsp. enterica serovar Typhi; identical to SEQ ID NO: 30952
  CDS (1)..(678)

SEQ ID NO: 33815 - protein, 225 aa, Salmonella enterica subsp. enterica serovar Typhi; identical to SEQ ID NO: 30953

SEQ ID NO: 33816 - DNA, 675 bp, Sinorhizobium meliloti; identical to SEQ ID NO: 30954
  CDS (1)..(675)

SEQ ID NO: 33817 - protein, 224 aa, Sinorhizobium meliloti; identical to SEQ ID NO: 30955

SEQ ID NO: 33818 - DNA, 923 bp, Pseudomonas pseudoalcaligenes; identical to SEQ ID NO: 30956
  CDS (95)..(832)

SEQ ID NO: 33819 - protein, 245 aa, Pseudomonas pseudoalcaligenes; identical to SEQ ID NO: 30957

SEQ ID NO: 33820 - DNA, 681 bp, Bacillus licheniformis DSM 13; identical to SEQ ID NO: 30958
  CDS (1)..(681)

SEQ ID NO: 33821 - protein, 226 aa, Bacillus licheniformis DSM 13; identical to SEQ ID NO: 30959

SEQ ID NO: 33822 - DNA, 654 bp, Photobacterium profundum; identical to SEQ ID NO: 30960
  CDS (1)..(654)

SEQ ID NO: 33823 - protein, 217 aa, Photobacterium profundum; identical to SEQ ID NO: 30961

SEQ ID NO: 33824 - DNA, 732 bp, Rhodopseudomonas palustris; identical to SEQ ID NO: 30962
  CDS (1)..(732)

SEQ ID NO: 33825 - protein, 243 aa, Rhodopseudomonas palustris; identical to SEQ ID NO: 30963

SEQ ID NO: 33826 - DNA, 711 bp, Rhodopseudomonas palustris; identical to SEQ ID NO: 30964
  CDS (1)..(711)

SEQ ID NO: 33827 - protein, 236 aa, Rhodopseudomonas palustris; identical to SEQ ID NO: 30965

SEQ ID NO: 33828 - DNA, 666 bp, Rhodopseudomonas palustris; identical to SEQ ID NO: 30966
  CDS (1)..(666)

SEQ ID NO: 33829 - protein, 221 aa, Rhodopseudomonas palustris; identical to SEQ ID NO: 30967

SEQ ID NO: 33830 - DNA, 738 bp, Rhizobium sp; identical to SEQ ID NO: 30968
  CDS (1)..(738)

SEQ ID NO: 33831 - protein, 245 aa, Rhizobium sp; identical to SEQ ID NO: 30969

SEQ ID NO: 33832 - DNA, 720 bp, Rhizobium sp; identical to SEQ ID NO: 30970
  CDS (1)..(720)

SEQ ID NO: 33833 - protein, 239 aa, Rhizobium sp; identical to SEQ ID NO: 30971

SEQ ID NO: 33834 - DNA, 675 bp, Chromobacterium violaceum; identical to SEQ ID NO: 30972
  CDS (1)..(675)

SEQ ID NO: 33835 - protein, 224 aa, Chromobacterium violaceum; identical to SEQ ID NO: 30973

SEQ ID NO: 33836 - DNA, 663 bp, Bordetella parapertussis; identical to SEQ ID NO: 30974
  CDS (1)..(663)

SEQ ID NO: 33837 - protein, 220 aa, Bordetella parapertussis; identical to SEQ ID NO: 30975

SEQ ID NO: 33838 - DNA, 711 bp, Bordetella parapertussis; identical to SEQ ID NO: 30976
  CDS (1)..(711)

SEQ ID NO: 33839 - protein, 236 aa, Bordetella parapertussis; identical to SEQ ID NO: 30977

SEQ ID NO: 33840 - DNA, 741 bp, Bordetella parapertussis; identical to SEQ ID NO: 30978
  CDS (1)..(741)

SEQ ID NO: 33841 - protein, 246 aa, Bordetella parapertussis; identical to SEQ ID NO: 30979

SEQ ID NO: 33842 - DNA, 657 bp, Bordetella bronchiseptica; identical to SEQ ID NO: 30980
  CDS (1)..(657)

SEQ ID NO: 33843 - protein, 218 aa, Bordetella bronchiseptica; identical to SEQ ID NO: 30981

SEQ ID NO: 33844 - DNA, 945 bp, Wautersia oxalatica; identical to SEQ ID NO: 30982
  CDS (1)..(945)

SEQ ID NO: 33845 - protein, 314 aa, Wautersia oxalatica; identical to SEQ ID NO: 30983

SEQ ID NO: 33846 - DNA, 699 bp, Ralstonia sp; identical to SEQ ID NO: 30984
  CDS (1)..(699)

SEQ ID NO: 33847 - protein, 232 aa, Ralstonia sp; identical to SEQ ID NO: 30985

SEQ ID NO: 33848 - DNA, 675 bp, Vibrio parahaemolyticus; identical to SEQ ID NO: 30986
  CDS (1)..(675)

SEQ ID NO: 33849 - protein, 224 aa, Vibrio parahaemolyticus; identical to SEQ ID NO: 30987

SEQ ID NO: 33850 - DNA, 669 bp, Vibrio parahaemolyticus; identical to SEQ ID NO: 30988
  CDS (1)..(669)

SEQ ID NO: 33851 - protein, 222 aa, Vibrio parahaemolyticus; identical to SEQ ID NO: 30989

SEQ ID NO: 33852 - DNA, 729 bp, Pseudomonas syringae; identical to SEQ ID NO: 30990
  CDS (31)..(729)

SEQ ID NO: 33853 - protein, 232 aa, Pseudomonas syringae; identical to SEQ ID NO: 30991

SEQ ID NO: 33854 - DNA, 696 bp, Pseudomonas putida; identical to SEQ ID NO: 30992
  CDS (1)..(696)

SEQ ID NO: 33855 - protein, 231 aa, Pseudomonas putida; identical to SEQ ID NO: 30993

SEQ ID NO: 33856 - DNA, 717 bp, Pseudomonas putida; identical to SEQ ID NO: 30994
  CDS (1)..(717)

SEQ ID NO: 33857 - protein, 238 aa, Pseudomonas putida; identical to SEQ ID NO: 30995

SEQ ID NO: 33858 - DNA, 774 bp, Bradyrhizobium japonicum; identical to SEQ ID NO: 30996
  CDS (1)..(774)

SEQ ID NO: 33859 - protein, 257 aa, Bradyrhizobium japonicum; identical to SEQ ID NO: 30997

SEQ ID NO: 33860 - DNA, 693 bp, Bradyrhizobium japonicum; identical to SEQ ID NO: 30998
  CDS (1)..(693)

SEQ ID NO: 33861 - protein, 230 aa, Bradyrhizobium japonicum; identical to SEQ ID NO: 30999

SEQ ID NO: 33862 - DNA, 924 bp, Bradyrhizobium japonicum; identical to SEQ ID NO: 31000
  CDS (1)..(924)

SEQ ID NO: 33863 - protein, 307 aa, Bradyrhizobium japonicum; identical to SEQ ID NO: 31001

SEQ ID NO: 33864 - DNA, 720 bp, Bradyrhizobium japonicum; identical to SEQ ID NO: 31002
  CDS (1)..(720)

SEQ ID NO: 33865 - protein, 239 aa, Bradyrhizobium japonicum; identical to SEQ ID NO: 31003

SEQ ID NO: 33866 - DNA, 627 bp, Vibrio vulnificus; identical to SEQ ID NO: 31004
  CDS (1)..(627)

SEQ ID NO: 33867 - protein, 208 aa, Vibrio vulnificus; identical to SEQ ID NO: 31005

SEQ ID NO: 33868 - DNA, 672 bp, Shewanella oneidensis; identical to SEQ ID NO: 31006
  CDS (1)..(672)

SEQ ID NO: 33869 - protein, 223 aa, Shewanella oneidensis; identical to SEQ ID NO: 31007

SEQ ID NO: 33870 - DNA, 675 bp, Xanthomonas campestris; identical to SEQ ID NO: 31008
  CDS (1)..(675)

SEQ ID NO: 33871 - protein, 224 aa, Xanthomonas campestris; identical to SEQ ID NO: 31009

SEQ ID NO: 33872 - DNA, 675 bp, Xanthomonas axonopodis; identical to SEQ ID NO: 31010
  CDS (1)..(675)

SEQ ID NO: 33873 - protein, 224 aa, Xanthomonas axonopodis; identical to SEQ ID NO: 31011

SEQ ID NO: 33874 - DNA, 765 bp, Pseudomonas sp; identical to SEQ ID NO: 31012
  CDS (1)..(765)

SEQ ID NO: 33875 - protein, 254 aa, Pseudomonas sp; identical to SEQ ID NO: 31013

SEQ ID NO: 33876 - DNA, 762 bp, Rhizobium loti; identical to SEQ ID NO: 31014
  CDS (1)..(762)

SEQ ID NO: 33877 - protein, 253 aa, Rhizobium loti; identical to SEQ ID NO: 31015

SEQ ID NO: 33878 - DNA, 663 bp, Rhizobium loti; identical to SEQ ID NO: 31016
  CDS (1)..(663)

SEQ ID NO: 33879 - protein, 220 aa, Rhizobium loti; identical to SEQ ID NO: 31017

SEQ ID NO: 33880 - DNA, 744 bp, Rhizobium loti; identical to SEQ ID NO: 31018
  CDS (1)..(744)

SEQ ID NO: 33881 - protein, 247 aa, Rhizobium loti; identical to SEQ ID NO: 31019

SEQ ID NO: 33882 - DNA, 780 bp, Rhizobium loti; identical to SEQ ID NO: 31020
  CDS (1)..(780)

SEQ ID NO: 33883 - protein, 259 aa, Rhizobium loti; identical to SEQ ID NO: 31021

SEQ ID NO: 33884 - DNA, 693 bp, Streptomyces coelicolor; identical to SEQ ID NO: 31022
  CDS (1)..(693)

SEQ ID NO: 33885 - protein, 230 aa, Streptomyces coelicolor; identical to SEQ ID NO: 31023

SEQ ID NO: 33886 - DNA, 732 bp, Alcaligenes eutrophus; identical to SEQ ID NO: 31024
  CDS (1)..(732)

SEQ ID NO: 33887 - protein, 243 aa, Alcaligenes eutrophus; identical to SEQ ID NO: 31025

SEQ ID NO: 33888 - DNA, 741 bp, Rhodococcus sp; identical to SEQ ID NO: 31026
  CDS (1)..(741)

SEQ ID NO: 33889 - protein, 246 aa, Rhodococcus sp; identical to SEQ ID NO: 31027

SEQ ID NO: 33890 - DNA, 780 bp, Comamonas testosteroni; identical to SEQ ID NO: 31028
  CDS (25)..(744)

SEQ ID NO: 33891 - protein, 239 aa, Comamonas testosteroni; identical to SEQ ID NO: 31029

SEQ ID NO: 33892 - DNA, 666 bp, Photobacterium leiognathi; identical to SEQ ID NO: 31030
  CDS (1)..(666)

SEQ ID NO: 33893 - protein, 221 aa, Photobacterium leiognathi; identical to SEQ ID NO: 31031

SEQ ID NO: 33894 - DNA, 22 bp, Primer
atgatcaggagtcacaccatga

SEQ ID NO: 33895 - DNA, 21 bp, Primer
ttaattgccagccatcgcctg

SEQ ID NO: 33896 - protein, 178 aa, consensus; identical to SEQ ID NO: 31034
  MISC_FEATURE (1)..(178): consensus for the disclosure of xaa see table XV

SEQ ID NO: 33897 - protein, 81 aa, consensus; identical to SEQ ID NO: 31035
  MISC_FEATURE (1)..(81): consensus for the disclosure of xaa see table XV

SEQ ID NO: 33898 - protein, 12 aa, consensus
  MISC_FEATURE (1)..(12): consensus for the disclosure of xaa see table XV
XXXXXXXXXXXX

SEQ ID NO: 33899 - DNA, 1779 bp, Saccharomyces cerevisiae
  CDS (1)..(1779)
atgttatcactgtctgccaaaaatcacttcacagtgagtaattctataactcacgttattaagtcatatcatataaggactctcacttcaagcgcagaaaaaatgccacatatcactactcctttttctacctcagccagtagtacaaagttaaaagctttcaggaaagttagacccgtcctacagagacatagctcttcctggattgttgctcaaaatcatagacgttcattatctggtcaatcttcgctaaacgacctgcgtcatttgaatcgctttccacaccacacgttgaaaacttcgaataacgagttttatcccgccgaacaattgactttggaagacgtaaatgaaaatgtcttgaaggctaagtacgccgttagaggtgccatcccaatgagagctgaagaattgaaagctcaactggagaaggatcctcaatctctgccatttgacaggattatcaacgccaatattggtaatcctcagcaactacaacagaaacctctgacttactacagacaggtcttgtctctcttacaatacccagaactattaaaccaaaacgaacagcagctagttgattcgaaattgtttaaactagatgccattaaacgtgcaaagagtttaatggaagatatcggtggttctgttggtgcttactcttcttctcaaggtgtagaaggtataaggaaaagtgtcgctgaatttataacgaagagggacgaaggcgagatatcatacccagaggatattttcctaactgctggtgcatccgcagctgtcaattacttgttatcaattttctgtagagggccagaaacgggtgtcttgattccaattcctcaatatccattatataccgctactctagctttgaacaattctcaagctttaccatactatttagatgagaattcaggttggtcaactaatccagaagaaattgaaactgtcgtcaaagaggctatacagaacgaaatcaaacctacagttctagtggttatcaatccaggtaatcctacaggagctgtcctatcacctgagtctatagctcagatttttgaagtcgcagccaagtacggtacagtagtgatagctgacgaagtttatcaagaaaatatcttcccgggcaccaagttccattctatgaagaaaattttgagacatttacagagggaacatccaggtaaattcgataatgttcagctagcttctttgcattcgacttctaagggtgtttctggtgaatgtggtcaaaggggtggctacatggaactcactggattcagccatgagatgagacaagttatcttgaaactagcctcgatttcattgtgtcccgttgtcacaggtcaagctttggttgatttgatggttcgtccaccagtggaaggggaggaatcattcgagtcggaccaagcagaacgtaactccatccatgaaaagttaattacaagagcaatgacactgtatgagacatttaactctttagaaggcattgaatgtcaaaagcctcaaggtgccatgtatttattccctaagatagacttacctttcaaggcagttcaagaagctcgccacttagagttaactccggatgaattttattgtaagaagttgttagaatctactggcatttgcactgttcccggttctgggtttggtcaagaacctggtacttaccatttaagaacaacatttttggcacctggtctggaatggattaagaaatgggaaagtttccataaagaattttttgaccaataccgtgactga

SEQ ID NO: 33900 - protein, 592 aa, Saccharomyces cerevisiae
MLSLSAKNHFTVSNSITHVIKSYHIRTLTSSAEKMPHITTPFSTSASSTKLKAFRKVRPVLQRHSSSWIVAQNHRRSLSGQSSLNDLRHLNRFPHHTLKTSNNEFYPAEQLTLEDVNENVLKAKYAVRGAIPMRAEELKAQLEKDPQSLPFDRIINANIGNPQQLQQKPLTYYRQVLSLLQYPELLNQNEQQLVDSKLFKLDAIKRAKSLMEDIGGSVGAYSSSQGVEGIRKSVAEFITKRDEGEISYPEDIFLTAGASAAVNYLLSIFCRGPETGVLIPIPQYPLYTATLALNNSQALPYYLDENSGWSTNPEEIETVVKEAIQNEIKPTVLVVINPGNPTGAVLSPESIAQIFEVAAKYGTVVIADEVYQENIFPGTKFHSMKKILRHLQREHPGKFDNVQLASLHSTSKGVSGECGQRGGYMELTGFSHEMRQVILKLASISLCPVVTGQALVDLMVRPPVEGEESFESDQAERNSIHEKLITRAMTLYETFNSLEGIECQKPQGAMYLFPKIDLPFKAVQEARHLELTPDEFYCKKLLESTGICTVPGSGFGQEPGTYHLRTTFLAPGLEWIKKWESFHKEFFDQYRD

SEQ ID NO: 33901 - DNA, 1179 bp, Bacillus sp
  CDS (1)..(1179)
atgaaagaattattagccaatcgtgtaaaaactttaacaccatctacaactttagcaattacagcaaaagcaaaagaaatgaaagcgcaaggcattgacgtgattggtcttggagctggtgaaccagattttaacactccacaaaacatcatggatgcagccattgattcaatgcaacaagggtatacaaagtatacgccttctggaggtcttcctgctttaaaacaagcgattattgagaaatttaaacgagataatcaattggaatataaacctaatgaaatcattgttggtgttggagcgaagcatgttctttacacattattccaagtgattttaaatgaaggcgatgaagttattattccaattccatattgggtttcatatccagagcaagtaaaactggctggtggagtaccagtttatattgaagcaacaagtgaacaaaactacaaaattactgctgaacagctaaaaaatgctattacggataaaacaaaagcggttattatcaattcaccaagcaatcctacgggaatggtttatactcgtgaagaattggaagacattgcgaaaatagcattagaaaataatattctgattgtatcagatgaaatttacgaaaaactattatacaatggagcggagcacttctctatcgcacaaatttccgaagaagtgaaagctcaaacgattgttattaatggtgtttcaaaatcccattcaatgacgggatggagaatcggttatgctgcaggtaatgcagatattattaatgcgatgacagatttggcatctcattcaacttccaatccaacaactgcatctcaatatgcagcgattgaagcttacaatggaccacaagactctgtagaagaaatgagaaaagcctttgagtctcgattagaaactatttatccaaaattaagtgcaattcctggtttcaaagtagtgaaacctcaaggtgccttttatttattgccagatgtcagcgaggcagctcaaaaaactggatttgcttcagtagatgaatttgcaagtgcgttgctaacggaagcaaacgtagcggtgatcccaggttctggttttggagcgccatcgacaattcgaatcagttacgcaacatctttaaacttaattgaagaagccattgaacgaatcgatcgatttgttaaatga

SEQ ID NO: 33902 - protein, 392 aa, Bacillus sp
MKELLANRVKTLTPSTTLAITAKAKEMKAQGIDVIGLGAGEPDFNTPQNIMDAAIDSMQQGYTKYTPSGGLPALKQAIIEKFKRDNQLEYKPNEIIVGVGAKHVLYTLFQVILNEGDEVIIPIPYWVSYPEQVKLAGGVPVYIEATSEQNYKITAEQLKNAITDKTKAVIINSPSNPTGMVYTREELEDIAKIALENNILIVSDEIYEKLLYNGAEHFSIAQISEEVKAQTIVINGVSKSHSMTGWRIGYAAGNADIINAMTDLASHSTSNPTTASQYAAIEAYNGPQDSVEEMRKAFESRLETIYPKLSAIPGFKVVKPQGAFYLLPDVSEAAQKTGFASVDEFASALLTEANVAVIPGSGFGAPSTIRISYATSLNLIEEAIERIDRFVK

SEQ ID NO: 33903 - DNA, 1491 bp, Rattus norvegicus (Norway rat)
  CDS (1)..(1491)
atggcctcacgggtgaatgatcaaagccaggcttcaaggaatgggctgaagggaaaggtgctaactctggacactatgaacccatgtgtgcggagggtggagtatgcagttcgaggacccattgtgcagcgtgccttggagctggagcaggagctgcgtcagggtgtgaagaagccgtttactgaggtcatccgtgccaacattggggatgcacaagccatggggcagagacccatcaccttcttccgccaggtcctggccctctgtgtctaccccaatcttctgagcagtcctgacttcccagaggatgccaagagaagggcagaacgcatcttgcaggcctgcgggggccacagcctgggtgcctatagcattagctctggaatccagccgatccgggaggatgtggcgcaatacattgagagaagagacggaggcatccccgcagacccgaacaacatatttctatccacaggggccagcgatgccatcgtgacaatgctcaagctgctggtatctggcgagggccgtgcacgaacaggtgtactcattcccattcctcagtacccactgtactcagccgcgctggctgaactggacgccgtgcaagtggactactacctggacgaagagcgcgcctgggctctggacatcgcagagctgcggcgcgctctgtgccaggcacgtgaccgttgctgccctcgagtactgtgcgtcatcaaccccggcaaccccactgggcaggtgcagacccgtgagtgcatcgaggccgtaatccgctttgctttcaaagaaggactcttcttgatggctgatgaggtataccaggacaacgtgtatgccgagggctctcagttccattcattcaagaaggtgctcatggagatggggccaccgtattccacgcagcaggagcttgcttctttccactcagtctctaagggctacatgggcgagtgcgggtttcgtggtggctatgtggaggtggtaaacatggatgctgaggtgcagaaacagatggggaagctgatgagtgtgcggctgtgtccaccagtgccaggccaggccttgatggacatggtggtcagtccgccaacaccctccgagccgtccttcaagcagtttcaagcagagagacaggaggtgctggctgaactggcagccaaggctaagctcacggagcaggtcttcaatgaggctcccgggatccgctgcaacccagtgcagggcgccatgtattccttccctcaagtgcagctgcccttgaaagcggtgcagcgtgctcaggaactgggcctggcccctgacatgttcttctgcctgtgcctcctggaagagactggcatctgcgttgtgcccgggagtggctttgggcagcaggagggcacctatcatttccggatgaccattctgccccccatggagaaactgcggctgctgctggaaaaactcagtcacttccatgccaagttcacccatgagtactcctga

SEQ ID NO: 33904 - protein, 496 aa, Rattus norvegicus (Norway rat)
MASRVNDQSQASRNGLKGKVLTLDTMNPCVRRVEYAVRGPIVQRALELEQELRQGVKKPFTEVIRANIGDAQAMGQRPITFFRQVLALCVYPNLLSSPDFPEDAKRRAERILQACGGHSLGAYSISSGIQPIREDVAQYIERRDGGIPADPNNIFLSTGASDAIVTMLKLLVSGEGRARTGVLIPIPQYPLYSAALAELDAVQVDYYLDEERAWALDIAELRRALCQARDRCCPRVLCVINPGNPTGQVQTRECIEAVIRFAFKEGLFLMADEVYQDNVYAEGSQFHSFKKVLMEMGPPYSTQQELASFHSVSKGYMGECGFRGGYVEVVNMDAEVQKQMGKLMSVRLCPPVPGQALMDMVVSPPTPSEPSFKQFQAERQEVLAELAAKAKLTEQVFNEAPGIRCNPVQGAMYSFPQVQLPLKAVQRAQELGLAPDMFFCLCLLEETGICVVPGSGFGQQEGTYHFRMTILPPMEKLRLLLEKLSHFHAKFTHEYS

SEQ ID NO: 33905 - DNA, 1128 bp, Methanococcus jannaschii
  CDS (1)..(1128)
atgataagcagtagatgcaaaaatataaaaccatcagcaattagggagatatttaacttagctacatctgattgcataaatttaggaataggagagccagattttgacactccaaagcatatcattgaggctgcaaaaagggctttagatgaggggaaaactcactactctccaaacaatggaattccagagcttagagaggagataagcaataagttaaaggatgattacaacttagacgttgataaggacaatattattgttacctgtggagcttcagaggcgttaatgttatctattatgactttgattgacagaggggatgaggttttaattccaaatccatcttttgtgtcttatttttcactaacagagtttgctgagggtaagattaagaatatagatttagatgaaaactttaatattgatttagagaaagttaaagaatcaataactaaaaaaacaaagctaataatatttaactctccatcaaatcctactggaaaagtctatgataaggagaccataaaaggcttggcagagattgctgaggattataatctaattattgtttcagatgaagtctatgataagattatctacgataagaagcattactctccaatgcaatttactgatagatgcatattaattaacggtttctctaaaacctatgccatgactggatggaggattggatatttggctgtttctgatgaactaaataaggagttagatttaatcaacaatatgattaagattcatcagtatagctttgcatgtgctacaacctttgctcaatatggggcattagcagctttaagaggtagtcaaaagtgtgttgaggatatggttagagagtttaaaatgaggagagatttaatctataatggattgaaggatatctttaaagtcaataagccagatggggcattctatatattcccagatgtttctgagtatggagatggggtagaggtagctaagaaattgattgagaataaggttttatgtgttcctggagttgcatttggtgagaatggagctaactatattaggttcagctatgctacaaaatatgaagatatagagaaagctttagggattataaaagagatttttgagtga

SEQ ID NO: 33906 - protein, 375 aa, Methanococcus jannaschii
MISSRCKNIKPSAIREIFNLATSDCINLGIGEPDFDTPKHIIEAAKRALDEGKTHYSPNNGIPELREEISNKLKDDYNLDVDKDNIIVTCGASEALMLSIMTLIDRGDEVLIPNPSFVSYFSLTEFAEGKIKNIDLDENFNIDLEKVKESITKKTKLIIFNSPSNPTGKVYDKETIKGLAEIAEDYNLIIVSDEVYDKIIYDKKHYSPMQFTDRCILINGFSKTYAMTGWRIGYLAVSDELNKELDLINNMIKIHQYSFACATTFAQYGALAALRGSQKCVEDMVREFKMRRDLIYNGLKDIFKVNKPDGAFYIFPDVSEYGDGVEVAKKLIENKVLCVPGVAFGENGANYIRFSYATKYEDIEKALGIIKEIFE

SEQ ID NO: 33907 - DNA, 1185 bp, Aquifex aeolicus
  CDS (1)..(1185)
atgagaaaaggacttgcaagtagggtaagtcacctaaaaccttcccccacgctgaccataaccgcaaaagcaaaagaattaagggctaaaggagtggacgttataggttttggagcgggagaacctgacttcgacacacccgacttcataaaggaagcctgtataagggctttaagggaaggaaagaccaagtacgctccctccgcgggaataccagagctcagagaagctatagctgaaaaactactgaaagaaaacaaagttgagtacaaaccttcagagatagtcgtttccgcaggagcgaaaatggttctcttcctcatattcatggctatactggacgaaggagacgaggttttactacctagcccttactgggtaacttaccccgaacagataaggttcttcggaggggttcccgttgaggttcctctaaagaaagagaaaggatttcaattaagtctggaagatgtgaaagaaaaggttacggagagaacaaaagctatagtcataaactctccgaacaaccccactggtgctgtttacgaagaggaggaacttaagaaaatagcggagttttgcgtggagaggggcattttcataatttccgatgagtgctatgagtacttcgtttacggtgatgcaaaatttgttagccctgcctctttctcggatgaagtaaagaacataaccttcacggtaaacgccttttcgaagagctattccatgactggttggcgaataggttatgtagcgtgccccgaagagtacgcaaaagtgatagcgagtcttaacagccagagtgtttccaacgtcactacctttgcccagtatggagctcttgaggccttgaaaaatccaaagtctaaagattttgtaaacgaaatgagaaatgcttttgaaaggagaagggatacggctgtagaagagctttctaaaattccaggtatggatgtggtaaaacccgaaggtgccttttacatatttccggacttctccgcttacgctgagaaactgggtggtgatgtgaaactctcggagttccttctggaaaaggctaaggttgcggtggttcccggttcggccttcggagctcccggatttttgaggctttcttacgccctttccgaggaaagactcgttgagggtataaggagaataaagaaagcccttgaagagatctaa

SEQ ID NO: 33908 - protein, 394 aa, Aquifex aeolicus
MRKGLASRVSHLKPSPTLTITAKAKELRAKGVDVIGFGAGEPDFDTPDFIKEACIRALREGKTKYAPSAGIPELREAIAEKLLKENKVEYKPSEIVVSAGAKMVLFLIFMAILDEGDEVLLPSPYWVTYPEQIRFFGGVPVEVPLKKEKGFQLSLEDVKEKVTERTKAIVINSPNNPTGAVYEEEELKKIAEFCVERGIFIISDECYEYFVYGDAKFVSPASFSDEVKNITFTVNAFSKSYSMTGWRIGYVACPEEYAKVIASLNSQSVSNVTTFAQYGALEALKNPKSKDFVNEMRNAFERRRDTAVEELSKIPGMDVVKPEGAFYIFPDFSAYAEKLGGDVKLSEFLLEKAKVAVVPGSAFGAPGFLRLSYALSEERLVEGIRRIKKALEEI

SEQ ID NO: 33909 - DNA, 1197 bp, Pyrococcus abyssi
  CDS (1)..(1197)
atggttagagcctcaaaaagggctctttctatagagtatgcaattagagatgtcgttctaccagctagagagctcgaaaagaagggtataaaggtcataaggctaaacattggcgatccagttaagtttgacttccagccaccggagcatatgaaggaagcatactgcaaggccattaaggaaggtcacaactactatggagatagtgagggtttaatggaactaagggaggcgatagttgagagggaaaagaagaagaatggtgtaaacattacgccagatgacgttagggttacggctgcagttacagaggcccttcagatgatatttggagcattactagacccaggagatgaaatattaattccaggaccaagttacccaccgtacaccggcctagtcaagttctatggtggagtaccagtagaatacagaacgatcgaggaggaaggctggcaacctgatatagatgaccttaggaagaagataaccgagagaaccaaggcgatagcggtaataaatccgaataatccgaccggagcattgtacgacaagaagactctggaggagataatcaacattgcaggtgagcatgacattccagttctaagcgacgagatctatgacttaatgacctatgaagggaagcacatttcaccagcatcactaaccaaggacgtcccggtaatagtgatgaacggcctatcgaaggtttactttgccaccggctggagattaggatacatgtactttgtagaccctgagggtaagctaagcgaagttagggaagccattgacaagcttgcaaggataagactgtgtccaaacactccagcccaatttgccgcaatagcaggactgaggggcccaatggattaccttgaagagtatatgaagaagcttaaggagaggagggactacatatacaagagattgaacgaaattcctgggataagcacgactaaaccacagggagccttctacatattccccaggattgaggaaggcccatggaaggatgacaaagagttcgtccttgacgtactccacaacgcccacgtcctctttgtacacggctcgggattcggagaatacggaagaggacacttcagggcagtattcctaccaccagtagaggttcttgaggaggcgatgaacaggtttgagaagttcatgagagagaagttaagctcttga

SEQ ID NO: 33910 - protein, 398 aa, Pyrococcus abyssi
MVRASKRALSIEYAIRDVVLPARELEKKGIKVIRLNIGDPVKFDFQPPEHMKEAYCKAIKEGHNYYGDSEGLMELREAIVEREKKKNGVNITPDDVRVTAAVTEALQMIFGALLDPGDEILIPGPSYPPYTGLVKFYGGVPVEYRTIEEEGWQPDIDDLRKKITERTKAIAVINPNNPTGALYDKKTLEEIINIAGEHDIPVLSDEIYDLMTYEGKHISPASLTKDVPVIVMNGLSKVYFATGWRLGYMYFVDPEGKLSEVREAIDKLARIRLCPNTPAQFAAIAGLRGPMDYLEEYMKKLKERRDYIYKRLNEIPGISTTKPQGAFYIFPRIEEGPWKDDKEFVLDVLHNAHVLFVHGSGFGEYGRGHFRAVFLPPVEVLEEAMNRFEKFMREKLSS

SEQ ID NO: 33911 - DNA, 1167 bp, Nostoc sp. PCC 7120
  CDS (1)..(1167)
atgaaactggcagcaagagtaagtcaggtaacaccttcgataaccttagcgatcgcagcgaaagctaaggcgatgaaggcagagggtatagacgtttgtagttttagcgctggtgaacccgattttgataccccagcgcatatcaaagcagcagccgccaaggctttggatgaaggcaaaaccaagtatggtgcagcagctggagaaccaaagttaagggaagcgatcgcccgcaagttgcaaaaggataatcatctggattacaaaccagagaatgtcattgtcactaatggcggtaagcattcgctttacaacttgattgtggcgctgattgatccaggtgatgaggtgattatcccggctccctattggttgagttatcccgaaatggtgactctggtaggtgggaaatcggtaattgtccccacagatgcttccactggttataaaatcacccccgaacaactgcgaaaagctattacccccaaaaccaagctatttgtcctcaactccccatctaaccccacagggatggtgtacacaccagaggaaatcaaagctttggctcaggtagtagttgatgcagatatctatgttgtgtctgatgagatttacgaaaaaattctctacgatggcgcacagcatatcagcatcggttcgctagggaaggaaatttttaaccgcacgttgattagtaatggctttgcgaaagcttattctatgacggggtggcgtttgggctatctagccgggccagtggacattatcaaggctgctagttccattcaagggcatagtacatcaaatgtatgtacctttgctcaatatggagcgatcgctgctttggaagattcccaagattgtgtggaagaaatgcgccaagccttcgctaaacgtcgtcaggtaatgctagatcgactcaacgccatccccggcttgagtactgcaaaaccagacggtgcattttatctgtttccagatatcagcaaaactggcttgaaatccctcgaattttgtgatgctttaattgaagaacacaaggttgcagtaattccagggatagcttttggtgctgatgacaacatccgcctttcctacgctactgatttggcaacaattgagaaaggtttggatcggttagagaagtttgtccgttctcgcatttag

SEQ ID NO: 33912 - protein, 388 aa, Nostoc sp. PCC 7120
MKLAARVSQVTPSITLAIAAKAKAMKAEGIDVCSFSAGEPDFDTPAHIKAAAAKALDEGKTKYGAAAGEPKLREAIARKLQKDNHLDYKPENVIVTNGGKHSLYNLIVALIDPGDEVIIPAPYWLSYPEMVTLVGGKSVIVPTDASTGYKITPEQLRKAITPKTKLFVLNSPSNPTGMVYTPEEIKALAQVVVDADIYVVSDEIYEKILYDGAQHISIGSLGKEIFNRTLISNGFAKAYSMTGWRLGYLAGPVDIIKAASSIQGHSTSNVCTFAQYGAIAALEDSQDCVEEMRQAFAKRRQVMLDRLNAIPGLSTAKPDGAFYLFPDISKTGLKSLEFCDALIEEHKVAVIPGIAFGADDNIRLSYATDLATIEKGLDRLEKFVRSRI

SEQ ID NO: 33913 - DNA, 1215 bp, Salmonella enterica subsp. enterica serovar Typhi
  CDS (1)..(1215)
atgtcccccattgaaaaatccagcaaactcgaaaatgtctgttatgacattcgtggccccgttctgaaagaagcgaaacgccttgaggaagaaggtaataaagttcttaaactgaatatcggcaaccccgcccccttcggattcgaagcgccggacgaaattctggtcgatgtcattcgtaatttgccgacggcgcaaggatattgcgactcgaaagggctttattccgcccgtaaagcgattatgcagcattatcaggcccgtggaatgcgcgatgtaaccgtggaagatatctatatcggtaacggcgtttccgagctgatcgttcaggcgatgcaggcgttgcttaacagtggcgatgaaatgctggttcccgcgcccgattatccgttatggacagcggcggtatcgctctccagcggcaaggcggtacattatctttgcgatgaatcttccgactggttcccggaccttgacgatatccgcgccaaaatcaccccacgtacgcgtggtattgtcattattaatccaaacaaccctactggcgccgtctattctaaagaattgttgatggaaattgtcaacattgcgcgcgagcataatctcatcatcttcgccgatgaaatttatgacaagattctctatgacgatgccgagcatcactctatcgccgcactggcgcctgatctgctgaccatcacctttaatgggttgtctaaaacctatcgcgtcgccggcttccgccagggctggatggtgctgaacgggccgaaaaaacatgcgaaaggctatattgaagggctggagatgttagcctcaatgcgcctgtgcgccaacgtcccggcgcaacatgctattcagaccgcgctcggcggctatcaaagcattagtgaatttattctgccgggcggtcgactgtatgaacagcgtaaccgcgcctgggagttgattaacgatattcccggcgtttcctgcgtaaaaccgcgcggcgcgttgtacatgttccccaggatcgacgctaaacgttttaatattcacgacgaccagaagatggtgctggacttcctgctacaggaaaaggtgctgctggtgcaaggtaccgcctttaactggccgtggccagatcacttccgcattgtgacgctaccgcgtgaagatgacctggagatggccatcaaccgttttgggcgtttcctctcaggttaccatcaataa

SEQ ID NO: 33914 - protein, 404 aa, Salmonella enterica subsp. enterica serovar Typhi
MSPIEKSSKLENVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVNIAREHNLIIFADEIYDKILYDDAEHHSIAALAPDLLTITFNGLSKTYRVAGFRQGWMVLNGPKKHAKGYIEGLEMLASMRLCANVPAQHAIQTALGGYQSISEFILPGGRLYEQRNRAWELINDIPGVSCVKPRGALYMFPRIDAKRFNIHDDQKMVLDFLLQEKVLLVQGTAFNWPWPDHFRIVTLPREDDLEMAINRFGRFLSGYHQ

SEQ ID NO: 33915 - DNA, 1170 bp, Pyrococcus abyssi
  CDS (1)..(1170)
atggcgatgagcgataggcttgaccttgttaacccttctgaaattagaaagctcttcgatatagcggcgggaatgaaggatgtcatatccctggggattggggagccggactttgatacccctcagcacattaaggagtatgctaaggaagcccttgatatgggattaacgcattatggccctaacataggcctgccagaattgagggaggcgatagctgagaagttgaaaaagcaaaataacattgaagctgacccaaataaggagattatggtcctcgttggtgccaatcaagcgtttctcatgggtctttcagcatttctaaaggatggggaagaagttctaatcccaacccctgccttcgtcagctacgctccagccgtaatattagctggaggaaagccagttgaagttccaacgtacgaagagaacgagttcagattaaacgttgatgagctaaagaagtacgtcacggagaagactaaggccttaataataaactctccttgcaacccaacaggttccgttttgaagaagaaagacctagaagagatagcggattttgccgtggagcatgatttaatagtgataagcgatgaggtttatgaacactttatatatgacgatgttaagcactacagcatagcttctttggatggaatgtttgagaggacgataacagttaacggcttctcaaagacgtttgcaatgactgggtggagactcggctttgtcgcggctccctcatggataatagagaagatggtcaagttccagatgtacaatgcaacgtgcccagtaactttcatccaatatgcggcagctaaggctctcagggatgagaggagttggaaggcagttgaagagatgaggaaggaatatgacaggagaaggaagctcgtgtggaagaggcttaacgagatgggtctcccaactgtaaaacccaagggtgcattctacatattccccaggataaaggatacgggattaacgagcaaggaattcagcgaactaatgttaatggaagcgaaggttgccgtggttcctgggagtgcattcgggaaggcaggggagggctacgttaggataagctatgcaacagcctatgaaaagttggaggaagccatggacagaatggagaaggttttgagggagaagaagctcacctaa

SEQ ID NO: 33916 - protein, 389 aa, Pyrococcus abyssi
MAMSDRLDLVNPSEIRKLFDIAAGMKDVISLGIGEPDFDTPQHIKEYAKEALDMGLTHYGPNIGLPELREAIAEKLKKQNNIEADPNKEIMVLVGANQAFLMGLSAFLKDGEEVLIPTPAFVSYAPAVILAGGKPVEVPTYEENEFRLNVDELKKYVTEKTKALIINSPCNPTGSVLKKKDLEEIADFAVEHDLIVISDEVYEHFIYDDVKHYSIASLDGMFERTITVNGFSKTFAMTGWRLGFVAAPSWIIEKMVKFQMYNATCPVTFIQYAAAKALRDERSWKAVEEMRKEYDRRRKLVWKRLNEMGLPTVKPKGAFYIFPRIKDTGLTSKEFSELMLMEAKVAVVPGSAFGKAGEGYVRISYATAYEKLEEAMDRMEKVLREKKLT

SEQ ID NO: 33917 - DNA, 1212 bp, Pseudomonas aeruginosa
  CDS (1)..(1212)
atgcaggtcagcaaatcgaacaagctcgccaacgtctgctatgacattcgcgggccggtgctcaagcacgccaaacgcctagaggaagagggtcaccgcatcctcaagctgaatatcggcaacccggcgccgttcggtttcgaagctcccgaggaaattctccaggacgtcatccgcaacctgccgaccgcccagggctacagcgactccaagggcctgttcagcgcgcgcaaggcagtgatgcagtattaccagcagaagcaggtggaaggcgtcggcatcgaggacatctacctcggcaacggcgtgtcggaactgatcgtgatgtccatgcaggcgctgctgaacaacggcgacgaggtgctgatccccgctcccgactacccgctgtggaccgccgccgtcagcctcgccggcggcaagccggtgcactacctgtgcgacgagcaggccaactggtggccggacctggaagacatcaaggcgaagatcacgccgaataccagggcgatggtgatcatcaacccgaacaaccccaccggcgcggtgtattccagggaagtgctggaaggcatggtcgaactggcccgccagcacaacctggtgctgttctccgacgagatctacgacaagatcctctacgacggcgccgtccacgtctccaccgcctcgctggcgccggacgtgctctgcctgaccttcaacggcctgtccaaatcctaccgggtggccggcttccgctccggctgggtggcgatctccgggcccaagcagcgggcgcagagctatatcgaaggtctcgacatcctcgccaacatgcgcctgtgcgccaacgtcccggcgcagcacgcgatccagaccgccctgggcggctaccagagcatcaacgatctggtcctgccgccggggcgcctgctggagcagcgcaaccgcgcctgggaactgctcaacgacatccccggcgtcagctgcgtgaagccgatgggcgcgctgtacgccttcccgcggatcgatccgaaggtctgcccgatccacaacgacgaaaagttcgtcctcgacctgctgctctcggaaaaactgctgatcgtccagggcaccgccttcaactggccgtggcccgaccacttccgggtggtcaccctgccccgcgtcgacgacctggagcaggcgatcctgcgcatcggcagcttcctcaagggctaccagcagtaa

SEQ ID NO: 33918 - protein, 403 aa, Pseudomonas aeruginosa
MQVSKSNKLANVCYDIRGPVLKHAKRLEEEGHRILKLNIGNPAPFGFEAPEEILQDVIRNLPTAQGYSDSKGLFSARKAVMQYYQQKQVEGVGIEDIYLGNGVSELIVMSMQALLNNGDEVLIPAPDYPLWTAAVSLAGGKPVHYLCDEQANWWPDLEDIKAKITPNTRAMVIINPNNPTGAVYSREVLEGMVELARQHNLVLFSDEIYDKILYDGAVHVSTASLAPDVLCLTFNGLSKSYRVAGFRSGWVAISGPKQRAQSYIEGLDILANMRLCANVPAQHAIQTALGGYQSINDLVLPPGRLLEQRNRAWELLNDIPGVSCVKPMGALYAFPRIDPKVCPIHNDEKFVLDLLLSEKLLIVQGTAFNWPWPDHFRVVTLPRVDDLEQAILRIGSFLKGYQQ

SEQ ID NO: 33919 - DNA, 1829 bp, Arabidopsis thaliana (mouse-ear cress)
  CDS (134)..(1756)
aatttctgagcgtggaggacaaggcaaaattcggtgtgcaaggcactggatattgggacccttgtttcctcgtgagagaattttcaatcctagggcttaaagagcacgttcctagtataaagctgattcacagatgcggagattcttgattaaccaagctaaaggtctcgtcgaccattctcgtcgtcaacatcaccacaaaagtccaagctttctctctcctcaacctcgtccccttgcttcttctcctcctgctctgtctcgtttcttctcttctacttcggagatgtctgcttctgattccacttcttctcttcccgttactcttgactccatcaatcccaaggttctgaaatgtgagtatgctgttcgaggagaaattgtcaacattgctcagaagttacaagaagacttgaagactaataaggatgcttatccctttgatgagataatctattgcaacattgggaatcctcaatctcttggtcagctgcctataaagttcttccgtgaggttctcgcattgtgtgaccacgcaagtcttttggatgagtctgaaacccatggtttgttcagtaccgattcaattgaccgagcatggaggattttggaccatattcccggaagagcaactggggcttacagtcatagccagggtatcaagggtttacgtgatgtaattgcagctggaatcgaagcacgtgatggtttccctgctgatccaaatgatattttcttgactgatggtgcaagtccagcggttcacatgatgatgcaacttctcttgagctcagagaaagatggtattctttccccgattcctcagtatccattgtactcggcttcaattgcccttcatggtggatctttggttccgtactatcttgatgaagcaacaggatggggactggaaatatctgaccttaagaagcaactagaggaagctaggtccaagggcatctctgtaagggccttggttgtcataaaccccggtaacccaactgggcaggttcttgcggaagaaaaccagcgtgacattgttaatttctgcaagcaagagggtttggttcttttagctgatgaagtctaccaagaaaatgtttacgtccctgacaaaaagttccattctttcaagaaagtggctcggtctttgggctatggagaaaaagatatctcgttagtctcgttccaatcagtctccaaaggatattatggagaatgtggaaaaagaggaggttacatggaggttactggattcacttctgatgtaagagaacagatatacaaaatggcttctgtgaatctttgttctaacatctctggtcaaattcttgctagccttgtcatgagcccacccaagcctggtgatgactcatatgactcatacatggcagaaagagatggaattctctcatccatggctaaacgtgcaaagactttggaagacgctctcaacagtttagaaggtgttacatgtaacagagccgaaggagcaatgtatctcttcccgcgaattaaccttcctcaaaaggctatcgaagctgctgaggctgaaaaaactgcaccagatgcgttctactgcaaacgccttctcaatgctactggtgtagttgtagtccctggttctggctttggacaggttcctggaacatggcactttagatgcacaatacttccacaagaagacaagattccagcgatagtgaatcgtctgacagagttccacaagagcttcatggacgagttccgcaactaaaaggacctgaccatgaagatgaacttaaagacccttttgaagaaaagtgtgatcagtttgagttattaaaaaa

SEQ ID NO: 33920 - protein, 540 aa, Arabidopsis thaliana (mouse-ear cress)
MRRFLINQAKGLVDHSRRQHHHKSPSFLSPQPRPLASSPPALSRFFSSTSEMSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIAAGIEARDGFPADPNDIFLTDGASPAVHMMMQLLLSSEKDGILSPIPQYPLYSASIALHGGSLVPYYLDEATGWGLEISDLKKQLEEARSKGISVRALVVINPGNPTGQVLAEENQRDIVNFCKQEGLVLLADEVYQENVYVPDKKFHSFKKVARSLGYGEKDISLVSFQSVSKGYYGECGKRGGYMEVTGFTSDVREQIYKMASVNLCSNISGQILASLVMSPPKPGDDSYDSYMAERDGILSSMAKRAKTLEDALNSLEGVTCNRAEGAMYLFPRINLPQKAIEAAEAEKTAPDAFYCKRLLNATGVVVVPGSGFGQVPGTWHFRCTILPQEDKIPAIVNRLTEFHKSFMDEFRN

SEQ ID NO: 33921 - DNA, 1182 bp, Bacillus subtilis
  CDS (1)..(1182)
atgaaactggcaaaaagagtatccgcattaacaccatcaaccacactggcaatcacagcgaaagcgaaagaactgaaagccgcaggccatgatgtcatcggcttaggagcaggcgagcctgacttcaatacaccgcagcatattattgatgccgctgtgcgttcgatgaacgagggccatacgaaatacacgccttccggtggtttggctgaactgaaaaacagcattgcagagaaatttaaacgcgaccagaatattgaatacaaaccgtctcaaattattgtctgcactggtgccaaacatgctctgtatacccttttccaagtgattttggatgaagaagatgaagttattattccaacgccttactgggtaagctacccggagcaggtgaaactcgctggcggaaagcctgtttatgtagaagggcttgaggaaaatcacttcaaaatttcgcctgagcagctgaaaaatgcaattacggaaaaaacaaaagcaatcgttattaactctccaagcaacccgactggtgtcatgtatacggaagaagaactatctgcgctcggtgaagtgtgccttgaacatgatatcttgattgtgtcagatgaaatttatgaaaaacttacatacggcggaaagaaacatgtttccattgcacagctgtcagacagactgaaagagcaaacggtcattataaacggcgtatcgaagtcccacagcatgacaggctggagaatcggttatgcggcaggctctgaagacattattaaagcgatgacgaaccttgcaagccacagcacgtcaaacccgacatcaatcgcacaatacggagcgattgctgcttataacgggccttctgagccattggaagaaatgagagaagcatttgaacatagattaaatacgatctatgcaaagctcatagaaatcccagggttcagctgcgtgaagccggaaggtgctttttacttgttcccaaatgcaaaagaggcagctcaatcttgcggtttcaaagatgtagatgaatttgttaaagcgcttctcgaggaggaaaaagttgcgattgttccaggatccggatttggctctcctgagaatgtccgtctttcttatgcaacatcgttagatcttcttgaagaagccattgaaagaatcaagcgttttgtagaaaaacatagctaa

SEQ ID NO: 33922 - protein, 393 aa, Bacillus subtilis
MKLAKRVSALTPSTTLAITAKAKELKAAGHDVIGLGAGEPDFNTPQHIIDAAVRSMNEGHTKYTPSGGLAELKNSIAEKFKRDQNIEYKPSQIIVCTGAKHALYTLFQVILDEEDEVIIPTPYWVSYPEQVKLAGGKPVYVEGLEENHFKISPEQLKNAITEKTKAIVINSPSNPTGVMYTEEELSALGEVCLEHDILIVSDEIYEKLTYGGKKHVSIAQLSDRLKEQTVIINGVSKSHSMTGWRIGYAAGSEDIIKAMTNLASHSTSNPTSIAQYGAIAAYNGPSEPLEEMREAFEHRLNTIYAKLIEIPGFSCVKPEGAFYLFPNAKEAAQSCGFKDVDEFVKALLEEEKVAIVPGSGFGSPENVRLSYATSLDLLEEAIERIKRFVEKHS

SEQ ID NO: 33923 - DNA, 1278 bp, Xylella fastidiosa
  CDS (1)..(1278)
atgatgtctaatagcccgcaaacgccgcttgccacgcgccagcgattgtccgaagttcgctatgagatccgaggggagttggcgcgccgtgcgcgtgagcttgaggcggagggacgcaagcttatcaagctcaacatcggtaatccaggtgcgttcggtttccgggcgccagagcatctgcaacgtgccatcgccgatgatatgggacgtaccgatccttatacgcatcagcagggtttgccaatcgcacgtgaggcgattgctgctgcttatgtacgacgtcactatccagatgctgatgcagatcgggtctttgtggggaatggggtttctgagttaattgatttgtcgttgcgggcgttgcttaatccaggcgatgaggtgttggttccttcaccggattatccgctgtggtcggcggcgacgattctcaacgatggtcggcccgtgtattaccgttgtgcgccggagaacggtttccagcccgatgcagtcgagatcgaaacgctggtgtcttcacggacacgtgcgattgtgttgattaatccgaataatcccagtggtgccaattattcgcaggagttattggagcggattgtggcaatcgcagtgaaacatcatctgctgttgttggttgatgagatttacgatcagattttgtatgacggtgcggtgtttgttccagtggctcctttggcggggacgcatccatgtatcactttcagtgggctgagtaaggtgcatcgtgcgtgcggttggcgtgtgggttgggcgttgctgtccgggagtagcattcaaattgataatctgcgcaatgcgatggatttgctgggtgcgttgcgtttgtgtgcgaatgtcccagggcaatatgcgattgatgcggcggtcaatgggccagatacgatcactccgttatgttcgcctggtggtcctttgtacgagacgcgccgtgcggtgattgaggcctgcgtggtgagtgagcatttgtcgttggtggtgcctgctggggcgttatacgcgttcccatcggtcgtgggaccggcggcgcggcactttgatgattatgcttttgcgctggagttgatgaatgacgagggggtgctggtggtgcctggatcaagttttaatgtgccatatcgggatcacttccgcgtgacgttgcttcctgatgctgcgttgatacgtgaagtgttttctcgtattgaccgggccttgtcgcgccgtgctgaggtggctgagaaggtggtgccgctcaagtcgcgtagcgccgccgcttga

SEQ ID NO: 33924 - protein, 425 aa, Xylella fastidiosa
MMSNSPQTPLATRQRLSEVRYEIRGELARRARELEAEGRKLIKLNIGNPGAFGFRAPEHLQRAIADDMGRTDPYTHQQGLPIAREAIAAAYVRRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQIDNLRNAMDLLGALRLCANVPGQYAIDAAVNGPDTITPLCSPGGPLYETRRAVIEACVVSEHLSLVVPAGALYAFPSVVGPAARHFDDYAFALELMNDEGVLVVPGSSFNVPYRDHFRVTLLPDAALIREVFSRIDRALSRRAEVAEKVVPLKSRSAAA

SEQ ID NO: 33925 - DNA, 1206 bp, Pyrococcus horikoshii
  CDS (1)..(1206)
atgaccctaatgataagggcttctaaaagagctctttctatagaatacgcaattagggatgttgtactacccgctagagagctcgaaaaaaagggcataaaagtgatcagactaaacattggcgaccccgttaaattcgacttccagccaccagagcacatgaaagaggcatactgtagggcaattcaggaaggtcataactattatggagacagcgagggattaattgagcttagagaagcaatagtgaaaagggaaaaggagaagaatggggttgatataactcccgatgacgttagagttacggccgctgtaacagaggcactacaattgatattcggggcccttctggatccaggagatgagattctaatcccaggaccgagctatcctccatatacgggcttagtgaaattttatggcggaaagccagtagagtatagaacaattgaggaggaaggatggcaaccagatatagacgacctaaggaaaaagataagtgaaagaacgaaagcgatagccgttataaatcctaacaatccaacgggggccctatacgataagaaaactatagaagagattataaacgttgcaggagaacacgatttagtagttttaagcgacgaaatctacgatttgatgacttatgaaggaaaacacatttctcctggctccttgaccaaggatgttccagttatagtcatgaatggattatcaaaggtatactttgccacgggatggaggcttgggtatatgtactttgttgatcccgaagggaaattaagcgaagtcagggaagcaattgataaactagcaaggataagaatatgtcctaacacaccaggacaatttgcagcgatagcgggattaacaggctccatggactatcttaaagagtatatgaaaaaactaaaggagagaagagacttcatatataagagactcaatgaaattccaggaataagcacaacaaaaccccagggggcattctatatctttccaagaattgaagaaggcccatggaagagtgataaggaatttgtgctcgacgttctacataacgcccatgtcctattcgttcatggctcaggattcggcgaatatgggaagggacacttcagaattgtattcttacctccgattgaaatcctcgaagaagctatggacaggtttgagaaattcatgagggaaaggctttcttcatga

SEQ ID NO: 33926 - protein, 401 aa, Pyrococcus horikoshii
MTLMIRASKRALSIEYAIRDVVLPARELEKKGIKVIRLNIGDPVKFDFQPPEHMKEAYCRAIQEGHNYYGDSEGLIELREAIVKREKEKNGVDITPDDVRVTAAVTEALQLIFGALLDPGDEILIPGPSYPPYTGLVKFYGGKPVEYRTIEEEGWQPDIDDLRKKISERTKAIAVINPNNPTGALYDKKTIEEIINVAGEHDLVVLSDEIYDLMTYEGKHISPGSLTKDVPVIVMNGLSKVYFATGWRLGYMYFVDPEGKLSEVREAIDKLARIRICPNTPGQFAAIAGLTGSMDYLKEYMKKLKERRDFIYKRLNEIPGISTTKPQGAFYIFPRIEEGPWKSDKEFVLDVLHNAHVLFVHGSGFGEYGKGHFRIVFLPPIEILEEAMDRFEKFMRERLSS

SEQ ID NO: 33927 - DNA, 1230 bp, Aeropyrum pernix
  CDS (1)..(1230)
atgaactggctgttgccccagaaggatcctaccctggacatccaggagagggttgttgagatagagggtgagactgctttcgcatacctcgcagtggccaggaagctgatccaggagggtaggcgcgtaataagctttgggataggccagcccgacttcccgacgccccatcacattagagaggctgcgaagaaggctttagacgaggggttcacaggctataccgagacggccgggataccggagctgagggaggctatcgcatggtacctcaactccaggtacggggccgacgtgtctccggaggaggttatagccacgacgggggctaagactgcaatattcctgggtatggccctctacctgaggccgggagacgaggtcataataccggaccccagctactacgcctacgcacaggtggctaaactcttcggcgccaggcccgtttacgttccaatgaagtttgagccgggtctagggttcaggttcgatatcgaggggatagaaagggctgtgagcgagaagacgaggatgatagttgtcaacaacccccacaaccccacggggagtgttttcccgccggaccaggtggaggcgatacacgatatagcgaggaggaggggcctaataatactggccgacgagatatacgacaacttcctctacacggagaagcccttcaagagcaccctctccctcccagactggagggagaacctcgtttacgtcaacggtttcagcaagacattcagcatgacgggctggaggctcggctatgttgtgctcaggagggaggtaatcccgaaggccctagacctcgcagtcacaatatacagctgcccccccagcatagctcagaaggctggcgtcgccgcgctcagaggcgactggggtcctgtgagagagatggtagaagagttcaggagcagagcgaggatactttacgacatactatcccaggccgagggtatagagccctacctcccggagggcgccttctacatgttcccccgtgtggccggcctcctgaggaagacggggctcagcgtggagcagctcgcggagaagctgctatacagctacggcgtcctggtcctgcccggcaccagcttccctgagagtgttggcagggagcatgttaggctgagcttcgccacggccaccagcgacgtgaaggagggggcggagataatagtcagggcgtctagggagctgtccagcggctag

SEQ ID NO: 33928 - protein, 409 aa, Aeropyrum pernix
MNWLLPQKDPTLDIQERVVEIEGETAFAYLAVARKLIQEGRRVISFGIGQPDFPTPHHIREAAKKALDEGFTGYTETAGIPELREAIAWYLNSRYGADVSPEEVIATTGAKTAIFLGMALYLRPGDEVIIPDPSYYAYAQVAKLFGARPVYVPMKFEPGLGFRFDIEGIERAVSEKTRMIVVNNPHNPTGSVFPPDQVEAIHDIARRRGLIILADEIYDNFLYTEKPFKSTLSLPDWRENLVYVNGFSKTFSMTGWRLGYVVLRREVIPKALDLAVTIYSCPPSIAQKAGVAALRGDWGPVREMVEEFRSRARILYDILSQAEGIEPYLPEGAFYMFPRVAGLLRKTGLSVEQLAEKLLYSYGVLVLPGTSFPESVGREHVRLSFATATSDVKEGAEIIVRASRELSSG

SEQ ID NO: 33929 - DNA, 1122 bp, Aquifex aeolicus
  CDS (1)..(1122)
atggacaggcttgaaaaagtatcacccttcatagtaatggatatcctagctcaggcccagaagtacgaagacgtagtacacatggagataggagagcccgatttagaaccgtctcccaaggtaatggaagctctggaacgtgcggtgaaggaaaagacgttcttctacacccctgctctgggactctgggaactcagggaaaggatatcggagttttacaggaaaaagtacagcgttgaagtttctccagagagagtcatcgtaactaccggaacttcgggagcgtttctcgtagcctacgccgtaacactaaatgcgggagagaagataatcctcccagacccctcttacccctgttacaaaaactttgcctacctcttagacgctcagccggttttcgtaaacgttgacaaggaaacgaattacgaagtaaggaaagagatgatagaagacattgatgcgaaagcccttcacatttcctcgcctcaaaaccctacgggcacactctactcacctgaaaccctgaaggaacttgcggagtactgcgaagagaagggtatgtacttcatatccgacgagatttaccacggactcgtttacgaaggtagggagcacacagcacttgagttctctgacagggctattgtcataaacgggttttctaagtacttctgtatgccaggtttcaggatagggtggatgatagttccggaagaactcgtgagaaaggcggaaatagtaattcagaacgtatttatatctgccccgacgctcagtcagtacgccgcccttgaggcttttgattacgagtatttggagaaggtaagaaaaacctttgaagagaggaggaacttcctttatggggaactgaaaaaactcttcaagatagacgcgaaacctcagggagctttttacgtatgggcaaacataagtgattactccacagatagctacgaatttgctttaaaacttttaagggaggcgagggtggcggtaacgcccggggtggactttggaaaaaacaaaacgaaggagtatataaggtttgcttatacgagaaagatagaagaacttaaggagggcgttgaaaggataaagaagttcttagagaagcttagctga

SEQ ID NO: 33930 - protein, 373 aa, Aquifex aeolicus
MDRLEKVSPFIVMDILAQAQKYEDVVHMEIGEPDLEPSPKVMEALERAVKEKTFFYTPALGLWELRERISEFYRKKYSVEVSPERVIVTTGTSGAFLVAYAVTLNAGEKIILPDPSYPCYKNFAYLLDAQPVFVNVDKETNYEVRKEMIEDIDAKALHISSPQNPTGTLYSPETLKELAEYCEEKGMYFISDEIYHGLVYEGREHTALEFSDRAIVINGFSKYFCMPGFRIGWMIVPEELVRKAEIVIQNVFISAPTLSQYAALEAFDYEYLEKVRKTFEERRNFLYGELKKLFKIDAKPQGAFYVWANISDYSTDSYEFALKLLREARVAVTPGVDFGKNKTKEYIRFAYTRKIEELKEGVERIKKFLEKLS

SEQ ID NO: 33931 - DNA, 1170 bp, Pyrococcus horikoshii
  CDS (1)..(1170)
atggcgctaagtgacagattagaattagttagtgcttctgaaattagaaagctctttgatattgctgcaggaatgaaggatgttatctccctgggaataggggaacctgattttgatacgcctcaacatattaaggagtatgccaaggaagccctggataagggattgactcattatggtccaaatatagggcttttagagcttagggaagccatagctgaaaagttaaagaagcagaatggcatagaggctgatccaaagacagagataatggtcttattaggtgcgaaccaagctttcttaatgggcctctcggcttttcttaaggatggtgaagaggtattaataccaactccagcctttgtcagctacgcacctgccgttatattggctggaggaaagcccgttgaagtcccaacgtacgaagaggatgaattcaggctaaacgttgatgagcttaaaaagtatgttaccgacaagactagagctttaataataaactcaccgtgtaatccaacgggagcagtgttaactaagaaagatctagaagagatagcggattttgtcgttgaacatgatctaattgtaataagcgatgaagtttatgagcacttcatttacgatgatgctaggcactacagtatagcctccctggatggaatgtttgaaaggacaataaccgttaacggattctcaaagacgtttgcaatgacgggctggaggttgggatttgttgcagcgccttcttggataatagagaggatggtgaagtttcagatgtataacgctacttgtccagtgactttcatacaatacgctgctgctaaagcgttaaaggatgagagaagctggaaagctgttgaagagatgagaaaggagtacgacagaagaagaaagctcgtgtggaagaggcttaacgagatgggactcccaacggtaaagccgaagggtgcattttacatattcccgaggataagggatactgggctaacgagcaagaaattcagcgagctcatgcttaaagaagctagggttgcagtagttccaggtagtgcctttggaaaagccggtgagggatacgtaaggatcagctatgcaacagcttatgagaagcttgaagaggccatggatagaatggaaagggtgttaaaggagaggaagctagtttaa

SEQ ID NO: 33932 - protein, 389 aa, Pyrococcus horikoshii
MALSDRLELVSASEIRKLFDIAAGMKDVISLGIGEPDFDTPQHIKEYAKEALDKGLTHYGPNIGLLELREAIAEKLKKQNGIEADPKTEIMVLLGANQAFLMGLSAFLKDGEEVLIPTPAFVSYAPAVILAGGKPVEVPTYEEDEFRLNVDELKKYVTDKTRALIINSPCNPTGAVLTKKDLEEIADFVVEHDLIVISDEVYEHFIYDDARHYSIASLDGMFERTITVNGFSKTFAMTGWRLGFVAAPSWIIERMVKFQMYNATCPVTFIQYAAAKALKDERSWKAVEEMRKEYDRRRKLVWKRLNEMGLPTVKPKGAFYIFPRIRDTGLTSKKFSELMLKEARVAVVPGSAFGKAGEGYVRISYATAYEKLEEAMDRMERVLKERKLV

SEQ ID NO: 33933 - DNA, 1176 bp, Pyrococcus horikoshii
  CDS (1)..(1176)
atgagagaaaagaggaagtattttatcgctgagagggtcctccttatcaaaagatcgaaaataagagaattattcgaaagagcttctaaaatggaggatgtaatatctttaggaatcggagaaccagactttgatactcctaaaaacataaaagaagccgctaaaagagctctagatgaaggatggactcattacactccaaatgcaggaattccagagctaagagaagccgtcgttgaatactataagaaattctatggaattgatatagaggtagaaaatgtgataataacagctggagcgtatgagggtacttacttagcctttgaatcattattggagagaggagatgaagttataataccagatccagcttttgtttcatatgctgaagatgcgaaagtcgcagaagcaaagccagttaggattcctttaagagaggaaaacaatttcttacccgatcctaacgagttgttagagaagatatcaaagaatactaggatgatagtgataaactatccaaataatccgactggggcaacgctagataaggagttggcaaagacaattgcagacatagcggaagattacaacatttacatactaagtgatgaaccctatgaacatttcatatacgaggatgcaaagcattatccaatgataaaattcgcaccagagaatacaatacttgcaaattcattctcaaagacgtttgcaatgacgggctggaggttgggatttgtagttgctccttcccaggtaattaaagaaatgacaaagttacatgcatacgtaatagggaatgtagcttcgtttgttcaaattgctggaattgaggcattaaggagcgaagagagctggaaggccgttgaggaaatgaaaaaagaatacaatgaaaggaggaaaattgttgtaaaacggctcaagaatatgccaggaataaaggttaaagaaccaaagggggcattttacgtattcccaaatatatccggaactggaatgtctagtgaaaaattcagtgaatggttattggagaaggctagagtggtcgtgatcccaggaacagcgttcggtaggatgggtgaaggttacgttagaataagctacgcgactagtaaggagaaactcatagaagctatgaatagaattgaaaaagccttggagggtgaaaagtga

SEQ ID NO: 33934 - protein, 391 aa, Pyrococcus horikoshii
MREKRKYFIAERVLLIKRSKIRELFERASKMEDVISLGIGEPDFDTPKNIKEAAKRALDEGWTHYTPNAGIPELREAVVEYYKKFYGIDIEVENVIITAGAYEGTYLAFESLLERGDEVIIPDPAFVSYAEDAKVAEAKPVRIPLREENNFLPDPNELLEKISKNTRMIVINYPNNPTGATLDKELAKTIADIAEDYNIYILSDEPYEHFIYEDAKHYPMIKFAPENTILANSFSKTFAMTGWRLGFVVAPSQVIKEMTKLHAYVIGNVASFVQIAGIEALRSEESWKAVEEMKKEYNERRKIVVKRLKNMPGIKVKEPKGAFYVFPNISGTGMSSEKFSEWLLEKARVVVIPGTAFGRMGEGYVRISYATSKEKLIEAMNRIEKALEGEK

SEQ ID NO: 33935 - DNA, 1299 bp, Methanococcus jannaschii
  CDS (1)..(1299)
atgaggaatcctataatagatgtaggggctaaagaattgagttatgaaattagggagattgtagatgtagctaaaaaaatagaagagtttggaataaacataacatgggaaaacataggagacccagtggctaaaggggaaaaaattccagattggattaaagatattatagcagagattgttaaaaacgactgttcttatgcctactgtcctactaaaggtttattagaaacacgagaatttttagccgaacaagtaaataaaagaggaggagttcagataactgctgaagacatcatattctttaacggcttaggagatgccattgcaaagatttatggtttattgaagaggcaggttagagttataaacccatccccatcatactcaacccattcttctgcagaggcatcccatgctggctctcctccagtaacttacttcttagacccttacaactactggtatccagacattgatgatttggagaagaggattaaatacaacccagcagttagtggaattttggttataaatcctgacaacccaactggagcagtatatccaaaaaaaatcttaaatgagattgttgatttagccaatgaatatgatttatttattatttgtgatgaaatatactgtaacttagtatataatgggaaaaaacagcatttactatgtgaggttatagatgatgtctgcggtttatctttaaagggtatatcaaaagaacttccatggccaggggcaagatgtggatggattgaaatttacaatgccgataaggatgaagaatttaaaaaatacgttgagagtatttataaagccaaattgatagaggtttgctccactacattgccacaaatggctattccaagaattatggggcatagaaattacaaaaaatacttagaggagaggaataggttctttgaaaaaaggtcaaacacagcctacaaaaaactaaaagatttagatggtgttatagcaaataaagccaatggagctttctatatgtctgttgtatttgaagataactatttaaatggaaacaattcaataaaaatagagaatgagaaattgaaggaatttatagaacaccaaataaaagatgcatctatagataagaaatttgtttattatctcttagcatctactggaatctgtgtagttcctctaacctcattctgctctcaacttaacggatttagagttacattgttagagagagatgacgaaaagtttgaatggatatttgacacattagctgaaaaaatagatgaatttttaaagacctaa

SEQ ID NO: 33936 - protein, 432 aa, Methanococcus jannaschii
MRNPIIDVGAKELSYEIREIVDVAKKIEEFGINITWENIGDPVAKGEKIPDWIKDIIAEIVKNDCSYAYCPTKGLLETREFLAEQVNKRGGVQITAEDIIFFNGLGDAIAKIYGLLKRQVRVINPSPSYSTHSSAEASHAGSPPVTYFLDPYNYWYPDIDDLEKRIKYNPAVSGILVINPDNPTGAVYPKKILNEIVDLANEYDLFIICDEIYCNLVYNGKKQHLLCEVIDDVCGLSLKGISKELPWPGARCGWIEIYNADKDEEFKKYVESIYKAKLIEVCSTTLPQMAIPRIMGHRNYKKYLEERNRFFEKRSNTAYKKLKDLDGVIANKANGAFYMSVVFEDNYLNGNNSIKIENEKLKEFIEHQIKDASIDKKFVYYLLASTGICVVPLTSFCSQLNGFRVTLLERDDEKFEWIFDTLAEKIDEFLKT

SEQ ID NO: 33937 - DNA, 1173 bp, Archaeoglobus fulgidus
  CDS (1)..(1173)
atgaggaagacaggaggcttgcctttgtcccgtagacttgcgagaagggttgaggagctgaagccgtcgggaataaggagatttttcgacttagtggtgggaagggatgatgtgataagtctcggcgttggagagccagacttccccgtgccgtggaggataagggaggagatgatttactcgctggaaaagggatacacatcctacacatccaacctcggcctgccggagctgagggaggggattgcggagtattatacgaggttcggcgtcaaggctctgcccgagcaggtcatggttacctcaggcgttagcgagggcgttgacattgcaatcagagctctgatagagccgggcgatgctgctctcatccctgagccgtgctacgtgagctacaaaccactcgttgagatatgcggcggtgaagccgtgacgattcccaccgctccggagttcaggctcacctacgagatgctgatgcagtacagggatgcgaaggccaaaattctcgttttgaactaccccgcaaatcccacgggtgtgagctactcgaagaaggagcttgaggagattgctgacgctgtaaacgagctcgacctcatcgttctgtccgatgagatttacgctgagctcacctacacgggaaggcatgtttccatggccgcgctgaacggaatggaggacagagttgttattttcaacggcttctccaaagcgttcgcaatgaccggaatgagggtcggctacgtgattgccccacctgacatctttgcggggatgctgaaaattcaccagtactgcatgctctgcgctccaataacgggacagataggggcgattgaggctctgaggagccttgacgaagtggagaggatgagggcagagtacatgagaagaaggaattttgtggtcaaaagattgagcgagatttttgagataaagaagcctgaaggagcattttacgcttttccgaagatttcctcaaccggaatgtccagcgaggagtttgcagagaagctgctgctcgagaaaagcgttgcggttgtgccgggaaatgccttcggcgagtgcggggagggctacgtaagattggcttacgctgtgaagttcgagaagctgaaggaagcaatggacagaataaaggagtttgttgaggagcatggtgagggttaa

SEQ ID NO: 33938 - protein, 390 aa, Archaeoglobus fulgidus
MRKTGGLPLSRRLARRVEELKPSGIRRFFDLVVGRDDVISLGVGEPDFPVPWRIREEMIYSLEKGYTSYTSNLGLPELREGIAEYYTRFGVKALPEQVMVTSGVSEGVDIAIRALIEPGDAALIPEPCYVSYKPLVEICGGEAVTIPTAPEFRLTYEMLMQYRDAKAKILVLNYPANPTGVSYSKKELEEIADAVNELDLIVLSDEIYAELTYTGRHVSMAALNGMEDRVVIFNGFSKAFAMTGMRVGYVIAPPDIFAGMLKIHQYCMLCAPITGQIGAIEALRSLDEVERMRAEYMRRRNFVVKRLSEIFEIKKPEGAFYAFPKISSTGMSSEEFAEKLLLEKSVAVVPGNAFGECGEGYVRLAYAVKFEKLKEAMDRIKEFVEEHGEG

SEQ ID NO: 33939 - DNA, 1182 bp, Lactococcus lactis subsp. lactis
  CDS (1)..(1182)
atgaaaaaaaattctgattttgtattaaaaatggatgagtccgtcactcttgctgcggcaaatcgcgcaaaagcattaaaagcacaagggcgagatattattgacctgacacttggtcagccagactttccaacaccaaaaataattggtcaagcagctattgaagcaatcgataatggcaaggcgagcttttatacacaagctggtggacttccagaattaaaaaatgcagttcaacattattggacgcgtttttataattatgaaattcaaccaaatgaaatattgattacagctggagcaaagtttgccctttatgcttactttatggcaactgttgaccctgacgatgaggtaatcattcctgctccttactgggtttcttatgttgaccaagtgaaaatggctggaggaaatccggtaattgtagaagccaagcaagagaataattttaaagttacggttgagcaattagaagaagcaagaacaagtaaaagtaaaattttattactcaattcaccttctaatccaacaggaatgatttattctaaagaagaattaacagccattggagagtgggctcttgctcatgatttattaattttggcagatgatatttatcatcgtttagtttataatggagcggaatttacagcaatttcaagtctatctgatgaaattcggaaaagaacgacagtgattaatggtgtttctaaaacatttgcaatgactggttggcggattggactagctgtaggtgatccagaaattatttctgcgatgactaagattgcgagccaaacgacttctaatccaactgctgtcgctcaatacgcagcaatagaagcttttgaagaaagagataatagttttgagataatgcatgcagcatttgaagaacgtttaaatatcatttatggtcaactttctgaggttccaggatttgaacttgtaaaaccaaatggtgctttctatttattcccgaaagtgactaaggcaatggcgatgaaaggctatagtgatgtgactgattttacaactgctattcttgaagaagcaggtgtagccttggttacaggagcaggttttggttcgccagaaaatgtgcgcctgagctatgcaacaagtcttaaaaatttagaagttgcagtggcacgtttaaaagattggatgaatgaatga

SEQ ID NO: 33940 - protein, 393 aa, Lactococcus lactis subsp. lactis
MKKNSDFVLKMDESVTLAAANRAKALKAQGRDIIDLTLGQPDFPTPKIIGQAAIEAIDNGKASFYTQAGGLPELKNAVQHYWTRFYNYEIQPNEILITAGAKFALYAYFMATVDPDDEVIIPAPYWVSYVDQVKMAGGNPVIVEAKQENNFKVTVEQLEEARTSKSKILLLNSPSNPTGMIYSKEELTAIGEWALAHDLLILADDIYHRLVYNGAEFTAISSLSDEIRKRTTVINGVSKTFAMTGWRIGLAVGDPEIISAMTKIASQTTSNPTAVAQYAAIEAFEERDNSFEIMHAAFEERLNIIYGQLSEVPGFELVKPNGAFYLFPKVTKAMAMKGYSDVTDFTTAILEEAGVALVTGAGFGSPENVRLSYATSLKNLEVAVARLKDWMNE

SEQ ID NO: 33941 - DNA, 1188 bp, Clostridium acetobutylicum
  CDS (1)..(1188)
atgaatttctcaaatagagttcacaatatggatttttcaccaataagaaagttagttccactttcaaaggctgctgaagatagaggtataaaagtataccatttaaatataggtcagccagatgtaaaaactcctgatactttctttcagggcattacaaattataacgaaaaaatagttaaatattctgattctcaaggaatagatactttaatagatagttttataagatctttgtctgattcaaacatatatttcgaaaaggatgaaataatgattactcacggtggaagtgaggccatacaattcgcaataatggcaacctgtgatcctggtgatgagatattaagtcctgagccattttactctaactacaatagttttgcaaaagtttcgggtgcaaaaattgttccctttgaaacaaagatagaagataacttccatcttccaaaaaaggaagaaatcatagctaaaataactgataaaactaaatgtattatgctttcaaatccttgcaatccaactgggacagtctattcctatgaggagatgcgaatgcttggagaaatagcaaaggagtataacttattcatcatatctgatgaagtttacagacagttcatattcgataacgttccatatacttcaagtatacatttaactgatatacttgatagagttattctcgttgacagtatatcaaaacattatagtgcctgcggtgctagaattggtttagttgcttctaaaaataaggacttaatgcaccaaatacttaagttatgtcaggcaagactttgtgtttcaactattgaacaatatgctgctgcaaatttaataaatacaatgggaagctatataacagatgtaaaaatggcctataagaaaagacgagatataatgtattcaggtcttagtagtattcctggagttatctgcagtaaacctgaaggagcattttatatattagcaaagcttccagtagatgattcagatgcctttgcaaaatggcttcttacagacttttcttataacaacgaaactgtcatgttcgctcctgcttcaggtttttatgcaactttgggccttggaaaaagcgaagcaagattttcatattgtacaagtatagaggacatagagaattctatagttatactaaaaaaggcacttgaagaatataataaataa

SEQ ID NO: 33942 - protein, 395 aa, Clostridium acetobutylicum
MNFSNRVHNMDFSPIRKLVPLSKAAEDRGIKVYHLNIGQPDVKTPDTFFQGITNYNEKIVKYSDSQGIDTLIDSFIRSLSDSNIYFEKDEIMITHGGSEAIQFAIMATCDPGDEILSPEPFYSNYNSFAKVSGAKIVPFETKIEDNFHLPKKEEIIAKITDKTKCIMLSNPCNPTGTVYSYEEMRMLGEIAKEYNLFIISDEVYRQFIFDNVPYTSSIHLTDILDRVILVDSISKHYSACGARIGLVASKNKDLMHQILKLCQARLCVSTIEQYAAANLINTMGSYITDVKMAYKKRRDIMYSGLSSIPGVICSKPEGAFYILAKLPVDDSDAFAKWLLTDFSYNNETVMFAPASGFYATLGLGKSEARFSYCTSIEDIENSIVILKKALEEYNK

SEQ ID NO: 33943 - DNA, 1215 bp, Streptococcus pneumoniae
  CDS (1)..(1215)
atgaaagaatataacaagtctagtaagttagagcatgttgcttatgatatccgtggtcctgtattggaagaagccatgcggatgcgagcgaatggagaaaagattttacgtctgaatacaggaaatccagcagaatttggctttacagcgccagacgaggtcattcatgacttgattatgaatgcgcgtgatagtgaaggctattctgactccaaaggaattttctcagcccgtaaggccatcatgcagtattgccagctgaagaaattcccaaacgtagatattgatgatatttaccttggaaatggtgtcagtgagttgattgtcatgtccatgcaggggcttttggacaatggggatgaggtcttagtgccaatgccagactatcctctatggacggcggctgtcagcctagctggaggaaatgccgttcactatatctgtgatgaagctgttgaatggtacccagatattgacgatatcaagtcaaaaatcacttccaataccaaggcaatcgtccttatcaatccaaataacccaactggagccctttatcctaaggaactcttgctggagattattgagattgcccgtcaaaatgatttgattatctttgcggatgaaatctatgaccgcatggtaatggacggacatgtgcatacgcctgtggcgagcttggcaccagatgtcttctgtgtcagcatgaatggtctgtcaaaatcccaccgcatagcaggtttccgtgtgggttggatggtcttgtctggccctaagactcatgttaagggctatatcgaagggctcaatatgctgtccaatatgcgcctttgctctaacgttttggcccaacaagtcgtacaaacttccttggggggtcaccaatcagtcgatgaattgcttcttcctggtggacgaatctacgagcaaagaaatttcatctataatgccattcaagatattccaggtttgtctgccgttaaacccaaggcggggctctatatcttcccaaaaatcgaccgcaatatgtaccgtatcgatgatgatgagcagtttgtccttgatttcttgaagcaggaaaaggttctcttggttcatggtcgaggctttaactggcaggaaccagaccacttccgtatcgtttaccttcctcgtgttgatgagttagcccaaatccaagaaaagatgactcgtttcttgaaacagtatcgtagatag

SEQ ID NO: 33944 - protein, 404 aa, Streptococcus pneumoniae
MKEYNKSSKLEHVAYDIRGPVLEEAMRMRANGEKILRLNTGNPAEFGFTAPDEVIHDLIMNARDSEGYSDSKGIFSARKAIMQYCQLKKFPNVDIDDIYLGNGVSELIVMSMQGLLDNGDEVLVPMPDYPLWTAAVSLAGGNAVHYICDEAVEWYPDIDDIKSKITSNTKAIVLINPNNPTGALYPKELLLEIIEIARQNDLIIFADEIYDRMVMDGHVHTPVASLAPDVFCVSMNGLSKSHRIAGFRVGWMVLSGPKTHVKGYIEGLNMLSNMRLCSNVLAQQVVQTSLGGHQSVDELLLPGGRIYEQRNFIYNAIQDIPGLSAVKPKAGLYIFPKIDRNMYRIDDDEQFVLDFLKQEKVLLVHGRGFNWQEPDHFRIVYLPRVDELAQIQEKMTRFLKQYRR

SEQ ID NO: 33945 - DNA, 1125 bp, Methanobacterium thermoautotrophicum
  CDS (1)..(1125)
atgatcatgaggaaatttgcctcccgtgtaaaggatatacagctttctgagataaggaaaatatttgaggttgcagatgaggatacaataaaccttggcataggtgaaccagatttcagtgtccctgatcatgtcagggaggctgttaaggatgctgttgacgagggcctgacccattacacctccaacatggggatggaggagctgagggaagccatagcagataaacttaaaagcgaaaacagggttcatgctgaaccagaatcaataatagtgactgtgggtgccagtgaggccatattcatgtgcacccaggccctccttgacattggtgaccatgccctcatacctgaccctggttttctatcctatgatgcctgtgtccggctttccggggcagtgagcatacccgtgcccctcagtatggatgaagggttctcgatgagccctgaaagggttgaatcactcatcacccaggatacccgggtcataataatgaattccccatcgaacccaaccgggagcgtcatgggaaaggatgatgtgaaggggattgctgagatcgccgaggacaatgacctgataataatatcggatgagatctatgagaagataatctatgatggaaaacactacagtccggcgcagtttacagataacgccctcatagtcaatgggttttcaaagacctatgcaatgactggtctcaggatcggttacgttgccggctgtgaggatataattgaggagctcctgaaggtccaccagtacaacaccgcctgtgccccttcaatatcccagtacgcagcccttgcagccatcagggggcctcagaactgtgttaaggatatggtggatgagtttagaagaaggagggaccttatgttccgttccctcactgatatgggccttgaatgtgtcctgcccggcggggcgttctacatgttcccgtatgctggggactcagaagaattcacaaagctttcacttgaagctggagttgcagttgtcccgggatccgcctttgggaatgaagggaaaggttacatcaggatgtcctatgcaacatcctatgagcttatcgaggaggctatggaacgacttaaaactgtctgtggtgtttaa

SEQ ID NO: 33946 - protein, 374 aa, Methanobacterium thermoautotrophicum
MIMRKFASRVKDIQLSEIRKIFEVADEDTINLGIGEPDFSVPDHVREAVKDAVDEGLTHYTSNMGMEELREAIADKLKSENRVHAEPESIIVTVGASEAIFMCTQALLDIGDHALIPDPGFLSYDACVRLSGAVSIPVPLSMDEGFSMSPERVESLITQDTRVIIMNSPSNPTGSVMGKDDVKGIAEIAEDNDLIIISDEIYEKIIYDGKHYSPAQFTDNALIVNGFSKTYAMTGLRIGYVAGCEDIIEELLKVHQYNTACAPSISQYAALAAIRGPQNCVKDMVDEFRRRRDLMFRSLTDMGLECVLPGGAFYMFPYAGDSEEFTKLSLEAGVAVVPGSAFGNEGKGYIRMSYATSYELIEEAMERLKTVCGV

SEQ ID NO: 33947 - DNA, 1215 bp, Neisseria meningitidis
  CDS (1)..(1215)
atggataaatttcccaagtctgcaaagctcgatcacgtctgttacgacatacgcgggccggttcacaaaaaagcccttcagttggaagaggagggcaataaaatccttaaactcaatatcggcaaccctgcgccgttcggctttgaagcccctgatgaaatcttggtcgatgtcatccgcaacctgccgacttcgcaaggctattgcgattctaaagggctgtattccgcccgcaaagccattgttcactactatcagaccaaaggtttgcgcgatattacggttgatgatgtctatatcggcaacggcgtgtccgagctgattacgatgtctatgcaggcattgctcaacgacggcgacgaaatcctgattcccgcgcccgactatcccttgtggacggcggcggcaacgcttgcgggcggtacggtacgccattatctgtgcgacgaagaaaacggctggttccccaaccttgccgatatggaagccaaaatcacgcccaaaaccaaagccatcgtcgtcatcaatcccaataatccgacaggcgcggtgtacagcagggaaatcctgttggaaatcgccgaactggcgcgcaagcacggtttgattattttcgccgacgagatttacgacaaaatcctttatgacggcgcggttcaccaccacatcgccgcgcttgcccccgaccttttgacggtaacgttcaacggtttgtccaaagcctaccgtgtagccggattccgccaaggctggatggtgctcaacgggccgaaacatcatgcaaaaggttacatcgagggtttggatatgctctcgtctatgcgcctgtgtgccaatacgccgatgcagcacgcgattcagacggcattgggcggctatcagagcatcaacgaattcattttgcccggcggacggcttttggaacagcgcaacagggcgtgggaactggtcaaccagattcccggcgtatcctgcgtcaaaccgatgggcgcgatgtatatgttcccaaaaatcgataccgaaatgtaccgtatccgcgatgacatgaaattcgtttacgatttgctggtgcgcgaaaaagtcttgctggtgcagggaacggggtttaattggatcaagcccgaccatttccgcattgttacgctgccttacgtccatcagattgaagaggcgatgggcaggctggcaagattcctgcaaacctaccgccaataa

SEQ ID NO: 33948 - protein, 404 aa, Neisseria meningitidis
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLNDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 33949 - DNA, 1188 bp, Bacillus halodurans
  CDS (1)..(1188)
atggagttagctaagcgagtttctaccttgacaccgtcatcaacattggcgattacagcaaaggcaaaagagttaaaggagcaagggcacgatgtgatcggattaggagcaggggagccggattttaatactcctcaatacattattgatgctgcggtacgatccatggaagaagggcatacgaaatacaccccatctggaggcttaccaaagttaaaggaagctattattgaaaagtttaagcaagatcaagggcttacatatacagcgaaggaaattttcgtcggtacaggggcgaagcacgttctctatacactgttccaagcgttgttaaatgaaggtgatgaagtgattatcccatctccttactgggtgagctatccagagcaagtgaagcttgctggaggggaacctgtgttcgtggaagggaaagaatcgaacgactttaagttaacaccagctcagcttgagcctgttcttacagaccgaacgaaggcgattattattaattcaccgagtaatccaacaggctctttatatacgcaagaggagttagcagcgttaggggaagtgtgccttaagcataatgtccttatcatctcagatgaaatttatgaaaagcttgtatatgatggagcaaaacatacatcggttgcggaaatttccccacaattaaaggaaaacacagtcgtaattaacggtgtttccaaatctcactcgatgacaggctggcggatcgggtacgcggcaggaccggaggcgctcattcaagcgatgaccaatctcgcgagccacagtacatccaatccaacgaccagcgctcaatatggtgcgattgccgcttacactgaggatgatggatctgtcgagaagatgcgagtggcgttcgaggagcgacttcacacgatttacgataagcttgtggcgattcctggtgtatcgtgcgtaaaacctaagggagcattttatttattcccgaatgtagaggaagctgcagcattaacaggtcacgaaacggttgacgactttgtgaaagtcttgttagaggaagaaaaagtcgccctcgtacctggctcagggttcggtgcacctgacaatgttcgtttatcctatgcaacgtcactggagctattagaagcagcgatcgaccgaattttccgcttcgtcgaagcgaaacgcagcaaataa

SEQ ID NO: 33950 - protein, 395 aa, Bacillus halodurans
MELAKRVSTLTPSSTLAITAKAKELKEQGHDVIGLGAGEPDFNTPQYIIDAAVRSMEEGHTKYTPSGGLPKLKEAIIEKFKQDQGLTYTAKEIFVGTGAKHVLYTLFQALLNEGDEVIIPSPYWVSYPEQVKLAGGEPVFVEGKESNDFKLTPAQLEPVLTDRTKAIIINSPSNPTGSLYTQEELAALGEVCLKHNVLIISDEIYEKLVYDGAKHTSVAEISPQLKENTVVINGVSKSHSMTGWRIGYAAGPEALIQAMTNLASHSTSNPTTSAQYGAIAAYTEDDGSVEKMRVAFEERLHTIYDKLVAIPGVSCVKPKGAFYLFPNVEEAAALTGHETVDDFVKVLLEEEKVALVPGSGFGAPDNVRLSYATSLELLEAAIDRIFRFVEAKRSK

SEQ ID NO: 33951 - DNA, 1218 bp, Escherichia coli
  CDS (1)..(1218)
atgtcccccattgaaaaatccagcaaattagagaatgtctgttatgacatccgtggtccggtgctgaaagaagcaaaacgcctggaagaagaaggtaacaaggtactgaaactgaacatcggcaacccagccccattcggttttgacgcgccagatgaaatcctcgttgacgtgatacgcaacctgcctaccgctcaagggtattgcgattccaaagggctttactccgcgcgtaaagccatcatgcagcactaccaggctcgtggcatgcgtgatgttaccgtggaagatatttacatcggcaatggtgtatcggagcttatcgttcaggcaatgcaggcattgctgaacagcggggacgaaatgttggttcctgcaccagattacccactctggaccgcggcggtttcgctttccagcggtaaagcggtgcattatctttgcgatgaatcctctgactggttcccggacctcgatgatattcgcgctaaaattacgcctcgtacgcgtgggattgttattatcaacccaaataacccaaccggcgcggtatattccaaagagcttttaatggagattgtggagattgcacgtcagcataatctcattatcttcgccgatgaaatttatgacaaaattctctacgacgatgctgagcatcactcaattgcgccgctggcacctgacctgctgaccattacctttaacggactgtcgaaaacgtaccgcgttgcaggcttccgtcaggggtggatggtgttgaacgggccgaaaaaacacgccaaaggctacatcgaaggtctggaaatgctggcttcaatgcgcctgtgtgctaacgttcctgcgcaacacgccattcagaccgcgctgggtggttatcagagcatcagtgaatttattacccctggcggtcgtctttatgagcagcgtaaccgcgcgtgggaactgatcaacgatattccgggcgtttcctgcgtgaaacctcgtggtgcgctgtatatgttcccgaaaatcgacgccaaacgctttaacattcatgacgatcagaaaatggtgctggatttcctgttgcaggaaaaagttctgttggtgcaagggacggcattcaactggccgtggccggatcacttccgcattgtcacgctaccgcgtgtcgatgatatcgagctgtctttgagcaagttcgcgcgtttcctttctggttatcatcagctgtaa

SEQ ID NO: 33952 - protein, 405 aa, Escherichia coli
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPRGALYMFPKIDAKRFNIHDDQKMVLDFLLQEKVLLVQGTAFNWPWPDHFRIVTLPRVDDIELSLSKFARFLSGYHQL

SEQ ID NO: 33953 - DNA, 1290 bp, Mycobacterium tuberculosis
  CDS (1)..(1290)
atggacaacgatggcaccattgtggacgtgacaacccaccagctgccctggcacaccgccagccatcagcggcagcgcgccttcgctcagtcggccaagctgcaggacgtcctgtacgagatccgcggcccggtgcaccagcacgccgcgcggctcgaagccgaaggtcaccgcatcctcaaactcaacatcggcaacccggcgccgttcggcttcgaagcacccgacgtgatcatgcgcgatatcatccaggcgctgccctacgcgcaggggtactccgactcgcagggcatcctgtcggcccggcgtgcggtggtcacgcgctacgagctggtgcccggatttccccgattcgacgtggacgacgtctacctgggtaacggggtctccgagctgatcacgatgacgctgcaagccctgctggacaacggcgatcaggtgctgattccatcaccggactacccgctgtggacggcgtcgacctcgctggctggcggcactccggtccactacctgtgcgatgagacccaaggctggcagcccgatatcgccgacctggaatccaagatcaccgagcgcaccaaggcgctggtcgtgatcaaccccaacaacccaaccggcgcggtgtacagctgcgaaatcctcacccagatggtcgatctggcccgcaagcatcaactgctgctgttggcggacgaaatctacgacaaaatcctctacgacgacgccaagcacatcagcctggcatcgatcgccccggatatgttgtgcctgaccttcaatgggctgtcgaaggcctaccgcgtcgccggataccgggccggctggctggcgatcaccggacccaaggagcacgccagcagcttcatcgagggcatcggcctgctggccaatatgcggttgtgcccaaatgtcccggcccagcatgccattcaggttgcactgggcggccatcagagcatcgaggacctggtgctgcccggcggccggctgctcgagcagcgcgacatcgcctggaccaagctcaacgagatcccgggggtgtcgtgcgtcaaaccggcgggcgcgctgtatgcgtttccccggctagaccccgaggtctacgacatcgacgacgacgagcaactcgtgctcgatctgctgctgtcggagaagatcctggtcacccagggcaccgggttcaactggcccgcaccggatcatctgcgcctggtgacgctgccatggtcccgcgatctggcggccgccatcgagcggctgggtaacttcctggtcagttaccggcaatag

SEQ ID NO: 33954 - protein, 429 aa, Mycobacterium tuberculosis
MDNDGTIVDVTTHQLPWHTASHQRQRAFAQSAKLQDVLYEIRGPVHQHAARLEAEGHRILKLNIGNPAPFGFEAPDVIMRDIIQALPYAQGYSDSQGILSARRAVVTRYELVPGFPRFDVDDVYLGNGVSELITMTLQALLDNGDQVLIPSPDYPLWTASTSLAGGTPVHYLCDETQGWQPDIADLESKITERTKALVVINPNNPTGAVYSCEILTQMVDLARKHQLLLLADEIYDKILYDDAKHISLASIAPDMLCLTFNGLSKAYRVAGYRAGWLAITGPKEHASSFIEGIGLLANMRLCPNVPAQHAIQVALGGHQSIEDLVLPGGRLLEQRDIAWTKLNEIPGVSCVKPAGALYAFPRLDPEVYDIDDDEQLVLDLLLSEKILVTQGTGFNWPAPDHLRLVTLPWSRDLAAAIERLGNFLVSYRQ

SEQ ID NO: 33955 - DNA, 1215 bp, Vibrio cholerae
  CDS (1)..(1215)
atgcaaaatatcgggatgtcgtcaaaactcgataatgtctgctatgacattcgaggaccagtgcttaaacatgctaaacgcatggaagaagaagggcataaaatactgaagcttaacatcggtaaccctgccccgtttggtttcgacgccccagacgagatcctagtcgatgtgatccgtaacctacctacttcacaaggttactgtgactcgaaaggcatttattccgctcgtaaagcggtggtgcagtactaccagaaaaaaggtatccgcagtctggacgtcgaagatgtgtacatcggcaacggtgcatcagagcttatcgtgatggcgatgcaagccctgctcaacaatggcgatgaaatgctggtacctgcccctgattacccactgtggacagccgcggtagcactttctggcggcaaagccgtgcactacatctgtgatgaagaagccgattggtatcctgacctcgacgatattcgcagcaaaatcaccccgaaaacccgtggcattgtgctgatcaaccccaataacccaaccggtgcggtttacagtcgtgatttcttgctggaaatcatcgagattgctcgcaagcacaagctgatgattttcgccgatgagatttacgacaaagtgctgtacgacggcgcggtgcatacctcaatcgccaccttagcggatgatgtattagtcgtcaccttcaacggcttatccaaagcttaccgtgtttgtggtttccgtggtggctggatgttcctgactggccccaaacagcaagcacaaggctatattgcagggctcgatatgctggcctcgatgcgcttgtgtgccaacgtgccaatgcaacatgccattcaaaccgcactcggcggctatcaaagtatcaatgagctgattttgccgggcggccgactgctggaacagcgtgatcgcgcatgggagctgattaaccagatcccggggatttcttgcgtgaagccaaaaggcgcgatgtacctgttcccgaaaattgataccaaaatgtatccgatcaaagatgaccagaaaatggtgcttgatttcctagtgcaagaaaaagtgctgctagtacaaggcagcggctttaactggccaaaaccggatcacttccgcattgtgactctgcctcatgtggaagatctggaaatcgccatcagtcgctttgaacgctttatcacgacttacagccaataa

SEQ ID NO: 33956 - protein, 404 aa, Vibrio cholerae
MQNIGMSSKLDNVCYDIRGPVLKHAKRMEEEGHKILKLNIGNPAPFGFDAPDEILVDVIRNLPTSQGYCDSKGIYSARKAVVQYYQKKGIRSLDVEDVYIGNGASELIVMAMQALLNNGDEMLVPAPDYPLWTAAVALSGGKAVHYICDEEADWYPDLDDIRSKITPKTRGIVLINPNNPTGAVYSRDFLLEIIEIARKHKLMIFADEIYDKVLYDGAVHTSIATLADDVLVVTFNGLSKAYRVCGFRGGWMFLTGPKQQAQGYIAGLDMLASMRLCANVPMQHAIQTALGGYQSINELILPGGRLLEQRDRAWELINQIPGISCVKPKGAMYLFPKIDTKMYPIKDDQKMVLDFLVQEKVLLVQGSGFNWPKPDHFRIVTLPHVEDLEIAISRFERFITTYSQ

SEQ ID NO: 33957 - DNA, 1215 bp, Lactococcus lactis subsp. lactis
  CDS (1)..(1215)
atgagaaaatttgaaaaatcgcataaacttgataatgtcagctatgatattcgtggtccagtattggatgaagcacaaagaatgcgagccaatggtgaaaaaattcttcgattgaatacaggaaatccagctgaatttggctttcttgctcctgatgaagtcattagtgacttgattcaacatgctgtggatagcgaaggatattcagattctaaagggattttctcggctcgtaaagcgattatgcaatactgtcagctcaagggttttcctaatcttgatatcaatgatattttcacaggtaatggggtttctgaattgattgttatggccatgcagggacttttggacacaggggatgaggttttgattcctatgcctgattatccactttggacggcttctgtcagcttagctggaggaacagctgttcattacctctgtgatgaacaggctggttggttccctgacattgatgatattcgctcaaaaatcacaagtaatacaaaagccattgttttgattaatcctaataatccaacgggtgcgctgtattctaaagatttattgcttgaaattgttcaagtggctagagaaaataatttaattattttctctgacgaaatttatgaccgattggttatggatggagcagttcatgttccgattgctagcttggcaccagatctttttgtggtcacaatgaatggcctctcaaaatcacaccgcattgcgggattccgtgtggggtggatggttttgtcaggtgaaaaatcacatgtcaagggttatattgaaggtttgaatatgctggcttcaatgcgactttgttccaatgttttagctcaatcagtcgtacaaacttcacttggtggcactcaatcggttgataaattgctgttgccgggtggacgagtttatgaacaaagagaattcatttataaagccatcaatgatattccaggattatctgcggtcaaacctcaagcagctttctatattttccctaaaattgacagagaaatgtataaaattgataatgatgaacaatttgtcttggactttttgaagcaggaaaaaatcctgcttgttcatggtcgaggatttaattggaaagagccagaccatttccgaattgtttatctgcctcgtgtggacgaattagcggaaatacaagaaaaaatggaacgtttcctttggcaatatcgtaaataa

SEQ ID NO: 33958 - protein, 404 aa, Lactococcus lactis subsp. lactis
MRKFEKSHKLDNVSYDIRGPVLDEAQRMRANGEKILRLNTGNPAEFGFLAPDEVISDLIQHAVDSEGYSDSKGIFSARKAIMQYCQLKGFPNLDINDIFTGNGVSELIVMAMQGLLDTGDEVLIPMPDYPLWTASVSLAGGTAVHYLCDEQAGWFPDIDDIRSKITSNTKAIVLINPNNPTGALYSKDLLLEIVQVARENNLIIFSDEIYDRLVMDGAVHVPIASLAPDLFVVTMNGLSKSHRIAGFRVGWMVLSGEKSHVKGYIEGLNMLASMRLCSNVLAQSVVQTSLGGTQSVDKLLLPGGRVYEQREFIYKAINDIPGLSAVKPQAAFYIFPKIDREMYKIDNDEQFVLDFLKQEKILLVHGRGFNWKEPDHFRIVYLPRVDELAEIQEKMERFLWQYRK

SEQ ID NO: 33959 - DNA, 1477 bp, Arabidopsis thaliana (mouse-ear cress)
  CDS (1)..(1446)
atgtctctcaaggcgttagactacgagtccttgaatgaaaacgtgaagaattgtcagtatgcagtcagaggtgaactttatcttcgtgcttctgagcttcagaaagaaggcaaaaagattattttcacaaatgttggaaaccctcatgctttaggacagaaacctctgacttttcctcgtcaggtggtttctttatgccaagcaccatttctgttagatgatccaaatgttggtatgatattcccagcagatgctattgcaagagctaagcattatctttccttgacttctggtggtcttggtgcttacagtgactcaagaggtcttccgggagttcggaaagaagtcgctgagttcattgaacggcgtgatggatatccaagcgatccagaactcatatttctaactgatggagcgagcaaaggtgtgatgcaaatcttgaattgtgtcatacgcggtcagaaagacggaattctggttccagttccacagtatccactctactcggctactatatctctgttaggtggtactcttgttccttactatcttgaagagtctgaaaactggggacttgatgttaacaaccttcgccaatctgttgctcaagctcgctctcaaggaataacagtaagggcaatggtgattattaaccccggaaacccaactggccagtgtcttagcgaagctaacataagagagatactacggttctgttgtgatgagagattagttcttctcggagacgaagtgtatcagcaaaatatataccaagatgaacgtccctttatcagttccaagaaggttttgatggatatgggagcaccgatcagcaaggaagttcagctcatatctttccacaccgtttccaaaggatactggggcgaatgtgggcaacggggaggttactttgagatgacaaatatccctcccaggaccgttgaggagatatacaaggtggcctctatagctctcagccccaacgtctctgcgcagatatttatgggtttaatggttagcccaccaaagcctggagacatttcatatgaccaattcgttcgtgagagcaagggaatactagaatcactgagaagaagagcaaggatgatgactgatggattcaacagctgcaaaaacgtcgtctgtaatttcacagaaggtgctatgtattcattccctcaaataaagttgccgtcgaaagcaatccaagcagcaaaacaagccggaaaagtccctgacgttttctactgccttaagctcttagaagccacaggaatctccacagttccaggctctggatttggacaaaaagaaggggtgtttcatttaaggacaacaattctgccagcagaagaagaaatgccagagattatggacagtttcaaaaagttcaatgatgagtttatgtctcagtacgctgataactttggttactccagaatgtgaaaaagaaaggacttagagtcagagtcagaga

SEQ ID NO: 33960 - protein, 481 aa, Arabidopsis thaliana (mouse-ear cress)
MSLKALDYESLNENVKNCQYAVRGELYLRASELQKEGKKIIFTNVGNPHALGQKPLTFPRQVVSLCQAPFLLDDPNVGMIFPADAIARAKHYLSLTSGGLGAYSDSRGLPGVRKEVAEFIERRDGYPSDPELIFLTDGASKGVMQILNCVIRGQKDGILVPVPQYPLYSATISLLGGTLVPYYLEESENWGLDVNNLRQSVAQARSQGITVRAMVIINPGNPTGQCLSEANIREILRFCCDERLVLLGDEVYQQNIYQDERPFISSKKVLMDMGAPISKEVQLISFHTVSKGYWGECGQRGGYFEMTNIPPRTVEEIYKVASIALSPNVSAQIFMGLMVSPPKPGDISYDQFVRESKGILESLRRRARMMTDGFNSCKNVVCNFTEGAMYSFPQIKLPSKAIQAAKQAGKVPDVFYCLKLLEATGISTVPGSGFGQKEGVFHLRTTILPAEEEMPEIMDSFKKFNDEFMSQYADNFGYSRM

SEQ ID NO: 33961 - DNA, 1938 bp, Sulfolobus solfataricus
  CDS (181)..(1389)
aagcttatatccatgataccatccaatgtggtaaaggtggcagaaagtggaatttctgagaggaatgaaatagaagaattaaggaaattaggtgttaacgctttcctaatcggatcatcactgatgcgaaacccagaaaagattaaagaatttatactatagcgttcttcatatacacttatggtctcgctactagactttaacggaaatatgtcacaagttactggagagactaccttattgtataaggaaattgctagaaacgtagaaaagactaagaagattaaaattatcgactttgggataggacaaccagatttacctacatttaaacgtataagagatgccgcaaaggaggcgctagatcaaggttttactttctacacttcggcattcggtattgatgaattaagggaaaaaatagctcaatacctaaatactagatacggtactgacgtaaagaaggaggaagtgatagtaacacctggtgctaagcctgcgcttttcttagtctttatattatatattaatccaagtgacgaggtaatactcccagatccctccttctattcttacgctgaggttgttaagttactaggaggaaagccaatatatgccaatttaaagtggagcagagaagaagggttctcaatagatgtagacgacctacaatctaaaatatcgaaaagaaccaaaatgatagtattcaataatcctcataatccgactggtactctattctctcctaatgatgttaagaaaattgtggatataagtagggataataaaattatcttactatctgacgagatttatgataattttgtatatgaaggtaagatgagaagtactcttgaagactcagattggagagatttcttaatttacgttaatggatttagtaaaactttctcgatgactggatggagattaggttatattgtagcgaagcgtgaaattatccagaaaatgggaattttggctgctaacgtatacactgctcctacaagttttgtacaaaaagccgcagtaaaggcctttgatactttcgacgaagttaaccaaatggtcagcctatttaagaagaggagagacgtaatgtatgatgaacttactaaggtcaaaggagttgaagtatctaaaccaaatggagcattctatatgttcccaaatgttagtaagatacttaaaacaagtggatttgacgtcaagtcacttgccataaagctaattgaagaaaaaggcgtagttacaatacctggtgaagttttcccattaaatataggtaaggagtttttaagattaagttttgctgtgaacgaagaagttattaaagagggcatacaaaaaattagagagttcgcggaacagatgatgaattcccgatagtacgattgatgagctaaactcccatggactgattagcagttttaatttccactttttcttcattcgattctattagttcaagattagttacctttaatgtcttcattacgtcatctttcacttcattaattaattcaataacttgcttagaagcgtacaattttacactaactggagtattcattgataatctattctttatcttctctgatcttatgagcgagttcgttttctttattacttctccaagttcatctattcttttattctcctcaatatcatctacttttggtaattcttctaggagaacactcttcttgtggccaaatagccttgagtaaatttcctctgttatatgaggtgcgataggatgaagcaatatgattatatctcttattattctctgtatagtatattttgcagagttatcgtcatcaaataacctatgctttatcatttccaaatactcgtcagctacgatctcccagccctagttatatagctcttgaatctaataaagtcgattcacatatgcttatgcttagtcga

SEQ ID NO: 33962 - protein, 402 aa, Sulfolobus solfataricus
MVSLLDFNGNMSQVTGETTLLYKEIARNVEKTKKIKIIDFGIGQPDLPTFKRIRDAAKEALDQGFTFYTSAFGIDELREKIAQYLNTRYGTDVKKEEVIVTPGAKPALFLVFILYINPSDEVILPDPSFYSYAEVVKLLGGKPIYANLKWSREEGFSIDVDDLQSKISKRTKMIVFNNPHNPTGTLFSPNDVKKIVDISRDNKIILLSDEIYDNFVYEGKMRSTLEDSDWRDFLIYVNGFSKTFSMTGWRLGYIVAKREIIQKMGILAANVYTAPTSFVQKAAVKAFDTFDEVNQMVSLFKKRRDVMYDELTKVKGVEVSKPNGAFYMFPNVSKILKTSGFDVKSLAIKLIEEKGVVTIPGEVFPLNIGKEFLRLSFAVNEEVIKEGIQKIREFAEQMMNSR

SEQ ID NO: 33963 - DNA, 1869 bp, Panicum miliaceum (proso millet)
  CDS (95)..(1543)
cgaaacggcagggtcctgttgtcccggcgatccagcccactgccccactccttgcgtcgcggcgaacgtctgatccttcctgtccctgttcgccatggccgccaccgtcgccgtggagaacctcaaccccaaggtcttaaaatgtgaatatgcagtacgtggggagattgtcattcatgctcagcacttacagcaacagctacaaactcaaccagggtctcttccttttgatgagatcctctactgcaacattgggaatcctcaatctcttggtcagcaaccagtgacattcttcagggaggttcttgctctttgtgatcatccatgcttgttggaaaaagaggaaactaaatcattgttcagtgctgatgctatttctcgagcaaagcagattctttctactattccaggaagagcaaccggtgcatacagtcacagccagggtatcaaaggactccgtgatgcaattgctgctgggattgcgtcacgtgatggattccctgcaaatgcagatgacattttcgtaactgacggcgcaagtcctggggtgcacatgatgatgcaattactgataaggaatgagaaagacggcattctgtgcccaattcctcagtaccctttgtactcagcctccatagctcttcatggtggaactcttgtcccctattaccttgatgaaaaaaccgggtggggtttggagatctctgatcttaagaagcaactcgaagatgctcggtctaaaggcattgatgttagggccttggtggttatcaatcctggaaatccaactgggcaggttcttgctgaggacaaccaatgtgacatagtgagattctgcaaaaatgagggccttgttcttctagctgatgaggtatatcaagagaacatctatgttgatgacaagaaatttaactctttcaagaagatagcaagatccgttggatatggcgaggatgatctccctctagtatcatttcagtctgtttctaaaggatattatggtgagtgtggtaaaagaggaggctacatggagattactggcttcagtgctcccgtaagagagcagatctacaagatagcttcagtgaacttatgctccaatatcactggtcaaatccttgccagccttgtcatgaatccaccaaaggtcggggacgaatcatatgctgcctacaaggcagagaaagatggaatccttcaatctttagctcgtcgtgcaaaggcattggaggatgcattcaacaatcttgagggaatttcgtgtaacaaggctgaaggagcaatgtaccttttccctcagattcatctgccaaagaaggcaattgaggctgctaaagcagctaataaagcacctgatgcattctatgctctccgtctccttgaatcaactggaattgttgtggtccctggatccgggtttggccaagttcccggaacatggcatatcaggtgcacgatcctgccgcaggaagacaagatccccgccgtgatcacccgcttcaaggcgttccatgaggcgttcatggctgagtaccgcgactaagccgttacaccctgtgaatgaagatggggtcatgtaatttgtttcttgtaatatcggtctgtaatttgaactcaaactctcttgcttcctcccttaaatgagagtgcagtgctcctgaaaacttttcaaaaaaaaagaagaaggtggggtcatgtggacgcgccttccttttcagcccctagtagcaccatcaagtagaccgaacaaaataaaagcagaccgcacatactttctatgtaagctgatctctgactctaaatggaggaacagatcagtctgttggcgccttcgatggcaatcgaggaaaattttgattaaaaaaaaaa

SEQ ID NO: 33964 - protein, 482 aa, Panicum miliaceum (proso millet)
MAATVAVENLNPKVLKCEYAVRGEIVIHAQHLQQQLQTQPGSLPFDEILYCNIGNPQSLGQQPVTFFREVLALCDHPCLLEKEETKSLFSADAISRAKQILSTIPGRATGAYSHSQGIKGLRDAIAAGIASRDGFPANADDIFVTDGASPGVHMMMQLLIRNEKDGILCPIPQYPLYSASIALHGGTLVPYYLDEKTGWGLEISDLKKQLEDARSKGIDVRALVVINPGNPTGQVLAEDNQCDIVRFCKNEGLVLLADEVYQENIYVDDKKFNSFKKIARSVGYGEDDLPLVSFQSVSKGYYGECGKRGGYMEITGFSAPVREQIYKIASVNLCSNITGQILASLVMNPPKVGDESYAAYKAEKDGILQSLARRAKALEDAFNNLEGISCNKAEGAMYLFPQIHLPKKAIEAAKAANKAPDAFYALRLLESTGIVVVPGSGFGQVPGTWHIRCTILPQEDKIPAVITRFKAFHEAFMAEYRD

SEQ ID NO: 33965 - DNA, 1701 bp, Hordeum vulgare (barley)
  CDS (95)..(1543)
ggccacaaaaccgcggaaagagatagacggacagctagaggcgtcggaagatactcgctgctctgccgcccccttcgtcttagttgatctcgccatggctgccaccgtcgccgtggacaacctgaaccccaaggttttaaaatgtgagtatgctgtgcgtggagagattgtcatccatgctcagcgcttgcaggaacagctaaagactcaaccagggtctctaccttttgatgagatcctctattgtaacattgggaacccacaatctcttggtcagcaaccagttacattcttcagggaggttcttgccctttgtgatcatccagacctgttgcaaagagaggaaatcaaaacattgttcagtgctgattctatttctcgagcaaagcagattcttgccatgatacctggaagagcaacaggagcatacagccatagccagggtattaaaggacttcgtgatgcaattgcttctgggatcgcttcacgagatggattccctgctaatgctgatgacatttttctcacagatggagcaagtcctggggtgcacctgatgatgcaattactgataaggaatgagaaagatggcattcttgtcccgattcctcagtaccccttgtactcggcttccatagctcttcatggcggagctcttgtcccatactatctcaatgaatcgacgggctggggtttggaaacctctgatgttaagaagcaacttgaagatgctcggtcaagaggcatcaacgttagggctttggtggttatcaatccaggaaatccaactggacaggtacttgctgaagaaaaccaatatgacatagtgaagttctgcaaaaatgagggtcttgttcttctagctgatgaggtataccaagagaacatctatgttgacaacaagaaattccactctttcaagaagatagtgagatccttgggatacggcgaggaggatctccctctagtatcatatcaatctgtttctaagggatattatggtgagtgtggtaaaagaggtggttactttgagattactggcttcagtgctccagtaagagagcagatctacaaaatagcatcagtgaacctatgctccaatatcactggccagatccttgctagtcttgtcatgaacccaccaaaggctagtgatgaatcatacgcttcatacaaggcagaaaaagatggaatcctcgcatctttagctcgtcgtgcgaaggcattggagcatgcattcaataaacttgagggaattacttgcaacgaggctgaaggagcaatgtacgtgttccctcaaatctgtctgccacagaaggcaattgaggctgctaaagctgctaacaaagcacctgatgcattctatgctcttcgtctcctcgagtcgactggaatcgtcgttgtccctggatcaggatttggccaggttcctggcacatggcacttcaggtgcacgatccttccgcaggaggataagatcccggcagtcatctcccgcttcacggtgttccatgaggcgttcatgtcagagtatcgtgactaaactggtgcaacatgtgggattacatacaaccctcatggggttttcgtaggcgttcttggttttgccccccccccccttctctctctctctctctctgacagcatcctcctctagatgagacaaaataaagcaaagccatgtcatccttaaaaaaaaaa

SEQ ID NO: 33966 - protein, 482 aa, Hordeum vulgare (barley)
MAATVAVDNLNPKVLKCEYAVRGEIVIHAQRLQEQLKTQPGSLPFDEILYCNIGNPQSLGQQPVTFFREVLALCDHPDLLQREEIKTLFSADSISRAKQILAMIPGRATGAYSHSQGIKGLRDAIASGIASRDGFPANADDIFLTDGASPGVHLMMQLLIRNEKDGILVPIPQYPLYSASIALHGGALVPYYLNESTGWGLETSDVKKQLEDARSRGINVRALVVINPGNPTGQVLAEENQYDIVKFCKNEGLVLLADEVYQENIYVDNKKFHSFKKIVRSLGYGEEDLPLVSYQSVSKGYYGECGKRGGYFEITGFSAPVREQIYKIASVNLCSNITGQILASLVMNPPKASDESYASYKAEKDGILASLARRAKALEHAFNKLEGITCNEAEGAMYVFPQICLPQKAIEAAKAANKAPDAFYALRLLESTGIVVVPGSGFGQVPGTWHFRCTILPQEDKIPAVISRFTVFHEAFMSEYRD

SEQ ID NO: 33967 - DNA, 1326 bp, Solanum tuberosum (potato)
  CDS (1)..(1326)
atggccatagagattgagcaacgtccaacagtagttcgtctatcaaacgttgcaacgtctgacactcatggagaagactcaccttactttgctggatggaaagcatatgatgaaaatccatttgatgaagttcacaacccatctggagttattcaaatggcattagccgaaaatcaagtgtcatttgatttgctggaagagtacttggaaaagaagaaagacgatggcattgctgaaatttctagattcagggaaaatgctttgttccaagattatcatggacttgtttgttttagaaaggcaatggctaccttcatggaacaagtaagaggtggaagggcaagatttgatcctgatagagttgttattacagctggtgccactgcagctaatgagttgttaactttcattttagctgatcctggtgatgctttgcttgttccaactccttactatcctggatttgacagagacttgaggtggagaacgggtgtgaaaatcattccagtccattgtgacagttcaaataatttccaagtcactctacaggccttggaagaagcctacaaggatgcagaatccaacaacatcaaagtgagaggggttcttataacaaacccctcaaaccctttgggtaccacagttcaaagatgtgttcttgaggaaattcttgaattcgtcgcaagaaaaaacatccatcttgtatctgatgaaatctactcaggttcagccttttgttgctccgaatttgtcagtattgctgaaatacttgaatcgagaaactacaaggattcagagagggtacacattgtgtacagcctctctaaagacttgggactccccgggtttcgagttggtacaatctactcatacaatgacaaagtagtcacaacggcaagaagaatgtcaagttttacattgatttcttctcagacacaacaactcttggcttccatgttgtctgatgagaaattcactgagaattacataaagaagaatcgcgaaaggctgagaaggagatatgaaatgatgattgaagggctgaggagtgctgggattgagtgcttgagagggaatgcgggattgttttgctggatgaatttaagtactttgttggaaaagcctacaaaggaatgtgaattggaagtgtggaacacaatattgcatgaagtgaaactgaatatttctccaggttcttcttgtcattgctcagagccaggctggttcagggtttgttttgctaacatgagtgaaaataccctagaaattgcactcaaaagaatacaccatttcatggaaacaaggggcatacttcaaaaatactaa

SEQ ID NO: 33968 - protein, 441 aa, Solanum tuberosum (potato)
MAIEIEQRPTVVRLSNVATSDTHGEDSPYFAGWKAYDENPFDEVHNPSGVIQMALAENQVSFDLLEEYLEKKKDDGIAEISRFRENALFQDYHGLVCFRKAMATFMEQVRGGRARFDPDRVVITAGATAANELLTFILADPGDALLVPTPYYPGFDRDLRWRTGVKIIPVHCDSSNNFQVTLQALEEAYKDAESNNIKVRGVLITNPSNPLGTTVQRCVLEEILEFVARKNIHLVSDEIYSGSAFCCSEFVSIAEILESRNYKDSERVHIVYSLSKDLGLPGFRVGTIYSYNDKVVTTARRMSSFTLISSQTQQLLASMLSDEKFTENYIKKNRERLRRRYEMMIEGLRSAGIECLRGNAGLFCWMNLSTLLEKPTKECELEVWNTILHEVKLNISPGSSCHCSEPGWFRVCFANMSENTLEIALKRIHHFMETRGILQKY

SEQ ID NO: 33969 - DNA, 1524 bp, Saccharomyces cerevisiae
  CDS (1)..(1524)
atgacaatgacacaccaacaggatttgaaaggtgtgttcaccgcaaaggatttggattttaagcccgctggcaagattactaaaaaagatttgaatacaggtgtcactaaggcagaatatgctgtaagaggagctattccaaccagagctgacgagctaaaagaggaattgaaaaaaaacccagaagttttgcctttcgatgatattatcaatgcgaacattggtaatccgcagcaactggatcagaagcctttgacctttaccaggcaagtactggccatcctggagtacccggaaattttacgagtaggccataatgaactggcttctttgaacttgttttccagggacgccttggaaagagctgagcgcctcttgaatgatattggcggttctataggggcatattcgcattctcaaggtgtgccaggaataaggcaaacagttgctgacttcattactagaagagacggcggtgagcccgctacaccggaagatatttatttaaccactggcgcttcgtccgcggcaacttctttgttatctttattgtgtaaagattctcaaacaggcctgctgattccaattccgcagtatccgctttatactgcatccgcatctcttttcaatgcacaagtgctgccatactacttagatgaggagtcaaattggtctacaaacagcgacgaaattgaaaaagtagtgcaagatgctttgaaaaaacagatcagaccatctgtgctgatagttattaatccaggtaacccaaccggtgcagttctttctgaagaaaccattgccaggatctgtttgatcgctgcgaaatacggcattacaatcatttctgatgaggtctatcaagaaaacattttcaacgatgttaaatttcattcgatgaagaaagtcctaagaaaattgcagcatctttatccaggaaaattcgataacgttcagctcgcctctttacactccatttctaaaggattcatggatgagtgcggccaaagaggcggttacatggaaattattgggttttctcaagaaataagagatgctcttttcaaactcatgtctatatccatatgttctgttgtcacaggacaagctgtggttgatttaatggtcaaaccaccccagcctggagacgagtcctatgaacaagatcatgacgaaaggctgaaaatttttcatgaaatgcgtacgagagcaaacttattgtacgagacgtttaaggaactagagggtatcgaatgccaaaaacctcagggtgcaatgtatcttttccctaggcttgttttacctaagaaagctctttgtgaaagcgaacgccttggcatcgaacctgatgagttctattgcacatctttgctagaatctacaggtatttgtactgtcccagggtctgggttcggacaaagacccgggacttatcatgtgcgaacaacgtttttggctccagggactaaatggattcaagactggaaagaatttcatcaagatttcttcagcaagtatcgtaattga

SEQ ID NO: 33970 - protein, 507 aa, Saccharomyces cerevisiae
MTMTHQQDLKGVFTAKDLDFKPAGKITKKDLNTGVTKAEYAVRGAIPTRADELKEELKKNPEVLPFDDIINANIGNPQQLDQKPLTFTRQVLAILEYPEILRVGHNELASLNLFSRDALERAERLLNDIGGSIGAYSHSQGVPGIRQTVADFITRRDGGEPATPEDIYLTTGASSAATSLLSLLCKDSQTGLLIPIPQYPLYTASASLFNAQVLPYYLDEESNWSTNSDEIEKVVQDALKKQIRPSVLIVINPGNPTGAVLSEETIARICLIAAKYGITIISDEVYQENIFNDVKFHSMKKVLRKLQHLYPGKFDNVQLASLHSISKGFMDECGQRGGYMEIIGFSQEIRDALFKLMSISICSVVTGQAVVDLMVKPPQPGDESYEQDHDERLKIFHEMRTRANLLYETFKELEGIECQKPQGAMYLFPRLVLPKKALCESERLGIEPDEFYCTSLLESTGICTVPGSGFGQRPGTYHVRTTFLAPGTKWIQDWKEFHQDFFSKYRN

SEQ ID NO: 33971 - DNA, 1170 bp, Synechocystis sp
  CDS (1)..(1170)
atgcgactaacccagcgagttagccaagttgtgccttccatcacccttgaaattacggcaaaggccaaggcaatgcggactgagggcattgatgtgcttagctttaccgctggggaaccggattttaccactcccccccacattgtggaggcggccaaattagccttggatgaagggaagacccgctatggccccgccgccggagaaccggccctccgtcaggcgatcgccaaaaagttacgggaaaagaataatttgccctacgaggcggccaatattttggtgaccaatgggggtaaacattccctgtttaacctaatgctagccatgattgagcagggggatgaggtaattattcccgccccctattggctcagttatccagaaatggtgcgtttagccgaaggaaccccagttattgtcaacaccacagcggccacggattacaaaatcaccccagagcaactacggcaggccattacctccaaaagtaagctgtttgtgctgaattctccttccaatcccaccggggcagtttacactcctgccgaaattagggctttggcggcggtgattttggaatatgaggatttatacgtagtttccgatgagatttatgagcgcattctctacgatggcacagagcacctcagcattggtgcggtgaacgacgagattttccaacgcaccatcattagtaacggttttgccaaaagttattccatgaccggttggcgggtgggttacctggcgggggaattacccttaatccaagcctgtagcaccatccagggccatagcacctccaacgtttgtacctttgcccagtacggggcgatcgccgctctggaaaatccccaaacctgtgtggagaccatggtcaaagccttcacagaaagacgacaggtgatagtggaaggcatcaatcaaattgcagggctgagttgtcctaatccgaaaggagcattttatgtttttgtggacattgctaaaacggggcttaattccctggagttcagtgcccgattattagaatcccaccaggtggcggtgattcctggagcggcgtttggagccgatgactgtgtgcgtttttcctacgctaccgatatggacaccattaaacagggtttggccgagttagagcggtttgtcagcactttggcttga

SEQ ID NO: 33972 - protein, 389 aa, Synechocystis sp
MRLTQRVSQVVPSITLEITAKAKAMRTEGIDVLSFTAGEPDFTTPPHIVEAAKLALDEGKTRYGPAAGEPALRQAIAKKLREKNNLPYEAANILVTNGGKHSLFNLMLAMIEQGDEVIIPAPYWLSYPEMVRLAEGTPVIVNTTAATDYKITPEQLRQAITSKSKLFVLNSPSNPTGAVYTPAEIRALAAVILEYEDLYVVSDEIYERILYDGTEHLSIGAVNDEIFQRTIISNGFAKSYSMTGWRVGYLAGELPLIQACSTIQGHSTSNVCTFAQYGAIAALENPQTCVETMVKAFTERRQVIVEGINQIAGLSCPNPKGAFYVFVDIAKTGLNSLEFSARLLESHQVAVIPGAAFGADDCVRFSYATDMDTIKQGLAELERFVSTLA

SEQ ID NO: 33973 - DNA, 1634 bp, Arabidopsis thaliana (mouse-ear cress)
  CDS (39)..(1307)
acccaaaaacaaaatctaatagagaaaaataagtagatatggcaacccttaagtgcattgattggcaattcagcggaagcgaggcggccaaagatgctgctgcggcctccttaggctcatatacctctgcactctatgccctgtgcgatcctcatggcaaacccattttgcccccacgaaatgagatcctggagaccagcaatacagccgaaaaagcagttgttaaagctgttctttatggctcgggaaacgcctatgctcctagcttaggcctcgcggccgccaaaagtgccgtagcagagtatctaaaccaaggtcttccaaagaagcttaccgcagatgacgtgtttatgactctgggatgcaaacaagctattgagctcgcggtagacattctcgctaaaccgaaagccaacgttttgcttccgagtcccggcttcccatgggacctagtccgctccatctacaagaaccttgaggtccgccactataatttccttccagaaaagaactttgaaatcgactttgatagcgtccgagcgctcgtggacgagaacacatttgccatatttataatcaacccccacaaccccaatggtaacacctactccgaggctcatctcaaacagctggctgaactggctaaggaactcaagattatggtggtttctgacgaggtttttagatggacactctttggtagtaacccttttgttcctatgggaaaattctcgtcgatcgtaccagtggttacactcggatccatatcaaagggatggaaagtcccaggatggcgaactggttggctcacgctacatgatctagacggtgtcttcagaaacaccaaggtcttacaagctgctcaagattttctccagataaacaataaccctccgacagttatccaggcggctattcctgacatcttggagaaaactcctcaagagttttttgataagaggcagagttttctgaaagataaagtagaatttggttattctaagctcaagtacattcctagcctcacttgctacatgaaacccgaagcctgcaccttcttatggaccgagcttgatttatcgagctttgtggacatcgaagacgatcaagacttttgcaataagcttgctaaagaagaaaacctcgtcgttttaccagggattgcattcagtcagaagaactggttgaggcattctatcgatatggagactccggtattggaggatgcattggaaagattgaagagcttctgcgatcgccattccaacaaaaaagctcccctcaaagacgtcaatggtgttaagtaaagggtcaatatggttatttgcctaagtcatttacgtatgctataatgataaataaatgagtgtttcttggtttgaggtaaatcatgaacactttagtgtatttgtaacaaataaaatgggtgcacttaatatcaatcgtgtgtaatgttttctcatagtttgctatatctttgtgtatatctatctacttttcggaaataaaatagattgtctgcatttaccattggaatacatatacatatatacatctcttaactacttcaaaatactttggacttgtcgtgtcgtgtatttttagaaaaattatgaagaaacccagttttacct

SEQ ID NO: 33974 - protein, 422 aa, Arabidopsis thaliana (mouse-ear cress)
MATLKCIDWQFSGSEAAKDAAAASLGSYTSALYALCDPHGKPILPPRNEILETSNTAEKAVVKAVLYGSGNAYAPSLGLAAAKSAVAEYLNQGLPKKLTADDVFMTLGCKQAIELAVDILAKPKANVLLPSPGFPWDLVRSIYKNLEVRHYNFLPEKNFEIDFDSVRALVDENTFAIFIINPHNPNGNTYSEAHLKQLAELAKELKIMVVSDEVFRWTLFGSNPFVPMGKFSSIVPVVTLGSISKGWKVPGWRTGWLTLHDLDGVFRNTKVLQAAQDFLQINNNPPTVIQAAIPDILEKTPQEFFDKRQSFLKDKVEFGYSKLKYIPSLTCYMKPEACTFLWTELDLSSFVDIEDDQDFCNKLAKEENLVVLPGIAFSQKNWLRHSIDMETPVLEDALERLKSFCDRHSNKKAPLKDVNGVK

SEQ ID NO: 33975 - DNA, 1344 bp, Arabidopsis thaliana (mouse-ear cress)
  CDS (1)..(1344)
atgggtcttcctctaatgatggagagatcatcaaacaacaacaacgtcgagctttctcgagtggcggtttcagacactcacggcgaagactcaccgtacttcgccggctggaaagcttacgacgaaaatccttacgacgaatctcataacccttccggtgtcatccaaatgggtctcgctgagaatcaggtctcgtttgatcttcttgaaacttacttggagaagaagaatccagaaggttcgatgtggggatcaaaaggagctcctgggttccgtgaaaacgcattgtttcaagactaccacggtctcaaaactttcagacaagccatggctagtttcatggaacagattcgaggaggcaaagctagatttgatcctgaccggatcgtcctcaccgccggagccaccgccgctaacgaactcttaactttcattctcgccgatcctaacgacgcccttctagttcccacaccgtattatccaggattcgatagagatttgagatggagaaccggagtgaaaatagtacccatccactgcgacagctcgaaccatttccagataaccccggaggcgctagagtcggcgtaccaaacggctcgtgacgcgaacattagagtccgaggagtgctcataaccaacccatcgaacccattaggggcgacggtccaaaagaaggttctagaagatctccttgacttctgcgtacgcaagaatattcacttggtctcagacgagatctactccggctccgtcttccatgcctccgagttcacaagcgttgccgagatcgtagaaaacatagatgacgtgtcagtaaaggaacgagttcacatcgtctacagtctctccaaggatcttggtcttcctggtttccgcgtgggaactatatactcgtacaacgataatgttgttcggacagcgagaaggatgtcgagcttcacgcttgtctcgtctcagacacaacatatgctggcttctatgttgtcggatgaggagtttacggagaagtacattaggataaaccgggaaagacttagaagacggtacgataccattgtggaagggcttaagaaggcagggattgagtgtttgaaagggaacgcagggctattttgttggatgaatttgggtttcttgctcgaaaagaaaactaaagacggcgagctccagctttgggatgtgatcttaaaggagctgaacctgaatatatctccgggatcttcgtgccactgctcggaggtcggatggtttagggtttgttttgctaatatgagtgagaacactttggagattgcgttgaagagaatacatgagttcatggaccgacgaaggaggttttga

SEQ ID NO: 33976 - protein, 447 aa, Arabidopsis thaliana (mouse-ear cress)
MGLPLMMERSSNNNNVELSRVAVSDTHGEDSPYFAGWKAYDENPYDESHNPSGVIQMGLAENQVSFDLLETYLEKKNPEGSMWGSKGAPGFRENALFQDYHGLKTFRQAMASFMEQIRGGKARFDPDRIVLTAGATAANELLTFILADPNDALLVPTPYYPGFDRDLRWRTGVKIVPIHCDSSNHFQITPEALESAYQTARDANIRVRGVLITNPSNPLGATVQKKVLEDLLDFCVRKNIHLVSDEIYSGSVFHASEFTSVAEIVENIDDVSVKERVHIVYSLSKDLGLPGFRVGTIYSYNDNVVRTARRMSSFTLVSSQTQHMLASMLSDEEFTEKYIRINRERLRRRYDTIVEGLKKAGIECLKGNAGLFCWMNLGFLLEKKTKDGELQLWDVILKELNLNISPGSSCHCSEVGWFRVCFANMSENTLEIALKRIHEFMDRRRRF

SEQ ID NO: 33977 - DNA, 1410 bp, Arabidopsis thaliana (mouse-ear cress)
  CDS (1)..(1410)
atgggtctcttgtcaaagaaagctagttgcaacacgcacggccaagattcttcgtatttttggggttgggaagagtatgaaaaaaatccttacgacgagatcaagaacccagacggcattatccaaatgggtctagcagaaaatcagttgtctttcgatctcattgagtcatggcttgctaagaaccccgacgcagccaatttccaaagagaaggccaatccatatttcgggaattagctctctttcaagattatcatggccttccttccttcaagaatgctatggcggatttcatgtcggaaaatagaggaaatcgagtttctttcaatccaaacaagcttgtcctcaccgctggtgctactccggctaacgagactctcatgttttgtctcgctgatcctggagatgctttcttgctccctacgccgtattatccaggatttgatagggatttgaaatggagaaccggagctgagattgtaccgatccagtgtaagagtgcaaacggtttccgcatcacaaaagtagcacttgaagaagcctacgagcaagctcaaaagcttaacctaaaagttaaaggagtccttataaccaacccatctaacccgttgggcactacaacgacacgaaccgaactaaaccatctcttggacttcatctcacgtaagaagatacatttgataagcgacgagatctattcgggtaccgttttcaccaatcccggattcattagcgtaatggaagtcctcaaagacagaaagctcgaaaacaccgatgttttcgaccgtgtccacattgtttacagtttgtctaaagatctaggcctacctggttttcgcgttggggtgatttactccaacgatgattttgttgtctccgcagcgacaaaaatgtccagtttcggtctaatctcttctcaaacacaatacctcttgtccgcattgttatcagacaagaccttcaccaaaaactacctcgaagaaaaccaaatccggctcaagaacagacacaagaagctcgtctcgggtctagaggctgcaggcatcgagtgtctcaagagcaacgccggactcttctgttgggttgacatgagacacctattaaaatcaaacacgttcgaagccgagattgagctatggaaaaagatcgtttacgaggttaagctcaatatctctcccggttcttcgtgccattgcaacgaaccgggttggtttagggtttgttttgcgaatttgagcgaagagacattaaaggtagcgttggatagattgaagaggttcgttgatggaccgtcgcctactagaagaagtcaaagtgaacatcaaagactaaagaatctaaggaagatgaaagtctctaattgggttttccggctatcgtttcacgaccgtgaacccgaggaacgatag

SEQ ID NO: 33978 - protein, 469 aa, Arabidopsis thaliana (mouse-ear cress)
MGLLSKKASCNTHGQDSSYFWGWEEYEKNPYDEIKNPDGIIQMGLAENQLSFDLIESWLAKNPDAANFQREGQSIFRELALFQDYHGLPSFKNAMADFMSENRGNRVSFNPNKLVLTAGATPANETLMFCLADPGDAFLLPTPYYPGFDRDLKWRTGAEIVPIQCKSANGFRITKVALEEAYEQAQKLNLKVKGVLITNPSNPLGTTTTRTELNHLLDFISRKKIHLISDEIYSGTVFTNPGFISVMEVLKDRKLENTDVFDRVHIVYSLSKDLGLPGFRVGVIYSNDDFVVSAATKMSSFGLISSQTQYLLSALLSDKTFTKNYLEENQIRLKNRHKKLVSGLEAAGIECLKSNAGLFCWVDMRHLLKSNTFEAEIELWKKIVYEVKLNISPGSSCHCNEPGWFRVCFANLSEETLKVALDRLKRFVDGPSPTRRSQSEHQRLKNLRKMKVSNWVFRLSFHDREPEER

SEQ ID NO: 33979 - DNA, 2534 bp, Chlamydomonas reinhardtii
  CDS (67)..(1632)
ttggagagtttgtgaaacgcttggcagttttacagcatttcaaaccagaagactctgattgtgcaaatgcggaaggaagcgactcgtcttgtgtccgccctgctgcgggcgggcaacaatggcgtgtctacgtcgtgggctgttggtggcactcgcctcaagtcggcgatgccccagcctgatgagaagaaggacgaggacctgcatgccaaggagggcaaggtgctgcaccctcaccttctgaacgagaacgtggtgaagactcagtatgccgtccgtggcgagctttacctgcgcgctgagcagctccgcaaggagggcaaggagatcattttcacaaacgtcggaaacccgcacgcgctgggtgccaagcccctgaccttcacccgtcaggtgctagccctgtgcgccgcgcccttcctgctggatcaccccaaggtggaggacatgttccccgccgacgccatcgcgcgtgccaagaagatcctagcctccttcaagggcggtgtgggcgcctacaccgactcgcgtggcaacccgctggtgcgcgaggaggtggcccgcttcatcgagaagcgtgacggcgttccctcgaaccccgaccacatcttcctgacggacggcgcctcggtggccgtgcgcttgtgcctgaacgccatgatccgccacgaccgcgactccgtgctggtgcccatcccgcagtacccgctgtacagcgcctccatccgcctgtacggcggcacgctggtgggctacttcctggatgagcgccgtggctggggcctgtccgtggaggagctgcagcgcgcgctgcaggagtcgcgcgaggagggcaagctggtgcgcggcctggtgtttatcaaccccggtaaccccaccggccagtgcttgagcaaggagaacctgcaggagctgatcaagcttgcgtaccaggagaagattgtgctcatggcggatgaggtgtaccaggagaacgtgtaccaggatgagcggccgtttgtgagcgccaagaaggtgatgtgggagatgggcgagccctaccgcagccacgtggagctgctgtccttccacaccgtgtccaagggcactgccggcgagtgcggcctgcgcggcggctacgtggagatgactaacatccaccccggcgccattgaggaggtgtacaagtgcgcctccattaacctgtcgcccaacaccatgggccagatcgcgctgtccgtgctcgtcaacccgcccaagcccggcgatccctcttacgaccagtacaccaaggagaaggcctcggagctggtgtcgctgcgccgccgccggcacatggtgacggacggcttcaacgcgctggacggcgtcacctgcaacttcaccgagggcgccatgtacagcttcccccagattaagctgccggccaaggcgctggaggccgccaaggccgccggaaaggcgggcgacgtgttctactgcctcaaacttctggaggccaccggcatctccaccgtgcccggcagcggcttcggccaggaggagggcaccttccacctgcgcaccaccattctgcctcgcgaggaggtgatgacgaccttcgtggagaagttcgacaagttccacaaggacttcatgaagcagtattcgtaacagcttagcaattcgagaagcagcgtagctgcggaaggtgtgcggaaacgtggcgagccagcagcggcgcatggggtttctaccgcaattaagccatgtgaagtggtatgaggctacggcgtgttgccacggcaggtcatccggatcacggttgcattgctccttttttgccgctgttgcgctactgctcctgctgtaatgcagaaccctatgcctccaaccttgctgactggctgggtgcagccacgcaggggcatccctggcttatgtctgtcgtgctgggttaggatgagagctttcccatgagcggcctttgttggtgtcgtgttttgttgcgcaattgttgctgtatcctggtggagagcagagagcgagcttatctgagcgctaggggtccattccctggcccactgcgccggttttccatgcatgcggcaaggtgacagaggttgggctttttgaagcaggcgtctggtcagcatgcaaaggggaacgccgcttcaacgtgcatgtgtgtgattattcaaacccgaacctgcagttttggtttgacagtcccaaggactcgcaacaagagaagaacaatagctgtggaggagttccttgtcacatgcgcgtagattgcagtttaatgtgtggatgcgtaagttctttggctgactcgcaagtgttgcgtttttgggctaggcacgccgaggtaagtaggaggaaatgcacttatgcacctgaggttgggtagccgtgttgcagccggttgtttcacgcaccggtcacctctcgtcaagagcgggttgtggactgttggcctcacagagttgggtcgagagctcgaaaccaaccggccgccgaatggcgatggggcaagcacagcaatgcccccgccaatgtaacacctgctgtgt

SEQ ID NO: 33980 - protein, 521 aa, Chlamydomonas reinhardtii
MRKEATRLVSALLRAGNNGVSTSWAVGGTRLKSAMPQPDEKKDEDLHAKEGKVLHPHLLNENVVKTQYAVRGELYLRAEQLRKEGKEIIFTNVGNPHALGAKPLTFTRQVLALCAAPFLLDHPKVEDMFPADAIARAKKILASFKGGVGAYTDSRGNPLVREEVARFIEKRDGVPSNPDHIFLTDGASVAVRLCLNAMIRHDRDSVLVPIPQYPLYSASIRLYGGTLVGYFLDERRGWGLSVEELQRALQESREEGKLVRGLVFINPGNPTGQCLSKENLQELIKLAYQEKIVLMADEVYQENVYQDERPFVSAKKVMWEMGEPYRSHVELLSFHTVSKGTAGECGLRGGYVEMTNIHPGAIEEVYKCASINLSPNTMGQIALSVLVNPPKPGDPSYDQYTKEKASELVSLRRRRHMVTDGFNALDGVTCNFTEGAMYSFPQIKLPAKALEAAKAAGKAGDVFYCLKLLEATGISTVPGSGFGQEEGTFHLRTTILPREEVMTTFVEKFDKFHKDFMKQYS

SEQ ID NO: 33981 - DNA, 1494 bp, Trypanosoma cruzi
  CDS (1)..(1494)
atgctgcgcaaaactctttttggattcagggccattcgcatcaacccccgtgtggtggcggcagagtatgcggtgcgtgggatgctcccaatgcgtgcggacgagatcagggcggccctggcgacaccggaggggaaggccaagtatcccttccccagcattgtgtactgcaacattgggaacccgcaggcactggaacagaagccgctgacgttcttccggcaggtgatgtcgctgattgacgcgccgttcctgctggaaaacgagaaggttacgtcgcagtacccggcggatgcggtggcgcgtgcgagggagtatcttcgccacatcggcgatcgcacgggcgcctacacggactctgcgggctacgcctttgtccgtgacatcgtggcgcggcaaatcaatgaacgcgaccacgagataaagccgctggtggacgcatcctctatttttctgacggacggcgcgagctcgggcgtgcgtcttttgctgcaggttctcgtgggtgacgcgagtgatgcggtgatggttcccattccgcagtacccgctgtacacggcgcagcttacgcttcttggcggcacgcccgcgatgtactacctgtgtgagaaggataactgggcactgaacgtggaggagctggcgtcggtgtacgacgagtgcgtggcgaagaataatgcgactccgcgcgtgctcgttgtgatcaaccctgggaacccgactggcggcgtgctggatcgcgacgtgatggaggctgtggcgaaattctgctgcgaccgcggcattgtgctgatggcggacgaggtgtaccaggagaacgtgtacgcggcgggaaagcgtttcttgagcttccgggaagtggtgcttgggctgccggcgccgtacaacacggacacggtgctggcctcgctgcactcgacgtcgaagggcatcattggtgagtgcgggcgccgcggcgggtacttctgcctcacaaacttccccgcgccggttcgggagcaggtgttaaagatgtgctccatggttccgtgcagcagcgtgaatgggcagttgatgacggcactgatgtgctcgccaccgcggcccggtgacgcgagctatgagtcatactgggcggagtacaatgggatctttgcgagtctaaagaagcgcgccctgctgcttgcgaaggagctgagcacgattcgcggtttttcttgccagccggtggaaggggcgatgtacgcgtttccgacgattgagctgccggagaagtactttcagcacaatgaggagctgaacgcgaaggaggggcgaaagcttgggcccgacacgcgatgggcgttggagcttctggagagcagcggggttgttgttgtggccggctctgggtttggtcagcagcccaacacgctgcacttccgcacgacgatcctgccgccggagcagcagatggaacggatggtgaaggcgatgcgcacattccaggagggcatttgggcaaagtacgggtaa

SEQ ID NO: 33982 - protein, 497 aa, Trypanosoma cruzi
MLRKTLFGFRAIRINPRVVAAEYAVRGMLPMRADEIRAALATPEGKAKYPFPSIVYCNIGNPQALEQKPLTFFRQVMSLIDAPFLLENEKVTSQYPADAVARAREYLRHIGDRTGAYTDSAGYAFVRDIVARQINERDHEIKPLVDASSIFLTDGASSGVRLLLQVLVGDASDAVMVPIPQYPLYTAQLTLLGGTPAMYYLCEKDNWALNVEELASVYDECVAKNNATPRVLVVINPGNPTGGVLDRDVMEAVAKFCCDRGIVLMADEVYQENVYAAGKRFLSFREVVLGLPAPYNTDTVLASLHSTSKGIIGECGRRGGYFCLTNFPAPVREQVLKMCSMVPCSSVNGQLMTALMCSPPRPGDASYESYWAEYNGIFASLKKRALLLAKELSTIRGFSCQPVEGAMYAFPTIELPEKYFQHNEELNAKEGRKLGPDTRWALELLESSGVVVVAGSGFGQQPNTLHFRTTILPPEQQMERMVKAMRTFQEGIWAKYG

SEQ ID NO: 33983 - DNA, 1618 bp, Malus domestica (apple tree)
  CDS (73)..(1413)
cttttctctctctatctgagtcgcacccacagctttcttgaaggccaaagtgcttttacaagaaacctagttatggctatagatattgagcagcggcagcagccttctcctgggctatcaaaaatagctgtttctgatactcatggagaagactctccatactttgcaggatggaaagcttatgatgaaaacccttatcatgagtcaagcaacccatctggagtcatacaaatgggacttgcggaaaatcaagtttcgtttgatctgttggaaaagcacttggaagaaaattcagaagcctccaactggggttcaaagggatcaaaaggagcgtctggctttagagaaaatgccttatttcaagactaccatggccttttgtctttcagaaaggcaatggcaaattttatggaacaaattagaggaggaagagccaaatttgaccctgttagggtagtcttaacggcaggtgcaactgcagcaaatgagctactgactttcatcatagctgatcccggtgatgctttgcttgttccaaccccatattatccagggtttgatagagatttgaggtggaggactggtgtgaacattgtgccaattcactgtgaaagctcaaacaacttccagattactcctcaagctttagaagctgcatacaaagaggcagaagccaagaacatgagagtgagaggggtactaatcacaaatccatcaaacccacttggtgcaacaatccaaagggcagtccttgaagagattcttgatttcgtcacccaaaaaaacatccatcttgtctctgatgaaatctactcgggatctgccttctcatcctccgaattcattagtgtggcagaaattattgaagacaggcagtacaaggatgcagaaagagttcacattgtttatagtctatccaaagatcttggccttccaggctttcgagttggcactgtgtactcttacaatgacaaggttgtgacaacagcaagaagaatgtctagcttcaccttgatatcttctcaaacacaacatctcttggcttccatgttatctgacaaggaattcactggaaactacataaagacaaatagaaagagactgaggacgagatatgatatgatcatcgagggtttgaaaaaatcggggatcgagtgtttgaaaggaaatgctgggttgttttgctggatgaatttaagtccatttttggacgaaccaacaagagaatgtgaactgactctttgggattccatgctgcatgaagtgaagctaaatatatctccaggttcttcttgtcattgctctgagccaggctggtttagggtgtgctttgccaacatgagtgagcagacacttgggattgcattaacaagaatacataatttcatggaaaagagagagcgggcttgctagaattaagtttcttctcttttatcttctatttttcagtggaccatcttttattcttttggaggacaaaacccaatttactctttctgaattgtaacaattccatcttgttttcttgcttgaaaaagcaagtttttacacaatcagtttgtataatcgatggatataatatttgttttggcgttctaaaaaaaaaaaaaaaaaaaaa

SEQ ID NO: 33984 - protein, 446 aa, Malus domestica (apple tree)
MAIDIEQRQQPSPGLSKIAVSDTHGEDSPYFAGWKAYDENPYHESSNPSGVIQMGLAENQVSFDLLEKHLEENSEASNWGSKGSKGASGFRENALFQDYHGLLSFRKAMANFMEQIRGGRAKFDPVRVVLTAGATAANELLTFIIADPGDALLVPTPYYPGFDRDLRWRTGVNIVPIHCESSNNFQITPQALEAAYKEAEAKNMRVRGVLITNPSNPLGATIQRAVLEEILDFVTQKNIHLVSDEIYSGSAFSSSEFISVAEIIEDRQYKDAERVHIVYSLSKDLGLPGFRVGTVYSYNDKVVTTARRMSSFTLISSQTQHLLASMLSDKEFTGNYIKTNRKRLRTRYDMIIEGLKKSGIECLKGNAGLFCWMNLSPFLDEPTRECELTLWDSMLHEVKLNISPGSSCHCSEPGWFRVCFANMSEQTLGIALTRIHNFMEKRERAC

SEQ ID NO: 33985 - DNA, 1209 bp, Streptomyces coelicolor
  CDS (1)..(1209)
atggagttccggcagtcgaacaagctcagcgaggtctgttacgagatccgcggcccggtcatcgagcacgccaacgcgctggaggaggcggggcacagcgtgctgcgcctgaacaccggcaaccccgccctcttcgggttcgaggcgcccgaggagatcgtccaggacatgatccgcatgctgccgagggcgcacggctacacggactcgcgcggcatcctctccgcccgccgggccgtcgcccagcgctaccaggcgctcggcctggaggtggacgtggacgacgtcttcctgggcaacggcgtctcggagctgatctccatggccgtgcaggccctccttgaggacggcgacgaggtgctgatccccgcccccgacttccccctctggacggcggtgaccaccctcgcgggcggcaaggcggtgcactacctctgcgacgagcaggccgagtggtaccccgacctggccgacatggaggcgaagatcaccgaccgcaccaaggcggtcgtcatcatcaaccccaacaaccccaccggcgccgtctaccccaaggagatcgtcgagggcatcctcgacctcgcccgccggcacggcctgatggtcctcgccgacgagatctacgaccagatcctgtacgacgacgccgtgcaccactcggccgcgtccctcgcccccgacctggtggtgctgaccttctgcggcctgtccaagacgtaccgggtggcgggtttccgctccggctggctggtggtgacggggccgaagcagcacgcgagggactacctggagggcctgaccatgctggcctccatgcgcctgtgcgccaacgcgcccgcccagtacgccatccaggccgcgctcggcggccgccagtccatccgcgagctgacggcccccggcggacggctgcacgagcagcgggacgtcgcctgggagaagctcaacgagatccccggcatctcctgcgtcaagcccaagggcgcgctgtacgccttcccgcgcatcgacccggccgtccacaagatccacgacgacgagcgcttcgtcctggacctgctgctgcgggagaagatccaggtggtgcaggggacgggcttcaactggccctcccccgaccacttccgcatcctgaccctgccgcacgcggaggacctggaggccgcgatcggacgcatcgggcgcttcctgagcgggtaccggcagtag

SEQ ID NO: 33986 - protein, 402 aa, Streptomyces coelicolor
MEFRQSNKLSEVCYEIRGPVIEHANALEEAGHSVLRLNTGNPALFGFEAPEEIVQDMIRMLPRAHGYTDSRGILSARRAVAQRYQALGLEVDVDDVFLGNGVSELISMAVQALLEDGDEVLIPAPDFPLWTAVTTLAGGKAVHYLCDEQAEWYPDLADMEAKITDRTKAVVIINPNNPTGAVYPKEIVEGILDLARRHGLMVLADEIYDQILYDDAVHHSAASLAPDLVVLTFCGLSKTYRVAGFRSGWLVVTGPKQHARDYLEGLTMLASMRLCANAPAQYAIQAALGGRQSIRELTAPGGRLHEQRDVAWEKLNEIPGISCVKPKGALYAFPRIDPAVHKIHDDERFVLDLLLREKIQVVQGTGFNWPSPDHFRILTLPHAEDLEAAIGRIGRFLSGYRQ

SEQ ID NO: 33987 - DNA, 1518 bp, Schizosaccharomyces pombe
  CDS (1)..(1518)
atgtttacagattatccaaatgatattaactgtgagtctccaagaatgtcggaccttgatggattttgtcaaaatgcgttctcagaccttaattctttgaatcaacaagtatttaaggcaaattacgccgtccgtggagctttagccattcttgcggacgagatccaagatgatttacttgaaaatccttcttcatatcctttcagtgagatcgtctatgcaaacatcggtaatcctcagcagatgggacagtctcctattacattcgttcgacaggttttatctctttgccagtaccctaccttgttagaccatgctgaggaaaagtggtttcaaaatttgttccctacggatgtcgtacaacgatccaaaatgctcttaaaggaatctggaagtttgggtgcctatagtgcttctcaaggtattccgcttgtaaggcgacatgttgcggatttcattagagcgagagatggatttgattgcgagccatctgacatatatttgactagtggtgcctcacacgctgcccggcttataatgactttgataatcgctaggccaacagatggtgtaatggttcccgctcctcaatatcctttgtacggtgcccaaattgatctcatgagtggatctatggtatcttacagcctctccgaggaaaataattgggacattgattttgaccaatttaaaaaatcatttgatgaagcatctaaaaaaggtatcaacgttcgtttatgcgtggttattaatcccggtaatcctactggagcttgcatttctgaaaatagcatggaaaaagttttgcgctttgctaaggcaaagggcatagtattgcttgccgacgaagtctatcaaaacaatatttaccaaaacaagtttcattcttttaggagaaaacttggtgaattaagagaaaaggaacccgacaatcattgggaccaagtttcgcttatttccgtaaattctgttagcaaaggtcaatttggtgaatgtggtcaaagaggtggatatttggacgttgttaatattccagagcccgctaaggatcaaatcctcaaactagctaccattgacatttgtccaccagttgctggtcaattattagtagacatgctagtaaatcctcctaaacctggtgatcccagttatgatttgttcatcaaagaagttgatgagattcatgaagcactgcgtttacaatgccgtcagctctacgagggaacaaagcgcatgaagagagtttcatgtttagaaccccacggggccatgtatttgcatcccagcgtctcacttcccgaaaagttaatcactacagccaaagctcagaaaattcaacctgacgaattctatgcgatagaattgcttaagcgttcaggtatatgtgttgttcctggaagtggatttgggcaaccagaaggtgattatcatattcgaatcacgtttttggctaaaggaactgaatacattgaacgatttgtcaaagctcataatgaaataatggacctctatgaataa

SEQ ID NO: 33988 - protein, 505 aa, Schizosaccharomyces pombe
MFTDYPNDINCESPRMSDLDGFCQNAFSDLNSLNQQVFKANYAVRGALAILADEIQDDLLENPSSYPFSEIVYANIGNPQQMGQSPITFVRQVLSLCQYPTLLDHAEEKWFQNLFPTDVVQRSKMLLKESGSLGAYSASQGIPLVRRHVADFIRARDGFDCEPSDIYLTSGASHAARLIMTLIIARPTDGVMVPAPQYPLYGAQIDLMSGSMVSYSLSEENNWDIDFDQFKKSFDEASKKGINVRLCVVINPGNPTGACISENSMEKVLRFAKAKGIVLLADEVYQNNIYQNKFHSFRRKLGELREKEPDNHWDQVSLISVNSVSKGQFGECGQRGGYLDVVNIPEPAKDQILKLATIDICPPVAGQLLVDMLVNPPKPGDPSYDLFIKEVDEIHEALRLQCRQLYEGTKRMKRVSCLEPHGAMYLHPSVSLPEKLITTAKAQKIQPDEFYAIELLKRSGICVVPGSGFGQPEGDYHIRITFLAKGTEYIERFVKAHNEIMDLYE

SEQ ID NO: 33989 - DNA, 2127 bp, Homo sapiens
  CDS (94)..(1665): n means a or g or c or t/u
cgccggggccgggtagctgctccaggcgcgcgagctaaccgagtgcggcgagggcctaccaggggcgacagggtttctctccgcaagcgcgcgatgcagcgggcggcgacgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactytgcctcgggcctcgcagaggccgctggtcacttygtcatcattttgcccctggagacgtctttctttgtgccttgatgttgagagcgcctctcttttgagcaaacaagcattctatatgcaaccagagtagaggggacctgctcagncaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcccccccatgatctgtgaaataaagcccttagcggtgaaaaaaaaaaaaaaaaaaaaaaarrcg

SEQ ID NO: 33990 - protein, 523 aa, Homo sapiens
MQRAATLVRRGCGPRTPSSWGRSQSSAAAEASAVLKVRPERSRRERILTLESMNPQVKAVEYAVRGPIVLKAGEIELELQRGIKKPFTEVIRANIGDAQAMGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 33991 - DNA, 1365 bp, Rattus norvegicus
  CDS (1)..(1365)
atggactcctacgtgattcagacggatgtcgacgacagcttgtcctcagttctggatgtgcgtgtcaatgttggtgggagaaactcggtacaaggaagaaagaaaggcaggaaggccagatgggacgtgagaccctctgacatgtccaataagaccttcaatcccatccgagccatcgtggacaacatgaaggtgcagcccaatccgaacaagaccgtgatttctctgtcaattggggaccctactgtgtttgggaacctgcctacagaccctgaagttacccaagccatgaaagatgccctggactcggggaagtacaatggctatgccccgtccatcggctacctatccagtcgggaggaggtcgcttcttactaccactgtcatgaggctcctctggaagctaaggatgtcattctgacaagcggctgcagtcaggccattgagctatgtctagctgtgttggccaatcctggacaaaacatcctcattccaaggcccgggttttccctctataggactttggctgagtctatgggaattgaggtcaagctctacaatctcctgcccgagaagtcttgggaaattgacctaaaacaactggaatctctgatcgatgaaaaaacagcgtgtcttgttgtcaacaacccatccaatccctgtggctccgtgttcagtaagcggcaccttcagaagattttggcagtggctgaaaggcagtgtgtccccatcttagctgacgagatctatggtgacatggtgttttcagactgcaaatacgaaccactggccaacctcagcaccaatgttcccatcctgtcctgtggtgggctggccaagcgctggctggttcctggctggaggttgggctggatcctcattcatgatcgaagagacatttttggcaatgagattcgagacgggctggtgaaactgagtcagcggatcctgggaccatgcaccatagtccagggtgctctgaagagcatccttcagcgaacccctcaggagttctatcacgacacgttaagcttcctcaagtccaatgcggacctctgctatggggcactggctgccatccctggactccagccggtccgcccttctggagccatgtaccttatggtgggaattgagatggagcatctcccggaattcgagaacgacgtggagttcacagagcggttgattgcggagcaggctgtccactgtctcccagcaacgtgcttcgagtacccaaatttcttccgagtggtcatcacagtccccgaggtgatgatgctggaggcttgtagccggatccaggagttctgtgaacagcactaccactgtgctgaaggcagccaggaggagtgtgacaaataa

SEQ ID NO: 33992 - protein, 454 aa, Rattus norvegicus
MDSYVIQTDVDDSLSSVLDVRVNVGGRNSVQGRKKGRKARWDVRPSDMSNKTFNPIRAIVDNMKVQPNPNKTVISLSIGDPTVFGNLPTDPEVTQAMKDALDSGKYNGYAPSIGYLSSREEVASYYHCHEAPLEAKDVILTSGCSQAIELCLAVLANPGQNILIPRPGFSLYRTLAESMGIEVKLYNLLPEKSWEIDLKQLESLIDEKTACLVVNNPSNPCGSVFSKRHLQKILAVAERQCVPILADEIYGDMVFSDCKYEPLANLSTNVPILSCGGLAKRWLVPGWRLGWILIHDRRDIFGNEIRDGLVKLSQRILGPCTIVQGALKSILQRTPQEFYHDTLSFLKSNADLCYGALAAIPGLQPVRPSGAMYLMVGIEMEHLPEFENDVEFTERLIAEQAVHCLPATCFEYPNFFRVVITVPEVMMLEACSRIQEFCEQHYHCAEGSQEECDK

SEQ ID NO: 33993 - DNA, 1515 bp, Caenorhabditis elegans
  CDS (1)..(1515)
atgcgaaccgtacaagcaatttccggactcgtcacaagtcgctttttcggcacatccactagaatcatggctagcggaaagactttgaacacctccaacatcaatccaaatgttatcaagatggagtatgctgttcgtggaccaatcgtgatccgtgccgtggagcttgaaaaagagcttgcgaccggtgctcagaagccattcccaaatgtcatcaaggctaatattggagatgctcatgctatgggtcaaaagccgattactttcattcgccagctcctcgcgtgtattgtcaacccagagatcatgaaaacggacaaatcaattccatctgatgttatcgaacatgcaaatgcattccttggaagttgtggaggaaaatccgctggagcatacagtcagagtacgggagtggaaattgtacgaaaacacgtggcagagtatattaagagacgtgatggaggaattccatgcaattcagaagatgtctgcttgtctggaggagcttctgaatcaatccgaaatgttctcaaactttttatcaatcataacaacgcaaagaaagtcggagtcatgattccaattccacaatatccactctattctgccactatcgaagaattcggacttggacaagttggatactatttgagtgaatcgtctaattggtccatggatgaagctgaacttgaaagatctttcaatgatcactgcaaagaatacgatattcgagttttgtgtatcatcaatccaggaaatcctaccggacaagcactttctcgtgaaaatattgagactatcatcaagtttgcacaaaagaagaacctgttccttatggctgatgaggtttatcaagacaacgtctacgctcaaggatcgcaattccattcattcaagaaggttcttgtggagatgggagagccatacaataaaatggaattggcttctttccattcggtatccaaaggatacatgggagaatgcggaatgcgtggaggatatgttgaattcttgaatctcgacccagaagtgtatgtccttttcaaaaaaatgatctctgccaaattgtgctccacagtactcggacaagccgtcattgatgccgttgtgaatccaccaaaggaaggagatgcatcgtatgctctgtggaaacaagaaaaggatgcagtacttgcttctcttaaggaacgtgctacactcgtcgagaaggcatacagtagcattgatggaatcagctgtaatccagttcaaggagccatgtacgctttcccgcaaatcacgattccacagagagctgttgaaaaagctcagtctttgaaccaacaacctgatttcttctatgctatgcaacttcttgagaccaccggaatctgtatcgtgccaggaagtggatttggacaaaaagacggaacttatcatttcagaacgacaattcttccacagccagaactcttcaaagacatgctctcccggttcactgatttccaccaaaaattccttgccgaatacaagtag

SEQ ID NO: 33994 - protein, 504 aa, Caenorhabditis elegans
MRTVQAISGLVTSRFFGTSTRIMASGKTLNTSNINPNVIKMEYAVRGPIVIRAVELEKELATGAQKPFPNVIKANIGDAHAMGQKPITFIRQLLACIVNPEIMKTDKSIPSDVIEHANAFLGSCGGKSAGAYSQSTGVEIVRKHVAEYIKRRDGGIPCNSEDVCLSGGASESIRNVLKLFINHNNAKKVGVMIPIPQYPLYSATIEEFGLGQVGYYLSESSNWSMDEAELERSFNDHCKEYDIRVLCIINPGNPTGQALSRENIETIIKFAQKKNLFLMADEVYQDNVYAQGSQFHSFKKVLVEMGEPYNKMELASFHSVSKGYMGECGMRGGYVEFLNLDPEVYVLFKKMISAKLCSTVLGQAVIDAVVNPPKEGDASYALWKQEKDAVLASLKERATLVEKAYSSIDGISCNPVQGAMYAFPQITIPQRAVEKAQSLNQQPDFFYAMQLLETTGICIVPGSGFGQKDGTYHFRTTILPQPELFKDMLSRFTDFHQKFLAEYK

SEQ ID NO: 33995 - DNA, 1449 bp, Zea mays
  CDS (1)..(1449)
atggccgccagcgtcaccgtggaaaacctcaaccccaaggtcttaaaatgtgagtatgcagtccgtggggagattgtcatccatgctcagcgccgccagcaacaactacaaacacaaccagggtctcttccttttgatgagatcctctattgcaatattgggaatccccaatctcttggtcagcaacctgtgacattcttcagggaggttcttgctctttgtgatcatccgtgcctcttggaaaaagaggaaaccaaatcattgttcagtgctgatgctatttctcgagcaaagcagattcttgcaactattcctggaagggcaacaggtgcatatagtcacagtcagggtatcaaaggactgcgtgatgcaattgctgctggaatcatgtcacgtgatggattccctgcaaatgcagatgacattttcattacagacggagcaagtcctggggtccacatgatgatgcaattactgattaggaatgagaaagatggcattctgtgcccaattccccagtaccctttgtactcagcctccatagctcttcatggtgggactcttgtcccctattaccttaatgaaaaaaatgggtggggtttggagatttctgattttaagacgcgactggaagatgttcggtcaaaaggcattgatgttagggccctggtggttatcaatccaggaaatccgactgggcaggttcttgctgaagacaaccaatatgatatagtgaaattctgcaaaaatgagggccttgttcttctagctgatgaggtatatcaagagaacatctatgtggacaacaagaaatttaactctttcaagaagattgtaagatccatggggtatggcgaggatgatctccctctagtatcgttacagtctgtttccaaaggatactatggagagtgtggtaaaagaggagggtacatggagattactggcttcagtgctccagtaagagagcagatctacaagatagcttcagtgaacttgtgctccaatatcactggtcaaatccttgcgagcctcgtcatgaatccaccaaaggctggggacgaatcatatgcttcctacaaggcagagaaggatggaatccttgagtctttagctcgtcgtgcaaaggcgttggaggatgcattcaacaagcttgagggattttcatgtaacaaggccgaaggagcaatgtatcttttccctcagattcatctgccacagaaggcaatcgaggctgctaaagctgctaagaaagcgcctgacgctttctacgctctccgtctccttgaatcaactggaatcgtcgtggtccctggatctggatttggtcaagttcctggaacatggcacatcagatgcacgatcctgccgcaggaagacaagatccccgcggtgatcagccgcttcagggctttccatgaggcgttcttggccgagtaccgcgactaa

SEQ ID NO: 33996 - protein, 482 aa, Zea mays
MAASVTVENLNPKVLKCEYAVRGEIVIHAQRRQQQLQTQPGSLPFDEILYCNIGNPQSLGQQPVTFFREVLALCDHPCLLEKEETKSLFSADAISRAKQILATIPGRATGAYSHSQGIKGLRDAIAAGIMSRDGFPANADDIFITDGASPGVHMMMQLLIRNEKDGILCPIPQYPLYSASIALHGGTLVPYYLNEKNGWGLEISDFKTRLEDVRSKGIDVRALVVINPGNPTGQVLAEDNQYDIVKFCKNEGLVLLADEVYQENIYVDNKKFNSFKKIVRSMGYGEDDLPLVSLQSVSKGYYGECGKRGGYMEITGFSAPVREQIYKIASVNLCSNITGQILASLVMNPPKAGDESYASYKAEKDGILESLARRAKALEDAFNKLEGFSCNKAEGAMYLFPQIHLPQKAIEAAKAAKKAPDAFYALRLLESTGIVVVPGSGFGQVPGTWHIRCTILPQEDKIPAVISRFRAFHEAFLAEYRD

SEQ ID NO: 33997 - DNA, 1209 bp, Streptomyces anulatus
  CDS (1)..(1209)
atggagttccggcagtcgagcaagctcagcgaggtctgttacgagatccggggccccgtcatcgagcacgccaacgccctggaggaggcgggccacagcgtcctgcgcctcaacaccggcaaccccgcgctcttcggcttcgaggcgcccgaggagatcgtccaggacatgatccggatgcttccgcaggcgcacggctacacggactcgcgcggcgtcctgtccgcccgccgcgccgtcgcccagcgctatcaggcgctcggcctcgacgaggtctcggtggacgacgtcttcctcggcaacggcgtgtccgagctggtcacgatggcggtccaggcgctcctggaggacggcgacgaaatcctcatccccgcgcccgacttcccgctgtggaccgcggtgacgaccctctccggaggcaaggccgtccactacgtctgcgacgaggcggcggactggtaccccgacctcgacgacatggcctcgaagatcaccgaccagaccaaggccgtcgagatcatcaaccccacgggcgcggtctatccgaaggagatcctggagggcatcctcgatctcgcgcggcggcacggcctgatggtcttcgccgacgagatctacgaccagatcctgtacgacgacgccgtgcaccacagcgtggccgccctcgccccggatctcgtggtcctcaccttctgcggtctttcgaagacgtaccgcgtggcgggtttccgttcgggctggctggtcatcaccggcccgcggcagcacgcgcgcgactacctggaggggctgacgatgctcgcctccatgcgcctgtgccccaacgcgcccgcgcagttcgccatccaggccgcgctcggcggccgccagtcgatccgtgaactgaccgcgcccggcggggcgttgcacgagcagcgggaccgggcctgggagaagctgaacgagatccccggcgtctcctgcgtcaagccgaagggcgcgctgtacgccttcccgcgcctggacccgaaggtccatccgatccacgacgacgagaagttcgtgctggacctcctgctccaggagaagatccaggtggtccagggcaccggcttcaactggccccgccccgaccacttccgcatcctcaccctcccccacgccgacgatctcgacgcggcgatcagccgcatcggccgcttcctgagcggctaccgccagggccgctga

SEQ ID NO: 33998 - protein, 402 aa, Streptomyces anulatus
MEFRQSSKLSEVCYEIRGPVIEHANALEEAGHSVLRLNTGNPALFGFEAPEEIVQDMIRMLPQAHGYTDSRGVLSARRAVAQRYQALGLDEVSVDDVFLGNGVSELVTMAVQALLEDGDEILIPAPDFPLWTAVTTLSGGKAVHYVCDEAADWYPDLDDMASKITDQTKAVEIINPTGAVYPKEILEGILDLARRHGLMVFADEIYDQILYDDAVHHSVAALAPDLVVLTFCGLSKTYRVAGFRSGWLVITGPRQHARDYLEGLTMLASMRLCPNAPAQFAIQAALGGRQSIRELTAPGGALHEQRDRAWEKLNEIPGVSCVKPKGALYAFPRLDPKVHPIHDDEKFVLDLLLQEKIQVVQGTGFNWPRPDHFRILTLPHADDLDAAISRIGRFLSGYRQGR

SEQ ID NO: 33999 - DNA, 1323 bp, Methanococcus voltae
  CDS (1)..(1323)
atgagaaacaatattgtaaacaagggaactgaagaactatcttacgaaattaggggaattgttgcagtagcggaaagagcccaaaaattaggcaaaaaaataatctgggaaaatattggggaccctatcgcaaaaggggaacaaatgcccgaatggattaaagaaatagtttcagaaagtactttagaaaataaaacatatggttactgccctactcagggtttattagaaacacgtgaatttttagcagatttaaacaatagtaaaaatggagctcagattacatccgacgatatgatatttttcaatggcttaggggatgctataactaatatttatggattaatgagaaaagaatgtagggtaattggccctactccagcatactccacacattcatctgcagaaggtttatactcaaatagttcacctgtgatgtacagtttggataaagataatttatggtatcccgatttggatgatttggaaaataaggtaaaatataatccttcggttagtggtatattattaataaatcccggcaatcccacaggtgcagtatattctaagaaagtattaagtgatattgtagatatagctaacgaatacgacgtatttatattatgtgacgaaatttaccaaaatttagtttacaatggtaaaaagcatgttagcctttcagaagtaatagacgatgtttgcggaatttcaatgaaaggtatttctaaagatttaccatggcctggctcccgttgtggctggacagaattttataataaagataaagacccagtattcaaaaaatacgttgaaaatatcggtaaattcaaaatgatagaagtatgttcaactacattacctcaaacgattatacctaaggtaatgggcgataaaaggtttgaaaaatctttgggtgaacgtaaaaaatactacgaaaaagcttcaaattacgcatataagacaattaataaagtcgaaggtgtttcagtaaatcttacaaatggagcattttatggagctttaacctttgacgatggtgttttaaatgacaaacagcatttaaaaatggataatgaattagacacgtatataaatggagttttagaccagtgtggacaacattccttagttgaaaaagacaagagatttgtctaccagttattgggtgcttcaggtatttgtatggtaccattgacgtctttctgttcaaaacatgagggattaagatttacactacttgaaaaagatgaaaatttaatgaaatggacatttaaaactttaagtgaaaaaatagacgagtacctcaatagttcagctaactaa

SEQ ID NO: 34000 - protein, 440 aa, Methanococcus voltae
MRNNIVNKGTEELSYEIRGIVAVAERAQKLGKKIIWENIGDPIAKGEQMPEWIKEIVSESTLENKTYGYCPTQGLLETREFLADLNNSKNGAQITSDDMIFFNGLGDAITNIYGLMRKECRVIGPTPAYSTHSSAEGLYSNSSPVMYSLDKDNLWYPDLDDLENKVKYNPSVSGILLINPGNPTGAVYSKKVLSDIVDIANEYDVFILCDEIYQNLVYNGKKHVSLSEVIDDVCGISMKGISKDLPWPGSRCGWTEFYNKDKDPVFKKYVENIGKFKMIEVCSTTLPQTIIPKVMGDKRFEKSLGERKKYYEKASNYAYKTINKVEGVSVNLTNGAFYGALTFDDGVLNDKQHLKMDNELDTYINGVLDQCGQHSLVEKDKRFVYQLLGASGICMVPLTSFCSKHEGLRFTLLEKDENLMKWTFKTLSEKIDEYLNSSAN

SEQ ID NO: 34001 - DNA, 1922 bp, Oryza sativa
  CDS (97)..(1557)
gtgcagcatcagcaggcagcagcagcagcttcctcctcctcctcctcatcttcaccgacgacaccgcacgctccgcttgctcgtctcgccggcgccatgtcgtacaaccattcgccgtccatcaccgcagagaccataaaccagaaggtcaggatcttcacctacgagccatgtggggagattgtccgccacgcacggcggttagagaaggagatatacgaaaatccaggctctctcccttttcaagagataatatactgcaatcttgggaaccctcaggctcttggccaacgaccaatcaatttctttcgcgaggttctttctctgtgtgacaatccatctctcatagacagagacgaagctcgtgcattattcagtccatgtgcgctaaaacgagccaggaagattattgaatcacttccaggcagagattctggttcctatactagtagtcagggagtcagaggtttgcgtgaagcagttgctgatggaatagctgccagagatggttttccatcaaaaccagataacatttttctgacagatggagcaagttcagcaatcaacatgatgatgcaaatactcatcaggtcccatgaagatggcattttgtgcccgctgcctgaatatcccttatactctgcttctattattcttcatggtggaacaatggtaccgtataatcttactgaagacagtatttgggggcttgagattttcgaagtcaagaggtgtttagaggacgcccgtgcatcgggtttgactattagagctatggtggtcataaatcccggcaatcctactggccaggtactgtctataaccaaccaggaggagattgtggaattctgtaggaaagaagggttggttattcttgctgatgaggtataccaagaaaatgtctatacagagaataagaggttcaattccttcaaaaaggtggccagatcacttggttatgatcaccatgacctctctatagtgtcatttcactcggtctctatgggatactatggagaatgtggtagaaggggaggctacatggagatttgtggttttggagatgatgtgatcgatgagatgtacaagttggcttctctaactatttgtcccaacatagctggccaaatccttatcagccttgttatggatccacctaagctaggggatgaggcttttgagattttcatggtcgagaaggaagagacttattcatctctactcaagcgcgcaaaggctttgcagaaagcgttcaacggtttggaaggcgtgtcgtgtaacaagttcgagggagccatgtacctcttcccacggctgcgcctgccacaggcggcgatcaaagcggcgcagctggagggcgtctcccccgacgtgttctacgcgcaccgcctgctcgacgccacggggatcgccgtcgtcccaggctctggatttcacccagtctccgggacatcgcacatccggtgcaccatcctccccggcgaggagacgatcacggcgatggttcccagcctccaggcgttccatgaggcgttcatggacgagtttcgcggctgatcgattgagcttcgtgaagcaacagaatttggcagatcacaagatcggcagctgtgccatgccttgagttacacaggagatacagctagcggagctgttgcttgtcgtctggcttgcttagcttcctgtttgtgtaatgtccatcggtccattggactccatgcatgtgtgccgtattataactgcaagtgcgttttagttatgcgcctatatgcaaaactcgtggaattggtgttagtgtttgatcagtttgttactatgatgtaaggagttatcagactacgatctagtactgtatggctgtaataatcaagtaatcaactaccccttgagggacaagtcctatttgtattgtattacacctt

SEQ ID NO: 34002 - protein, 486 aa, Oryza sativa
MSYNHSPSITAETINQKVRIFTYEPCGEIVRHARRLEKEIYENPGSLPFQEIIYCNLGNPQALGQRPINFFREVLSLCDNPSLIDRDEARALFSPCALKRARKIIESLPGRDSGSYTSSQGVRGLREAVADGIAARDGFPSKPDNIFLTDGASSAINMMMQILIRSHEDGILCPLPEYPLYSASIILHGGTMVPYNLTEDSIWGLEIFEVKRCLEDARASGLTIRAMVVINPGNPTGQVLSITNQEEIVEFCRKEGLVILADEVYQENVYTENKRFNSFKKVARSLGYDHHDLSIVSFHSVSMGYYGECGRRGGYMEICGFGDDVIDEMYKLASLTICPNIAGQILISLVMDPPKLGDEAFEIFMVEKEETYSSLLKRAKALQKAFNGLEGVSCNKFEGAMYLFPRLRLPQAAIKAAQLEGVSPDVFYAHRLLDATGIAVVPGSGFHPVSGTSHIRCTILPGEETITAMVPSLQAFHEAFMDEFRG

SEQ ID NO: 34003 - DNA, 1338 bp, Desulfotalea psychrophila
  CDS (1)..(1338)
atgcctttaaggaaaaaacagtggggggaagatatgagaactgatattgttcacataggtgcgggtgagctcacctatgaaattagaaatattgtggaggttggtcagcgtctgcaacgacttggggtggaggtcaattgggaaaatatcggtgatcccatcgccaagggagaggaggttccgtcctggatgaaggctcttgtggccgaggccgtgcaggatgatgccagctatggctactctcccaccaagggtgtgctggcaacccgtcggtttatcgccgcagagaccaataagaagggtgctgttcagattagcgccgaggatattatcttttttaatggacttggtgatgcgatttcaaagatatttggttttctcaagcgcactgcccgggtgctggtgccgaccccgagctataccactcactcttcggccgaggccgcccattccggtgataaacctctgacctataagcttgaccctcataatgactggtatcccgacattgccgatatagagcggcgggtgaagtataatcccatggtggccggaattctgatcatcaaccccgataatcccactggtgctgtttatccggtggagatccttagggccattgttgatattgcccgtcgctatgacctgtttctgatctgtgacgaggtctatcaaaacatcatctataacggtaaaaaaacggcaagccttgccgaggttatcggcgaggtgcccggctttgccatgcgcggtgcctcaaaggagatgccctggccgggtgcccgctgtggctggatagaggtctataatgccgatcgcgatcccatgtttcagcgctatatcgattcgatcttcaacgccaagatgcttgaggtctgctcgaccaccctgccccagattgtctaccccagggtggtaacccatgccgaataccctggctatctgcagagtcggatagcgcgttatcagagattttccaaaattgcctacgattgcttaaaagatatcgaaggtatcctggtcaatcaggcaaatggcgcattttatatgagtgtctgttttgaggacggtgttcttaacagcggccagagcctggctattgccagagatgaggtccggaccatggtcgaagatctggtcttctctgccgatactgcccttgataagaggtttgtctactatctgttgggcgccaccggtgtctgtgtggtccctctgacctcctttgcctcggatatcaacggctttcgagtgaccctgcttgaacgcgacgaggccgagttcatccgtatttttacggtcatagccgccgcaatcagaacctatttaaaaagttag

SEQ ID NO: 34004 - protein, 445 aa, Desulfotalea psychrophila
MPLRKKQWGEDMRTDIVHIGAGELTYEIRNIVEVGQRLQRLGVEVNWENIGDPIAKGEEVPSWMKALVAEAVQDDASYGYSPTKGVLATRRFIAAETNKKGAVQISAEDIIFFNGLGDAISKIFGFLKRTARVLVPTPSYTTHSSAEAAHSGDKPLTYKLDPHNDWYPDIADIERRVKYNPMVAGILIINPDNPTGAVYPVEILRAIVDIARRYDLFLICDEVYQNIIYNGKKTASLAEVIGEVPGFAMRGASKEMPWPGARCGWIEVYNADRDPMFQRYIDSIFNAKMLEVCSTTLPQIVYPRVVTHAEYPGYLQSRIARYQRFSKIAYDCLKDIEGILVNQANGAFYMSVCFEDGVLNSGQSLAIARDEVRTMVEDLVFSADTALDKRFVYYLLGATGVCVVPLTSFASDINGFRVTLLERDEAEFIRIFTVIAAAIRTYLKS

SEQ ID NO: 34005 - DNA, 1470 bp, Debaryomyces hansenii CBS767
  CDS (1)..(1470)
atgtttaaaaggtttgtatcatttaaggcagctggtaagttgaagctagcagatttgaacaagctgacaataaatgcaaaatatgctgtcagaggaaagattcctattagagccgacgagctcaaagaacagttgaacgacacgaacaatgagttgccgtttaaggagattatttatgctaatattggtaatccacaacaattggaccaggctccattgacatggtacagacaggtgttatcagttttgcaaaaccctaagttattgaattcccagattgattatccgaaggacgtgattgatagagctaagattttattggagaatgtgggatcggtgggtgcctattcccattcacaggggactccacatgtcagaaaatcagttgcagatttcatcacaagaagagatggattccctagtaactcatcggacatctttttgaccagtggtgcttccgccgccgtgtcttatttattgcaggttttatcgagtagtgatcgctcagggtttttgattcccatcccccagtatccgttatacactgctactattgccttgaatgatgccgttccaattggatactatttgaacgaagaaaacaattggtctaccaaccctactcaaattagagagttgatcaaagaaaacaacgagaagggtattcaaatcaaagcgttggttgttattaacccgggtaatcctactggctctatcttgtcgtatgataatatagttgagatcattaatattgctgctgaacatggaattgctattattgcagatgaagtataccaggaaaatgtatttgaaggagagtttgtttcggtgaagaaggttttatcgaagttgaataggcttgatcctcaagcctacaataatgtgcaattggcttcattacattctacatcgaagggggtgagtggcgaatgtggacaaagaggcggatatatggagttagttggattttcaaaggaagtgagagatataatttttaaattggcctcaattaacttatgctctgttgtttctggacaaaccttaatggagctaatgattaatcccccaactccagaatccccatcgtatgagttatacaaatctgaaacttccaagatccacaaatctttacagtcaagagccgacttgttatataaatctttcattgaaatggaaggtataacttgtaataaacctatgggtgccatgtatctattccctaagttgaattttaccccaaattcatattcaaaattatttgaggcttctgaaaacattggtgctacaatagatgaagtatattgtattgaattattagaaaacactggtatttgttgtatccctggttcaggatttggtcaagtaccagatacgtaccatttaaggactacattcttaccgccagggtcgaaatggattgatagatgggttgaatttcataatgattttatagcgaagtacaaaaactga

SEQ ID NO: 34006 - protein, 489 aa, Debaryomyces hansenii CBS767
MFKRFVSFKAAGKLKLADLNKLTINAKYAVRGKIPIRADELKEQLNDTNNELPFKEIIYANIGNPQQLDQAPLTWYRQVLSVLQNPKLLNSQIDYPKDVIDRAKILLENVGSVGAYSHSQGTPHVRKSVADFITRRDGFPSNSSDIFLTSGASAAVSYLLQVLSSSDRSGFLIPIPQYPLYTATIALNDAVPIGYYLNEENNWSTNPTQIRELIKENNEKGIQIKALVVINPGNPTGSILSYDNIVEIINIAAEHGIAIIADEVYQENVFEGEFVSVKKVLSKLNRLDPQAYNNVQLASLHSTSKGVSGECGQRGGYMELVGFSKEVRDIIFKLASINLCSVVSGQTLMELMINPPTPESPSYELYKSETSKIHKSLQSRADLLYKSFIEMEGITCNKPMGAMYLFPKLNFTPNSYSKLFEASENIGATIDEVYCIELLENTGICCIPGSGFGQVPDTYHLRTTFLPPGSKWIDRWVEFHNDFIAKYKN

SEQ ID NO: 34007 - DNA, 1491 bp, Yarrowia lipolytica CLIB99
  CDS (1)..(1491)
atgctgagacagggtataaagcgtgcggtggtgcatgcccgagccgtacaggccgtgtgcaaacgaaccaacatgaccatcaccaaaaaagatctcaacccccaggtggtcaacgcccagtatgccgtgcgaggcaagttggcggtgcgggccgacgaaatcaaggagcagatgcgaaccaacccgtcgctgttcccctttgacaaggtcatcaacgccaacattggcaacccccagcagctcgaccagaagcccgtcactttctaccgccaggtcctggctatgctgcagtaccccgagttgatggatcgggccgccgacgtgggcatccccaacgacgcagtgcagcgtgctcgaaagctgctggacgacattggatcggtcggcgcctactcgtcgtcccagggcgtcaccaccgtgcgaaattcggtggctaacttcatccaaaagcgagacggctacgcagcctcggcctccgacatctacctcaccacaggagcctccaacgccgtcacttttctgctcacaactttggctcgaggcgacggatcggacggattcatgatccccattccccagtatcccctttacaccgccaccctgaccctgcagaactccaaccccgtcccctactacctggacgaagccaaggagtggggcaccaacatggctgctctcaacgacgccgtcgagtcctccaagcacaagctcaaggccgtcgtggtcatcaaccccggaaaccccaccggagcttgtctcggcgtcaaggaaatcaaggacattctgctgctggcacagaaggagggcattgccgtgatcgccgacgaggtctaccaggccaacatttttgcctctggccagttccactccttcaaaaaggtctggtccattctcaaggaggagaaccccgacttcaacgtgcccctggcatctctgcattccacctccaagggcaagatcggagagtgtggccagcgaggaggctacatggagctcgttggtttccatgaggacgtgattgagcagatctacaagctctgttccatctctctgtgtcccgttgtcaccggacaggctcttattgagtgtatggtcaacccccccgttgagggagacgaatcgtaccctctgttcaacaaggaaaccaaccacattatggatactctcacccagcgagccaaccggctgtacgaggccttcaaggagatgcccaaggtctcctgcgagcctccccagggcgccatgtacctgttcccctccatcgagctgcctgctggcgccattgccgaggccgagcgacacaacgagcagcccgacgagttttactgcatgaagctgctggagcagactggtatctgtgttattcctggctctggatttggccagaaggatggcacttaccatttccgaacaaccttcctcgcacctggtgatgactacggagagaagattgtcaacttccacaagaagtttttggctcagtacgagtaa

SEQ ID NO: 34008 - protein, 496 aa, Yarrowia lipolytica CLIB99
MLRQGIKRAVVHARAVQAVCKRTNMTITKKDLNPQVVNAQYAVRGKLAVRADEIKEQMRTNPSLFPFDKVINANIGNPQQLDQKPVTFYRQVLAMLQYPELMDRAADVGIPNDAVQRARKLLDDIGSVGAYSSSQGVTTVRNSVANFIQKRDGYAASASDIYLTTGASNAVTFLLTTLARGDGSDGFMIPIPQYPLYTATLTLQNSNPVPYYLDEAKEWGTNMAALNDAVESSKHKLKAVVVINPGNPTGACLGVKEIKDILLLAQKEGIAVIADEVYQANIFASGQFHSFKKVWSILKEENPDFNVPLASLHSTSKGKIGECGQRGGYMELVGFHEDVIEQIYKLCSISLCPVVTGQALIECMVNPPVEGDESYPLFNKETNHIMDTLTQRANRLYEAFKEMPKVSCEPPQGAMYLFPSIELPAGAIAEAERHNEQPDEFYCMKLLEQTGICVIPGSGFGQKDGTYHFRTTFLAPGDDYGEKIVNFHKKFLAQYE

SEQ ID NO: 34009 - DNA, 1587 bp, Kluyveromyces lactis NRRL Y
  CDS (1)..(1587)
atgttgtctgtcagagttaacttgaagaccaggatcagttctggcatgattagagtcaatgctccagctttgaaaagtacaatgccttctgtaacaagtttaacccaattgcgtttttctactactgtgaaaccagctccaaagctttcgctagatgatgttaatgaaaatgttttgaaggctaagtacgctgttagaggtagaattccaatgagggctgaggaattgagagatcagttgaaaaaggatccaagttctttacccttctctaagattatcagtgccaacatcggtaaccctcaacaattggaccaaaaacctttgactttttacagagaagtattatctctattgcaacatccagaactgctagaagaagctgatgaggctttacaaactctatataagactgactccattaagcgtgccaaaagacttttgtctgaggttggtggatccgtcggtgcttactctcaatcacagggtgttcaaggaattcgagaaaccgttgcagacttcattacgaagagagatgacggtgaaatatcttacccagaagatatttacctcactgctggtgcatctgcagcagtttcttacattctctccattctatgcaagggcccaaatactggcgtattaatacctatcccacaatacccgttgtacacagcatctttggctctaaataactctaggcctttaccatactacttgagagaagaacaaaattggtccactgacccagaagaaattgaacaagtcgtgctggatgcaattcagaagggaattaaacccacctgtctagttgttattaatccaggtaacccaactggtgccatcctttcagaacagtccattcaaaagatcttcgaagtcgctgccaagtacggtattgtcgtcatcgctgatgaagtgtatcaagaaaacgtattcaaaggctctaaattctactcaatgaaaaaagttttgagaaacttgcaaaagacttatcatggacaatacgacaacattcaattagcttctctacactctacttccaaaggtgtctcgggtgaatgtggtcaaagaggtggttatatggaattggtcggattcaatcatgatatcagacaggtattcttaaaattggcttctatttctttatgtcccgtggttaccggtcaagccttggtggacttaatggtatctccacctcaaccaggtgatgaatcttacgaacaagatcaacaggaacgtgaagatattcatgacgcattggacgaacgtgcctctaaacttttcgaaacattctctagattggaaggtattgaatgccgtaaacctcaaggtgccatgtacctatatccaaaactcgatcttccttataaagttatccaggaagctcagcatcttgaaatggaacctgatgaattttattgtaaagcattactagaaaacactggtatttgcaccgttccaggatctggtttcggacaagtcccaggtacttatcacttaagaaccacattcctaccaccagggaccgaatgggtagaaacatgggaaaaattccacaaggccttctttgacaagtaccgtgattag

SEQ ID NO: 34010 - protein, 528 aa, Kluyveromyces lactis NRRL Y
MLSVRVNLKTRISSGMIRVNAPALKSTMPSVTSLTQLRFSTTVKPAPKLSLDDVNENVLKAKYAVRGRIPMRAEELRDQLKKDPSSLPFSKIISANIGNPQQLDQKPLTFYREVLSLLQHPELLEEADEALQTLYKTDSIKRAKRLLSEVGGSVGAYSQSQGVQGIRETVADFITKRDDGEISYPEDIYLTAGASAAVSYILSILCKGPNTGVLIPIPQYPLYTASLALNNSRPLPYYLREEQNWSTDPEEIEQVVLDAIQKGIKPTCLVVINPGNPTGAILSEQSIQKIFEVAAKYGIVVIADEVYQENVFKGSKFYSMKKVLRNLQKTYHGQYDNIQLASLHSTSKGVSGECGQRGGYMELVGFNHDIRQVFLKLASISLCPVVTGQALVDLMVSPPQPGDESYEQDQQEREDIHDALDERASKLFETFSRLEGIECRKPQGAMYLYPKLDLPYKVIQEAQHLEMEPDEFYCKALLENTGICTVPGSGFGQVPGTYHLRTTFLPPGTEWVETWEKFHKAFFDKYRD

SEQ ID NO: 34011 - DNA, 1215 bp, Erwinia carotovora
  CDS (1)..(1215)
atgtctccgattgaaaaatccaaaaaactggagaacgtatgctatgacatccgtggcccagtcttaaaggaagccaagcggcttgaagaagaaggtaataaagtccttaaactgaatattggcaaccctgcccctttcggcttcgaggcaccggacgaaattctggtcgatgtcatccgtaacctgcctactgcacagggctactgtgattccaaggggctctattccgcccgtaaggctatcgttcagcactatcaggcgcgcgatatgcgcgatatgacggttgaagacgtctatattggtaacggtgtttctgaactcatcgtgcaatccatgcaggcgctactcaatccgggtgatgaaatgctggttcccgcaccggattatccactctggactgcggcggtttccctgtctaacggcaatgccgttcactatctctgcgatgagtcctccgattggttccccgatctggatgatatccgcaaaaaaatcacgtccaatactcgcggtattgtcatcatcaacccgaataatccgacgggagcggtctacagcaaagagttgctgctggatatcgtggctatcgcgcgtgaacacagcctgatcattttcgccgacgaaatttacgacaaaattctgtatgacgatgcgcagcaccactctattgctgcgttagcgccggatctgctgacagtcacgttcaacgggctgtccaaaacatatcgtgtggcggggttccgtcaaggctggatggtactgaacggcccgaaaaagcacgcaaaagggtacattgaagggctggaaatgctggcgtccatgcgtttgtgtgccaacgtgccaatgcagcatgcgattcagaccgccttgggtggctaccaaagcatcagcgaatttattcaacccggtggacgtctgtatgaacagcgcaatcgttcatgggaattgatcaatcagatccccggtgtatcgtgcgtaaaaccacgcggcgcgctctatatgttcccgcgtattgatgccaaacgctttaatatccacgacgaccaaaagctggtgctggatctcctgttacaggaaaaagtgttactggttcagggaaccgcatttaactggccttacccggatcatgtacgtatcgtcacgctgccgcgtattgatgaactggacatggcaatccacaaattagggcgcttcctaggacactatcaccaataa

SEQ ID NO: 34012 - protein, 404 aa, Erwinia carotovora
MSPIEKSKKLENVCYDIRGPVLKEAKRLEEEGNKVLKLNIGNPAPFGFEAPDEILVDVIRNLPTAQGYCDSKGLYSARKAIVQHYQARDMRDMTVEDVYIGNGVSELIVQSMQALLNPGDEMLVPAPDYPLWTAAVSLSNGNAVHYLCDESSDWFPDLDDIRKKITSNTRGIVIINPNNPTGAVYSKELLLDIVAIAREHSLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRNRSWELINQIPGVSCVKPRGALYMFPRIDAKRFNIHDDQKLVLDLLLQEKVLLVQGTAFNWPYPDHVRIVTLPRIDELDMAIHKLGRFLGHYHQ

SEQ ID NO: 34013 - DNA, 1459 bp, Lycopersicon esculentum
  CDS (1)..(1458)
atgggatttgagattgcaaagaccaactcaatcttatcaaaattggctactaatgaagagcatggcgaaaactcgccatattttgatgggtggaaagcatacgatagtgatcctttccaccctctaaaaaaccccaacggagttatccaaatgggtcttgctgaaaatcagctttgtttagacttgatagaagattggattaagagaaacccaaaaggttcaatttgttctgaaggaatcaaatcattcaaggccattgccaactttcaagattatcatggcttgcctgaattcagaaaagcgattgcgaaatttatggagaaaacaagaggaggaagagttagatttgatccagaaagagttgttatggctggtggtgccactggggctaatgagacaattatattttgtttggctgatcctggcgatgcatttttagtaccttcaccatactacccagcatttaacagagatttaagatggagaactggagtacaacttattccaattcactgtgagagctccaataatttcaaaattacttcaaaagcagtaaaagaagcatatgaaaatgcacaaaaatcaaacatcaaagtaaaaggtttgattttgaccaatccatcaaatccattgggcaccactttggacaaagacacactgaaaagtgtcttgagtttcaccaaccaacacaacatccaccttgtttgtgacgaaatctacgcagccactgtctttgacacgcctcaattcgtcagtatagctgaaatcctcgatgaacaggaaatgacttactgcaacaaagatttagttcacatcgtctacagtctttcaaaagacatggggttaccaggatttagagtcggaatcatatattcttttaacgacgatgtcgttaattgtgctagaaaaatgtcgagtttcggtttagtatctacacaaacgcaatattttttagcggcaatgctatcggacgaaaaattcgtcgataattttctaagagaaagcgcgatgaggttaggtaaaaggcacaaacattttactaatggacttgaagtagtgggaattaaatgcttgaaaaataatgcggggcttttttgttggatggatttgcgtccacttttaagggaatcgactttcgatagcgaaatgtcgttatggagagttattataaacgatgttaagcttaacgtctcgcctggatcttcgtttgaatgtcaagagccagggtggttccgagtttgttttgcaaatatggatgatggaacggttgatattgcgctcgcgaggattcggaggttcgtaggtgttgagaaaagtggagataaatcgagttcgatggaacagaagcaacaatggaagaagaataatttgagacttagtttttcgaaaagaatgtatgatgaaagtgttttgtcaccactttcgtcacctattcctccctcaccattagttcgttaag

SEQ ID NO: 34014 - protein, 485 aa, Lycopersicon esculentum
MGFEIAKTNSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEKSGDKSSSMEQKQQWKKNNLRLSFSKRMYDESVLSPLSSPIPPSPLVR

SEQ ID NO: 34015 - DNA, 1431 bp, Acinetobacter sp
  CDS (1)..(1431)
atgtcgcagaaaaaaagcgttatttttaaaaacctactccctgtgattaaacaatatcaacaggctggattcacgcatgaaaaaattgttgctttactcaaagaccaacatgatcttgatcttgtaacaactgaaacatttaaaagctatttatatcgttatgcaaaagtgacccccactccatccgagagcctcaaaatgacgaacacaattcaaaccccacgagaaattaaaaaatcttctaagctcgagcatgtatgctacgacattcgtggacctgtgttacgagcggccaatgaaatggaagaacaaggtcataaaattattaaacttaatattggcaaccctgcgccatttggtttcgaagcacctcaagaaattattaatgatgtcgcattaaatctacctaacgcgattggttacactgactccaaaggtatcttccctgcacgtaaagccatttgccagtattatcagcaaaaaggtattcgcgatatgcacgtcaatgatgtgtatgttggaaacggggtatccgaactgattgtcatggccatgcaaggtttgctaaatgatggcgatgaaatgctggttccaatgccagattatccactctggacagcagcagtaaatttatctggtggtacagcaattcactataaatgtgatgaagaaaatagctggtatccagatattgtcgatatggaaagcaaaataacgcctaatactcgtggtattgtggtgattaatccaaataatccaacaggttcggtttatccaagacacgtgctccagcaaattgtagctttagctaaaaagcacgatctgattttatttgccgatgaaatctatgacaagattatttacgatggaattgaacacgtagcacttgcctctcttgcaggcgatcaactctgtatttcctttaatggtttatcaaaatcttatcgtgttgcaggttatcgttcaggctggatggcgattacaggtgataaatcacgtgctaaagattacatcgaaggtctggatatgctggcatccatgcgcctatgtgccaaccatcaagcacaatatgcgattcaaacggctttaggcggttatcagtcgattaatgacttgattcgtccaagcggacgtttatacgagcaacgcaatattgcatgggaaatgcttaatgaaatacacggcgtcagttgtgtaaaacctgagggtgccatgtattgctttccaaaactagatccgaatatttatcaggtcgaggatgatgaacagttgatgctggatttcttacgtgcagagaaagtgcttctggtacaaggaacaggatttaactggccaacgcatgatcacttccgcttggtcttcttaccagcagagaatgagcttcgagaagcaattacacgattatcacgctttctcgcaacgcgccgttaa

SEQ ID NO: 34016 - protein, 476 aa, Acinetobacter sp
MSQKKSVIFKNLLPVIKQYQQAGFTHEKIVALLKDQHDLDLVTTETFKSYLYRYAKVTPTPSESLKMTNTIQTPREIKKSSKLEHVCYDIRGPVLRAANEMEEQGHKIIKLNIGNPAPFGFEAPQEIINDVALNLPNAIGYTDSKGIFPARKAICQYYQQKGIRDMHVNDVYVGNGVSELIVMAMQGLLNDGDEMLVPMPDYPLWTAAVNLSGGTAIHYKCDEENSWYPDIVDMESKITPNTRGIVVINPNNPTGSVYPRHVLQQIVALAKKHDLILFADEIYDKIIYDGIEHVALASLAGDQLCISFNGLSKSYRVAGYRSGWMAITGDKSRAKDYIEGLDMLASMRLCANHQAQYAIQTALGGYQSINDLIRPSGRLYEQRNIAWEMLNEIHGVSCVKPEGAMYCFPKLDPNIYQVEDDEQLMLDFLRAEKVLLVQGTGFNWPTHDHFRLVFLPAENELREAITRLSRFLATRR

SEQ ID NO: 34017 - DNA, 1725 bp, Candida glabrata CBS138
  CDS (1)..(1725)
atgttacgtagtactacatcgaaatcactatcgaaaatgccacatgctataccaccacaatgccgtcgttctcactcgagttcgatattccagactaagaagaggctcgcccacttggagtccgatagaccttacctgacccacctgcctcgctccatgaactcaagtcccaacttgagattccactcctctgcttcgtcttcctcgctgaggtcgtctttcctaaacacggaaatacaccaccatagccacaacaacctgcctttcttgcctgccgagcaagctactttgaaagacgtgaacgagtgcgtcctgaacgccaagtacgctgtgcgcggtgccatccctatgcgtgccgaggagctgaaaacacagctgatggaaaacccgcactctttgcccttcaacgacattattaacgccaacatcggtaacccacagcagctgaaacagaagccactgagcttctacagacaggtattgtccctgctgcagtaccctgagctgatccccacgctggagaacaatccccagaccatgatcaagcaagacgccatcgacagagccaagaggctcctggacgacattggcgggtccgtcggtgcttactcctcttcacagggtgtcctcggcatcaggaaaaccgtcgctgacttcatcacaaacagggacgacggtatcattgcttaccccgaagacatattcttgaccgcgggtgcttctagcgccgtagactacttgctgtccatcttctgcagaggcgaggagacaggtgtgctgatcccaatcccacagtatccactttacacagccactctggccctgcaaaactctcacgccctgccatactacctgaacgaagaaacaggctggtccaccgaccctgaggaactagagtccatcatcttagactccatcgagaacaacatcaaaccaagcgttcttgtagttatcaacccaggtaaccctacaggtgccgtgctatccgaagaggctatcgaacagatattcacattggccgccaagtacggtataatcgtcatcgcagatgaagtctaccaggaaaacgtcttcgaagacgtaaagttccattcaatgaagaaagtcttgagacaactgcaaatgaaacaaccaggcctctacgacaacgtccaattggcctccttacattccacctctaagggtgtctccggtgagtgtggccaaagaggtggttacatggaactagttggtttcactcacgatatcagacaagtagtcctaaaattggcttctatctccttgtgtccagtggtgacaggtcaagcccttgttgatttaatggtttgtcctcctcagaagggcgaagaatcttacgaacaggatcaagaagaacgtagaaacattcacaaggaattgcacaagagagctactctattgcacgacgcttttgtcaaattagatggtatctcttgtcaaaagccacaaggtgccatgtacttgttcccaaaacttgagctaccttacaaggctatccaagaggcccttcaccaggacatgagcccagatgaattttattgtaagtcattgttggagaagactggtatctgtaccgtgcctggttccggttttggccaggagccaggtacttaccatttgagaactactttcttggctccaggaaccaaatggatcgaagactgggttgatttccaccaagagttctacaacaagtttaagaactga

SEQ ID NO: 34018 - protein, 574 aa, Candida glabrata CBS138
MLRSTTSKSLSKMPHAIPPQCRRSHSSSIFQTKKRLAHLESDRPYLTHLPRSMNSSPNLRFHSSASSSSLRSSFLNTEIHHHSHNNLPFLPAEQATLKDVNECVLNAKYAVRGAIPMRAEELKTQLMENPHSLPFNDIINANIGNPQQLKQKPLSFYRQVLSLLQYPELIPTLENNPQTMIKQDAIDRAKRLLDDIGGSVGAYSSSQGVLGIRKTVADFITNRDDGIIAYPEDIFLTAGASSAVDYLLSIFCRGEETGVLIPIPQYPLYTATLALQNSHALPYYLNEETGWSTDPEELESIILDSIENNIKPSVLVVINPGNPTGAVLSEEAIEQIFTLAAKYGIIVIADEVYQENVFEDVKFHSMKKVLRQLQMKQPGLYDNVQLASLHSTSKGVSGECGQRGGYMELVGFTHDIRQVVLKLASISLCPVVTGQALVDLMVCPPQKGEESYEQDQEERRNIHKELHKRATLLHDAFVKLDGISCQKPQGAMYLFPKLELPYKAIQEALHQDMSPDEFYCKSLLEKTGICTVPGSGFGQEPGTYHLRTTFLAPGTKWIEDWVDFHQEFYNKFKN

SEQ ID NO: 34019 - DNA, 1155 bp, Staphylococcus aureus
  CDS (1)..(1155)
atgaaactttctttaaactctaattctaaatttttaagagcaccaagtattcgccaattttcaaatcgtatgaataatttggatgattgtgttaatttaactattggccaaccagacttccctatgcctgatgttgtgaaaaaggcatatatagatgctattaacaatgacaagacatcttactctcacaataaaggcttattagaaactcgcgaagctattagtcaatacttcaaaaatcgttatcatttttcctatgatcctgaagaaattattgtgacaaatggagcaagtgaagcaatagacacaacgttacgttctatcatagagcctggagatgaaattataataccgggaccaatttatgcaggctacataccactcatcgaagtactaggtggtaaaccaatttatattgatacaacagcaacacaattcaaaattacacctgatgcgttagaaagtcatatttctccaaagacaaaagctgtcttgttaaattatccgactaatccaactggcgtagttttaaaaagaaatgaagttttaaatatcgtaaatgtattaaaaaaatatccgatatttattattagcgatgagatttatgctgaaaatacatttagtggtaaacatgtatccttcgctgaatttgaagacattcgtgatcaattaatattaattggtggtttaagtaaatcacactcagcaacaggaataagaattggttttctattaggacctcaatatttgattgataaattaacatttatgcacgcctataattgtatttgtgccaatgttccagctcaaatagcatgtataacagcacttaacgaaggattagaagctcctaaatatatgaatgaagcttatgtagaacgaagaaattatttagtatctgaattaactaaattaggttttgagattaccgctcaacctgaaggcgcgttttatattttcccaaatattaagcatatcaccgatgacgatttcgaattttgtgtcgatttacttgaatcaacacatttagcaatcgttccaggctcatcctttacagaattcggtaaaggatttgtgaggatttcctatgcttatgaaatggatgttttaaaagaaggtatgaagagacttgctaaatatttaaatactaaataa

SEQ ID NO: 34020 - protein, 384 aa, Staphylococcus aureus
MKLSLNSNSKFLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPIFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPNIKHITDDDFEFCVDLLESTHLAIVPGSSFTEFGKGFVRISYAYEMDVLKEGMKRLAKYLNTK

SEQ ID NO: 34021 - DNA, 2976 bp, Xenopus laevis
  CDS (140)..(1762)
cacaaactgccggcgtcagatctccccaagtgcccccaggacctgccacatcttctcttttacatttggcttctaggggaccctcgtggctctcgagacccttttctctcttttattttccaattggagcatctgggacatgagtattctcagggggtctctgaggggggtgctggcccccaatgcttctgttgtgtttaggagcagattgcccccccagctcacttctgccctcctgtgccccctcaggtcgctgtcgggaacgccgctggctgaaccggacgggaaagttactcgcaagatgtctgagaacgggacatgcaaccggatcctgactctggactccatgaatccctgtatccagaaagtggaatacgcagtgaggggccccatcgtcatcagggctgtggagctggagaaagaactgcagcagggggtaaagaagccattcacagaagtgatcaaagccaatattggagatgcccatgcaatgggtcagaaacccgttactttcctgcgccaggtgagtgccatctgtctgtaccccgagctcatgaatgacaacaagttcccggaggacgtgaagcagaaggcagcgaggatcctgcaggcgtgtggcgggcacagcattggggcctacagcgccagccaagggattgaagtgatccgacaagatgtggccaagtacattgagagaagggatgggggtatcctgtccgaccccaacaacatctacctctccacgggggccagtgactctattgtgacaatgctgaagttgctggtgtctgggcaagggaaatcccgaactggggtgatgatcccgatccctcaatacccgctgtattctgcggccctggcagagttggatgccgtgcaggttaattattatctggatgaggagaactgctgggccctggacatcaacgagctgcggagagcactagcggaggcccgaaaacattgtgaccccaaagtactgtgcattattaacccaggaaaccctacagggcaggtgcagagccgcaagtgcattgaggacgtgatccgttttgctgctgaagagaatcttttcctgatggcggatgaggtctaccaagataatgtctatgccaagggctgtgcctttcactccttcaaaaaggttctctttgagatgggacccaagtattcagaaacgctggaactggcttctttccactccacatccaagggatacatgggagagtgcgggttcagagggggttacatggaagtgatcaatatggatcctgctgtcaagcaacaactaaccaagttggtgtctgtgcgtctgtgccccccagtgccggggcaagtattacttgatgtgattgtgaacccaccaaagcctggggagccctcctacaaacagttcatttctgagaaacaggctgtgctcaataacctggctgagaaagctcgtctcactgaggaaatcctaaaccaagcgcctgggatccgctgtaacccagtccagggagccatgtactcgtttccaaggatccacatcccagagaaggccattaaacttgcacaggctgagggacaggccccagacatgttcttctgtatgaagctgctggaagagactggcatttgtgtggtacctggaagtggatttggacaacgtgagggcactcaccatttcaggatgaccatcctccctcccaccgataagctgaagagcctgttagagcggctgaaggatttccaccagaaatttatggatgagtattcctaggatgccacaatggcgcagaccatctgcttccatatcctaatcttgactgttgactagtagtacatgcataaccctcagatttgccccagtgctttttacctcctgctttccaccctcagacttgagctactcaaccccaaccctggagaagccttcactgactcccaagtaaactcacggttgactcccctactagacaagaacttgaggagtaggcccacaatcgtgcctcacagtattccctaattatcaacagatcagtatccagttacaactacacatgcacctttttatgtttttatctcaatttagcacttttgttggaatccaaagccaaaatgtgaatgagctccgtgttttcttacactaatgactgagccccagtaaggaggcccctaataaccactggatgcattttgtgatttcccagcctggtgccccattcacatctctacttgacctgcctcttctatagggccctgccggctggtagacagagagaggtaaatctgctttttagggtgtcatgtgggggtatacagtgggcttagtgtgtaccccttgtgttgcttaatctcttgctttacagactaatccagattaacgtaacattatgggagttttacattcaggcccttggttggctgagttctataggccttattccagatgccctgcagaagtctctaagtgccctttctaaatatggacttgcctgatcttgtgcccaggaggccacctcaaagccccgaacgctgctcagaattgtataataatctgaattcatggaaggtcctatgcaatgcctcaactggtgaagtggaatccctgcgcttgctcctattctccggaggccgccatcttggatgcagaataaagtgcaggatgcaatttgcatttctatcagaacatcacaaacacacaaggactcgcactataacaggttctgattgcacctgcccatacccatttgcttttataccaattggaaaaagaatgcaaagatctgattggttgctatgggcaactgcactgaagtattggctgtagggtcatccttggcggctgttgccagatcagctgagcttctagccaagatgtcgagtagccaaattactggccagtcctgttcagcattttaatatacgtaaagggctaaaattcatgtttttaatatgaatcaataaagattgtttggaaaaaaaaaaaaaaaa

SEQ ID NO: 34022 - protein, 540 aa, Xenopus laevis
MSILRGSLRGVLAPNASVVFRSRLPPQLTSALLCPLRSLSGTPLAEPDGKVTRKMSENGTCNRILTLDSMNPCIQKVEYAVRGPIVIRAVELEKELQQGVKKPFTEVIKANIGDAHAMGQKPVTFLRQVSAICLYPELMNDNKFPEDVKQKAARILQACGGHSIGAYSASQGIEVIRQDVAKYIERRDGGILSDPNNIYLSTGASDSIVTMLKLLVSGQGKSRTGVMIPIPQYPLYSAALAELDAVQVNYYLDEENCWALDINELRRALAEARKHCDPKVLCIINPGNPTGQVQSRKCIEDVIRFAAEENLFLMADEVYQDNVYAKGCAFHSFKKVLFEMGPKYSETLELASFHSTSKGYMGECGFRGGYMEVINMDPAVKQQLTKLVSVRLCPPVPGQVLLDVIVNPPKPGEPSYKQFISEKQAVLNNLAEKARLTEEILNQAPGIRCNPVQGAMYSFPRIHIPEKAIKLAQAEGQAPDMFFCMKLLEETGICVVPGSGFGQREGTHHFRMTILPPTDKLKSLLERLKDFHQKFMDEYS

SEQ ID NO: 34023 - DNA, 1191 bp, Bacillus thuringiensis
  CDS (1)..(1191)
atgaagcaatttgaactatctagagcagcagaatctctacaaccatctggtattcgaaagtttttcgatttagcagcaaatatgaaaggtgttatttctcttggggtaggagagcctgattttgttacaccttggaatgtgaggcaagcatgtattcgttctatagaacaaggatatacgtcatatacagcaaatgcaggattattggagctccgtcaagaaatagcaaagtatctaaaaaaacaatttgcagtatcttatgatccaaacgatgaaatcattgttacagttggagcgagtcaggcgttagatgtagcgatgcgcgccattataaatcctgatgatgaagtacttattattgaaccaagctttgtttcttatgcaccgctcgtaactttagctggaggggttccagttcctgtggcgactactttagaaaatgagtttaaagtacaaccagaacaaattgaagcagctattacagcgaaaacgaaggcaattttactttgttcaccaaataacccaacaggtgcaatgttgaataagtccgagcttgaagaaatagcagtgattgttgagaagtacaatttaatcgtattatctgatgaaatttacgcagagcttgtatacgacgaagcatatacaagtttcgcgagtattaaaaatatgcgtgagcatacgattttaatttcaggattttcaaaaggatttgcgatgacagggtggcgccttggtatgattgcagctcccgtttatttttcggaattaatgctcaaaattcaccaatattccatgatgtgtgcaccgacgatgtctcagtttgcagcacttgaagcgttacgcgcggggaatgatgaagtaattcggatgagagatagttataagaaacgccgtaattttatgacgacatctttcaatgaaatgggattaacatgtcatgtgccgggcggagcattttatgtctttccttctatttcttcaactggactatcttcggcggaatttgcagaacagttattattagaagaaaaagtggctgttgtacctggaagtgtatttggcgaaagtggtgaaggatttattcgttgttcgtatgcaacatcgcttgaacaacttatggaagcaatgaagagaatggaacggttcgtagagaataaaaaaaggacaaaacacaatacgttttgtccataa

SEQ ID NO: 34024 - protein, 396 aa, Bacillus thuringiensis
MKQFELSRAAESLQPSGIRKFFDLAANMKGVISLGVGEPDFVTPWNVRQACIRSIEQGYTSYTANAGLLELRQEIAKYLKKQFAVSYDPNDEIIVTVGASQALDVAMRAIINPDDEVLIIEPSFVSYAPLVTLAGGVPVPVATTLENEFKVQPEQIEAAITAKTKAILLCSPNNPTGAMLNKSELEEIAVIVEKYNLIVLSDEIYAELVYDEAYTSFASIKNMREHTILISGFSKGFAMTGWRLGMIAAPVYFSELMLKIHQYSMMCAPTMSQFAALEALRAGNDEVIRMRDSYKKRRNFMTTSFNEMGLTCHVPGGAFYVFPSISSTGLSSAEFAEQLLLEEKVAVVPGSVFGESGEGFIRCSYATSLEQLMEAMKRMERFVENKKRTKHNTFCP

SEQ ID NO: 34025 - DNA, 1188 bp, Bacillus thuringiensis
  CDS (1)..(1188)
atgaaattagcaaagcgagtagctgctttaacaccatctgcaactttagaaattacagcaaaggcacaagcattaaaagcagaaggtcatgatgtaattggattaggagcaggagagcctgactttaatacgccagaacatattatggatgctgcacataaagcgatgttagaaggacatacgaagtatacaccaacaggtggattacaagcgttaaaacaagagattgtgaagaagtttactcgcgatcaaggaattgcgtatgatccgtccgaaattattgtatgtaacggtgcaaagcatgcattatatacattattccaggtgttacttgatgaaggagatgaagttatcatcccaacgccttactgggtaagttatcctgagcaagtaaaactcgctggaggtaagccagtttatgtagaaggtctggaaggcaatgagtacaaaattacagcagagcagctgcgtgaggcaattacagagaaaacgaaagcagttattattaattcaccgagcaatccaacaggaatgatttacagcaaagaagaattacaacagcttggagaagtatgtttagaacatgatatcttaatcgtttcagatgaaatttatgaaaaattaatttatggtggagcagaatatacttcaattgcccagctttctaatgcattaaaagaacaaacacttattattaatggtgtatctaaatctcattctatgacaggatggcgtattggatatgcagcaggaaataagcagcttattaaagcgatgacgaacttagcgagtcatagtacgtcaaaccctacttcaatcgctcaatacggcgcaatcgcggcatatgcaggctcacaagaacctgttgaaacaatgcgtcaagcatttgaagaaagattaaacattatttatgataaattaattcaaatccctggctttacttgcattaaaccacaaggtgcattttatttattcccgaatgtaaaagaagctgtagcgttatcaggatacgaaacggttgatgaatgggcaaaagctttattagaagaggaaaaagtggctcttgtaccaggtacaggatttggtgcaccaaataacgttcgtttatcatatgcgacatctcttgaacaagtagagaaagcattagaacgcattcatacgtttatgaaaagtaaagtgcaagcttaa

SEQ ID NO: 34026 - protein, 395 aa, Bacillus thuringiensis
MKLAKRVAALTPSATLEITAKAQALKAEGHDVIGLGAGEPDFNTPEHIMDAAHKAMLEGHTKYTPTGGLQALKQEIVKKFTRDQGIAYDPSEIIVCNGAKHALYTLFQVLLDEGDEVIIPTPYWVSYPEQVKLAGGKPVYVEGLEGNEYKITAEQLREAITEKTKAVIINSPSNPTGMIYSKEELQQLGEVCLEHDILIVSDEIYEKLIYGGAEYTSIAQLSNALKEQTLIINGVSKSHSMTGWRIGYAAGNKQLIKAMTNLASHSTSNPTSIAQYGAIAAYAGSQEPVETMRQAFEERLNIIYDKLIQIPGFTCIKPQGAFYLFPNVKEAVALSGYETVDEWAKALLEEEKVALVPGTGFGAPNNVRLSYATSLEQVEKALERIHTFMKSKVQA

SEQ ID NO: 34027 - DNA, 2349 bp, Sparus aurata
  CDS (99)..(1763)
gagttccactcctgtcgagtgaagcaaccggcgtgtggtgtgtgtgttcgctgtgcaccgcggaggctttaaaagtcacccaactcgccgtgttaaacatgtcggctacaaggatgcagctgctgtcacccagaaacgtccggcttctgagccgcgggcgaagcgagttgttcgccggtggtagcggcggtggtcccagggtccgctcactgatttctccccctctgtcctcctcctctcccggcagagctttatcgagtgtgagcgcgacgcggcgcgggctccccaaagagaagatgaccgagaatggtgtgtcgtcccgggccaaggtgttgaccatcgacaccatgaaccccacggtgaagaaggtggagtacgcggtgcgggggcccatcgtgcagcgggctatggagctggagaaggagctctctgagggaatgaagaaacccttcgccgaggtcatcaaggccaacatcggggatgcgcacgctatgggccagcagccaatcactttcttccgacaggtcctggcgctctgctcctaccctgaactgctgaatgacagcacattccccgaggatgctaaaagtagagcgcgccgcattctgcagtcctgcggagggaacagcatgggttcctacagcgccagccagggcatagactctgtgcgtcacgatgtggcccggtacactgagcgaagagatggcggtgtgccctgcgacccagacaacatttatctcaccacaggggccagcgacggcattgtgaccatgctgaagctgctggtgtgtggcgaaggtgccacccgcaccggcatcatgatttccatacctcagtatcccttgtactcggctgcactggcagaactgggcgccgtgcagatcaactattaccttaatgaacaaaagtgctggagcctggacatcagcgagctgcagcgctctctggacgaggcccggcaacactgcaacccccgagccctttgcatcatcaaccctgggaaccccaccggtcaggttcagagcagacaatgcatcgaggatgtaattcgatttgcggcaaaggaacgtctcttcctcatggccgatgaggtgtaccaggataacgtgtatgctgagggttgccagtttcactcttttaagaaggtcctgtttgaaatggggcccgagtactcaaacacagtggagctggtatctttccactccacctccaaatgttacatgggagagtgtggcttccgtggaggctacatggagatcatcaacttggacagtgaggtgaaggcccagctgacaaagctggtgtctgtccgcctgtgtcctcccgttcctggtcaggctctaatggacctggtggtcaacccgccgcagcctggggaaccctcacatgaaaagttcattaaggagcgcacaacaaccttatgtgccttagcagagaaggccaagctaactgagcaggttctcaatactgtgcagggcatcagctgcaatcctgtgcagggtgctatgtactccttcccttgcataaccatccctgaaaaggctataaaagaggccacggacaacggccagaagccggatatgttttactgcatgaagttgctggaggagactgggatctgcctcgtacctgggagcggcttcggacagagggatggaacctaccacttcagaatgaccatcttgccgccaaaagacaagctgaagatcctgctgaccaaagtcaaggagttccaccagaagttcactcagcagtattcttaaatgtccacatctccttccgttcacaaagggagaaactaaccagcagaatcaacagcaacaaagaactcagccaatcataatgatgtagtcgatgataagtgcctttcctttgacggctctggtggtctctgtgacgacgcacttcagcctctacagatatctcatttggacatttgcagggcggaaaacaagacactgttatgtgttagacaacaaaactggagatgaagaaattaactcgtgtgtcagcttggtacgagaaatgtggtgtgtgtgtgtgtgtgtgtgtgtgtgtgtgtgtgtgtgtgtgtgtgtgtgtgtggtttcagctttgaaggatgtacagtaagtacagtcagtgtatttgtatatgagagactgtccatgagaacgccaagctagaaaaacagtaaaggacaagtgatgctgcttacaaactcgagcacaactggttaaagtgttccattcctacaggcagtgcttgacagggagaatacgcaggaaaatgttccatttgcatgatgattcggagatgattttgtagattaaaaaaatggaacagtcaaaaaaaaaaaaaaaaaaaaaa

SEQ ID NO: 34028 - protein, 554 aa, Sparus aurata
MSATRMQLLSPRNVRLLSRGRSELFAGGSGGGPRVRSLISPPLSSSSPGRALSSVSATRRGLPKEKMTENGVSSRAKVLTIDTMNPTVKKVEYAVRGPIVQRAMELEKELSEGMKKPFAEVIKANIGDAHAMGQQPITFFRQVLALCSYPELLNDSTFPEDAKSRARRILQSCGGNSMGSYSASQGIDSVRHDVARYTERRDGGVPCDPDNIYLTTGASDGIVTMLKLLVCGEGATRTGIMISIPQYPLYSAALAELGAVQINYYLNEQKCWSLDISELQRSLDEARQHCNPRALCIINPGNPTGQVQSRQCIEDVIRFAAKERLFLMADEVYQDNVYAEGCQFHSFKKVLFEMGPEYSNTVELVSFHSTSKCYMGECGFRGGYMEIINLDSEVKAQLTKLVSVRLCPPVPGQALMDLVVNPPQPGEPSHEKFIKERTTTLCALAEKAKLTEQVLNTVQGISCNPVQGAMYSFPCITIPEKAIKEATDNGQKPDMFYCMKLLEETGICLVPGSGFGQRDGTYHFRMTILPPKDKLKILLTKVKEFHQKFTQQYS

SEQ ID NO: 34029 - DNA, 2018 bp, Sparus aurata
  CDS (112)..(1587)
gacaactgtcagtgaagacgacaaacagcacgcgagcctagtgagcaactgatatcagtccagagggtgacagcggcggaaaacaacaacaacaacaacaacaaaaacaacatgtcccaccaggcggcgaacggggtcccgtgccggggcaaggtgctcactgtggacaacatgaaccccagagtgaagaaggtcgagtacgcggttcgtggtcccgtagtccagcgagcggtgcagatagagaaggagctgagggagggagtcaagaaacctttcacagaagtcatcaaggctaacataggcgatgctcacgccatgggccagaaaccaatcacatttttcagacaagtcttggctatgtgtagttaccctgaactcctgaaagacaacatgtttccagaggatgccaaacaaagagcacgccgtattctcgaggcctgcggaggccacagtataggggcctacagcgccagccagggcattgagtgcatacgtcaggatgtggcgcgctacatagagaagagagatggtggaatcgcctccaaccctgacaacatctacctctccactggagccagtgatgccattgtgaccattctaaagttgctggttcgtggtgagggttgtgaccgtacaggtgtgatgatctccatcccccagtaccctctgtactcggccgctattacagacctgggtgctgtgcaggtccactactacttggacgaggccaactgttggagccttgatgtcgcagagctcaggagagccctcaatgcagccaggcagcactgcaatccccgtgtcctctgcatcatcaatcctggaaaccccaccggtcaggtccagagcaggcagtgcattgaagatgtgatccgatttgttaaagaggagcatcttttcctcatggctgatgaagtctatcaggataatgtgtacgcagagggctgtaagtttcagtcctttaagaaggtgttgtttgagatgggaccagagtactcgagtacagtggagatggcctccttccactccacctccaaatgctacatgggagagtgtggattccgtggcggttacatggaggtgattaacatggaccctgaggtaaaggcccagctcaccaaactggtgtcggtgcgtctgtgccccccagtttctggacaggctctcatggacctggtggtcaaccccccgcagcctgacgagccctcctacacaacatttatgaaggaacggacagcagtgttagcagagttagcagagaaggccaggctaacagagcagatcttaaacacagtacccggtataacctgcaaccctgtgcagggggccatgtacagcttccctcgcatcactctacctcagaaggccatcgacaaggcaaaggaggcaggccatatcccagacatgttctactgtatgaagctgctggaggaggaggggatctgcctggtgccaggtagtggctttggccagagagagggaactttccacttcaggatgaccatcctgccgcccaccgagaagctgaaggttttgctgcagcggctccgtgacttccaccagcgcttcacacaagagttctcataacaaccccaccacctccatttctgaaccacacctcaagatccgattcattcagtgccagtatcttcaagtgcctttgtgtgaaggaggcggcgtcacaacgtagcctcctgcagcacacacctctcacctcggggctgatttcacactagatctgatttttaaagagatttttaatgttttgaatcagaatcatggatatttctgtgtctagacagctagtctgttcctgctgatgtgtatgtgatgatgatgatgatgatttcaggggcatccctctcctgccaagttagttggaagtttaaatttaaacacgttgggtcactacttgaataacctgaaggctgtagtagagccatttgtgttactaatgtctaaattgttcttaattgtgattaaaaacactactgaaaaagtcaaaaaaaaaaaaaaaa

SEQ ID NO: 34030 - protein, 491 aa, Sparus aurata
MSHQAANGVPCRGKVLTVDNMNPRVKKVEYAVRGPVVQRAVQIEKELREGVKKPFTEVIKANIGDAHAMGQKPITFFRQVLAMCSYPELLKDNMFPEDAKQRARRILEACGGHSIGAYSASQGIECIRQDVARYIEKRDGGIASNPDNIYLSTGASDAIVTILKLLVRGEGCDRTGVMISIPQYPLYSAAITDLGAVQVHYYLDEANCWSLDVAELRRALNAARQHCNPRVLCIINPGNPTGQVQSRQCIEDVIRFVKEEHLFLMADEVYQDNVYAEGCKFQSFKKVLFEMGPEYSSTVEMASFHSTSKCYMGECGFRGGYMEVINMDPEVKAQLTKLVSVRLCPPVSGQALMDLVVNPPQPDEPSYTTFMKERTAVLAELAEKARLTEQILNTVPGITCNPVQGAMYSFPRITLPQKAIDKAKEAGHIPDMFYCMKLLEEEGICLVPGSGFGQREGTFHFRMTILPPTEKLKVLLQRLRDFHQRFTQEFS

SEQ ID NO: 34031 - DNA, 1335 bp, Oryza sativa
  CDS (1)..(1335)
atggcaccgacgacggcggcggcggcggcgagcagcaacggcggcggcgagagcgacggcagcagcaaggagtggaggctgacggcgccgacgaggggcggcgcgatggcggcggcgggggacaagatgagcatccgggcggtgcggtacaagatcagcgccagcgtcgacgaccgcggcccgcgccccgtcctgccgctcgcccacggcgacccctccgtgttccccgagttccgcaccgccgccgaggccgaggacgccgtcgccgacgcgctccgctccggcgacttcaactgctaccccgccggcgtcggcctccccgccgcgcgacgtgctgtggcagatcatttgtcacgcgacctcccatacaagctatcttctgatgacatcttcctaaccgctggaggaactcaggccatcgaggtcgtaatctcaatccttgcccaacctggcacaaacatattgcttcctagaccaggctacccaaactatgaagctcgagccgcgttcaacaaccttgaagttcgtcactttgatcttattcctgagaagggctgggagattgaccttaactccctagaatctattgcggacaagaacactactgcgatagtcatcataaatcccaataatccatgcgggaatgtgtacacttacgagcatttatccaaggtggcagaggtagcaaggaagcttgggatattggtaattactgatgaggtgtatggtaatttggtttttgggagttccccatttgtcccaatgggttgctttgggcacatcgtaccaatattaaccataggatcgctatcaaagaggtggatagtgccgggatggcgacttggttgggtagcaatatgtgaccccaagaagactctacaagaaaccaagattgcaacattaattactaatttccttaatgtttcaactgatccagcaactttcattcagggagctctaccgaatattcttaagaataccaaggaagaattctttaagaggataattgatttgcttacggaaacatcagatatttgctatagaggaataaaggatattaaatgcatcacttgtcctcacaagcccgaaggatccatgtttgtgatggtgaaattgaacctatatcttttggagggaatccatgatgatgttgatttttgttgccaacttgcgaaagaagagtcggtgattctttgcccagggagtgtgctgggaatgaagaattgggttcgcattacttttgctattgattcatcttctctcctggatggtcttgagaggatcaaatccttctgccaaaggcacaagaagaaaaaccctttaaattatatctag

SEQ ID NO: 34032 - protein, 444 aa, Oryza sativa
MAPTTAAAAASSNGGGESDGSSKEWRLTAPTRGGAMAAAGDKMSIRAVRYKISASVDDRGPRPVLPLAHGDPSVFPEFRTAAEAEDAVADALRSGDFNCYPAGVGLPAARRAVADHLSRDLPYKLSSDDIFLTAGGTQAIEVVISILAQPGTNILLPRPGYPNYEARAAFNNLEVRHFDLIPEKGWEIDLNSLESIADKNTTAIVIINPNNPCGNVYTYEHLSKVAEVARKLGILVITDEVYGNLVFGSSPFVPMGCFGHIVPILTIGSLSKRWIVPGWRLGWVAICDPKKTLQETKIATLITNFLNVSTDPATFIQGALPNILKNTKEEFFKRIIDLLTETSDICYRGIKDIKCITCPHKPEGSMFVMVKLNLYLLEGIHDDVDFCCQLAKEESVILCPGSVLGMKNWVRITFAIDSSSLLDGLERIKSFCQRHKKKNPLNYI

SEQ ID NO: 34033 - DNA, 1293 bp, Oryza sativa
  CDS (1)..(1293)
atggagagcggcggcgccggcggcgaaggcgagacggcggggtggcggttcggcgcggcgaacccggcgctggcggtggcggggtcgcagagcatccgcgcggccgtgacacggatttaccgctgcctcgacgggagcggcgacgcgcggcccgtggcgccactcgcccacggcgacccctccgcgttcgcgtgcttccgcgccgcgcccgccgccacggacgccgtcgccgccgctgccgcctccggcaagtacaactactactcccccgccgtaggaatcgccccggcgtgcagcgcggtggcggcgcacctgtcgcgggagctcccctacgccgtctcgccggcggacgtggtgctcaccgccggctgcaaccacgccgtcgagatcatgatgtccgtgctcgcgtcgccgggcgccaacgtgctgctcccgcggcccggctacccgctgtacgcgtcgcgcgccgccctgagcggcctcgagttccgccacttcgacctcctccccgacagcgagtgggaggtcgacctcgccggcgtcgaggccctcgccgacgccaacaccgtcgccatggtcatcgtcaaccccaacaacccctgcggctgcgtctactcccgcgaccacctcgccaagatcgcagagacggcgaggaagctggggataatggtgatcagcgacgaggtgtacgaccacttcgcgttcgggagcaagccgttcgtgccgatgggggtgttcggcgacgtggcgccggtgatgacgctgggcggcatctccaagcggtggatggtgcccggctggcgcctcggctggatcgccgccaccgatcccaacggaatcctcaggaacaagaagatcatcgactcagtcattgactaccgagccatctcggtagatcccgtaacatttgttcagggagcattgcccgacatcctcgcgaagacggacgatgcgttcttcaccaatgcccttggggtggtgaagaaggcggcggagatatgctacgagaagctcaaggagatcgactgcatcacctgccctcacaagccggagggctccatgttcgtcatggcgaagctggacctgtcttccctagatggcatagaggacgacgtcgacttctgcagcaagctggccaaggaggaatccgtggtcatctgcccagggagtggattagggatgaagaattggctccggataaccttcgcggttgatccacaattactagaggatggtctagagagaaccaagtgtttctgcaagaggcatggtaaaatcaaggaagccagctag

SEQ ID NO: 34034 - protein, 430 aa, Oryza sativa
MESGGAGGEGETAGWRFGAANPALAVAGSQSIRAAVTRIYRCLDGSGDARPVAPLAHGDPSAFACFRAAPAATDAVAAAAASGKYNYYSPAVGIAPACSAVAAHLSRELPYAVSPADVVLTAGCNHAVEIMMSVLASPGANVLLPRPGYPLYASRAALSGLEFRHFDLLPDSEWEVDLAGVEALADANTVAMVIVNPNNPCGCVYSRDHLAKIAETARKLGIMVISDEVYDHFAFGSKPFVPMGVFGDVAPVMTLGGISKRWMVPGWRLGWIAATDPNGILRNKKIIDSVIDYRAISVDPVTFVQGALPDILAKTDDAFFTNALGVVKKAAEICYEKLKEIDCITCPHKPEGSMFVMAKLDLSSLDGIEDDVDFCSKLAKEESVVICPGSGLGMKNWLRITFAVDPQLLEDGLERTKCFCKRHGKIKEAS

SEQ ID NO: 34035 - DNA, 1621 bp, Oryza sativa
  CDS (47)..(1366)
aaatttggataaaccgctcgaagagcggcatccgatcgagctaacaatggagggtgtcggtggcggcaagcgccgcggggacgacggggcggaggccacgccgcggtggcgcttctcccggccgtcgtcgcagggcgggcccctggcggccgccggcctcacgagcatccgcgcggtgctcaaccgcgtcaactcctccgtcgacgccgccgccgccggcgggccgcgccccgtcctgcggctcggcaacggcgaccccaccgcgtccgcctgctaccgcaccgcgcccgccgccgaggacgccgtcgtcgacgcgctccgctccggggcgcacaacggctactccctaaccgtcggcgtcctctcggcgcgccgtgctattgcagaatacctatctcgagatcttccttatgagctttcggcaaatgatatttacctgacctccggatgtgtccaagcgatcgaagtcatgatctctgttttggctcagcccggatccaacatcttacttcccaaacccggctttccattgtatgaatcacggactacattcagcaatctagaggttcgacatttcgatctcattccagagagaggctgggaggtagacctagagggtgtgcaagctattgctgatgagaacactgttgcaattgtcgtgatcaatcccagtaacccttgtggaagcgtgtattcgtatgatcatttggcaaaaattgccgagaccgccaggaaacttggtttgctgataattgctgatgaggtatatgaccatttggcatttgggaataatccttttatacctattggtgtttttgggaagaccgtcccagtgatcaccttgggatctatttcaaaaagatggcttgtacctggttggcgacttggttggatagcaacatgtgatccaaatggcattttaaaggaagccaaggttaaccaatcaattgagaactatattaacatctcaactgatcctgcaacgtttgttcagggagcaatccctcaaattatagccaacacaaaagaagattacttcaacaaaattctcgatcaattaaggaatgcagcggatttatgttatgataaaataaaggacatcaagggcattacatgtccacacaagccagagggatcaatgtttgtgatggtaaaattggatctctcttacttggatggcttccatgatgatatggacttctgctgcaggttggcaaaagaggagtctgtgatagttttgccagggagtgcattaggattgaagaattgggttcgcatcactttcgccatcgatataccatctcttgtggatgcctttgaaaggataaaatctttctgccagaggcatggcaaactggaaacctaagcacaaaggtgttgagatatttcattattgtggtgcatcggcaactacgcgttggggcacccaaatgttgttcttaataatctgttgctgtgaccaagatgatcatttaccttgtcaaacatgtatatcgtattcttccggcaggtgaactcaaacctatcttgtatttgtaatgtattaattgtcgggaaatgctgtaatctataactgtaagtcattcttggttacagttgatttgaatacgtcagcctgtat

SEQ ID NO: 34036 - protein, 439 aa, Oryza sativa
MEGVGGGKRRGDDGAEATPRWRFSRPSSQGGPLAAAGLTSIRAVLNRVNSSVDAAAAGGPRPVLRLGNGDPTASACYRTAPAAEDAVVDALRSGAHNGYSLTVGVLSARRAIAEYLSRDLPYELSANDIYLTSGCVQAIEVMISVLAQPGSNILLPKPGFPLYESRTTFSNLEVRHFDLIPERGWEVDLEGVQAIADENTVAIVVINPSNPCGSVYSYDHLAKIAETARKLGLLIIADEVYDHLAFGNNPFIPIGVFGKTVPVITLGSISKRWLVPGWRLGWIATCDPNGILKEAKVNQSIENYINISTDPATFVQGAIPQIIANTKEDYFNKILDQLRNAADLCYDKIKDIKGITCPHKPEGSMFVMVKLDLSYLDGFHDDMDFCCRLAKEESVIVLPGSALGLKNWVRITFAIDIPSLVDAFERIKSFCQRHGKLET

SEQ ID NO: 34037 - DNA, 1215 bp, Photobacterium profundum
  CDS (1)..(1215)
atgcataacatcgggatgtcctccaagcttaataatgtctgctatgacatacgtggtcccgttctgaagcatgccaagcgcatggaagaagaaggccataaaattttaaagcttaatattggtaatcccgccccatttggtttcgatgccccggatgagattctggttgatgtgatccgtaacttaccgacatctcaagggtattgtgattcaaaaggcatttatcctgcacgtaaagccattgttcagcattaccaaaaacgcggtttactcgatcttgatgttgaagatgtttatatcggtaatggtgtatctgaattgatcgtcatggcgatgcaagctttactagacaacaacgatgaaatcttagttccctctcctgactatccattatggaccgcagcggtttctttgtctggtggtaacccagtacattatatttgtgatgaagagtcagattggtatccagacctcgatgatattaagaaaaaaatcacccccaatactcgcggcatcgtattaatcaatccgaataatccaacgggtgccgtttatagccgcgatttcttactcgaaatcgttgagattgcacgtaagcataagctgatcatttttgcagatgaaatctatgacaagattttatatgaaggggctcaacacacctctatcgcgccacttgcgccagacgttttctgtatcacgttcaatggcctttctaagtcataccgcgtgtgtggtttccgtgcaggttggatggtgctatcaggtcctaagcatgaagctaaggggtatatcgaagggttagagatgctgtcgtctatgcgtctgtgtgccaacgtacccatgcagcatgctattcaaacggcgattggtgggtatcagagtattaatgagcttatcttaccgggtgggcgtttattagagcagcgtgacaaagcctatgacttgatcactcaaatccctggcgtttcttgtgtgaagcccaaaggagcgctatatctatttccgaagttagatcagaaaaaattcaacatcgttgatgatcaacgcatggcactggatttcttacaacaagaaaaagtgcttatcgtgcatggtacgggctttaattgggagaaaccggaccatttccgtattgtgaccttaccccgtgtcgatgatttagaaatggcaattggtcgactagagcgcttcttgcacaattatcgtcaataa

SEQ ID NO: 34038 - protein, 404 aa, Photobacterium profundum
MHNIGMSSKLNNVCYDIRGPVLKHAKRMEEEGHKILKLNIGNPAPFGFDAPDEILVDVIRNLPTSQGYCDSKGIYPARKAIVQHYQKRGLLDLDVEDVYIGNGVSELIVMAMQALLDNNDEILVPSPDYPLWTAAVSLSGGNPVHYICDEESDWYPDLDDIKKKITPNTRGIVLINPNNPTGAVYSRDFLLEIVEIARKHKLIIFADEIYDKILYEGAQHTSIAPLAPDVFCITFNGLSKSYRVCGFRAGWMVLSGPKHEAKGYIEGLEMLSSMRLCANVPMQHAIQTAIGGYQSINELILPGGRLLEQRDKAYDLITQIPGVSCVKPKGALYLFPKLDQKKFNIVDDQRMALDFLQQEKVLIVHGTGFNWEKPDHFRIVTLPRVDDLEMAIGRLERFLHNYRQ

SEQ ID NO: 34039 - DNA, 1305 bp, Methanococcus maripaludis
  CDS (1)..(1305)
atgagaaccgatattgtcagttcaggagtaggggaattgtcctatgaaatcagagaaattgtaaaggtggctaaaaaagccgaaagttcgggattagaagttgtatgggaaaatattggtgatcctattgccaaaggagaaaagcttcccctctggataaaagaaatagtttcagaaaccacaatggatgacagttcttatggatactgtcctacaagaggtcttttagaaacgagggagtttttaactgatttaaacaacagcagaaatggagcacagattacgcctgatgaaatcgtattttttaacggtttaggggatgctatcacaaatatttacggtttgatgagaaaagagtgtagagtaataggtccaacacctgcatattccacacattcttctgcagaaggactttattcaaactgtaggcctgtaatgtatgaattagataaagatgacggatggaatcccgatattgatgatttgagaaataaagtaaaatataacccttcaattgcatcaatattgttaataaatcctggaaatccaaccggtgcagtttattcaaagaaaatattgagcgaagttgtagatattgcaaacgaatacgaccttttcattttagctgatgagatatattcaaaccttgtttacaatggaaaaaaacacaactacttatcagaagttttagatgacgttccaggaatttctttaaagggaatttctaaggatctgccatggcctggttcaaggtgcggttggacagagttttacaatactcaaagtgatgaattattcaagaaatatactgaaaacatctgcaagtttaaaatgattgaagtatgttcgacaacacttcctcaaaaagtaattccaaagataatgtctgataaacgatataataagtacctcgaagaaaggaaaagctactacgaaacggcttcaaagtacgcatacaataaaatgaaaaatatcgatggattaaatgtaaacagaactgatggtgcattttataacacaatagttttagaaaaagaatacttaaatgaaaatcaatctttgaagattcaagatagtgaacttaaaaattacgttgaatcgatttcaaaaggaattcctgaagataaaaggtttgtatactacttacttgcatctactggaatttgtggtgttcctttaacttcattctgttcagaacacaatggaatgagattcacgcttcttgaaagagacgaagaaaagagaaactgggtttttgaaacaatcgcagaaaaagttgaagaatatttcaacagcagtaactaa

SEQ ID NO: 34040 - protein, 434 aa, Methanococcus maripaludis
MRTDIVSSGVGELSYEIREIVKVAKKAESSGLEVVWENIGDPIAKGEKLPLWIKEIVSETTMDDSSYGYCPTRGLLETREFLTDLNNSRNGAQITPDEIVFFNGLGDAITNIYGLMRKECRVIGPTPAYSTHSSAEGLYSNCRPVMYELDKDDGWNPDIDDLRNKVKYNPSIASILLINPGNPTGAVYSKKILSEVVDIANEYDLFILADEIYSNLVYNGKKHNYLSEVLDDVPGISLKGISKDLPWPGSRCGWTEFYNTQSDELFKKYTENICKFKMIEVCSTTLPQKVIPKIMSDKRYNKYLEERKSYYETASKYAYNKMKNIDGLNVNRTDGAFYNTIVLEKEYLNENQSLKIQDSELKNYVESISKGIPEDKRFVYYLLASTGICGVPLTSFCSEHNGMRFTLLERDEEKRNWVFETIAEKVEEYFNSSN

SEQ ID NO: 34041 - DNA, 1236 bp, Rhodopseudomonas palustris
  CDS (1)..(1236)
atgccgactcatgacggctgcaaggagaagacgatgccgttcctcgccaccgcgctcgatcgtgtgaagccgtccgcgaccatcgcggtcacggacaaagcgcgtgagctgaaagcggccgggcgcaacgtcatcggcttgggttccggcgagccggacttcgatactcccgccaacatcaagctggcggcgatccatgcggtcgaggccggcaagaccaagtacaccgcggtcgacggcattccggagctgaagcaggccatcatcgacaagttcaagcgcgagaacggcctgacctacaagccgaaccagatcatcgtcggtaccggcggcaagcaggtgctgtacaacgccctgatggcgaccatcaatccgggcgacgaggtgatcatcccggcgccgtattgggtcagctatccggagatggtcgcgctcgccggcggcgaaagcgtgccggtggtgtgcaccgccgagttcggcttcaagctgcagccggcggcactggaagcggcgatcacgccgaagaccaagtggatcattctcaactcgccctcgaacccgaccggcgcggcctacagccgtgccgagctgaaggcgctcaccgacgtgctggtcaagcacccgcatgtctgggtgatgaccgacgacatgtacgagcacctcgtctatgacgacttcgagttcaccaccccggcgcagatcgagccgaagctgttcgatcgcaccctcacggtgaacggcgtgtcgaagtcgtattgcatgaccggctggcggatcggttatgccggcggcccggccgagctgatcaaggcgatgtcgacgatccagtcgcagtcgacctcgaacccgtgctcgatcgcccagtgggccgccgtcgaggcgctcaacggtccgcaggacttcatcgacgcgcacaacaaggtgttcaaggagcgccgcgacctcgtcgtgtcgatgctgaaccaggcgaccggcatcgactgcccgcggcccgagggtgcgttctacgtctatccgtcgtgcgccggcaccatcggcaagaccgcgccgtcaggcaaaaagatcgagaccgaccaggacttcgtcaccgagcttctggaagcggaaggcgtcgcggtggtgcagggctcggcgttcggcctcggcccggcattccgcatctcctacgccaccaagacctcggatctcgaggatgcctgcaagcgcattcagcggttctgcggaaatttgcggtaa

SEQ ID NO: 34042 - protein, 411 aa, Rhodopseudomonas palustris
MPTHDGCKEKTMPFLATALDRVKPSATIAVTDKARELKAAGRNVIGLGSGEPDFDTPANIKLAAIHAVEAGKTKYTAVDGIPELKQAIIDKFKRENGLTYKPNQIIVGTGGKQVLYNALMATINPGDEVIIPAPYWVSYPEMVALAGGESVPVVCTAEFGFKLQPAALEAAITPKTKWIILNSPSNPTGAAYSRAELKALTDVLVKHPHVWVMTDDMYEHLVYDDFEFTTPAQIEPKLFDRTLTVNGVSKSYCMTGWRIGYAGGPAELIKAMSTIQSQSTSNPCSIAQWAAVEALNGPQDFIDAHNKVFKERRDLVVSMLNQATGIDCPRPEGAFYVYPSCAGTIGKTAPSGKKIETDQDFVTELLEAEGVAVVQGSAFGLGPAFRISYATKTSDLEDACKRIQRFCGNLR

SEQ ID NO: 34043 - DNA, 1272 bp, Corynebacterium diphtheriae
  CDS (1)..(1272)
atgaataacaaaaaagagactccacaagcagcccctgcccaacgcaagcgcacacggcggatatttgatcagtcggacaagttgaaaaatgtgctgtatgaaatccgtgggccggtgacggctgaagcagaggccatggagctcgacgggcaccggattctcaagctcaacacgggcaaccctgcgatctttgggttcgaggcccctgatgtgatcatgcgtgacatgattgcgtccttgcctacgtcgcaaggctattccacgtcgaaaggcatcattccggcacgtcgtgcgatcgtaacacgctacgaggtcattccaggttttcctgcttttgacgtagatgatgtttacatcggcaatggtgtatccgagctgattaccatgaccacccaagcgttgctgaacaacggcgacgaagtgctcattccgatgccggattatccgctgtggactgcggcgacgtctcttgcgggcggcaaaccggtgcactatctgtgcgatgaggaagacgattggaacccgtcgatcgaagacatcaagtccaagatcaccgagcgcaccaaagccattgtggtgattaaccctaataaccccaccggtgcggtgtattccaaggaagtcttgcaaaagatcgttgatgttgcccgtgaacatgatctgctgattttggccgatgagatctacgatcgcattctttacgatggcgccgtgcacaccaacatcgcagctcttgcacctgatcttttgtgcatcactttcaatggtttgtctaaggcttatcgtgtggcgggttatcgtgccggctggatgatcgtcaccggcccgaagaataatgctcgcggttttatcgagggtctcgatttgctgtcgggcacccgtctttgcgctaatgtgccaggccagcacgcaatccaggtggcgttgggtggccgccagtcgatttacgatctcacaggtcaaggtggccgtttgctggagcagcgcaatgtgacgtgggagaagctcaacgctattcctggcgtgagctgcgtgaagccgatgggtgcgttgtatgccttcccgaagctcgacttggagtactacgacatcaaggatgatgcccagctgatgcttgatttgctgcgccaggaaaaaatcttgatggtacagggtacgggctttaactgggataagccggatcatttccgtgtggttacgttgccgtgggcttcacagttgtcggaggccatggaccggttgggtaacttcctagccagctataagcagtaa

SEQ ID NO: 34044 - protein, 423 aa, Corynebacterium diphtheriae
MNNKKETPQAAPAQRKRTRRIFDQSDKLKNVLYEIRGPVTAEAEAMELDGHRILKLNTGNPAIFGFEAPDVIMRDMIASLPTSQGYSTSKGIIPARRAIVTRYEVIPGFPAFDVDDVYIGNGVSELITMTTQALLNNGDEVLIPMPDYPLWTAATSLAGGKPVHYLCDEEDDWNPSIEDIKSKITERTKAIVVINPNNPTGAVYSKEVLQKIVDVAREHDLLILADEIYDRILYDGAVHTNIAALAPDLLCITFNGLSKAYRVAGYRAGWMIVTGPKNNARGFIEGLDLLSGTRLCANVPGQHAIQVALGGRQSIYDLTGQGGRLLEQRNVTWEKLNAIPGVSCVKPMGALYAFPKLDLEYYDIKDDAQLMLDLLRQEKILMVQGTGFNWDKPDHFRVVTLPWASQLSEAMDRLGNFLASYKQ

SEQ ID NO: 34045 - DNA, 1646 bp, Cattleya bicolor
  CDS (94)..(1398)
tgcactcctgccttcaattccttttcttctctttcgcactgcttaataataacttttttcaattacatctcggctgttaattactgttcagtcatgtcaaaagtgtttgggattgaggccccattgtcaaaaattgcactttcaaaagctcatggagaggactctccatactttgctggctggaaagcttatgaagaaaatccttatgatgctatgaacaatcctaatggagttatacagatgggcttggctgagaatcaactttcttttgatctgctggaagagtatctggagcagcacccagatgctttcggctggggttctgacttgtccggttttagagaaaatgctttgtttcaggactatcatggcctccagactttcagaaaggcaatggcaagctttatggagaaaataagaggcggccgttcaaaattcgatcccaaccgcatcatcctcaccgccggtgccaccgcagccaacgaactccttaccttcatcttagctaatcccggcgacgccatacttgtccccactccttattacccagggttcttgagagatctccaatggagaactggagtcaccatcttccccgttcattgcgacagctccaatggcttccaactcactctatcttccctcgaaaaagcctacgccgacgccaaagcttccaacttcaaagtaaagggtctgctaataaccaatccttgtaatcctctcggaaccaccgcctctttctctcttctccaagacataattctcttcatctcagacaaaaacatccatttaatctccgacgagatctactccggctctgtcttctcttccacgaacttattcagcatttcagatctcatcaccgatgccgtctctgaacaaattcatattgtttatagcttatcaaaagacttgggccttcctggcttccgagttggagctctgtattcttataacgacagagttgttaaaacagcaagaagaatgtcaagtttcagtcttgtttcttctcagacacaaaagttgctggcttttatgctgtcagatgaggaatttacagtgaggtatatagagaagaatagagagagactgacagaaagatatgaattagttgttgaaggattgaaggaagcaaggattgagtgtttgaaaggggaagcagggctattctgttgggtgaatatggaagaactgatggaggagaagacgatggaagaagaactcaagctttggaaggtgatagtcgaggaattgaagcttaatataacgcctggttcttcttgttgttgttctgaaccaggttggtttagagtctgttttgctaatatgagcagagaaacgttggaggtggctttgaggagattgaaggattttgctcagaaaaaagattgccgctaagaagatcaggaagaagaagaagattaattgcttagctttcgttgattcattatacttaattttagttaatatgtgcaattaatttgatgaaaaaacaaattacaaatagtttaacactttgtttatgagaaattagtactctattcagtagcacagttgtattttcgatcagtagcttgtcataattatgtataatgaaatatatgttaattattttgactgattgtcatctaaaaaaaaaaaaaaaa

SEQ ID NO: 34046 - protein, 434 aa, Cattleya bicolor
MSKVFGIEAPLSKIALSKAHGEDSPYFAGWKAYEENPYDAMNNPNGVIQMGLAENQLSFDLLEEYLEQHPDAFGWGSDLSGFRENALFQDYHGLQTFRKAMASFMEKIRGGRSKFDPNRIILTAGATAANELLTFILANPGDAILVPTPYYPGFLRDLQWRTGVTIFPVHCDSSNGFQLTLSSLEKAYADAKASNFKVKGLLITNPCNPLGTTASFSLLQDIILFISDKNIHLISDEIYSGSVFSSTNLFSISDLITDAVSEQIHIVYSLSKDLGLPGFRVGALYSYNDRVVKTARRMSSFSLVSSQTQKLLAFMLSDEEFTVRYIEKNRERLTERYELVVEGLKEARIECLKGEAGLFCWVNMEELMEEKTMEEELKLWKVIVEELKLNITPGSSCCCSEPGWFRVCFANMSRETLEVALRRLKDFAQKKDCR

SEQ ID NO: 34047 - DNA, 1680 bp, Pyrus communis
  CDS (132)..(1472)
aaaagtgggtgatcatgtcaaaggtttactgtcaacttcaaacaattactcattcaactcttttctctctctatctgagtcacacctacagctttcttgaaggccaaagtgattttacaagaaacctagttatggctatagatattgagcagcagcagcagccttctcctgggctttctaaaatagctatttctgatactcatggagaagactctccatactttgcaggatggaaagcttatgatgaaaacccttaccatgagtcaagcaacccatctggagtcatacaaatgggacttgctgaaaatcaagtttcgttcgatctgttggaaaaacacttggaagaaaattcggaagcctccaactggggttcaaagggatccaaaggagcgtctggctttagagaaaatgccttatttcaagactaccatggccttttgtcttataagaaggcaatggcaaattttatggaacaaattagaggaggaagagccaaatttgaccctgttagggtagtgttaacggcgggtgcaactgcagcagatgagcttctgactttcataatagctgatcccggtgatgctttgcttgttccaaccccatattatccagggttcgatagagatttgaggtggagaactggtgtgaacattgtgccaattcactgtgaaagctcaaacaacttccagattactcctcaagctttggaagctgcatacaaagaagcagaagccaggaacatgagagtgagaggggtattatttacaaatccatcaaacccacttggtgctacaatccaaaggacagtccttgaagagatccttgacttcgtcacccaaaaaaacatccatcttgtctctgatgaagtctactcgggatctgccttttcatcctccgaattcattagtgtggcagaaattatggaagacaggcagtacaaggatgcagaaagagttcacattgtttatagtctatccaaagatctcggccttccaggctttcgagttggcactgtgtactcttacaatgataaggttgtgacaacagcaaggagaatgtccagcttcaccttgatatcttctcaaacacaacatctcttggcttccatgttatctgacaaggaattcactgaaaactacataaagacaaatagagagagactgaggaggagatatgatatgatcgtggagggtttgaaaaaatcggggatcgagtgtttgaaaggaaatgctgggttgttttgctggatgaatttaagtccatttttggacgaaccaacaagagaatctgaactgactctctgggattccatgctgcatgaagtgaagctaaatatatctccaggttcttcttgtcattgctctgagccaggctggtttagggtgtgctttgccaacatgagtgagcagacacttgggattgcattaacaaggatacataatttcatggaaaagagagagcgtgcttgctagaattaagtttcttctcttttctcttctatttttcagtgggtagccatcttttattcttttggaggggcaaaacccaatttactctttctgaattgtaacaattccatcttgttttcttgcttgaaaagcaagttgttacacaatcagtttgtataatcgatggatataatatttgttttggcgttctactaaaaaaaaaaaaaaaaaa

SEQ ID NO: 34048 - protein, 446 aa, Pyrus communis
MAIDIEQQQQPSPGLSKIAISDTHGEDSPYFAGWKAYDENPYHESSNPSGVIQMGLAENQVSFDLLEKHLEENSEASNWGSKGSKGASGFRENALFQDYHGLLSYKKAMANFMEQIRGGRAKFDPVRVVLTAGATAADELLTFIIADPGDALLVPTPYYPGFDRDLRWRTGVNIVPIHCESSNNFQITPQALEAAYKEAEARNMRVRGVLFTNPSNPLGATIQRTVLEEILDFVTQKNIHLVSDEVYSGSAFSSSEFISVAEIMEDRQYKDAERVHIVYSLSKDLGLPGFRVGTVYSYNDKVVTTARRMSSFTLISSQTQHLLASMLSDKEFTENYIKTNRERLRRRYDMIVEGLKKSGIECLKGNAGLFCWMNLSPFLDEPTRESELTLWDSMLHEVKLNISPGSSCHCSEPGWFRVCFANMSEQTLGIALTRIHNFMEKRERAC

SEQ ID NO: 34049 - DNA, 1680 bp, Pyrus communis
  CDS (132)..(1472)
aaaagtgggtgatcatgtcaaaggtttactgtcaacttcaaacaattactcattcaactcttttctctctctatctgagtcacacctacagctttcttggaggccaaagtgcttttacaagaaacctagttatggctatagatattgagcagcggaagcagccttctcctcggctatcaaaaatagctgtttctgatactcatggagaagactctccatactttgcaggatggaaaacttatgatgaaaacccttatcatgagtcaagcaacccatctggagtcatacaaatgggacttgcagaaaatcaagtttcgtttgatctgttggaaaaccacttggaagaaaattccgaagcctccacctggggttcaaagggatcaaaaggagtgtctggctttagagaaaatgccttatttcaagactaccatggccttttgtctttcagaaaggcaatggcaagttttatggaacaaattagaggaggaagagccaaatttgaccctgctagggtagtcttaacggcgggtgcaactgcagcaaatgagctattgactttcgtcatagctgatcccggtgatgctttgcttgttccaaccccatattatccagggtttgatagagatttgaggtggaggactggtgtgaacattgtgccaattcactgtgaaagctcaaacaacttccagattactcctcaagctttagaagctgcatacaaagaggcagaagccaagaacatgagagtgagaggggtactattcacaaatccatcaaacccacttggtgcaacaatccaaaggacagtccttgaagagattcttgatttcgtcacccaaaaaaacatccatcttgtctctgatgaaatctactcgggatctgccttctcatcctccgaattcattagtgtagcagaaattcttgaaaacaggcagtacaaggatgcagaaagagtccacattgtttatagtctatccaaagatcttggccttccaggctttcgagttggcactgtgtactcttacaatgacaaggttgtgacaacagcaagaagaatgtctagcttcaccttgatatcttctcaaacacaacatctcttggcttccatgttatctgacaaggaattcacggaaaactacataaagacaaatagagagagactgaggaggagatatgatatgatcctggagggtttgaaaaaatcggggatcgagtgtttgaaaggaaatgctgggttgttttgctggatgaatttaagtccatttttggacgaaccaacaagagaatctgaactgactctttgggattccatgctgcatgaagtgaagctaaatatatctccaggttcttcttgtcattgctctgagccaggctggtttagggtgtgctttgccaacatgagtgagcagacacttgggattgcattaacaagaataaagaatttcatggaaaagagagagcgggcttgctagaatgaagtttcctctcttttatcttctttttttcagtggtgttaaccatggtttattcttttggaggacaaaacccaatttactctttctgaattgtaaacaactccatcttgttttcttgcttgaaaagcaagtttttacacagtcagtttgtataatcgatggatataatatttgttttggcgttctaaaaaaaaaaaaaaaaaaa

SEQ ID NO: 34050 - protein, 446 aa, Pyrus communis
MAIDIEQRKQPSPRLSKIAVSDTHGEDSPYFAGWKTYDENPYHESSNPSGVIQMGLAENQVSFDLLENHLEENSEASTWGSKGSKGVSGFRENALFQDYHGLLSFRKAMASFMEQIRGGRAKFDPARVVLTAGATAANELLTFVIADPGDALLVPTPYYPGFDRDLRWRTGVNIVPIHCESSNNFQITPQALEAAYKEAEAKNMRVRGVLFTNPSNPLGATIQRTVLEEILDFVTQKNIHLVSDEIYSGSAFSSSEFISVAEILENRQYKDAERVHIVYSLSKDLGLPGFRVGTVYSYNDKVVTTARRMSSFTLISSQTQHLLASMLSDKEFTENYIKTNRERLRRRYDMILEGLKKSGIECLKGNAGLFCWMNLSPFLDEPTRESELTLWDSMLHEVKLNISPGSSCHCSEPGWFRVCFANMSEQTLGIALTRIKNFMEKRERAC

SEQ ID NO: 34051 - DNA, 1858 bp, Capsicum annuum
  CDS (119)..(1564)
atcaccaaaactagtaccatttcttctactatttgttcttcttctacaatttcccctctaaattctctatcacctgcgctgcagctcttcgtttttgtccactcttcatcctcattcaatggattccatcactattgataccattaatcccaaggttttgaaatgtgagtatgctgttcgtggagaaattgttacaattgctcagaaattgcagcaagacctcaaggacaatccaggttctcatccctttgatgagatcttatactgcaatattggaaatcctcaatcactggcccagcagcctatcactttctttagagaggtccttgcattatgtgaccatccatccattttggacaaaagtgaaacccaaggtctgttcagtgcggatgccatagaacgagctttccagatccttgatcaaattcctgggagagcaactggtgcatacagccacagtcagggtataaaaggattacgtgacacaatcgcttctggtattgaagctcgtgatggcttccctgctgatccaaatgatcttttcttgactgatggtgctagcccagcggttcacatgatgatgcagctactcatcaggtcacagaatgatggaattctctgtcccattccccagtatcctctttactctgcttcaatcgccctccatggtggaactcttgttccttattatcttgatgaacaaacaggatgggggcttgagatatcagagctagagcatcagttaaacactgcaaaatccaacggtattgacgttagggctttggttgtgatcaatccgggcaacccaactgggcaggttcttggtgaggccaaccaacgggaaattgtagaattctgcaagaaggaaggcctcgtccttctggctgatgaggtctatcaagaaaatgtttatgtgcctgacaagaaattccactcatttaagaaaattacccgctctatgggatacggggaaaaggatatatctttagtgtctttccagtctgtgtcaaaagggttttacggagagtgtggaaaacgaggaggttacatggagatcactggttttagccctgaagtgagggaacaaatatacaaattggcttctgtcaatctgtgttccaatatctctgggcagatacttgcaagcctcgtcatgagtcccccaaaggtaggagatgaatcatatgagtctttttctgccgagaaagaagcagtactctcatccttggcgagacgtgcacaggcgctacaagatgcactgaatagtttggaaggagtgacatgcaatagagcagaaggggctatgtatctctttccgcgtattaacttacccgacaaagcaataaaagcagcagaagtagctaaaactgcaccagacgctttctatgctaaacttcttcttaatgccacaggaatcgttgttgttccaggctctggattccgccaggttcctggaacctggcattttaggtgcacaatattaccacaagaagagaagataccagctatcgtatctcgtcttacagaattccataaaaagttcatggatgaattctgcggctaaggaatcagacagtacggagtctgataatagggaattttgaataagcagtgccagttgactcctgtctgcaactgttttgtctgcctacttctatagtcgaacagtaaggactctaatggttccaaattttggggtttgttcctcattttctggttgggattgatgctttagttcattctgttaatttatcccagcttcagacattcagtggatatataaatatgatttgtgcaacacagggtgcatgtatatgcaaagaagcatttgtttctcagacaaaaaaaaaaaaaaaaa

SEQ ID NO: 34052 - protein, 481 aa, Capsicum annuum
MDSITIDTINPKVLKCEYAVRGEIVTIAQKLQQDLKDNPGSHPFDEILYCNIGNPQSLAQQPITFFREVLALCDHPSILDKSETQGLFSADAIERAFQILDQIPGRATGAYSHSQGIKGLRDTIASGIEARDGFPADPNDLFLTDGASPAVHMMMQLLIRSQNDGILCPIPQYPLYSASIALHGGTLVPYYLDEQTGWGLEISELEHQLNTAKSNGIDVRALVVINPGNPTGQVLGEANQREIVEFCKKEGLVLLADEVYQENVYVPDKKFHSFKKITRSMGYGEKDISLVSFQSVSKGFYGECGKRGGYMEITGFSPEVREQIYKLASVNLCSNISGQILASLVMSPPKVGDESYESFSAEKEAVLSSLARRAQALQDALNSLEGVTCNRAEGAMYLFPRINLPDKAIKAAEVAKTAPDAFYAKLLLNATGIVVVPGSGFRQVPGTWHFRCTILPQEEKIPAIVSRLTEFHKKFMDEFCG

SEQ ID NO: 34053 - DNA, 1215 bp, Leptospira interrogans
  CDS (1)..(1215)
atggatctcagcgcaaagaggctgaatgtcatcgaaccttctcctactctcgtaattactgctaaggcaaacgagttgaaaaaaaagggagaagatattgttagttttggagccggtgagccggattttgaaactccatctcatatcagagacgctgcaaaaaatgcaatcgataggggaatgactcgttatacggctgtttctggaacggttgaattgaaagaagcaatcgtccacaagttcaaaagagacaatggtcttgattacgataaaagtcaggtaatcgttggaaccggtggtaaacaagttatttacaactactttctcgcaaccttaaatgcgggggacgaagtaatcattcccgctccgtattgggtgagttatgcggatattgttcgtttggcagaaggtgttcctgtgattgtcaacactactccggaggcaaattttcaaattactccggaacaattgaaaaaggtaattactcctaagacaaaatgtttgattctaaattctccctccaatcctaccggtgcgggatatactaagaaagatatagaagctttgggagaggttgtactttctaccggaattcaagtcatgagcgatgacatttacgaaaaaatagtctatgacggattcgtattttctaatcttgctatgttgtctccggaacttaaaaaacaaacctttgtaatcaatggagtttctaaaacgtattccatgaccggttggagaattggctacggggcgggcgatttgaatatcgttaaaaatatggaaacgattcaaagtcaatctacttcgaatccttcttcgatttctcaggcagctgcacaagctgcaattgcaggagatcaatcctgtgtagaggagatgagaaaagcgtttcaagtcagaagagatcttatcgtttctcttttaaatgcgattccgggtgtaaaatgtaacaaccctcaaggagccttttacgtatttccgtatttgacggatgtttacaaaactactggttttataaaactaaaacaaggatcttccgaaacctctctcagtaaaattttctgtagcactttattagaaaaatataaagtagccgcggttccaggaattgcatttggagaagaccaggctctcagactttcttacgcaatgggagaaaacgacatccgacgcggggtggaaagaatcgcggaaatgataagggatttgaactag

SEQ ID NO: 34054 - protein, 404 aa, Leptospira interrogans
MDLSAKRLNVIEPSPTLVITAKANELKKKGEDIVSFGAGEPDFETPSHIRDAAKNAIDRGMTRYTAVSGTVELKEAIVHKFKRDNGLDYDKSQVIVGTGGKQVIYNYFLATLNAGDEVIIPAPYWVSYADIVRLAEGVPVIVNTTPEANFQITPEQLKKVITPKTKCLILNSPSNPTGAGYTKKDIEALGEVVLSTGIQVMSDDIYEKIVYDGFVFSNLAMLSPELKKQTFVINGVSKTYSMTGWRIGYGAGDLNIVKNMETIQSQSTSNPSSISQAAAQAAIAGDQSCVEEMRKAFQVRRDLIVSLLNAIPGVKCNNPQGAFYVFPYLTDVYKTTGFIKLKQGSSETSLSKIFCSTLLEKYKVAAVPGIAFGEDQALRLSYAMGENDIRRGVERIAEMIRDLN

SEQ ID NO: 34055 - DNA, 1293 bp, Mycobacterium paratuberculosis
  CDS (1)..(1293)
atggacagtgatggcaccattggtggtgtgacaacccaccagctgcctgtgcactcgtccgcgcaccatcgccagcagcgtactttcgcccagtcgtccaagctccaggacgtcctgtacgagatccgcggcccggtacatcagcacgcggcgcggctggaggccgagggacaccgcatcctcaagctcaacatcggcaacccggcgccgttcggcttcgaggcgcccgacgtcatcatgcgcgacatgatccaggccctgccgtacgcccagggctactccgactcgcagggcatcctgcccgcgcgccgggcggtggtcacccgctacgagttggtcgacgggttcccccgcttcgacgtcgacgatgtctacctgggcaacggcgtgtccgaactgatcacgatgacgctgcaggcgctgctcgacaacggcgacgaggtgctgatcccgtcgccggactacccgctgtggacggcgtcgacctcgctggccggcggcacccccgtgcactacctgtgcgacgagacgcagggctggcagcccgacatcgccgatctggaatccaagatcaccgagcgcaccaaggcgctggtggtgatcaacccgaacaacccgaccggcgcggtgtacagcggcgaaatcctgagccagatggtcgatctggcgcgcaagcacgagctgctgctgctggccgacgagatctacgacaagatcctctacgacgacgccaagcacatcaacgtggcgtcgctggcgccggacatgctgtgcctgaccttcaacggcctgtcgaaggcgtaccgggtggccggctaccgggccggctggctggcgatcaccggacccaaggaccacgccggcagcttcatcgagggcatcaacctgctggccaacatgcggctgtgcccgaacgtcccggcgcagcatgcgatccaggtggccctgggcggccaccagagcatcgaggacctggtgctgccgggcgggcggctgctcgagcagcgcgacgtggcgtggagcaagctcaacgagatccccggggtgtcctgcgtcaaacccgccggcgccttgtacgcgtttccccggctggaccccgaggtctacgacatcaccgacgacgagcagctggtgctcgacctgctgctgcaggagaagatcctggtcacccacggcaccggcttcaactggccggcgccggatcacctgcgcatcgtgacgctgccgtgggcgcgggacctggccgccgcgatcgagcggctgggcaacttcctggtcggctatcgacagtaa

SEQ ID NO: 34056 - protein, 430 aa, Mycobacterium paratuberculosis
MDSDGTIGGVTTHQLPVHSSAHHRQQRTFAQSSKLQDVLYEIRGPVHQHAARLEAEGHRILKLNIGNPAPFGFEAPDVIMRDMIQALPYAQGYSDSQGILPARRAVVTRYELVDGFPRFDVDDVYLGNGVSELITMTLQALLDNGDEVLIPSPDYPLWTASTSLAGGTPVHYLCDETQGWQPDIADLESKITERTKALVVINPNNPTGAVYSGEILSQMVDLARKHELLLLADEIYDKILYDDAKHINVASLAPDMLCLTFNGLSKAYRVAGYRAGWLAITGPKDHAGSFIEGINLLANMRLCPNVPAQHAIQVALGGHQSIEDLVLPGGRLLEQRDVAWSKLNEIPGVSCVKPAGALYAFPRLDPEVYDITDDEQLVLDLLLQEKILVTHGTGFNWPAPDHLRIVTLPWARDLAAAIERLGNFLVGYRQ

SEQ ID NO: 34057 - DNA, 1305 bp, Geobacter sulfurreducens
  CDS (1)..(1305)
atgagaaatgaactggttacgccaggagccggcgaactgacctatgaaatccgcaacatcgtgaatgtggcggaaaagctccagaagcacggcgtcaagatcaactgggagaatatcggcgatccgatcgtgaagaaggaggaaatcccccgctggatgaaggaaatcgtggcagccgccgtgatggagaacgatacctggggctactgccatacccgtggggtactggaaacccgggagtttctctgcgggctgaccaacaaccgcggcggggcccagatcacccccgacgacatcatcttcttcaacggacttggcgatgccatctccacggtttatggcaatcttcgccacgaaagccgtattctgatgccatcccccacctataccacccactccatcggggaagccgcccacgcccaggcagcgccggtctgctacaggctgaagcccgaagacaactggttccccgacgtggaagatctggagaaccatgtaaaatataatccgcagatctccggcatccttctcattaatccggacaatcccaccggcatggtctaccccagggagatcctcgaacagatcgtagccatcgcccgcaggtacgatctcttcatcattgccgacgaggtctacaacaacatcacgtacaacggccagaccaccgtgcccatctccgacgtgatcggcgaggtgccggccattgccatgaagggaatttcaaaggaaatcccctggcccggctcgcgctgcggctggatcgaggtctataacggcaaccgcgacgagcagttccacaagttcctgaactccatcctcaccgccaagatgaacgaagtctgctccaccaccctgccgcagaagtgcatcccggccatcatgaagcatcccgagtaccagacgtaccttcgggagcgaatcgcatgctacgagcggatgagcaccatcacctacgactgcctcaagcaggttccgggtctcatggttaaccggaccaacggtgccttctacatgtcggtcgcgttccgggacggactcctcaccgaccggcagtcgctgcccatcgagagcgtggaggtccgtgaactggtggagaagctcgtgaacgcccccggggtttcgccggacaaacgtttcgtctattatatcctggcaagcactggcatctgcatcgtacctctttcttccttcaacaccccgcttcagggcttccgggttacgctgcttgaaaaggatgagaacgagtgcatgcgcatttaccgtaccctggcggagaggatcaaggagtacttgaactcctga

SEQ ID NO: 34058 - protein, 434 aa, Geobacter sulfurreducens
MRNELVTPGAGELTYEIRNIVNVAEKLQKHGVKINWENIGDPIVKKEEIPRWMKEIVAAAVMENDTWGYCHTRGVLETREFLCGLTNNRGGAQITPDDIIFFNGLGDAISTVYGNLRHESRILMPSPTYTTHSIGEAAHAQAAPVCYRLKPEDNWFPDVEDLENHVKYNPQISGILLINPDNPTGMVYPREILEQIVAIARRYDLFIIADEVYNNITYNGQTTVPISDVIGEVPAIAMKGISKEIPWPGSRCGWIEVYNGNRDEQFHKFLNSILTAKMNEVCSTTLPQKCIPAIMKHPEYQTYLRERIACYERMSTITYDCLKQVPGLMVNRTNGAFYMSVAFRDGLLTDRQSLPIESVEVRELVEKLVNAPGVSPDKRFVYYILASTGICIVPLSSFNTPLQGFRVTLLEKDENECMRIYRTLAERIKEYLNS

SEQ ID NO: 34059 - DNA, 1566 bp, Ashbya gossypii
  CDS (1)..(1566)
atggcaatagggatgctgagaagaaatagcagcggcaccgccgtgagcgttctacaggggcgtgtgcttcgcactcgtagattgagctcagtaaaggacgggtcgcggtttgtgcctgcggaaccgatgacactagcggacgtgaacgaaaacgtggtcaaggcgaagtacgcggtgcgggggaagattccaacgcgtgcagaggagctggagcggcggctggaggagcacccgggctcgctgccgttcagcaaaatcatccaagcgaacatcggcaatccgcagcagctgggccagaagccgctgacattctaccggcaagtgatctcgctgatgcagaatccacagttgctggagatgcccgcagaatggctgcagcaggcgttcaaggcggatgtggtggtgcgtgcgcggaggatgctgcaggacgccggaggctccgtgggagcgtactcggcgtcgcagggtgtgaaaggctaccggcgcacggttgcgcagtttattgagcggcgcgatgggatcccagcgaatccagacaacgtgtacctgaccgcgggtgcgtcctctgctgtgtcttgtctgctgtcgacattctgcaagggaccggagacaggcgtgttgatcccaatccctcagtacccgctgtacactgctacgatcacacagaataacgcggttgcgctgccgtactacctaaatgaggctgatgggtggtctacgaatccagatgagatggaacgtgtcatcctcgattctaagaagaggaacatcgcgcccaaatgtctggttgtgattaaccctgggaatcccactggttccgtactgtctgtaaaggatatggaggctattctaacacttgctgcgaagtatgggattgtcgttattgcggacgaggtataccaggataatgtgtttggcgatgccaagttccactctatgcgtaaggtgctgaaaaaccttcaactcagagagccaacgctctacaagaatgtccagttagcctctcttcactcgatctcgaaggggctctccggcgaatgtggccagcgtggtggctacatggaattgatcggtttccgtgaggagctcaggaaggttttcgttaagttggcttctatatctctttgtccagtggttaccggacaagctctagtcgaccttatggttgggcctcccagccaaggggatccatcctatgagcaatatacccaggaaacaaggagtatctatcacgaattggaggaacggtcgcaactgctgtggaaaacgttctgttccttggagggtatagaatgcaatatgccacaaggtgctctatatctattccctaagttgcatcttccacagaaagctattgaagcggcgcaaaagctgggtataccagcggatgagctctactgtagcgaattacttgatgaaacaggcatctgcactgtccctggaactggtttcggccaaatcccgggcacatatcacgttagaactacgtttttgccacctggtactaagtggatcgaaagttggaaggacttccacaagaaattttatgacaagtatagggactaa

SEQ ID NO: 34060 - protein, 521 aa, Ashbya gossypii
MAIGMLRRNSSGTAVSVLQGRVLRTRRLSSVKDGSRFVPAEPMTLADVNENVVKAKYAVRGKIPTRAEELERRLEEHPGSLPFSKIIQANIGNPQQLGQKPLTFYRQVISLMQNPQLLEMPAEWLQQAFKADVVVRARRMLQDAGGSVGAYSASQGVKGYRRTVAQFIERRDGIPANPDNVYLTAGASSAVSCLLSTFCKGPETGVLIPIPQYPLYTATITQNNAVALPYYLNEADGWSTNPDEMERVILDSKKRNIAPKCLVVINPGNPTGSVLSVKDMEAILTLAAKYGIVVIADEVYQDNVFGDAKFHSMRKVLKNLQLREPTLYKNVQLASLHSISKGLSGECGQRGGYMELIGFREELRKVFVKLASISLCPVVTGQALVDLMVGPPSQGDPSYEQYTQETRSIYHELEERSQLLWKTFCSLEGIECNMPQGALYLFPKLHLPQKAIEAAQKLGIPADELYCSELLDETGICTVPGTGFGQIPGTYHVRTTFLPPGTKWIESWKDFHKKFYDKYRD

SEQ ID NO: 34061 - DNA, 1161 bp, Bacillus subtilis
  CDS (1)..(1161)
atgacttcgtatttatcagactatgtacaacaaataaaaccatccggcatccgcaaattctttgatttggcggcaacgatggaaggcgtcatttctttaggcgtcggcgagcctgattttgttaccgcatggaatgtccgcgaagcaagcattctctctcttgaacaaggatatacgtcatacacggccaatgcgggtttatactcattgcgggaggaaatcagccgttatttgagcaacaggtttgaccttagctactcgccagataatgagctgattgtgacagtgggggcaagtcaggctttggatattgcgatccgcgccattgtgaatccaggtgaggaagtcatcattcctgagccgtgttttgttgcgtacgatgcgcttgtttctttggcaggcggtatcccggttcacgttcatacaacggcagacaaaggatttaaagcaacggctgctgattttgaagcggcagtcactgaaaaaacaaaggccattctcatctgctcaccatcgaatccgacaggttcggtttattcgaaggaagagctgaatgagattgctgagtttgccaaaaaacatgatgtcatcgtcttagccgacgagatctacgcggagctgacatatgatgaggaatttacaagtatagcggcattaccgggaatgaaggaacggacggtagtcatctcaggcttttcaaaagcatttgcaatgacgggctggaggctcggttttgccgcggcaccatccttgcttcgggatgccatgcttaaaattcatcagtatgcgatgatgtgcgcgcccgcaatggcgcagtttgccgcccttgaaggcctgaagaacggcatggaagacgtagaaaaaatgaaaaaaagctatcgaagaagacggaatctgtttgtagaatcgctcaatgaaatcggtctcagctgtcatcatccgggcggcgctttctatgcttttccatctatcaaaagcatgggaatgagttcagaacagtttgccgaggagctactgacgcaggaaaaagtggcagttgttcctggaagtgtgtttggtccgagcggtgagggatatatccgttgttcatacgcaacctcgattgaacagcttcaagaagcgttagtcagaatgaaacgcttcctgcacaaaacaacataa

SEQ ID NO: 34062 - protein, 386 aa, Bacillus subtilis
MTSYLSDYVQQIKPSGIRKFFDLAATMEGVISLGVGEPDFVTAWNVREASILSLEQGYTSYTANAGLYSLREEISRYLSNRFDLSYSPDNELIVTVGASQALDIAIRAIVNPGEEVIIPEPCFVAYDALVSLAGGIPVHVHTTADKGFKATAADFEAAVTEKTKAILICSPSNPTGSVYSKEELNEIAEFAKKHDVIVLADEIYAELTYDEEFTSIAALPGMKERTVVISGFSKAFAMTGWRLGFAAAPSLLRDAMLKIHQYAMMCAPAMAQFAALEGLKNGMEDVEKMKKSYRRRRNLFVESLNEIGLSCHHPGGAFYAFPSIKSMGMSSEQFAEELLTQEKVAVVPGSVFGPSGEGYIRCSYATSIEQLQEALVRMKRFLHKTT

SEQ ID NO: 34063 - DNA, 1194 bp, Thermococcus litoralis
  CDS (1)..(1194)
atggttaaagcgtcaaaaagagcgatgagtattgagtatgccattagggacgttgttctgcctgcaagggagcttgaaaagcagggaataaaaatcatcaagctcaacatcggtgatcccgtgaagtttgactttcagcccccagagcacatgaaaaaagcttattgcgaagcaataatggagggtcacaactattacggggacagcgagggggatagggaacttagagaggctattgtggagagggaaaagaaaaagaacggtgtggatattactccagaggatgtccaagttacagctgccgttaccgaggcattgcagttcatttttggggcacttatcgatggaggcgaggagatactaatccccgggccgagctatccgccatacgttggacttgtgaagttctacggtggtgttcccaaggcttatagaacagttgaggaagagggatggcagccggatatagatgacatgaggaaaaagataaccgaaaaaacgaaagcaatagccgttataaatccaaacaaccccactggagccctctatgaaaagaagacccttcaagagataatagaccttgctggtgagtatgacttgccaataataagcgatgagatttatgacctcatgacatatgaaggaaagcacgtttctccgggttcattaactaaggacgtgcctgtaatagtcatgaacggtctctcaaaggtctacttcgcaacaggatggagattgggctatatgtactttgtagacccagagaacaagcttgctgaggttagagaagcaatagggaagctcgcaaggataaggctctgtccaaacactccggctcaaaaagcggcaatcgctggccttaggggtccaatggactaccttgaggaatacatggcaaaactgaaggagagaagggactacatctacaagcgccttaatgagatgccaggaataagcacccagaagccacagggagcattctacatattccccaagattgaggaaggcccatggaagagcgacaaagagttcgtccttgatgtcctccacaacgcccatgtgctctttgtccacggctctggatttggcgaaggtggcgaaatgcacttccgttcaatattcttagctccggttccagtgttagaagaagccatggacaacctggagaagtttatgaaagaaaggcttggatga

SEQ ID NO: 34064 - protein, 397 aa, Thermococcus litoralis
MVKASKRAMSIEYAIRDVVLPARELEKQGIKIIKLNIGDPVKFDFQPPEHMKKAYCEAIMEGHNYYGDSEGDRELREAIVEREKKKNGVDITPEDVQVTAAVTEALQFIFGALIDGGEEILIPGPSYPPYVGLVKFYGGVPKAYRTVEEEGWQPDIDDMRKKITEKTKAIAVINPNNPTGALYEKKTLQEIIDLAGEYDLPIISDEIYDLMTYEGKHVSPGSLTKDVPVIVMNGLSKVYFATGWRLGYMYFVDPENKLAEVREAIGKLARIRLCPNTPAQKAAIAGLRGPMDYLEEYMAKLKERRDYIYKRLNEMPGISTQKPQGAFYIFPKIEEGPWKSDKEFVLDVLHNAHVLFVHGSGFGEGGEMHFRSIFLAPVPVLEEAMDNLEKFMKERLG

SEQ ID NO: 34065 - DNA, 1215 bp, Vibrio vulnificus
  CDS (1)..(1215)
atgcaaaatatcgggatgtcgtcaaaactcgacaatgtctgctatgacatcaggggtcctgtactcaaacatgctaagcgcatggaagaagaagggcataaaatccttaagctaaatattggaaaccccgccccatttggctttgacgcccctgatgaaattctggtcgatgtgattcgtaacttgcctacgtcgcaaggttactgcgattcaaaaggcatctactcagcacgtaaagccgtggtacagcactaccaacgcaaagggattcgttctctcgatgtggaagatgtttacgtgggcaatggcgtctctgagctgatcgtgatggccatgcaagcactgcttaacaacggtgacgaaatgctggttccagcaccagactacccattatggaccgccgccgtggcactttcaggcggcaaagcggtgcattacctctgtgatgagcaagcagactggtaccctgatctggatgatatgcgcaaaaaaatcacgcctaagactcgtggtattgtactcatcaacccaaataacccgacgggtgccgtctacagccgcgattttctactggaagtgatcgaaatcgcgcgtcaacacaagctgatgattttcgccgatgaaatctacgacaaggtgttgtacgacggagcggttcacacctcagtcgcgaccttaactgacgatgtgctggtgatgacgtttaacggcctatcaaaagcctatcgcgtatgtggtttccgtggtggttggatgtttatgaccggaccaaaacatttagcgcaaggctatgttaacggtttggacatgctggcttcgatgcgcctgtgtgccaacgtgccaatgcaacacgcgattcaaactgccttggggggctatcagagcatcaatgaattgatcttacctggcggtcgtttattggagcaacgtgatcgcgcatgggagttgatcaaccaaatacctggcgtttcatgtgtgaaaccaaaaggcgcaatgtatctgttccctaagattgatacgaaaaaatacagcatcaaagatgaccaaaagatggtttttgattttctcgttcaagaaaaagtgttgttagtgcagggttctggattcaactggccaaaaccagaccacttccgcattgttactctaccgcacatcgaagatctcgaaaccgccattggccgctttgaacgtttcttacatggctatagccagtag

SEQ ID NO: 34066 - protein, 404 aa, Vibrio vulnificus
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLVPAPDYPLWTAAVALSGGKAVHYLCDEQADWYPDLDDMRKKITPKTRGIVLINPNNPTGAVYSRDFLLEVIEIARQHKLMIFADEIYDKVLYDGAVHTSVATLTDDVLVMTFNGLSKAYRVCGFRGGWMFMTGPKHLAQGYVNGLDMLASMRLCANVPMQHAIQTALGGYQSINELILPGGRLLEQRDRAWELINQIPGVSCVKPKGAMYLFPKIDTKKYSIKDDQKMVFDFLVQEKVLLVQGSGFNWPKPDHFRIVTLPHIEDLETAIGRFERFLHGYSQ

SEQ ID NO: 34067 - DNA, 1215 bp, Photorhabdus luminescens
  CDS (1)..(1215)
atgctagcagttaaaaaatccagcaaattggataatgtttgttatgatatccgcggccccgtactcaaggaagctaaacgccttgaagaagaaggcaataaagtcctcaaattaaatattggtaatccagccccctttggttttgaagcaccagatgaaatcttggtagatgttatccgtaacttaccaacagcacagggttattcagattcgaaaggtctgtattctgcacgcaaagctatcatgcaacattatcaagcccggaatatgatggacgtaaccgttgaagatatttatatcggcaatggtgtttctgaattaatcgttcaggcaatgcaagcattactgaatactggtgatgaaatgctggttcctgcacctgattatcctctctggactgcggcagtttcactttccagtggcaaagccgtgcattatatgtgtgatgaagggtcagattggtttcctgacttaaatgatatccgcaacaaaattacgccccgcacacgtgggattgtgattattaaccctaataatccaacgggtgctgtatatagtaaagagctgttattggaagttgttgaaatagcccggcaacacaatttgattatttttgctgatgagatttacgacaaaatcttatatgacgatgccgagcatcattcaattgccgccctcgcgcctgatctgttaacggtaacatttaatggattatctaaaacatatcgggttgcaggttttcgtcaaggctggatggtattaaacggcccgaagaaacacgctaagagctatattgaaggtttggagatgctggcatcaatgcgtttatgtgccaatgtgccaatgcaacacgctattcaaactgctttaggcggttaccaaagtatcagtgaattcattttacctggtggccgtttgtatgagcagcgtaaccgagcatgggaattaatcaatcaaatccccggcgtttcctgcgtgaaacctaaaggcgctttatatatgtttccaaaaattgatgcaaaacgttttaatgttcacgatgaccagaaaatggtgcttgaccttttattacaagagaaggtcttgttagtgcagggaaccgcatttaactggccggaacctgaccatctccgcattgtgaccctaccaaggcttgatgaactggagatggcaattcagaaattcgcccgatttattggtaaatatcatcagtaa

SEQ ID NO: 34068 - protein, 404 aa, Photorhabdus luminescens
MLAVKKSSKLDNVCYDIRGPVLKEAKRLEEEGNKVLKLNIGNPAPFGFEAPDEILVDVIRNLPTAQGYSDSKGLYSARKAIMQHYQARNMMDVTVEDIYIGNGVSELIVQAMQALLNTGDEMLVPAPDYPLWTAAVSLSSGKAVHYMCDEGSDWFPDLNDIRNKITPRTRGIVIINPNNPTGAVYSKELLLEVVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHLRIVTLPRLDELEMAIQKFARFIGKYHQ

SEQ ID NO: 34069 - DNA, 1188 bp, Gloeobacter violaceus
  CDS (1)..(1188)
atgtcccgcctggccacccgcgtcgcttcgctgactccatcgctcacgcttgccattgccgccaaagccaaggcgctggcggcgggcggcgtcgatgtgtgcggcctgagcgccggggaacccgatttcgatactcctgctcccatcaaggcggcggccaaggcggccctcgaccgcggtgagaccaagtacggaccggtggccgggcagccgcgcctgcgcgaacggattgcccgaaagttggagcgcgaaaacggcctaccctacacccccgagcagattctggtcaccaacggcggcaagcagggcctttacaacgcgatcatggccctcatcgaacccggcgatgcggtgctcatcccgagcccctactggctgagctacccggagatggtttcgctcgcgggcggtacctcggtgctcttgcccaccaccgaggcgaccggcttcaagatcacgcctgagcaactggaggccgccatcaccccccgcacccggttgctcatcctcaattccccctccaacccgacgggcatggtctacagccgccccgaactggaggcgattaccgaggtggttctgcgccacgacctgatggttctctccgacgaaatctacgaaaaactcgtctacgacggcgcgcggcaccacagcatcggcggcctggggcgcgaaatgtttgcgcgcacgatcaccagcggcggcttcagcaaggcttttgcgatgaccggctggcggctcgggtacctggccggtcccacggacctgattggggccgccggcgccattcagagccacagcacctccaacgtcgccgcctactcccaagccggggcgttggcggccctcgaagatccgcaggtggcgctcgaagtggagcggatggtgcgcgtcttcgccgagcggcgcaccgccatgtacgatgcggtggcggcgatcccgggtctgcgctgtgcccgtgcccagggggctttctatctgctgccggatatttccgccacgggcctcaattccacggccttctgcgaacaactgctcgaccaattccacgtcgctgcggtgcccggcatcgccttcggctcggacagccacgtccgcctttcttacgccaccgacctcgacaccatctacaaaggcgttgaacgtctcggccagtttgtgcgccagtgcctggccgtgcgcgcctga

SEQ ID NO: 34070 - protein, 395 aa, Gloeobacter violaceus
MSRLATRVASLTPSLTLAIAAKAKALAAGGVDVCGLSAGEPDFDTPAPIKAAAKAALDRGETKYGPVAGQPRLRERIARKLERENGLPYTPEQILVTNGGKQGLYNAIMALIEPGDAVLIPSPYWLSYPEMVSLAGGTSVLLPTTEATGFKITPEQLEAAITPRTRLLILNSPSNPTGMVYSRPELEAITEVVLRHDLMVLSDEIYEKLVYDGARHHSIGGLGREMFARTITSGGFSKAFAMTGWRLGYLAGPTDLIGAAGAIQSHSTSNVAAYSQAGALAALEDPQVALEVERMVRVFAERRTAMYDAVAAIPGLRCARAQGAFYLLPDISATGLNSTAFCEQLLDQFHVAAVPGIAFGSDSHVRLSYATDLDTIYKGVERLGQFVRQCLAVRA

SEQ ID NO: 34071 - DNA, 1305 bp, Chromobacterium violaceum
  CDS (1)..(1305)
atgaaacaaccacaccgccaacgcaagaccgttccgtccggcgggcggcctgaaacggaaaccgccgccgccatgcagccagtacacaagtctcagaaactcgccaacgtctgttacgacatccgcggaccggtgctcgaacacgcgaagaggatggaggacgaggggcaccgcatcatcaagctgaacatcggcaacccggcgccgttcggcttcttcgccccggacgagatcatcgaggacgtgatcgtcaacctgccggcggcgtccggttactccgactccaagggtctgttcgccgcgcgcaaggccatcatgcattacgcgcagcagaagcacctgcccaacgtggcgatggacgacatcatcgtcggcaacggcgtgtccgagctgatcgtgatggcgatgcaggcgctgctggacaacggcgacgaagtgctggtgccggcgccggattatccgctgtggaccgcggcggtgagcctggccggcggcaaggccgtgcactacttgtgcgacgaggagcagggctggttccccagcatcgacgacatccgcgccaagatcacgccgaccacccgcgccatcgtcatcatcaacccgaacaatccgaccggcgcggtgtatccgcccgcgctgctgcagcagatcgtcgacgtcgcgcgccagcaccagctgatcatctatgccgacgagatctacgacaaggtgctgtacgacgcggtccggcacacttccatcgcctccttggcgccggacctgttcgtggtgacgctgaacggcctgtccaagaactaccgcgcctgcggttaccgcgccggctggatgatcctgtcgggcgagaaaaagcacgccaaggactacatcgaaggcctgaacatgctggcttcgatgcggctgtgcgccaacgtgccgtcgcaatacgcgatccagaccgcgctgggcggctaccagagcatcgacgacctggtggcgccgggcggacgcctggcgcgccagcgcgacctcgcccacaagctgctgaccgagattccgggcgtgtcctgcgtcaagccgcagggcgcgctgtacctgttccccaggctggatcccaaggtctacccgatcgccgacgaccagcagttcatcctggaactgctgcagcaggagaaggtattgctggtgcagggcagcggtttcaactggattgcgcccgatcacttccgcgtggtattccttcccaactcggacgatctgatcgaggccatcggccgcatcgcgcgcttcctggaaagctaccgcaagcgtcacggcgctgccgagtaa

SEQ ID NO: 34072 - protein, 434 aa, Chromobacterium violaceum
MKQPHRQRKTVPSGGRPETETAAAMQPVHKSQKLANVCYDIRGPVLEHAKRMEDEGHRIIKLNIGNPAPFGFFAPDEIIEDVIVNLPAASGYSDSKGLFAARKAIMHYAQQKHLPNVAMDDIIVGNGVSELIVMAMQALLDNGDEVLVPAPDYPLWTAAVSLAGGKAVHYLCDEEQGWFPSIDDIRAKITPTTRAIVIINPNNPTGAVYPPALLQQIVDVARQHQLIIYADEIYDKVLYDAVRHTSIASLAPDLFVVTLNGLSKNYRACGYRAGWMILSGEKKHAKDYIEGLNMLASMRLCANVPSQYAIQTALGGYQSIDDLVAPGGRLARQRDLAHKLLTEIPGVSCVKPQGALYLFPRLDPKVYPIADDQQFILELLQQEKVLLVQGSGFNWIAPDHFRVVFLPNSDDLIEAIGRIARFLESYRKRHGAAE

SEQ ID NO: 34073 - DNA, 1440 bp, Giardia lamblia ATCC 50803
  CDS (1)..(1440)
atgccttaccagcccgttttgactcctgaaacctgctacaaaggcctcttcgatgtcaagttctccatggtgaacctagatctctcaagcgtcgagcagaaaatcgcccagaaacaggcgccctttagctccatcattaagtgtaatctgggcaacccgcagggtgttgggcagaagcctgtcacataccttcgtcaaatggtagccggatttgcctgcccagatcttatagggaagtatgtattgcccacagacgtcgagttacgtgtcaaacacattctcaattcgtgctccgggaaaagctctgggtcgtaccaggcgacagcggggattcctgccgttgttgatgacgtggccgcgtatatttctgatcgcgacgagattccgtgcaatccagccactgtctgcatggctaacggagccactgaggcaattatgactcttctccgcccaataattcgcaacgaaaccgacgccatcctctgcccacgccccggattccccctttacgcctccacgatcgtttactatgggggaaaggaggtcagctatgacctggacgaatccaatgagtgggctcttacacaggaggctctggatgctgcactccaacaatgcaaggatgaaggactgactccccgctgtcttgtcctcataaatccgaacaatccaacgggctcgacgctgacagagagcgatataaagaacgctctccgtttcgcatacaagaacgacatgatggtcatgtctgacgaggtgtaccaaacgaatatctatgagccagaggaatttcctttcctctccgccagaaagcttctctacgcgcttaacgccgagggtgagtgtcaaggccttgagctgatctccatccactcggcctcaaagtccatctttggtgagtgtggacggcgcggcggctattggcaagcggagaacttgaatccaaaatttatggagcagataatggacataatttcactggggtcaactaatacggatggaatgatggctatggatgtcatcgttaaccctccgagacccggagagccgtcttattggaaattcaagcgagaatgcgacgctctctatactagccttcaacgcaaggcgagaatggtatcccatgagatgaacagttggagggggctgagttgctgtaagccttctggggcaatgtacgttttccccagaatccatgcaccgccagccgctattgaagcagcgaggttggcgggcaaagagccagaccaattgtactgccaggatctgctagatagcgtaggagtcttcacgcttgacggtggcatgtttggccaaaagcccggaacctaccatctccgtatgactattcttccttctgaagaggtaatgaccgatctgctcgccagatggaaggttttccacgaaggatggatgtccaagtactctgcagaagagtaa

SEQ ID NO: 34074 - protein, 479 aa, Giardia lamblia ATCC 50803
MPYQPVLTPETCYKGLFDVKFSMVNLDLSSVEQKIAQKQAPFSSIIKCNLGNPQGVGQKPVTYLRQMVAGFACPDLIGKYVLPTDVELRVKHILNSCSGKSSGSYQATAGIPAVVDDVAAYISDRDEIPCNPATVCMANGATEAIMTLLRPIIRNETDAILCPRPGFPLYASTIVYYGGKEVSYDLDESNEWALTQEALDAALQQCKDEGLTPRCLVLINPNNPTGSTLTESDIKNALRFAYKNDMMVMSDEVYQTNIYEPEEFPFLSARKLLYALNAEGECQGLELISIHSASKSIFGECGRRGGYWQAENLNPKFMEQIMDIISLGSTNTDGMMAMDVIVNPPRPGEPSYWKFKRECDALYTSLQRKARMVSHEMNSWRGLSCCKPSGAMYVFPRIHAPPAAIEAARLAGKEPDQLYCQDLLDSVGVFTLDGGMFGQKPGTYHLRMTILPSEEVMTDLLARWKVFHEGWMSKYSAEE

SEQ ID NO: 34075 - DNA, 1461 bp, Neurospora crassa
  CDS (1)..(1461)
atgtcgtcctccaactcccgccgtctcaacattgacaacatcaacccgcacgttagagcggccaagtacgctgtgcgcggtgagcttgccgtcaagtccgaggagttccgggccgccctcctccgtggaacctccgacatccccttcagccaggtcatctcggccaacatcggcaacccccagcagcttgaccagaagcccatcacctttttccgccaggtcctcagtctcctcgagaaccctctgcttctcgagcatgaggacgtcctcatcaaccacctcggctacaagactgatgtcattgagcgcgccaagtggttcctcaagaatgttggctccgtaggagcttacagtgccagcaacggcgcccctgccatcagacagcacattgcagagttcctcgagaggcgcgatggcttccctgccaactggcaagacatctacctctctgccggtgcttcttcgggagtcaacaccctcctgcacatcatctgcgccgatgagaagagcggcatcctggttcccatcccccagtaccctctctacaccgcctcgctctccatcctgaacgccacctgcgttccctacctcctcgatgagtccaagaactggggcaccgacatcaacaccatcaaggagtcgtaccaaaaggccaaggacgccggcgtcgacactcgcgccatcgtcatcatcaaccccggcaaccccaccggcgcctccctctccgaggaggacatccgcgccgtcctcgagttcgcgcgccaggagcgccttgtcgtcctcgccgacgaagtctaccagaccaacgtcttcatcggcgagttcatctcgttcaagcgcgtgctccgccagttgcagaaggagaaccccgacggcaagtacgactgcgtcgagctggcttccctccactccatttccaagggcatggtgggcgagtgcggccaccgcggtggctactttgagctggtcaactttgatcccgaagtccaggctgaaatctacaagttcgtcagcatcatgctctgcgcgcctgtcattggccagtgcctggtcgagctgatggtcaatccgcccaagcccggcgagccctcctacgagctctacgagaaggagtaccgcggcatctacgagggcatgagggagcgcgccaacgctctccacaaggcgtttgagcagatggagggcgtcgagtgcggtgctccccagggtgccatgtacctcttccctaccatcaacttgccccccaaggccgccgaggccgccgccaaggagggccgtacccccgacgagttctactgcatgaagctcctcgaggctaccggcgtctgcgttgttcctggttctgggttcggtcagaaggagggtagcttgcacttccgcactaccttccttgctcctggtaccgagtgggttggcagcattgtcaagttccacaaggagttcatggatcaatatcgttga

SEQ ID NO: 34076 - protein, 486 aa, Neurospora crassa
MSSSNSRRLNIDNINPHVRAAKYAVRGELAVKSEEFRAALLRGTSDIPFSQVISANIGNPQQLDQKPITFFRQVLSLLENPLLLEHEDVLINHLGYKTDVIERAKWFLKNVGSVGAYSASNGAPAIRQHIAEFLERRDGFPANWQDIYLSAGASSGVNTLLHIICADEKSGILVPIPQYPLYTASLSILNATCVPYLLDESKNWGTDINTIKESYQKAKDAGVDTRAIVIINPGNPTGASLSEEDIRAVLEFARQERLVVLADEVYQTNVFIGEFISFKRVLRQLQKENPDGKYDCVELASLHSISKGMVGECGHRGGYFELVNFDPEVQAEIYKFVSIMLCAPVIGQCLVELMVNPPKPGEPSYELYEKEYRGIYEGMRERANALHKAFEQMEGVECGAPQGAMYLFPTINLPPKAAEAAAKEGRTPDEFYCMKLLEATGVCVVPGSGFGQKEGSLHFRTTFLAPGTEWVGSIVKFHKEFMDQYR

SEQ ID NO: 34077 - DNA, 1185 bp, Lactobacillus johnsonii NCC 533
  CDS (1)..(1185)
atgccaaaattatcaaatgatttatcacttacaaaaaatacacgattaaattctttaggaccttcaaaaattagagcttttgatgaaaaagcttctcaaatcccaggaattattaaattaacgattggagaacctgacttaaatacaccagatcatgttaaagatgcagctattgccgatattaaagcaaacgactcgcattatgcaccacaagcaggtaagcctgagttattagaagctatcagcaactatctcgatcgcagccttgatgttaaatacgatccaaaaactgaaatttgtgttacagttggagccactggagctttaaatgatgtattcatgtcaattttaaatccaggtgataagattttagttcctacgccagtatgggcactctactttcaactaattaaattaaccggagctatcccagttcaaattgatacttcaaaagatgattttatcctgactcctgaacatcttgaaacagtactacaaaatgaaggaaaaggtgctaaagcaatcattttaactgatccatctaatccaacaggtcgtgtttatccagcagccactttaaaggcacttgcagaggttattaccaagtaccatctcttctcggttacagacgaaatatatggtgaattggtttacgataataatgttcatcattctttatctcaatatattcctgagcgcaatattctaatttcaggactttcaaaagcatatgcaatgactgggtggcgtttaggatatattgcagctcctgcagatattatgaaaaccattcaaaaagtaaatgcttttcttgttacctccgtaaccgataatgttcaggctgctgcaattgaagcactaaataatggacaagcagatcctcttgaagcacgcaaaatttacgaagacagattggaatttatgaaaactggtctagaaaaattaggctttgaaatgtctactccacaaggagctttctacatttttgctaaaattcctgatacttttggtaccgacgacgaagccttcgctaatgaattagccactaaagcaaaagttggtgtgactccaggtcgctatttcggtaagggcggccaaggatatgttagaatgtcttacgcttcttcgaccgaacaattacaagaagccttaaaacgaattgcaaaatttgttgaaaatatctaa

SEQ ID NO: 34078 - protein, 394 aa, Lactobacillus johnsonii NCC 533
MPKLSNDLSLTKNTRLNSLGPSKIRAFDEKASQIPGIIKLTIGEPDLNTPDHVKDAAIADIKANDSHYAPQAGKPELLEAISNYLDRSLDVKYDPKTEICVTVGATGALNDVFMSILNPGDKILVPTPVWALYFQLIKLTGAIPVQIDTSKDDFILTPEHLETVLQNEGKGAKAIILTDPSNPTGRVYPAATLKALAEVITKYHLFSVTDEIYGELVYDNNVHHSLSQYIPERNILISGLSKAYAMTGWRLGYIAAPADIMKTIQKVNAFLVTSVTDNVQAAAIEALNNGQADPLEARKIYEDRLEFMKTGLEKLGFEMSTPQGAFYIFAKIPDTFGTDDEAFANELATKAKVGVTPGRYFGKGGQGYVRMSYASSTEQLQEALKRIAKFVENI

SEQ ID NO: 34079 - DNA, 1440 bp, Oryza sativa
  CDS (1)..(1440)
atgcttcgcgccgccgcccgcgcgctcaccgtcagctccctcaacccaaaggtgctcgcgctggcggatcaccacctcggcggactcgtcgcccgccgcgcgcagctggtgacagtaacggttaatatccttatagtagagaggaaaaaaattttgcaagctgacacgagcatgcaacaagagctagacgctaatccagcttcacatcctttcagtgaggttcttgcattgtgtaatcatccccatctcctagaccggagtgaggccagcttcatgttcagctctgatgcgataacgagggcacgggagattgtaggcttcattcctggaaaaacaactggaggatacagtcactgtcaggcaaattcaattgtttcagaattcagagcaaatgctgacaaatatgggaatgagctttcatcaaacttgactatttttgacagggttcatatgatgatgcacttgttgatacgtggcaagaaggacggcatcctttgcccaattccatcacactctttgtacacagattctatggttcttcgtggcgcaactcttgtaccgtattaccttgatgaatccagaggttggagtgtgaacatttcagatctgaagaaacagttggatggtgcccgggcaaagggcattgatgtgaggggacttgtggtggtaaatccgggaaaccctactgggcaggttcttgtggaggaaaaccagtgtgaaatagtggagctctgcaagaatgaatgccttgttctcctagcagatgaggtttaccaagaaaacatttacacggatcagaagaaatttaactccttcaagaaggtagcacggtccataggctatggggaaggggatatatctttagtatcattccactcagtatctaatggatactacggagaatgcgggagaagagggggttacatggaggtcactggcttcagctcggaagtaaggggagaagtatacaaagttgcatccctaagcgcatgctccaacatatctggccagatccttatgagcctagtcatgaacccaccaaaggttggagatgagtcatacccctcttatcgtgcagaaagagacagcatactatcatctttgtcttgctgtgcagaggccatggtgtccacattcaacagcatggaagggatgacttgcaacaaggctgaaggtggaatatctgtgttccctagtgttcggctgccgccacgggcaattgaagctgctgaggcgatgaacacagagccggatgtgttctatgctctccgtcttctcgaaagcactgggattgttgttgtgcctggctcagtgtttggacaagtacctggaacatggcatttcagatgcacaattctgccacaggaagagaagacacggcagattatctcccgctttaatgtgttccatgaagcatttatggaagaattccgcagctaa

SEQ ID NO: 34080 - protein, 479 aa, Oryza sativa
MLRAAARALTVSSLNPKVLALADHHLGGLVARRAQLVTVTVNILIVERKKILQADTSMQQELDANPASHPFSEVLALCNHPHLLDRSEASFMFSSDAITRAREIVGFIPGKTTGGYSHCQANSIVSEFRANADKYGNELSSNLTIFDRVHMMMHLLIRGKKDGILCPIPSHSLYTDSMVLRGATLVPYYLDESRGWSVNISDLKKQLDGARAKGIDVRGLVVVNPGNPTGQVLVEENQCEIVELCKNECLVLLADEVYQENIYTDQKKFNSFKKVARSIGYGEGDISLVSFHSVSNGYYGECGRRGGYMEVTGFSSEVRGEVYKVASLSACSNISGQILMSLVMNPPKVGDESYPSYRAERDSILSSLSCCAEAMVSTFNSMEGMTCNKAEGGISVFPSVRLPPRAIEAAEAMNTEPDVFYALRLLESTGIVVVPGSVFGQVPGTWHFRCTILPQEEKTRQIISRFNVFHEAFMEEFRS

SEQ ID NO: 34081 - DNA, 1191 bp, Bacillus cereus
  CDS (1)..(1191)
atgaagcaatttgaactatctagatcagcagaatctttaaaaccatctggtattcgaaaattttttgatttagcagcaaatatgaaaggtgttatttccctcggggtaggagagccggattttgttaccccttggaatgtaaggcaagcatgtattcgttctttggaacaagggtatacgtcatatacagcaaatgcaggattattggagctccgtcaagaaatagcaaagtatctaaaaaaacaatttgcagtatcttatgatccaagtgatgaaatcattgttacagttggagcgagccaggcgttagatgtagcgatgcgtgccattataaatcctgatgatgaagtgctcattgttgaaccaagcttcgtttcttatgcaccacttgtgacattagctggaggagttccggttcctgtggagactaagctagaaaacgagtttaaagtacaaccagaacaaattgaagcagctattacagcgaaaacaaaggcgattttgctttgttcaccaaataacccgacaggtgcaatgctaaataaatccgagcttgaagaaatagcagtgattgttgagaagtacaatctaattgtattatctgatgaaatttatgcagagcttgtatacgacgaagcatatacaagtttcgcgagtattaaaaatatgcgcgagcatacgattttaatttcaggattttcaaaaggatttgcgatgacaggatggcgtctcggtatgattgcagctcctgttcagttttcagaattgatgctcaaaatccaccaatattccatgatgtgtgcaccgacgatgtctcagttcgcagcacttgaagcgttacgtgcggggaatgatgaagtaattcggatgagagatagttataagaagcgtcgtaattttatgacgacatctttcaatgaaatgggcttaacgtgtcatgtgccgggcggagcattttatgttttcccttctatatcttcaacaggattatcttcagcggaatttgcagaacagttattgctggaagaaaaagtagctgttgtccctggtagcgtatttggcgaaagtggtgaagggtttattcgttgttcttatgcgacgtcgcttgaacaacttatggaagcaatgaagagaatggaacggtttgttgaaaataaaaaaaggacaaaacgtaatacgttttgtccataa

SEQ ID NO: 34082 - protein, 396 aa, Bacillus cereus
MKQFELSRSAESLKPSGIRKFFDLAANMKGVISLGVGEPDFVTPWNVRQACIRSLEQGYTSYTANAGLLELRQEIAKYLKKQFAVSYDPSDEIIVTVGASQALDVAMRAIINPDDEVLIVEPSFVSYAPLVTLAGGVPVPVETKLENEFKVQPEQIEAAITAKTKAILLCSPNNPTGAMLNKSELEEIAVIVEKYNLIVLSDEIYAELVYDEAYTSFASIKNMREHTILISGFSKGFAMTGWRLGMIAAPVQFSELMLKIHQYSMMCAPTMSQFAALEALRAGNDEVIRMRDSYKKRRNFMTTSFNEMGLTCHVPGGAFYVFPSISSTGLSSAEFAEQLLLEEKVAVVPGSVFGESGEGFIRCSYATSLEQLMEAMKRMERFVENKKRTKRNTFCP

SEQ ID NO: 34083 - DNA, 1188 bp, Bacillus cereus
  CDS (1)..(1188)
atgaaattagcaaagcgagtagctgctttaacaccgtcttcaactttagaaattacagcaaaggcacaagcactaaaagcagagggtcatgatgtaattggattaggggcaggggaacctgactttaatacaccagagcatattatggatgctgcacataaagcgatgttagaagggcatacgaagtatacaccaacaggtggattacaatcgttaaaacaagaaattgtgaagaaatttactcgcgatcaaggtattgcgtatgatccatctgaaattattgtatgtaatggtgcaaagcatgcattatatacattattccaagtattacttgatgagggagatgaagttatcatcccaactccttactgggtaagctatccagagcaagtaaagcttgctggcggtaagccggtttatgtagaaggtttagaagacaatgagtacaaaattacagcaaagcagctgcgtgaggcaattacagagaaaacgaaagcagttattattaattcaccgagcaatccaacaggaatgatttatagcaaagaagaattacaacagcttggagaagtatgtttagaacatgatattttaatcgtttctgatgaaatttatgaaaaattaatttatggtggcgtagaatatacttcaattgcccagctttctaatgcattaaaagaacaaacacttattattaatggtgtatctaaatctcattctatgacaggatggcgtattggatatgctgcaggaaataagcagcttattaaagcaatgacgaatttagcgagtcatagtacgtcaaaccctacttcaatcgctcaatacggcgcaattgcggcatatacaggctcacaagaacctgtggaaacaatgcgtcaagcctttgaagagagattaaacatcatttatgataaattaattcaaatccctggctttacttgtattaaaccgcaaggggcattttacttattccctaacgtaaaagaagctgtagctttatcaggatatgcaacagttgatgattgggcaaaagctctattagaagaggaaaaagtggctcttgtaccaggtacaggatttggtgctccaaataatgttcgtttatcatatgcgacatctcttgaacaagtagagaaagcattagagcgcatccatacatttatgaaaagtaaagtgcaagcttaa

SEQ ID NO: 34084 - protein, 395 aa, Bacillus cereus
MKLAKRVAALTPSSTLEITAKAQALKAEGHDVIGLGAGEPDFNTPEHIMDAAHKAMLEGHTKYTPTGGLQSLKQEIVKKFTRDQGIAYDPSEIIVCNGAKHALYTLFQVLLDEGDEVIIPTPYWVSYPEQVKLAGGKPVYVEGLEDNEYKITAKQLREAITEKTKAVIINSPSNPTGMIYSKEELQQLGEVCLEHDILIVSDEIYEKLIYGGVEYTSIAQLSNALKEQTLIINGVSKSHSMTGWRIGYAAGNKQLIKAMTNLASHSTSNPTSIAQYGAIAAYTGSQEPVETMRQAFEERLNIIYDKLIQIPGFTCIKPQGAFYLFPNVKEAVALSGYATVDDWAKALLEEEKVALVPGTGFGAPNNVRLSYATSLEQVEKALERIHTFMKSKVQA

SEQ ID NO: 34085 - DNA, 1227 bp, Streptomyces avermitilis
  CDS (1)..(1227)
atgagcgctgcaacccctcccaccgagcgccgggtctccgcccgagtcggcgcgatctccgagtccgccaccctcgccgtggatgccaaggccaaggccctcaaggccgccggacgtccggtgatcggcttcggcgccggtgagcccgacttcccgaccccggactacatcgtccaggccgccatcgaggcctgctcgaacccgaagtaccaccgctacacgccggccggcggcctgcccgagctgaaggccgccatcgccgcgaagacgctccgcgactcgggctacgaggtggacgcctcgcaggtcctggtcaccaacggcggcaagcaggcgatctacgaggccttcgccgcgatcctcgacccgggcgacgaggtcatcgtccccgcgccgtactggaccacctacccggagtcgatccgtctcgccggcggtgtccccgtcgacgtcgtcgccgacgagaccaccggctaccgcgtctcggtcgagcagctggaggccgcccgcaccgagaacaccaaggtgctgctcttcgtctccccgtccaacccgacgggcgcggtctacacccgcgagcagatcgaggagatcggccgctgggccgccgagaagggcctgtgggtcctgaccgacgagatctacgagcacctcgtctacggggacgccgagttccactccctgccggtggtcgtgcccgagctggccgacaagtgcatcgtggtcaacggtgtcgcgaagacgtacgcgatgaccggctggcgcgtgggctgggtcatcggtcccaaggacgtcatcaaggccgcgacgaacctccagtcgcacgccacgtcgaacgtctccaacgtggcgcaggtcgccgcgctcgccgccgtgtccggcgatctgacggccgtcgccgagatgcgcgaggccttcgaccgccgccgcaagaccatcgtgcggatgctgaacgagatcggcggcgtcctgtgcccggagcccgagggcgcgttctacgcgtacccctcggtgaaggcgctgctcggcaaggagatccgcggcaagcgcccgcaggacacggtcgagctggccgcgctgatcctggaggaggccgaggtcgcggtcgtccccggcgaggccttcggcacgccgggctatctgcggctgtcgtacgccctgggtgacgaggatctggtcgagggcgtcagccggattcagaagctgctgtccgaggcgaaggactga

SEQ ID NO: 34086 - protein, 408 aa, Streptomyces avermitilis
MSAATPPTERRVSARVGAISESATLAVDAKAKALKAAGRPVIGFGAGEPDFPTPDYIVQAAIEACSNPKYHRYTPAGGLPELKAAIAAKTLRDSGYEVDASQVLVTNGGKQAIYEAFAAILDPGDEVIVPAPYWTTYPESIRLAGGVPVDVVADETTGYRVSVEQLEAARTENTKVLLFVSPSNPTGAVYTREQIEEIGRWAAEKGLWVLTDEIYEHLVYGDAEFHSLPVVVPELADKCIVVNGVAKTYAMTGWRVGWVIGPKDVIKAATNLQSHATSNVSNVAQVAALAAVSGDLTAVAEMREAFDRRRKTIVRMLNEIGGVLCPEPEGAFYAYPSVKALLGKEIRGKRPQDTVELAALILEEAEVAVVPGEAFGTPGYLRLSYALGDEDLVEGVSRIQKLLSEAKD

SEQ ID NO: 34087 - DNA, 1212 bp, Streptomyces avermitilis
  CDS (1)..(1212)
atgcaggtgatccagtccacgaagctcgccaacgtctgctacgagatccggggcccggtgctcgaggaggcgatgcggctggaagcggctggtcatcggatcctcaagctcaacacgggcaatccggcggcgttcggcttcgagtgcccgcccgagatcctcgaggacatcctccgcaacgtctcctccgcacacggctacggcgacgcgaagggcctgctggccgcccgccgcgccgtcgtcatgcacaaccagaccctcggcatcgagacggacgtcgagcacgtcttcgtgggcaacggcgtctccgagctgatcgtgatggccatgcagggcctgctggacgacggcgacgaggtgctcgtaccggcgcccgactacccgctgtggaccgcctccgtctccctgtccggcggcacggccgtgcactaccactgcgacgagcagtcggactggatgcccgacctcgccgacgtggagcgcaaggtcaccgaccgcaccaaggcgatcgtcatcatcaacccgaacaacccgacgggcgcggtgtacgacgaggcgatgctgcggggcctgacggacatcgcccgccgccacaacctgctcgtctgctcggacgagatctacgacaagatcctctacgacggcgccacgcacaccccgaccgccgcggtcgcccccgatctgctcacgctgacgttcaacggcatgtcgaaggcgtaccgcgtggccggctaccgggtcggctggatggcgatctccgggccgcgcgcgcacgccgactcgtacatcgagggcctgacgatcctggcgaacatgcggctgtgcgcgaacatgccgggtcagcacggggtggtcgccgcgctgagcggccgtcagacgatcaacgaactggtgctgccgggcggacggctcaaggaacagcgggacgtggcgcacgagctgctgacccagatccccggcgtgagctgtgtgaagccgaagggcgcgctctatctgttcccgcggctcgaccccaaggtcttcaagatcaaggacgaccggcagatggtgctcgacctgctgcgccgcgagaagatcatggtggtccagggcacgggcttcaactggccggaccccgaccacttccgggtggtgaccctgccgacggtgggcgatctgacctcggcgatcacccggatcgggaacttcctggacggttacagccagccgtga

SEQ ID NO: 34088 - protein, 403 aa, Streptomyces avermitilis
MQVIQSTKLANVCYEIRGPVLEEAMRLEAAGHRILKLNTGNPAAFGFECPPEILEDILRNVSSAHGYGDAKGLLAARRAVVMHNQTLGIETDVEHVFVGNGVSELIVMAMQGLLDDGDEVLVPAPDYPLWTASVSLSGGTAVHYHCDEQSDWMPDLADVERKVTDRTKAIVIINPNNPTGAVYDEAMLRGLTDIARRHNLLVCSDEIYDKILYDGATHTPTAAVAPDLLTLTFNGMSKAYRVAGYRVGWMAISGPRAHADSYIEGLTILANMRLCANMPGQHGVVAALSGRQTINELVLPGGRLKEQRDVAHELLTQIPGVSCVKPKGALYLFPRLDPKVFKIKDDRQMVLDLLRREKIMVVQGTGFNWPDPDHFRVVTLPTVGDLTSAITRIGNFLDGYSQP

SEQ ID NO: 34089 - DNA, 1209 bp, Streptomyces avermitilis
  CDS (1)..(1209)
atggagttccggcagtcgagcaagctcagcgaggtctgttacgagatccgcggcccggtgatcgagcacgccaacgcgctggaggaggcgggccacagcgtgctgcgcctgaacaccggcaaccccgcgctcttcggcttcgaggcgcccgaggagatcctccaggacatgatccggatgctcccccgggcgcacggctacaccgactcgcgcggcgtcctctccgcccgccgcgccgtggcccagcgctaccaggaccgtggcctggaggtcgacgtcgacgacgtgttcctgggcaacggcgtctccgaactcgtctcgatggccgtacaggcgctgatcgaggacggcgacgaagtcctcatcccggccccggacttccccctctggacggccgtcaccacgctcgcgggcggcaaggcggtgcactacctctgcgacgagcaggccgactggtacccggacctggcggacatggccgcgaagatcaccgaccgcacgcgcgccgtggtcatcatcaaccccaacaaccccaccggcgcggtctatccgaaggagatcgtcgagggcatcctcgatctcgcccgtcggcacggcctgatggtgttcgcggacgagatctacgaccagatcctgtacgacgacgccgtgcaccactcggccgccgccctcgcgcccgacctggtggtcctcaccttctgcggcctgtcgaagacgtaccgcgtggccggcttccggtccggctggctggtcgtcacgggccccaagcagcacgcccgcagctatctggagggcctgacgatgctcgcctccatgcggctgtgcgcgaacgcccccgcccagtacgcgatccaggccgcgctcggcggccgccagtccatccaggagctgaccgcaccgggcggccggctgtacgagcagcgcgaccgcgcctggcagaagctcaacgagatcccgggcgtctcgtgcgtgaagccgaagggcgcgttgtacgcgttcccgcgcatcgaccccaccgtgcacaagatccacgacgacgagaagttcgtcctggacctgctgctgcgggagaagatccaggtggtccagggcaccggcttcaactggccccgccccgaccacttccgcatcctcacgctcccccacgcggacgacctggacgcggcgatcagccggatcgggcggttcctgagcgggtaccggcagtaa

SEQ ID NO: 34090 - protein, 402 aa, Streptomyces avermitilis
MEFRQSSKLSEVCYEIRGPVIEHANALEEAGHSVLRLNTGNPALFGFEAPEEILQDMIRMLPRAHGYTDSRGVLSARRAVAQRYQDRGLEVDVDDVFLGNGVSELVSMAVQALIEDGDEVLIPAPDFPLWTAVTTLAGGKAVHYLCDEQADWYPDLADMAAKITDRTRAVVIINPNNPTGAVYPKEIVEGILDLARRHGLMVFADEIYDQILYDDAVHHSAAALAPDLVVLTFCGLSKTYRVAGFRSGWLVVTGPKQHARSYLEGLTMLASMRLCANAPAQYAIQAALGGRQSIQELTAPGGRLYEQRDRAWQKLNEIPGVSCVKPKGALYAFPRIDPTVHKIHDDEKFVLDLLLREKIQVVQGTGFNWPRPDHFRILTLPHADDLDAAISRIGRFLSGYRQ

SEQ ID NO: 34091 - DNA, 1227 bp, Nitrosomonas europaea
  CDS (1)..(1227)
atgcaacccatcaagaaatccagcaaactcgataatgtctgctacgacatacgcggcccggttctcgatcgcgccagacaaatggaggatgaaggccagcgtgttatcaagctcaacatcggcaatcctgcttccttcgggttcgaggcgccggacgagattctgcaggatgtcatccgcaatctttctgctgcatccggttattgcgattccaaagggttgtttgctgcccgcaaagccatcatgcactacacgcaggaaaaaaatatcgccaacgtgcagatggatgacatttatatcgggaatggcgtatcggaactgatcatgctggccacgcaggcgctgctggaaaatggtgatgaaatactggttccctcgccggattacccgctgtggacggcagccatctcgcttgccggcggggttgcacgtcattacacctgtgacgaacaatccagctggctgcccgatccggaaaacataaaagcccaggtcagcagcagaacccgggccatcgtaatcatcaaccccaacaacccgaccggtgcgctgtatccggatgatctgttgcgcgaaatcattgaaattgcccggcgtaacaatctgatcatttttgcggatgaaatctacgacaaaattctttacgactctgccagccacacttcggttgcctcgctggctgatgatgttttattcgttacattcaacggtttatccaaaaactaccgtgcagccggctttcgctccggctgggtcgtcgtttccggtaacaagactcatgcacgggattacattaccgggctcaacatgctggcatcgatgcgcctgtgcgccaatgttccggcacaattcggcatccagactgcattaggcggttatcagagcatacatgatctcaccatgcctaccggccggctgaaacggcagcgtgatctggcctggaaactgctgaccgacatcccgggcgtgacctgcttcaaaccgcagagtgcactgtacctgttcccacgactcgatcccgactactatccagttaaagatgatgaacagtttgcactggatctgctgctggaagagaaggtgctggtggtacagggaaccgggttcaactggtcgcaacccgatcatttccggatcgtgtttctacccaacagtgatgatttgacagaagcaatcggccggatcgcgaagtttctcgaccgttatcgcacccgccacggcagttga

SEQ ID NO: 34092 - protein, 408 aa, Nitrosomonas europaea
MQPIKKSSKLDNVCYDIRGPVLDRARQMEDEGQRVIKLNIGNPASFGFEAPDEILQDVIRNLSAASGYCDSKGLFAARKAIMHYTQEKNIANVQMDDIYIGNGVSELIMLATQALLENGDEILVPSPDYPLWTAAISLAGGVARHYTCDEQSSWLPDPENIKAQVSSRTRAIVIINPNNPTGALYPDDLLREIIEIARRNNLIIFADEIYDKILYDSASHTSVASLADDVLFVTFNGLSKNYRAAGFRSGWVVVSGNKTHARDYITGLNMLASMRLCANVPAQFGIQTALGGYQSIHDLTMPTGRLKRQRDLAWKLLTDIPGVTCFKPQSALYLFPRLDPDYYPVKDDEQFALDLLLEEKVLVVQGTGFNWSQPDHFRIVFLPNSDDLTEAIGRIAKFLDRYRTRHGS

SEQ ID NO: 34093 - DNA, 1200 bp, Enterococcus faecalis
  CDS (1)..(1200)
atgaacgtatcaaatcgagcacagcaattgactccttctgttacattagcagctgccgccaaggcgaaagcattaaaagcaaaaggtgtagatgttttaagcttaacggttggggaaccagattttgtaaccccgaaaaatattcaaaaagcagcaattgcttcaattgaggatggaagagcaagttattacacaccttctggcggcattcctgaattaaagcaagcaattgtctcttatgtggaacgagaatatcaacttcgttatcaacccaagcaagttattgtgacagatggtgccaaatatgcgctgtatctattatttcaagccattttgaacgttggggacgaagtgattatccctgtcccttattgggtaagttatggtgaacaagtcaaattagcagaaggcaagccagtatttgtatcaagcacgcaagagcaatcatttaaagtgtcagtcgcacaattagaagctgtacgaacggacaaaacaaaagcaatcattttaaattcaccatctaacccaactggtgttatttatacggaagaagaattacgccaaattggtgaatgggcagttgctcataatatcctcattattgcagatgatatttatggtcgtttggtgtacaatggacatcggttcacaccaattgcaaccatctcagaagcaattcgtcaacagacaatcattattaatggtgtttccaaaacatatgcaatgacaggctggcgcattggttttgcagtcggggatgaaaaaattattcaagcaatgacacaactcgcttcacaatccaccagtaatccagtcgcagttagccaatatgcggcaattgaggctttaacaggtgaacagtcgacagttgaagacatgcgtcaggcctttgaaaaacgcctaaatcatatctatccaaaagtagcagctttgccaggcgtttcgctaataaaacctgaaggcgccttttatctattcccgaatgtcaaaaaaacgttagaaatttgtgggtatgataacgtgactaactgggtggaagatttattacaagaagcgcatgttgctctggtaacgggagagggctttggtgcaccagaacatgtgcggatgagctatgcgacagatttaatgacgttagaaaaagcgattgagcgaatgaatgactttatagaaaagaaacgaattcagcacaacgcctaa

SEQ ID NO: 34094 - protein, 399 aa, Enterococcus faecalis
MNVSNRAQQLTPSVTLAAAAKAKALKAKGVDVLSLTVGEPDFVTPKNIQKAAIASIEDGRASYYTPSGGIPELKQAIVSYVEREYQLRYQPKQVIVTDGAKYALYLLFQAILNVGDEVIIPVPYWVSYGEQVKLAEGKPVFVSSTQEQSFKVSVAQLEAVRTDKTKAIILNSPSNPTGVIYTEEELRQIGEWAVAHNILIIADDIYGRLVYNGHRFTPIATISEAIRQQTIIINGVSKTYAMTGWRIGFAVGDEKIIQAMTQLASQSTSNPVAVSQYAAIEALTGEQSTVEDMRQAFEKRLNHIYPKVAALPGVSLIKPEGAFYLFPNVKKTLEICGYDNVTNWVEDLLQEAHVALVTGEGFGAPEHVRMSYATDLMTLEKAIERMNDFIEKKRIQHNA

SEQ ID NO: 34095 - DNA, 1218 bp, Enterococcus faecalis
  CDS (1)..(1218)
atgagaaattttaaaaaatccgataaattaaataacgtaagttacgatgtccgtggtcctgttttagaagaagcagaacgcatgcaagaagagggcatacgtattttgaaattaaatacagggaatccagcgccatttggttttgatgccccaaatgaaattgtgcgcgacatgattgtaaatgttcgcgattcagaaggttattccgattcaaaaggtattttttctgcaagaaaagcgattgaacaatattgccaattaaaaaaatttcctaatgtaacgattaatgatatttacactggtaatggcgtgagtgaactaattaccatgtgtatgcaaggcttgttaaataacggcgatgaagtacttgtgccaatgccagactatcctttatggactgcatctgtttctttggcgggcggtacacccgttcattatatttgtgatgagcaagcagaatggtatccagacattgatgatataaaatcaaaaataacttcgaatacaaaagcaatcgttattatcaatcccaataatccgactggtgctttatatccgaaagagttattactagaaattgtcgaagtggcacgtcaaaatgatttaattatttactccgatgaaatttatgatcgcttggtcatggacggtttggttcatgtaccgattgctacattagctcctgatttatttgtcgtaacattgaatggtttgtcaaaatcacatcgagtggcaggcttccgatgcggttggatggtgttaagtggagataaatcacgagtaaaagggtatatcgaagggctaaatatgcttgcttccatgcggttatgctcaaatgtgttgtcacaacaaatcattcaaactgcattaggtggctatcaaagtgtcgatggtttacttttgccaggtggcagaatttacgaacaacgagaatttatttacaatgcgataaatgatattcctggtttatcagccgtgaagcctaaagcagctttctatatttttccgaaaattgatacggccaaatttgacatttatgatgatgaaaaatttgttttagatttcttacacaaacatcatattttattagtccatggtggtgggttcaactggcaacaacccgatcacttccgtattgtttatttaccgaagatggaagacttaaaaactacagcagataaaatgcgtgaatttttaagtacctacaaacaaaaataa

SEQ ID NO: 34096 - protein, 405 aa, Enterococcus faecalis
MRNFKKSDKLNNVSYDVRGPVLEEAERMQEEGIRILKLNTGNPAPFGFDAPNEIVRDMIVNVRDSEGYSDSKGIFSARKAIEQYCQLKKFPNVTINDIYTGNGVSELITMCMQGLLNNGDEVLVPMPDYPLWTASVSLAGGTPVHYICDEQAEWYPDIDDIKSKITSNTKAIVIINPNNPTGALYPKELLLEIVEVARQNDLIIYSDEIYDRLVMDGLVHVPIATLAPDLFVVTLNGLSKSHRVAGFRCGWMVLSGDKSRVKGYIEGLNMLASMRLCSNVLSQQIIQTALGGYQSVDGLLLPGGRIYEQREFIYNAINDIPGLSAVKPKAAFYIFPKIDTAKFDIYDDEKFVLDFLHKHHILLVHGGGFNWQQPDHFRIVYLPKMEDLKTTADKMREFLSTYKQK

SEQ ID NO: 34097 - DNA, 1314 bp, Corynebacterium glutamicum ATCC 13032
  CDS (1)..(1314)
atgactacagacaagcgcaaaacctctaagaccaccgacaccgccaacaaggctgtgggcgcggatcaggcagcgcgtcccactcggcgaacaactcgccgcatcttcgatcagtcggagaagatgaaggacgtgctgtacgagatccgtggcccggtggccgcggaggcggaacgcatggagcttgatgggcataacatcttaaagctcaacacgggaaatccagccgtgttcggattcgatgcccccgacgtgattatgcgtgacatgatcgccaaccttccaacttcccaagggtattccacctccaaaggcattattccggcccggcgagcagtggtcacccgctacgaagttgtgcccggattcccccacttcgatgttgatgatgtgttcttaggcaacggtgtctcagaactaatcaccatgaccacccaagcactcctcaacgacggcgatgaagttcttatccccgcaccggactacccactgtggactgccgcaacctccctggctggtggtaagcctgtgcactacctctgtgatgaggaagatgactggaacccatccatcgaagacatcaagtccaaaatctcagagaaaaccaaagctattgtggtgatcaaccccaacaaccccacgggagctgtctacccgcgccgggtgttggaacaaatcgtcgagattgcacgcgagcatgacctgctgattttggccgatgaaatctacgaccgcattctctacgatgatgccgagcacatcagcctggcaacccttgcaccagatctcctttgcatcacatacaacggtctatccaaggcataccgcgtcgcaggataccgagctggctggatggtattgactggaccaaagcaatacgcacgtggatttattgagggcctcgaactcctcgcaggcactcgactctgcccaaatgtcccagctcagcacgctattcaggtagctctcggtggacgccagtccatctacgacctcactggcgaacacggccgactcctggaacagcgcaacatggcatggacgaaactcaacgaaatcccaggtgtcagctgtgtgaaaccaatgggagctctatacgcgttccccaagctcgaccccaacgtgtacgaaatccacgacgacacccaactcatgctggatcttctccgtgccgagaaaatcctcatggttcagggcactggcttcaactggccacatcacgatcacttccgagtggtcaccctgccatgggcatcccagttggaaaacgcaattgagcgcctgggtaacttcctgtccacttacaagcagtag

SEQ ID NO: 34098 - protein, 437 aa, Corynebacterium glutamicum ATCC 13032
MTTDKRKTSKTTDTANKAVGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 34099 - DNA, 1284 bp, Brassica oleracea
  CDS (10)..(1284)
atggcgataatggcgaccacccccatgtgcactgagtggcagttcagcgggaacgaggcagccaaagaagctgctgcggccgccctaggtgcctacacctctaaactcatggctctttgtgatcctaatggcaagcccattttgcccccgagtaacaaggccgtggagaccagcaattcagcggaaaaggctgtcgttaaatttattctctccggcactggaaacgcctatgctcctagcattggccttccgctcgccaaaagtgccgtagcagagtatctaaacagagatcttccaaagaagctaacagcagctgacgtgtttatgactgttggatgcaaacgagcaattgaccttgcggtggatattctggctaaaccaaaagccaacgttttgcttccgaggccaggcttcccgtgggatgtagtacgctgcatctataagaaactcgaggtccgttactatgatttcatccctgaacaaaactttgagatcgacttcgaaagcgtcaaaaaggtgacagacaagaacacctttgctatatttatcatcaaccctcacaatcccaatggaaacacttactcggaggctcatctcaaacagctcgctgaattggctaaggaactctcgattatggtggtttctgatgaagtttttagatggaccgtcttcgggaataacccttttgtgccgatgggaaagttttcttccatcgtaccagtggttacactcggatccttatctaagggatggaatgtcccaggatggcgaactggctggctcgcgctgcacgatctagacggtgtcttcagaaacactaagatattacaagctgccaacgaatttctccagataaatgccaaacctccgactgttattcaggcggctatgcctgacattttggagagaactccaaaacatttcttccacgagaggggaagttttctgaaacataaagtagatattggatattctaaggtcaagcacatacctggcctcacttgttacatgaaacccgaagcgtgcacctttttatggaccaagctggatatatcgtgctttgctgacattgaagacgatcaagacttctgcaggaagcttgctatggaagaaaatctcgtcgttttgccagggattgcatttaggcagaagaattggctgaggcattctatcgacatggagacgcaaacagttgaggacgcatttgaaagattgaagagcttctgtgaacgccattccgctgaacgtggagcttcactcaaaaacgtcaatggcgtgaactag

SEQ ID NO: 34100 - protein, 424 aa, Brassica oleracea
MATTPMCTEWQFSGNEAAKEAAAAALGAYTSKLMALCDPNGKPILPPSNKAVETSNSAEKAVVKFILSGTGNAYAPSIGLPLAKSAVAEYLNRDLPKKLTAADVFMTVGCKRAIDLAVDILAKPKANVLLPRPGFPWDVVRCIYKKLEVRYYDFIPEQNFEIDFESVKKVTDKNTFAIFIINPHNPNGNTYSEAHLKQLAELAKELSIMVVSDEVFRWTVFGNNPFVPMGKFSSIVPVVTLGSLSKGWNVPGWRTGWLALHDLDGVFRNTKILQAANEFLQINAKPPTVIQAAMPDILERTPKHFFHERGSFLKHKVDIGYSKVKHIPGLTCYMKPEACTFLWTKLDISCFADIEDDQDFCRKLAMEENLVVLPGIAFRQKNWLRHSIDMETQTVEDAFERLKSFCERHSAERGASLKNVNGVN

SEQ ID NO: 34101 - DNA, 1558 bp, Oryza sativa
  CDS (43)..(1497)
caccaactcctctcaacttcttgatccggcggcggcggcaagatgttcggcggcggcggcggcgggaggaagccgctggactacgaggagctgaacgagaacgtgaagaaggtgcagtacgcggtgcggggggagctgtacctgcgcgcctccgagctccagaaggagggcaagaagatcatcttcaccaacgtcggcaacccacacgcgctcggccagaagccgctcaccttcccccgccaggttgtggcgctgtgccaggcccccttcctgctcgatgatcccaacgtcggccttatcttccccgccgacgccatcgcgcgggccaagcactacctcgccatggcacccggtggactaggtgcttacagtgattcccgaggtatccctggtattaggaaggaagtcgccgagttcatcgagaggcgtgatggttatccaagtgatccagaacttatttacctcacagatggtgccagcaaaggtgtgatgcaaatgctgaataccattatcagaaatgagagagatgggattctggttcctgttccacaatacccgctttattctgctgccatttccccctttggtggttctctcgtgccatactacttagaagaagaggctaactggggacttgacttcgtcaatctccgacagactgtggcgtcagcgcggtcaaagggaatcactgttcgagcaatggtgattatcaacccaggaaaccctactggccaatgccttagtgaaggaaacataaaggaacttctcaaattctgcttccatgagaacttagttctgcttgcagatgaagtctatcaacagaacatttatcaagatgagcgcccatttataagtgctagaaaggttctgtttgacatgggtcctcctatgagcagggaagttcagctggtttctttccatactgtgtcaaaaggatattggggggagtgtggacaacgtggagggtattttgaaatgacaaatcttcctcccaagacagtagacgagatctacaaggttgcatcaatcgcactcagtccaaatgttcctgggcagatctttatgggtttaatggttaaccctcctaagcctggagatatctcttatctgaagttttctgctgaaagcaagtctatcctcgagtctttgaggaggagagcacgcctgatgacagatggtttcaatagttgccgaaatgttgtctgcaatttcacagaaggagctatgtactctttcccccaaatacgcttaccaccaaaagctatagatgcagccaaaagggctggcaaagcggccgatgttttctactgcctcaagcttcttgaagcaactggaatatccactgttccagggtcaggtttcggacaaaaagaaggggtgttccacctgaggacgaccatcctgccagctgaggaggacatgcctgccatcatgaccagcttcaagaagttcaacgacactttcatggatcagtacgatggctactccaggatgtgaaatgaaaacaagatgagcactaccccaggagaagagagaaagaatctgcctcagcgtggct

SEQ ID NO: 34102 - protein, 484 aa, Oryza sativa
MFGGGGGGRKPLDYEELNENVKKVQYAVRGELYLRASELQKEGKKIIFTNVGNPHALGQKPLTFPRQVVALCQAPFLLDDPNVGLIFPADAIARAKHYLAMAPGGLGAYSDSRGIPGIRKEVAEFIERRDGYPSDPELIYLTDGASKGVMQMLNTIIRNERDGILVPVPQYPLYSAAISPFGGSLVPYYLEEEANWGLDFVNLRQTVASARSKGITVRAMVIINPGNPTGQCLSEGNIKELLKFCFHENLVLLADEVYQQNIYQDERPFISARKVLFDMGPPMSREVQLVSFHTVSKGYWGECGQRGGYFEMTNLPPKTVDEIYKVASIALSPNVPGQIFMGLMVNPPKPGDISYLKFSAESKSILESLRRRARLMTDGFNSCRNVVCNFTEGAMYSFPQIRLPPKAIDAAKRAGKAADVFYCLKLLEATGISTVPGSGFGQKEGVFHLRTTILPAEEDMPAIMTSFKKFNDTFMDQYDGYSRM

SEQ ID NO: 34103 - DNA, 1239 bp, Streptococcus pyogenes
  CDS (1)..(1239)
atggaatacgaggtgtatgagactatgaaaattattgaaaaatcatcaaaattagaacatgttgcctatgatattcgagggcctgttttggatgaagctaatcgcatgattgcgagtggtgaaaaaattctgcgtttaaatactggcaatcctgctgcttttggttttgaagcaccagatgaagtgattcgtgatttaattgtcaacgcgaggctaagtgagggctattctgacagtaaagggattttttcagcgcgtaaggctatcatgcagtattgccaactcaagggcttcccagatgttgacattgaagatatttatttgggaaatggcgtgtcagagttgatatccatatcccttcaagctttgctagataatggcgatgaagttttagtaccaatgccggattatcctttatggacggcttgtgtgagtcttggtggaggaaaagcggtccattatctttgtgatgaagaagctggttggtatcctgatattgctgatatcaaatcaaaaatcacgagtcgcaccaaagctattgtggtcatcaatcctaataacccaacaggagccctttatcctaaggagattttagaagacatcgttgctttggcaagagaacaccagctgattatttttgccgatgaaatctatgatcgtttggtgatggatggtaaagagcatattgctattgcaagtttggcacctgatgttttttgtgtatctatgaatggtctttccaaatctcatcgtattgctggttttcgtgttggatggatggtcttatcaggtcctaaagaccatgttaaaggttacattgaagggttaaacatgcttgccaatatgcggttatgctccaatgttttagcccaacaagttgttcaaacttccttaggaggtcatcaatcagttgatgcactgttactgccaggagggcgtatttttgagcaacgtaattttatttatgaagctattaatgctatccctggcttatcggcagttaaacctgaagcaggtctttatttatttccgaaaattgatcgtcagatgtatcgtattgatgatgatgaagaatttgtcttacagttattaaagcaagaaaaagtgatgttggtacatggacgtggttttaactggaaagatccagatcacttccgtattgtttacctaccaagtgtagaagaattagaagatgtccaagaaaagattacacgtgtcttataccagtatagacgttaa

SEQ ID NO: 34104 - protein, 412 aa, Streptococcus pyogenes
MEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 34105 - DNA, 1278 bp, Xylella fastidiosa
  CDS (1)..(1278)
atgatgtctaatagcccgcaaacgccgcttgttacgcgccagcgcctgtccgaagtccgctatgagatccgaggggagttggcgcgccgtgcgcgtgagcttgaggcggagggacgcaagcttatcaagctcaacatcggtaatccaggtgcgttcggttttcgggcgccagagcatctgcaacgtgctattgccgatgatatgggacgtaccgatccttatacgcatcagcagggtttgccaatcgcacgtgaggcgattgctgctgcttatgcgcgacgtcactatccagatgttgatgcagatcgggtctttgtggggaatggggtttctgagttaatcgatttgtcgttgcgggcgttgcttaatccaggcgatgaggtgttggttccttcaccggattatccgctgtggtcggcggcgacgattctcaacgatggtcggccggtgtattaccgttgtgcgccggagaacggtttccagccagatgcagttgagatcgaaacgctggtgtcttcacggacacgtgcgattgtgttgattaatccgaataatcccagtggtgccaattattcgcaggagttattggagcggattgtggcaatctcagtgaaacatcatctgctgttgttggttgatgagatttacgatcagattttgtatgacggtgcggtgtttgttccagtggctcctttggcggggacgcatccatgtatcactttcagtgggctgagtaaggtgcatcgtgcgtgcggttggcgtgtgggttgggcgttgctgtccgggagtagcattcaagttgataatctgcgcaatgcgatggatttgctgggtgcgttgcgtttgtgtgcgaatgtcccagggcaatatgcgattgatgcggcggtcaatgggccagatacgatcactccgttatgttcgcctggtggtcctttgtacgagacgcgccgtgcggtgattgatgcatgcgcggcgagtgagcatttgtcgttggtggtgcctgctggggcattatacgcgttcccatcggtcgtgggaccagcggcgcggcactttgatgattatgcttttgcgctggagttgatgaatgaggagggagtgctggtggtgcctggatcaagttttaatgtgccatatcgggatcacttccgcgtgacgttgcttcctgatgctgggttgatacgtgaagtgttttctcgtattgaccgggcattgtcgcgccgtgctgaggtggctgagaaggtggtgccgctcaagtcgcgtagcgccgccgcttga

SEQ ID NO: 34106 - protein, 425 aa, Xylella fastidiosa
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAISVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKSRSAAA

SEQ ID NO: 34107 - DNA, 1215 bp, Vibrio parahaemolyticus
  CDS (1)..(1215)
atgcaaaatatcgggatgtcgtcaaaactcgacaatgtctgctacgacattagggggcctgtactcaaacatgctaagcgcatggaggaagaagggcataaaatcctaaagttgaacattggtaaccctgccccatttggttttgacgcccctgatgagattcttgtagatgtaattcgtaatctaccgacctctcaaggctactgtgattccaaaggcatttactctgcgcgtaaagcggtggttcaacattaccaacgcaaaggcattcgttctttagacgtagaagatgtgtacgtcggtaatggcgtgtcggagctgatcgtgatggcaatgcaagcgctgctaaacaacggcgatgaaatgctcatccctgcgcctgactacccattgtggacggcatcagtagcgttgtctggtggcaaccccgttcattatctgtgtgatgaacaatcggattggtatccagaccttgatgacatcaaaaagaaaatcacgccgaagacccgcggtattgttctgatcaacccgaacaatccaacaggtgctgtatatagtcgtgacttcttgcttgaagtgattgagattgctcgccaacacaagctgatcattttcgctgacgagatttacgacaaagtgctttacgatggcgcaacacacacttctgttgcgacgctaacggaagacgtacttgtgatgaccttcaatggtttgtcgaaagcttaccgggtatgtggtttccgcggtgggtggatgttcttaactggtccaaaacacttagcacaaggctacgttaacggtctagagttgctctcttctatgcgtctttgtgccaacgtgccgatgcaacatgcgattcaaaccgcgctaggtggctaccaaagtatcaatgagttgatcttacctggtggccgattgctagagcagcgtaatcgtgcgttcgagctgatcaaccagatcccaggggtatcttgtgtgaaacccaaaggtgccatgtacttattccctaaaatcgataccaagatgtacaacatcaagaatgaccaacagatggtgctcgatttcttgaaacaggaaaaagtactgctagtacaaggctcaggttttaactggccaaaaccagaccatttccgcattgtgactttgccacacgttgaagatctggaaaccgcaatcggacgcttcgagcgattcctatcaacctacagccagtaa

SEQ ID NO: 34108 - protein, 404 aa, Vibrio parahaemolyticus
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGNPVHYLCDEQSDWYPDLDDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAFELINQIPGVSCVKPKGAMYLFPKIDTKMYNIKNDQQMVLDFLKQEKVLLVQGSGFNWPKPDHFRIVTLPHVEDLETAIGRFERFLSTYSQ

SEQ ID NO: 34109 - DNA, 1212 bp, Pseudomonas syringae
  CDS (1)..(1212)
atgcagttcaacaaatcgaacaagctcgcaaacgtctgctacgacattcgcgggccagtgctcaagcacgccaaacgcctggaagaggaaggccatcgcatcctcaagctgaatatcggcaacccggcaccgtttggtttcgaggcgccggacgaaatcctgcaggacgtgatccgcaacctgccgaccgctcagggctacagcgactccaagggcctgttcagcgcccgcaaggcggtcatgcagtactaccagcagaagcaggtcgaaggtgtcggcatcgaagacatctacctgggcaacggcgtttccgagctgatcgtgatgtcgatgcaggcgctgctaaataacggcgacgaagtgctggttccggcacccgattacccattgtggaccgccgcagttgcgctgtccggtggcagcccggtgcattatctgtgcgacgagcaggccaactggtggcctgaccttgaagacatcaaggccaagatcacgccgaacaccaaggccatggtcatcatcaacccgaacaaccccaccggtgcggtgtattcccgcgaagtgctgctgggcatgctggagctggcccgtcagcacaacctggtggtgttctccgacgaaatatacgacaaaatcctgtatgacgacgccgtgcatatctgcaccgcctcgctggcgccggacctgctgtgcctgaccttcaacggcttgtcgaaatcgtaccgcgttgcgggcttccgctcgggctggatcgccatttccgggccgaaacacaacgcgcagagctacatcgaaggcatcgacattctggccaacatgcgcctgtgcgccaacgtgcctagccagcacgccatccagaccgcgctgggcggctaccagagcatcaatgacctgatcctgccaccaggtcgcctgctggagcagcgcaaccgcacctgggagttgctcaacgacattcccggcgtgagctgcgtcaagccgatgggcgcgctgtatgcgttcccgcgcatcgacccgaaggtctgcccgatcttcaacgacgagaagtttgtgctcgacctgctgctctcggaaaaactgctggtggttcagggcactgcgttcaactggccttatcctgaccacttccgcgtggtgaccctgcctcgggtcgacgagctggagcaggccattggccgcatcggcaacttcctcaagggttatcgtcagtaa

SEQ ID NO: 34110 - protein, 403 aa, Pseudomonas syringae
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAVHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPIFNDEKFVLDLLLSEKLLVVQGTAFNWPYPDHFRVVTLPRVDELEQAIGRIGNFLKGYRQ

SEQ ID NO: 34111 - DNA, 1212 bp, Pseudomonas putida
  CDS (1)..(1212)
atgcagttcagcaaatcgaacaagctcgccaatgtctgctacgacattcgcggcccagtgctcaagcacgccaaacgcctggaggaggaaggccaccgcatcctcaagctgaacatcggcaacccggcgccgtttggcttcgaggcgcctgatgaaatccttcaggatgtgatccgcaacctgcccaccgcacagggctacagcgactccaaaggcctgttcagtgcccgcaaggcggtgatgcagtactgccagcagaaagatatcgaaggcgtcaccatcgaggacatctacctgggtaatggtgtgtccgagctgatcgtcatgtcgatgcaggcgctgctcaacaacggcgacgaagtgctgatcccggcccccgactacccgctgtggactgccgccgtgagcctggccggcggcaagccggtgcactacctgtgcgacgagcaggccgactggttccctgaccttgaggacatcaaggccaagatcaccccgaacaccaaggcgctggtgatcatcaacccgaacaacccgaccggcgccgtctactccaaagaactgctgctgggcatgctggagctggcccgccagcacaacctggtggtgttctccgacgagatctacgacaagatcctgtacgacgaagccgtgcacatcagcaccgcctcgctggctccggacctgctgtgcctgaccttcaacggcttgtccaagtcgtaccgggtggcgggcttccgctctggctggctgatcatttccgggcccaagcaccacgcacacagctacatcgaaggcatcgacatgctggccaacatgcgcctgtgcgccaacgtgccggcccagcatgccatccagaccgcgctgggcggctaccagagcatcaacgacctggtgctgccgccgggccgcctgctggagcagcgcaaccgcacctacgaactgctcaacgacatccctggcgtcagctgcgtgaaaccgatgggcgcgctgtatgcgttcccgcggatcgacccgaaggtttgcccgatcctcaacgacgagaagttcgcccttgacctgctgctgtcggagaagctgctgatcgtacaagggacggcgttcaactggccgtggccggaccacttccgcgtggtgaccttgccgcgggtggatgacctggaagcggcaattggccggatcggcaatttcctgaagggttattcgcagtag

SEQ ID NO: 34112 - protein, 403 aa, Pseudomonas putida
MQFSKSNKLANVCYDIRGPVLKHAKRLEEEGHRILKLNIGNPAPFGFEAPDEILQDVIRNLPTAQGYSDSKGLFSARKAVMQYCQQKDIEGVTIEDIYLGNGVSELIVMSMQALLNNGDEVLIPAPDYPLWTAAVSLAGGKPVHYLCDEQADWFPDLEDIKAKITPNTKALVIINPNNPTGAVYSKELLLGMLELARQHNLVVFSDEIYDKILYDEAVHISTASLAPDLLCLTFNGLSKSYRVAGFRSGWLIISGPKHHAHSYIEGIDMLANMRLCANVPAQHAIQTALGGYQSINDLVLPPGRLLEQRNRTYELLNDIPGVSCVKPMGALYAFPRIDPKVCPILNDEKFALDLLLSEKLLIVQGTAFNWPWPDHFRVVTLPRVDDLEAAIGRIGNFLKGYSQ

SEQ ID NO: 34113 - DNA, 1194 bp, Clostridium tetani
  CDS (1)..(1194)
atgttatctaaaaaaggaaaggaaatatcaccttctgttacattagcaataactgcaaaagctaatgaaatgaagaaggatggaatagatgtagtaggttttggggcaggggaaccggattttaatacacctgaaaatatccaaaatgctgcaattaaagcaatgagagaaggatatacaaagtacacaccagtttctggcgtagttgaattaaaagatgctatagtaaataaattcaaaaaggaaaataatttaatatataaatcatcacagataatagtatccactggagcaaagcaatgtatagctaatttgtttatggctattttaaatccaggagatgaggttttaatatctgcaccatattgggttagttatccagaactcgttaaattagcagatggtgtgcctgtatttgtagattgtaaaaaagaaaatgattataaatactctatagatgaattagaaaagagggtttctagtaaaacaaaggctataattattagtagtccgaacaatccaacaggaagtatttattatgaagaagagcttagagatatagctgaattttgtaaaaaacataatttaataattttatccgatgaaatatatgaaaaacttatttatggacataataaacatataagtatagctagcctaaatgaagatacttataatagaactgttgtaataaatggagtatctaagacttatgctatgactggttggagaataggatatgcggcagggccaggaaatgtaattaaattaatgaataatatacagagtcatatgacttcaaatccaaattcaatcgctcaatatgctgccctagaagctttaacaggagagcaggagtctataaatagtatggtgagtgaatttgaaaagagaagaaattatatggtggaaagaataaattcaataaatggaatagagtgtatagagcctaaaggagccttttatatgtttgctgatataaataaagtaataggtaagaaaatcaatggagaagaaataaaaaactctgtggatttttgtgaaaaattattagaattatataaagtagctgttgttccaggagcggcttttggtttagaaaatcacataaggctttcctatgctatatctatggaaaatatagaaaaaggattggacagaatatcaaattgtgttagcgaattacaaagttaa

SEQ ID NO: 34114 - protein, 397 aa, Clostridium tetani
MLSKKGKEISPSVTLAITAKANEMKKDGIDVVGFGAGEPDFNTPENIQNAAIKAMREGYTKYTPVSGVVELKDAIVNKFKKENNLIYKSSQIIVSTGAKQCIANLFMAILNPGDEVLISAPYWVSYPELVKLADGVPVFVDCKKENDYKYSIDELEKRVSSKTKAIIISSPNNPTGSIYYEEELRDIAEFCKKHNLIILSDEIYEKLIYGHNKHISIASLNEDTYNRTVVINGVSKTYAMTGWRIGYAAGPGNVIKLMNNIQSHMTSNPNSIAQYAALEALTGEQESINSMVSEFEKRRNYMVERINSINGIECIEPKGAFYMFADINKVIGKKINGEEIKNSVDFCEKLLELYKVAVVPGAAFGLENHIRLSYAISMENIEKGLDRISNCVSELQS

SEQ ID NO: 34115 - DNA, 1200 bp, Bacteroides thetaiotaomicron
  CDS (1)..(1200)
atgccaaccatatccattcgcggaaacgagatgcctgcatctcctatcagaaaactggctcctttggcagacgctgccaagcaacggggagtccatgtgtttcacctgaatatcggacagcctgacctgcccactcctcaggccgcgattgacgcgatacgcaacatcgaccgtaaagtgctggaatatagccccagtgccggaaacagaagctatcgcgagaaacttgtgggatattatgcaaagttcaacatcaacctgacggctgacgatataatcattacatcgggggggtcggaagcggtacttttttccttcctttcctgcctgaatccgggagatgaaatcattgttccggaacctgcatacgccaactacatggcatttgccatctctgccggagcaaagatccgtacgattgcaacgaccattgaagaaggtttctccctgccgaaagtagagaaattcgaagaactgatcaatgaacgtaccaaggctatcctgatttgtaatccgaacaacccgaccggttatctgtatacacgtcgggaaatgaatcagatccgtgacctggtgaagaagtacgacctcttcctcttctctgacgaagtatatcgtgaatttatttataccggctctccttatatctctgcctgtcatctggaaggtatcgagaataatgtagtgctgatcgattcagtttccaagcgttattcggagtgcggaatccgtatcggtgcattgattaccaagaacaaagagatacgtgacgctgttatgaaattctgtcaggctcgtctgagtcctcctttgatcggacagattgccgccgaggcttctttggatgctccggaggaatattcgcgtgagacgtatgatgaatacgtagaacggcgtaaatgcttaattgatggattgaaccgtattccgggcgtttattctccgattccgatgggggctttctataccgtagccaaactccccgtagacgactcggacaagttctgtgcatggtgtctttctgactttgaatacgaaggccagaccgtatttatggcaccggcttccggtttctatactactccgggctccggcatcaatgaagtgcgtatcgcctacgtattgaagaaagaagatttgacccgtgcgcttttcatcctgcaaaaggcgttggaggtgtatccgggaagaacggaatag

SEQ ID NO: 34116 - protein, 399 aa, Bacteroides thetaiotaomicron
MPTISIRGNEMPASPIRKLAPLADAAKQRGVHVFHLNIGQPDLPTPQAAIDAIRNIDRKVLEYSPSAGNRSYREKLVGYYAKFNINLTADDIIITSGGSEAVLFSFLSCLNPGDEIIVPEPAYANYMAFAISAGAKIRTIATTIEEGFSLPKVEKFEELINERTKAILICNPNNPTGYLYTRREMNQIRDLVKKYDLFLFSDEVYREFIYTGSPYISACHLEGIENNVVLIDSVSKRYSECGIRIGALITKNKEIRDAVMKFCQARLSPPLIGQIAAEASLDAPEEYSRETYDEYVERRKCLIDGLNRIPGVYSPIPMGAFYTVAKLPVDDSDKFCAWCLSDFEYEGQTVFMAPASGFYTTPGSGINEVRIAYVLKKEDLTRALFILQKALEVYPGRTE

SEQ ID NO: 34117 - DNA, 1293 bp, Yersinia pestis
  CDS (1)..(1293)
atggcgtcggagtacattgagcaccttgcagtgttccacgctgaggacacgcttttaccagcaaaaggctcattttttatgtcccccattgagaaatccagcaaactggacaacgtctgttatgacattcgtggaccggtgctaaaagaagctaagcgtcttgaagaggaaggtaacaaggttctgaaactgaacatcggcaaccctgccccgtttggtttcgatgcacccgacgagattctggtggatgtaatccgtaatttaccgaccgcacaaggctattgcgactccaaaggcttgttttcggcacgtaaagccattatgcaacactatcaagcccgcaatatccgtgatctgacggtcgaggatatctacattggaaacggtgtttccgagttgatcgttcaatccatgcaagcattactgaatttgggtgatgaaatgctagtacccgcaccggattacccgctgtggacagctgccgtgtcgctctcaagtggtaaagcgattcattatatgtgtgatgaagagtcaggctggttccctgatttggatgatattcgcagcaaaatcactccgcgtacccgtgggattgtgattatcaacccgaataacccaaccggtgcggtatacagcaaagagctgctgttagaaattgttgaaattgctcgccagaatgacctaattattttcgctgatgagatctacgataaaattttgtatgacgatgctcagcaccattcgatcgccgcattagcccctgatttgctgaccgttacgttcaatgggctgtctaaaacataccgtgttgcgggtttccgccagggctggatggtgttgaacgggccgaaaaagcacgctaaagggtatattgaaggcttggaaatgctggcatcgatgcgtttgtgcgccaacgtaccaatgcagcatgcgattcaaaccgccttgggcggctatcagagcattagtgagtttatccaacctggtggccgtttgtacgagcagcgtgatcgggcctgggagcttatcaaccaaatccccggtgtttcctgtgtgaaacctcagggcgcgttgtatatgttcccacgtattgatcagaaacgttttaacctgaaagacgaccagaagttggtattggatctgttgttgcaagagaaagtgctattggtgcaaggtagcgcctttaactggccgtacccggaccatgtgcggatcgtcacgctgccacgggtggatgagctagagatggcggtgaggaagctggggcggttcttagagacgtatcatcagtaa

SEQ ID NO: 34118 - protein, 430 aa, Yersinia pestis
MASEYIEHLAVFHAEDTLLPAKGSFFMSPIEKSSKLDNVCYDIRGPVLKEAKRLEEEGNKVLKLNIGNPAPFGFDAPDEILVDVIRNLPTAQGYCDSKGLFSARKAIMQHYQARNIRDLTVEDIYIGNGVSELIVQSMQALLNLGDEMLVPAPDYPLWTAAVSLSSGKAIHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 34119 - DNA, 1218 bp, Streptococcus mutans
  CDS (1)..(1218)
atgatgaaagaatttaataagtctgctaaacttgaacatgtggcctatgatattcgcggtccagtattagaagaagccgatcgtatgattgctaatggggagaaaatcttacgtcttaatacaggaaatcctgccgcttttggattaacagcacctgatgaggttattcgggatttaattatgaatgcgcgtgagagcgaaggttattcagattcgaagggaatcttttcagctcgtaaagctattatgcaatattgtcagcttaaaaatattcctgatgttgatgttgatgacatctatattggcaatggtgtatcggaaatgattactatgtctatgcaaggacttttagatgacggtgacgaagttttagtccccatgcctgattatccactgtggacggctgctgttagtctggcaggaggtcaggctgttcattatgtctgtgatgaaagttccaattggtatccagatattgataatattaagtctaaaatcacttcaaatacgaaagctcttgtggttatcaatcctaataaccctacaggggctctttatcccaaagatgtattagaagatatcgttgaagttgctcgtcagaatgatttaattatttttgctgatgagatttatgatcgtctggtcatggatggtggggaacatgtggctattgctagtcttgcaccggatcttttttgtgtttctatgaatggtttgtcaaaatcccatcgtattgcaggtttccgtgtaggttggatggttttatctgggcctaaaaaacatgtcaaagattatattgaaggccttaacatgctttcaaatatgcgcctttgttctaatgttctggctcaacaagttattcaaacatctttgggcggcgttcagtctattgatgaacttcttttgccgggtggccgtatttatgaacagcgtaattttatttataaagctatgaatgaaatccctggaatcacagcggtaaaacctcaggcgggactttatattttcccaaaaattgaccgtaatatgtatcggattgatgatgatgagcaatttgttctgaattttctcaaacaggaaaaaatccttcttgttcatggacgcggctttaactggatggaaccagatcatttccgtattgtttatttaccgcgcgttgaagagctctctaagattcaagaaaagatgacacgcttcctagggcaatatcgaaaataa

SEQ ID NO: 34120 - protein, 405 aa, Streptococcus mutans
MMKEFNKSAKLEHVAYDIRGPVLEEADRMIANGEKILRLNTGNPAAFGLTAPDEVIRDLIMNARESEGYSDSKGIFSARKAIMQYCQLKNIPDVDVDDIYIGNGVSEMITMSMQGLLDDGDEVLVPMPDYPLWTAAVSLAGGQAVHYVCDESSNWYPDIDNIKSKITSNTKALVVINPNNPTGALYPKDVLEDIVEVARQNDLIIFADEIYDRLVMDGGEHVAIASLAPDLFCVSMNGLSKSHRIAGFRVGWMVLSGPKKHVKDYIEGLNMLSNMRLCSNVLAQQVIQTSLGGVQSIDELLLPGGRIYEQRNFIYKAMNEIPGITAVKPQAGLYIFPKIDRNMYRIDDDEQFVLNFLKQEKILLVHGRGFNWMEPDHFRIVYLPRVEELSKIQEKMTRFLGQYRK

SEQ ID NO: 34121 - DNA, 1212 bp, Streptococcus agalactiae
  CDS (1)..(1212)
atgaagatatttgataaatcaatgaagctggaacatgtagcttatgatattagaggccctgttttagaagaggcggaccgcatgagggcaaatggtgaaaagatattgcggttaaatactggaaatccagctgcctttggcttcgaagcgccagatgaagtcattcgtgatttaattacgaatgcgcgtgaatcagaaggttactctgattcgaaaggtattttttcagctcgtaaggctgttatgcagtattaccagttacaaaacatccatgttgacatggatgatatatacattgttaatggtgttagtgagggaatctctatgtcaatgcaagctttgcttgataatgatgacgaggttctagttccaatgccagattacccgttatggacagcttgtgttagccttgctggtggaaatgctgtgcattatatttgtgatgaggaagctaattggtatcctgatattgatgatatcaaatcaaaaatcacatccaaaacaaaagcaattgtcctcattaatccaaataatccaactggagcagtctatccgcgtgaaattctgcaagagattgtggatatcgctagacaaaatgacttgattattttttcagacgaggtttatgaccgtttagttatggatggaatggagcatatcccaattgcttctattgcagaggatatttttacagttactttatctggcttatctaaatcacatcgcatctgtggtttccgcgttggttggatggtattgtctggtccgcgacaacatgttaaaggttatattgaaggtttgaatatgttagctaacatgaggctgtgttcaaatgttcttgctcaacaggttattcaaacatcgttaggcggacagcaatctattgatagtatgttgttgccaggaggtcgtatctacgagcaacgtaattatatccataaagcaattaatgaaatacctggtttatctgctgtaaaaccaaatgctggactgtatcttttccctaaaattgatacagatatgtaccgtattgataatgatgaagagtttgtgcttaatttcttaaaacaagaaaaagtattactaacacacggtagaggatttaatatgaataccgctgaccattttagaattgtttacttaccacgtgttgatgaattgactgaactacaagaaaaaatggctcgctttttaagccaatacaagcgctag

SEQ ID NO: 34122 - protein, 403 aa, Streptococcus agalactiae
MKIFDKSMKLEHVAYDIRGPVLEEADRMRANGEKILRLNTGNPAAFGFEAPDEVIRDLITNARESEGYSDSKGIFSARKAVMQYYQLQNIHVDMDDIYIVNGVSEGISMSMQALLDNDDEVLVPMPDYPLWTACVSLAGGNAVHYICDEEANWYPDIDDIKSKITSKTKAIVLINPNNPTGAVYPREILQEIVDIARQNDLIIFSDEVYDRLVMDGMEHIPIASIAEDIFTVTLSGLSKSHRICGFRVGWMVLSGPRQHVKGYIEGLNMLANMRLCSNVLAQQVIQTSLGGQQSIDSMLLPGGRIYEQRNYIHKAINEIPGLSAVKPNAGLYLFPKIDTDMYRIDNDEEFVLNFLKQEKVLLTHGRGFNMNTADHFRIVYLPRVDELTELQEKMARFLSQYKR

SEQ ID NO: 34123 - DNA, 1215 bp, Shewanella oneidensis
  CDS (1)..(1215)
atgcgccctatcatcaagtccaacaagttggatactgtttgctacgacattcgcggcccagtgcacaaggaagccagacgtttagaggacgagggccataggatccttaaactcaatattggtaaccctgcacctttcggttttgaagcaccggaagaaattgtgcgcgatgtgatccttaatcttcccagcgcccaaggttactgtgagtcaaaaggattattctctgcccgcaaggcaattgtgcagcattatcaagcgcaagggatctatgacgttgatatcgaggatgtctatatcggtaacggcgtgtcagaactgattatgatggccatgcagggcttattaaacaccgcggacgaaatactgatcccatcccccgattacccactgtggacagcggcagccaacttggctggcggtaaagccgtacattatcgctgtgatgaagaagcagattggttccctgatcttgatgatattaagagcaaaatctcttcgcgtacccgtggcattgtgttgattaaccccaataacccaacgggtgccgtctacagtaaagaattattactacaagtcgttgagctatgccgtgagcacaacttgatcctgtttgccgatgaaatctacgataagattttatacgatgaagccaaacatattccggcagctagcttatccgatgatattttaacggtcacgtttaatggattatcaaaagcatatcgcgcggccggttttagaataggctggatgatgctctcgggtaatctcaaagccgcgaaaagttatattgaagggttagacatgctagcctctatgcgtctatgcgctaacgtgccaaatcaacatgccattcaaactgcactcggtggctatcaaagcattaatgaactgattttacctagtggccgtttgaccgtgcagcgagatacctgctatgagttgctcaaccaaatccccggcgtgagcgtgaaaaagcccaaaggcgcactttatgctttccccaaattggatatgaaaaagttcaatttaagggatgatgaacgcttggtactcgatttattaagggacaaaaaaatccttttagtgcatggtaccgcctttaattggccggagccggatcatctccgagtcgtgtttttaccctataaagaagatctaactaaagccttgactgagtttggcaacttccttgaaacctacaagcagtaa

SEQ ID NO: 34124 - protein, 404 aa, Shewanella oneidensis
MRPIIKSNKLDTVCYDIRGPVHKEARRLEDEGHRILKLNIGNPAPFGFEAPEEIVRDVILNLPSAQGYCESKGLFSARKAIVQHYQAQGIYDVDIEDVYIGNGVSELIMMAMQGLLNTADEILIPSPDYPLWTAAANLAGGKAVHYRCDEEADWFPDLDDIKSKISSRTRGIVLINPNNPTGAVYSKELLLQVVELCREHNLILFADEIYDKILYDEAKHIPAASLSDDILTVTFNGLSKAYRAAGFRIGWMMLSGNLKAAKSYIEGLDMLASMRLCANVPNQHAIQTALGGYQSINELILPSGRLTVQRDTCYELLNQIPGVSVKKPKGALYAFPKLDMKKFNLRDDERLVLDLLRDKKILLVHGTAFNWPEPDHLRVVFLPYKEDLTKALTEFGNFLETYKQ

SEQ ID NO: 34125 - DNA, 1185 bp, Oceanobacillus iheyensis
  CDS (1)..(1185)
atggaattagcacaaagagttcaaacattaacaccatcatctacattagcgataactgctaaggcaaaagatttaaaaaaacaagggtttgatgtcattggattaggagcaggtgagccagactttaatacaccagaatatattatggatggcgctaagcaagcaatgaacaacggcctaacaaagtatactcctgcaggtggaattgccgagttaaaactagcaattattgataaatttaaacaagacaacggtctttcctataatgaaaaacaaattattgtgacaaacggggcaaaacatgctttatatacacttttccaagtaatattaaataaggaagacgaagtaatcatcccatcaccatattgggttagttatcctgaacaagtaaaacttgctgaaggaaacccaataatattaccagctgccgagactaatgattttaaaataactccaacacaattagaagaggctattactccaaaaacaaaagcagtaattattaattcaccttctaatccaactggcttaatgtattcaaaagaagaattagcagcgctcggtgaagtatgccttaaacataatatcatcattgtttctgacgaaatttatgaaaaattaatctatacatcaaaagaacatgtatctatagcttccatatctgatgaattatataaccaaacaattataataaacggtgtctctaaatcacatgcaatgactggttggagaattggttatgctgcaggtaatgagacaattattaaagcgatgaccaatcttgcttctcattcaacttcaaaccctacatcaattgcacaatatggagcactagcagcttatacgaaagatcctggtgatatatcattagaatataagaaaatatttgctgaacgattagatgccttttataaattgatacaagatatcccaggaatggaatgcattaaaccagaaggcgcattttatctatttcctaatgcaaaaaaagcagctgaaatgaatggttttgcaacggttgatgaatgggtagctgcacttttagaagaagaaaaagttgcattagtaccagggtctggatttgggtcaccagataatgtacgtttatcctatgcactgtcaattgaggaactaacagaagcagctaatcgaattcatcgatttgttctaaatcataaataa

SEQ ID NO: 34126 - protein, 394 aa, Oceanobacillus iheyensis
MELAQRVQTLTPSSTLAITAKAKDLKKQGFDVIGLGAGEPDFNTPEYIMDGAKQAMNNGLTKYTPAGGIAELKLAIIDKFKQDNGLSYNEKQIIVTNGAKHALYTLFQVILNKEDEVIIPSPYWVSYPEQVKLAEGNPIILPAAETNDFKITPTQLEEAITPKTKAVIINSPSNPTGLMYSKEELAALGEVCLKHNIIIVSDEIYEKLIYTSKEHVSIASISDELYNQTIIINGVSKSHAMTGWRIGYAAGNETIIKAMTNLASHSTSNPTSIAQYGALAAYTKDPGDISLEYKKIFAERLDAFYKLIQDIPGMECIKPEGAFYLFPNAKKAAEMNGFATVDEWVAALLEEEKVALVPGSGFGSPDNVRLSYALSIEELTEAANRIHRFVLNHK

SEQ ID NO: 34127 - DNA, 1152 bp, Oceanobacillus iheyensis
  CDS (1)..(1152)
atggaacatttattaaatcagcaagtacaaaacattgaaatatcaggaattcgaaagttttttaatctcgtttctaacgaaaaagatattgtttcgttaaccattggtcaacctgacttttatactccacatgcaataaaacaagcttccataaatgcggttaataataatcatacaacttacaccgcaaatgctggtgtaatagagttacgtaaagctattgctaactactatgaatctcgatatcagattccatatcatccagaatcagaaattatcgtaactgcaggagcttcagaggctattgatattaccctccgtacaattttagagcctggtgatgaagtgatcttaccagcaccaatttaccctgggtatgaaccattaattacactagcacgtgccaaacctatacatatggacacaacaaagaccaatttcaaaataactaagtctcaactagaagagaccattacagagaagacaaaatgtataattatcccttctccttccaacccaactggtgcagcttatacgaagaaggagcttgatgaaattgtttctgtattaaaagataaaaaactatttatactgtctgatgaaatttatagtgaaattatctttgatcaacctcatgtatctatagcatcgtatcctgagatgagagatcaaacaattgtaattaatggtttgtcaaagtctcattccatgaccggctttcgtattggatatgcgctagcccctcattggttgtctaaacatatgttaaaagttcatcaatacaatgtttcttgtgcttcttctataagtcaatatgctgcactagaagcttttaattctaacgatgatcatttgcaactgataaaagatacgtataaaagtagaagagatttagtttacaaccgccttacatcaatgggaatcgatgttcaactaccagaaggagcgttttacatgtttcctcgttttccaatgagaaacgaaaactcatttgaattcggattgacattagtaaaacaagcaaaagtagcacttgtacctggtaatagtttttcacaatatggagaaggatttatgaggttatcttacgcctaccatgaagatgtattaaataaaggactagatcgaatagaaaagtttctaaaccagtaa

SEQ ID NO: 34128 - protein, 383 aa, Oceanobacillus iheyensis
MEHLLNQQVQNIEISGIRKFFNLVSNEKDIVSLTIGQPDFYTPHAIKQASINAVNNNHTTYTANAGVIELRKAIANYYESRYQIPYHPESEIIVTAGASEAIDITLRTILEPGDEVILPAPIYPGYEPLITLARAKPIHMDTTKTNFKITKSQLEETITEKTKCIIIPSPSNPTGAAYTKKELDEIVSVLKDKKLFILSDEIYSEIIFDQPHVSIASYPEMRDQTIVINGLSKSHSMTGFRIGYALAPHWLSKHMLKVHQYNVSCASSISQYAALEAFNSNDDHLQLIKDTYKSRRDLVYNRLTSMGIDVQLPEGAFYMFPRFPMRNENSFEFGLTLVKQAKVALVPGNSFSQYGEGFMRLSYAYHEDVLNKGLDRIEKFLNQ

SEQ ID NO: 34129 - DNA, 1305 bp, Leptospira interrogans
  CDS (1)..(1305)
atgagaagaaacatcgttcacagcggagcggacgccctaatttatgaaatcagacagatcgtagccgtcgcaaaaaagttagaggcactgggacttcagattacttacgaaaacataggagatcctatcttaaaaggggaatcgattccagattggatgaaagaaatagtttccaatttgatcttaaaagataagtcctgggcttatacggccacacaaggatatgaaccaactcgtaagttcttagcagaaaaagtgaacgaaaggagaggcgctcagatcacagcggacgatcttttattttttaacggactgggagacgcggtcgcaaaaattttcggttttatgagaagggaagctagagtattaggaccaagtccagcgtattctacgatttcttctgcggaagcggcgcatagcggctatgaacacctaacgtataacttacttccggaacacaattggatgccggatctagaagatatggaaaacaaggtgaaatacaatgattctatagctggaatattactgattaacccagataatcccaccggtgcagtatatgataaaaacttaatgaagaagatagtggcgatctgcgaaaaatacgatctgatgttaatttgcgacgaaacttatgcacacgtaaattattccgatcacggtccgcttcatctttcggaagtaatcggggataaggttcccggaatggcgcttagatctatttctaaagaatttccctggcctggaggacgttgtggatggttggaaatatttaacaaagagaaagatccggtttttagtcgttacgtaaaatcgttgttagacgcaaagatgctcgaagtatgttctactactttgccacagatggcaattccggaagtgtattctcatcctgattttattcctcatctaaaaagaagaaacgaaaaattcaaaaaacgcgcgcacgttgcaacggaatattttgcagaattaagaggggttaaggtagtagaaccaaaaggggctttttatcttacggtcgcttttgacgacgacgttttaaattcttccatgaaattggaaattgaaaataaaaaggcggacgaatttatccaacctctattggcttccgcggcaaacgacagaaggtttgtatattatttgcttgcgtccaccggtatttgtgtggttcccttatcagcgttttgtactttaaaagacggatttcgcgtaacgttgttagaggaagacgaggaaaaattcaattggatttacaaaacgcttcgggataagattggcgagtatatcgcttccgcctaa

SEQ ID NO: 34130 - protein, 434 aa, Leptospira interrogans
MRRNIVHSGADALIYEIRQIVAVAKKLEALGLQITYENIGDPILKGESIPDWMKEIVSNLILKDKSWAYTATQGYEPTRKFLAEKVNERRGAQITADDLLFFNGLGDAVAKIFGFMRREARVLGPSPAYSTISSAEAAHSGYEHLTYNLLPEHNWMPDLEDMENKVKYNDSIAGILLINPDNPTGAVYDKNLMKKIVAICEKYDLMLICDETYAHVNYSDHGPLHLSEVIGDKVPGMALRSISKEFPWPGGRCGWLEIFNKEKDPVFSRYVKSLLDAKMLEVCSTTLPQMAIPEVYSHPDFIPHLKRRNEKFKKRAHVATEYFAELRGVKVVEPKGAFYLTVAFDDDVLNSSMKLEIENKKADEFIQPLLASAANDRRFVYYLLASTGICVVPLSAFCTLKDGFRVTLLEEDEEKFNWIYKTLRDKIGEYIASA

SEQ ID NO: 34131 - DNA, 1215 bp, Leptospira interrogans
  CDS (1)..(1215)
atggatctcagcgcaaagaggctgaatgtcatcgaaccttctcctactctcgtaattactgctaaggcaaacgagttgaaaaaaaagggagaagatattgttagtttcggagccggtgagccagattttgaaactccatctcatatcagagacgctgcaaaaaatgcaatcgataggggaatgactcgttatacggctgtttctggaacggttgaattgaaagaagcaatcgtccacaagttcaaaagagacaatggtcttgattacgataaaagtcaggtaatcgttggaaccggtggtaaacaagttatttacaactactttctcgcaaccttaaatgcgggggacgaagtaatcattcccgctccgtattgggtgagttatgcggatattgttcgtttggcagaaggtgttcctgtgattgtcaacactactccggaggcaaattttcaaattacttcggaacaattgaaaaaggtaattactcctaagacaaaatgtttgattctaaattctccctccaatcctaccggcgcgggatattctaagaaagatatagaagctttgggagaggttgtgctttctactggaattcaagtcatgagcgatgacatttacgaaaaaatagtctatgacggattcgtattttctaatcttgctatgttgtctccggaacttaaaaaacaaacctttgtaatcaatggagtttctaaaacgtattccatgaccggttggagaattggctacggggcgggcgatttgaatatcgttaaaaatatggaaacgattcaaagtcaatctacttcgaatccttcttcgatttctcaggcagctgcacaagctgcaattgcaggagatcaatcctgtgtagaggagatgagaaaagcgtttcaagtcagaagagatcttatcgtttctcttttaaatgcgattccgggtgtaaaatgtaacaaccctcaaggagccttttacgtatttccgtatttgacggatgtttacaaaactactggttttataaaactaaaacaaggattttccgaaacctctctcagtaaaattttttgtagcactttattagaaaaatataaagtagctgcggttccaggaattgcatttggagaagaccaggctctcagactttcttacgcaatgggagaaaacgacatccgacgcggggtggaaagaatcgcggaaatgataagggatttgaactag

SEQ ID NO: 34132 - protein, 404 aa, Leptospira interrogans
MDLSAKRLNVIEPSPTLVITAKANELKKKGEDIVSFGAGEPDFETPSHIRDAAKNAIDRGMTRYTAVSGTVELKEAIVHKFKRDNGLDYDKSQVIVGTGGKQVIYNYFLATLNAGDEVIIPAPYWVSYADIVRLAEGVPVIVNTTPEANFQITSEQLKKVITPKTKCLILNSPSNPTGAGYSKKDIEALGEVVLSTGIQVMSDDIYEKIVYDGFVFSNLAMLSPELKKQTFVINGVSKTYSMTGWRIGYGAGDLNIVKNMETIQSQSTSNPSSISQAAAQAAIAGDQSCVEEMRKAFQVRRDLIVSLLNAIPGVKCNNPQGAFYVFPYLTDVYKTTGFIKLKQGFSETSLSKIFCSTLLEKYKVAAVPGIAFGEDQALRLSYAMGENDIRRGVERIAEMIRDLN

SEQ ID NO: 34133 - DNA, 1314 bp, Corynebacterium efficiens
  CDS (1)..(1314)
atgactaccaaaaagcgcaacacctcagagaccaccgacaccgccccgaaggcagtgggcgcggatcaggcagcgcgtccggttcggcggaccacccgccgcatcttcgatcagtcggagaagatgaaggacgtgctgtacgagatccgtggcccggtggccgcggaggcggaacgcatggagcttgatgggcacaatatcctcaagctcaacaccggcaacccggccgtcttcgggttcgatgcccccgatgtgatcatgcgtgacatgatcgccgccctgcccacctcccaggggtattcgacctccaagggcatcatccccgcacgtcgtgccgtggtgacccgctatgaggtcatcccggacttccccaacttcgacgtcgatgatgtcttcctgggcaatggtgtctccgagttgatcaccatgaccatgcaggcactgctcaacgacggcgatgaggttctcatcccggcaccggactacccgctgtggaccgccgcgacctccctgtccggtggcaaaccggtgcactacctctgtgatgaggacaatgagtggaacccctccatcgaggacatccgctccaagatcaccgagaagaccaaggccatcgtggtgatcaaccccaacaacccgaccggggctgtctactcccgcaaggttctgcaggagatcgcggacatcgcccgcgaatacgatctgctggtgctcgccgatgagatctacgaccgcattctctacgacgatgcccagcacatcaacatggccaccctgtgcccggacctgatgtgcatcacctacaacggcctgtccaaggcctaccgtgtcgcaggctaccgcgccggctggatgatcatcactggccccaagcgttatgccaagggcttcatcgacggcctggagctgctcgccggcacccgcctgtgcccgaatgtcccggcgcagcacggcatccaggtggccctcggtggccggcagtccatctacgggctcaccggtgaaggcggacgcctgctcaaccagcgtaatgtcgcctggcagaaactcaacgagatccccggtgtcagctgctacaagccgatgggtgcgctctacgccttcccgcgcctggatccgaatgtctatgagatccacgacgacacccagctgatgctcgatatcctgcgttcagagaagatcctcctggtgcagggcaccggcttcaactggccccaccatgaccacttccgcgtggtcaccctgccgtgggcatcccagttggaaaacgccatcgagcgactgggcaacttcctggtcagctacaaacagtag

SEQ ID NO: 34134 - protein, 437 aa, Corynebacterium efficiens
MTTKKRNTSETTDTAPKAVGADQAARPVRRTTRRIFDQSEKMKDVLYEIRGPVAAEAERMELDGHNILKLNTGNPAVFGFDAPDVIMRDMIAALPTSQGYSTSKGIIPARRAVVTRYEVIPDFPNFDVDDVFLGNGVSELITMTMQALLNDGDEVLIPAPDYPLWTAATSLSGGKPVHYLCDEDNEWNPSIEDIRSKITEKTKAIVVINPNNPTGAVYSRKVLQEIADIAREYDLLVLADEIYDRILYDDAQHINMATLCPDLMCITYNGLSKAYRVAGYRAGWMIITGPKRYAKGFIDGLELLAGTRLCPNVPAQHGIQVALGGRQSIYGLTGEGGRLLNQRNVAWQKLNEIPGVSCYKPMGALYAFPRLDPNVYEIHDDTQLMLDILRSEKILLVQGTGFNWPHHDHFRVVTLPWASQLENAIERLGNFLVSYKQ

SEQ ID NO: 34135 - DNA, 1545 bp, Bifidobacterium longum
  CDS (1)..(1545)
atgtttgcggaacgtctgcgcaatgcgatgaacagcaggggactgaagcaggtcgatttggtgcacgccgccgaacatcgtggtgtaaagatgggcaagagccacatcagccaatacgtggccggcaagaccatgccccgcgaggacgtgctcgaattcctggccagcgaactggacgtcgacatgaactggctgcgcggcgaggaatccaccacgcaattgaactcggacgcctccaacagcgtcacggacggcgaacacgccgccacaccgcttgccacgggtgcctccaagccccagacggacagcgagattcccgtgggccgccgccgcaccttcggcaaatcgcacaagctcgacaacgtgctctacgacgtgcgcggcccggtcgccgacgaggcgatgcgcatggaggccaacggcacccacatcctgaaattgaacatcggcaacccggcacccttcggcttccgcacgccggacgaagtcgtctacgacatggcccaccagctcaccgacaccgaaggctactcgccgtccaagggcctgttctccgcgcgcaaggccatcatgcagtacgcgcagctgaagaacatcccgaacgtcaccatcgacgacatctacaccggcaacggcgtcagcgagctcatcaacctgtccatgtccgcgctactcgacaccggcgacgaagtgctcgtgccatccccggactacccgctgtggaccgcctgcgtgaacctggccggcggcaccgccgtgcactacctgtgcgacgaacagtccgaatggtatccggacatcgacgacatccgctccaagatcaccagcaacaccaaggcgattgtcatcatcaacccgaacaaccccaccggcgcactttacccaaaggaagtgctccagcagatcgtcgacatcgcgcgcgaacaccagctcatcatcttctccgacgaaatctacgatcgcctcgtcatggacggcctgcagcacatctccatcgcctcgatggccccggacctgttctgcgtgaccttctccggcctgtcgaaatcgcacatgatcgccggctaccgcatcggctggatgatcctgtccggcaacaagcgcattgccaaggactacatcgagggcctcaacatgctcgccaacatgcgcatgtgttcgaacgtgcccgcccagtccgtggtgcagaccgcgcttggcggccaccagagcgtcaacgactacatcgtgccgggcggccgcgtgcacgaccagcgcgacctcgtctacgacatgctcaaccagattcccggcatcaccgccgtcaagccgaaggccgcgttctacatcttcccgaagatcgacgtcaaacgcttcaacatccactcggacgagcagttcgcgctcgacctgctgcatgacaagcacatcctcatcagccacggcggcgcgttcaactggcatcgccccgaccacttccgcgtggtgtacctgccgcgcatgggcatgctgcgcgaaaccatgggggagatctccgacttcttcagctactactggcagagctga

SEQ ID NO: 34136 - protein, 514 aa, Bifidobacterium longum
MFAERLRNAMNSRGLKQVDLVHAAEHRGVKMGKSHISQYVAGKTMPREDVLEFLASELDVDMNWLRGEESTTQLNSDASNSVTDGEHAATPLATGASKPQTDSEIPVGRRRTFGKSHKLDNVLYDVRGPVADEAMRMEANGTHILKLNIGNPAPFGFRTPDEVVYDMAHQLTDTEGYSPSKGLFSARKAIMQYAQLKNIPNVTIDDIYTGNGVSELINLSMSALLDTGDEVLVPSPDYPLWTACVNLAGGTAVHYLCDEQSEWYPDIDDIRSKITSNTKAIVIINPNNPTGALYPKEVLQQIVDIAREHQLIIFSDEIYDRLVMDGLQHISIASMAPDLFCVTFSGLSKSHMIAGYRIGWMILSGNKRIAKDYIEGLNMLANMRMCSNVPAQSVVQTALGGHQSVNDYIVPGGRVHDQRDLVYDMLNQIPGITAVKPKAAFYIFPKIDVKRFNIHSDEQFALDLLHDKHILISHGGAFNWHRPDHFRVVYLPRMGMLRETMGEISDFFSYYWQS

SEQ ID NO: 34137 - DNA, 1311 bp, Photorhabdus temperata
  CDS (1)..(1311)
atgcatcttcaaaacacctggagggaagagtacattaaatgtcagacgctatatgccaggcaccccctttttaccaagattaaggtaagactctctatgctagcagttaaaaaatccagcaaattggataatgtttgttacgacatccgcggccccgtactcaaggaggctaaacgccttgaagaagaaggcaacaaagtcctcaaattaaatatcggtaatccagccccttttggttttgaagcacccgatgaaatcctggtagatgttatccgcaacttaccaacagcacagggttattcagattcaaaaggtctgtattctgcacgtaaagcgatcatgcaacattatcaagcccggaatatgctggatgtgagtgttgaagatatttatatcggcaatggtgtttctgaattaatcgttcaggcaatgcaagcattactgaataccggtgatgaaatgctggttcctgcccccgattatcctctctggaccgctgcggtttcactttccagcggtaaagccgtacattatatgtgtgatgaagggtcggattggtttcctgacttagatgatatccgtaacaaaattactcctcgcacgcgtgggattgtgattattaaccccaataatccaacgggtgctgtatatagcaaggcgctgttattggaaattgttgaaatagcccgtcagcataatttgattatttttgctgatgagatttacgacaaaatcttatatgacgatgcagagcatcattccattgccgcacttgcccctgacctgttaacggtaacatttaacggattatctaaaacatatcgggttgccggttttcgtcagggctggatggtattaaacggtccgaagaagcacgccaagagctatattgaaggtttggagatgctggcatcaatgcgtttatgcgccaatgtgccaatgcaacacgctattcaaaccgcgttaggcggttaccagagtatcagtgaattcattttacctggtggtcgtttgtatgaacaacgtaaccgcgcatgggaattaattaatcaaatccctggcgtttcctgtgtgaaacctaagggagctttatatatgttcccgaaaattgatgcgaagcgttttaacgttcatgatgaccagaagatggtgcttgatctcttattacaggagaaggtcctgctcgtgcagggaactgcatttaactggccggaacctgatcatttccgcatcgtaacactgccaaggcttgatgaactggagatggctattcagaaattcgcccgatttattggcaaatatcatcagtaa

SEQ ID NO: 34138 - protein, 436 aa, Photorhabdus temperata
MHLQNTWREEYIKCQTLYARHPLFTKIKVRLSMLAVKKSSKLDNVCYDIRGPVLKEAKRLEEEGNKVLKLNIGNPAPFGFEAPDEILVDVIRNLPTAQGYSDSKGLYSARKAIMQHYQARNMLDVSVEDIYIGNGVSELIVQAMQALLNTGDEMLVPAPDYPLWTAAVSLSSGKAVHYMCDEGSDWFPDLDDIRNKITPRTRGIVIINPNNPTGAVYSKALLLEIVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHFRIVTLPRLDELEMAIQKFARFIGKYHQ

SEQ ID NO: 34139 - DNA, 1236 bp, Solenostemon scutellarioides
  CDS (1)..(1236)
atggagttgcagaattcagcgcaggaaatggaagcgccgaccaccattacgattaaggggattttggggctgttgatggccaacaccgatgccaaggagaacgggaaaagagtgatttctcttggaatcggagatccgactgcctattcgtgcttccacgctagtaatgccgctcaggaaggtgttgtcgagtgccttcgctccgccaaattcaacggctacgctcccaccgccggtcttcctcaaacaagacaggcaattgcagagtacttatctcgcgatctcccctacaagttaccagcggaaagcgtctacgtcacagccggctgcacgcaagctatcgagatagcattatcagttttggcccgacccggtgctaacatcttgcttccgagaccatgtttcccaatctacggactctgcgcctcattcagaaacatcgaagttcgctacttcgatcttcatcccgagaagggatgggaggtcgatctccaagcagtcgaagatttggcagatcacaacacagttgctatggtgatcataaaccctgggaacccatgtggaaacgtgtattcatatcagcacctaaagaaggttgctgagacagctaagaggctggggatagttgtgattgccgacgaggtttacggccacctggcattcggagcgaaccctttcgtgccgatggggaatttcggatcgatagctccggtggtgacgctgggatctttgtctaagagatggttggtccctggttggcgacttggttggttggtgattaatgatcctgacggcactttgatgagcccaaagtttgtggagcgcataaagaaatactgcgacatttgcggagggcctgctacattcatacaggcggcagttccagaaattgttgagcaaacacaggaagttttcttcagaaaaacaattaatattctgaggcagacttctgatatctgttgccaaaagatagaagaaattgatggcataacttgtccaacgaagccaaaaggagcaatggctttcatggtgaagctgaatatttcccggatgaaagacattagtgatgatattgacttctgtttcaagctggccaaagaggaatctgttataattcttcctggaattgctgtgggcctaaacaactggctccgaatcacatttgcagttgagccatctgctcttgaagaggccatggagaggctcaagtctttctgcatacggcactcctactaa

SEQ ID NO: 34140 - protein, 411 aa, Solenostemon scutellarioides
MELQNSAQEMEAPTTITIKGILGLLMANTDAKENGKRVISLGIGDPTAYSCFHASNAAQEGVVECLRSAKFNGYAPTAGLPQTRQAIAEYLSRDLPYKLPAESVYVTAGCTQAIEIALSVLARPGANILLPRPCFPIYGLCASFRNIEVRYFDLHPEKGWEVDLQAVEDLADHNTVAMVIINPGNPCGNVYSYQHLKKVAETAKRLGIVVIADEVYGHLAFGANPFVPMGNFGSIAPVVTLGSLSKRWLVPGWRLGWLVINDPDGTLMSPKFVERIKKYCDICGGPATFIQAAVPEIVEQTQEVFFRKTINILRQTSDICCQKIEEIDGITCPTKPKGAMAFMVKLNISRMKDISDDIDFCFKLAKEESVIILPGIAVGLNNWLRITFAVEPSALEEAMERLKSFCIRHSY

SEQ ID NO: 34141 - DNA, 1569 bp, Mus musculus
  CDS (1)..(1569)
atgcagcgggcagcggtgctggtgcggcggggctcctgcccccgcgcctcgggcccctggggccgtagtcacagcagcgctgcagccgaagcctcggcggcgctcaaggtgcgaccggagcgcagccctcgagaccgcatcctcaccctggagtccatgaacccgcaggtgaaggcggtggagtacgctgtgcggggacccatcgtgctcaaagccggcgagatcgagatggagctgcagcggggtatcaaaaaaccattcactgaggtaatccgagccaacattggggatgcccatgctatgggccagcagccaatcaccttcctccgtcaggtgatggcactctgcacctacccaaacctactaaacagccccagcttcccagaagacgctaagaaacgagcgcggcggatcctgcaggcttgtggtggaaacagcttgggatcttacagtgctagccagggcgttaactgtatccgtgaagatgtggcagcctttatcaccaggagagatggtgtgcctgcagacccagacaacatttacctgactactggagctagcgacggtatttctacaatcctgaaactcctggtctccggtggtggcaagtcacggaccggcgtgatgattcccatcccccagtatcccttgtactccgcggtcatctccgagctcgacgcggtgcaggtcaactactatctggatgaagagaactgctgggctttgaatgtggacgagctccggcgggcattgtggcaagccaaagaccactgtgaccctaaagttctctgcattatcaaccccggaaaccccacaggccaggtacaaagcagaaagtgcatagaagatgtgattcactttgcctgggaagagaagctttttctcctggctgatgaggtgtaccaggacaacgtgtactctccagactgcagattccactcctttaagaaagtgctttaccagatggggcacgagtactccagcaacgtggagctcgcctccttccactccacctccaagggctacatgggcgagtgtggctacagagggggctacatggaggtgatcaatttgcaccccgagatcaaaggccagctggtgaagctactctcggttcgcctctgtccgccagtgtcaggacaggccgccatggacattgttgtgaatccaccagaaccaggagaggagtcctttgagcaattcagcagggaaaaagaattcgtccttggtaatctggccaaaaaagcaaagctgacagaagatctgtttaaccaagtcccagggatccagtgcaaccccttgcaaggagctatgtatgcgttccctcggattctcatccctgccaaggccgtggaggcagctcagtcccataaaatggctccagacatgttctactgcatgaagctcctggaggagactggcatctgtgtcgtgcctggcagtggctttgggcagcgagaaggcacttaccacttcagaatgaccattctccctccggtggataaactgaagaccgtgctccacaaggtgaaagactttcacctgaagttcctggagcagtactcatga

SEQ ID NO: 34142 - protein, 522 aa, Mus musculus
MQRAAVLVRRGSCPRASGPWGRSHSSAAAEASAALKVRPERSPRDRILTLESMNPQVKAVEYAVRGPIVLKAGEIEMELQRGIKKPFTEVIRANIGDAHAMGQQPITFLRQVMALCTYPNLLNSPSFPEDAKKRARRILQACGGNSLGSYSASQGVNCIREDVAAFITRRDGVPADPDNIYLTTGASDGISTILKLLVSGGGKSRTGVMIPIPQYPLYSAVISELDAVQVNYYLDEENCWALNVDELRRALWQAKDHCDPKVLCIINPGNPTGQVQSRKCIEDVIHFAWEEKLFLLADEVYQDNVYSPDCRFHSFKKVLYQMGHEYSSNVELASFHSTSKGYMGECGYRGGYMEVINLHPEIKGQLVKLLSVRLCPPVSGQAAMDIVVNPPEPGEESFEQFSREKEFVLGNLAKKAKLTEDLFNQVPGIQCNPLQGAMYAFPRILIPAKAVEAAQSHKMAPDMFYCMKLLEETGICVVPGSGFGQREGTYHFRMTILPPVDKLKTVLHKVKDFHLKFLEQYS

SEQ ID NO: 34143 - DNA, 1535 bp, Arabidopsis thaliana
  CDS (65)..(1402)
accaacaacacaaaacttgtactcacaactaaaagaagaactcaaacgcaagacagaaagatcaatggcgagcaacggagttaccaactgtaacgcaaacgccaatgtttggcggttcaaaggaaacggtgcaacgagtgatgcggcggcggtgacgttgagaaagcttgcttttgggatgtttaaaaactgcaccatgaacagtggaaagaccattttgttcccaactcccggcgagccctccgcccattccaacttcaggacttgcccggaagccgaggaagccgttgccgacgctgcacgctccggcatggctaactcttacgcacccagccctggagttttcaaggctagaagggcggtggctgaatatttaaacggagaacttccgacgaagctgaaggccgaggatgtgtatatcaccggaggatgtaaccaagccatagagatcgtgatagattctcttgccggaaatccatccgccaacattctacttccaaggccgggatatcctcactacgatgctcgtgctgtctatagcggcctcgagattcgcaaatacgatcttctccccgagagtgattgggaaatcaatctcgatggcctcgaggcggctgcggatgagaataccgtcgcaatggtaatcatcaaccccaacaatccatgtggaaacgtctacacctacgaccatctcaacaaggtcgcggagatggctagaaaactcggtataatgataatatccgacgaagtatatgatcatgttgtatatggagacaagccttttattcccatggggaagtttgcatcaatagctccggtgatcacgctcggatccatatccaaaggatgggtcaacccaggctggagagttggctggatcgccatgaacgatcctaatggtatctttgtatctacaggggtagttcaagcaatagaggattttcttgatttaactccacagccttcatttattctccaggaagcacttcctgatatattggagaaaacacctaaagagttcttcgagaagaagatcaaagccatgagacgcaacgtcgagctttcatgtgagaggctcaaggatattccttgtctcttttgtcccaagaaacccgaatcttgttcttatttatggttgaagcttgacacatcaatgttgaataatatcaaaaatgattttgatttctgcacgaagctagttagtgaggagagtcttatccttataccaggagtggctctaggggcagagaattgggtgaggatatcgataggaaccgacgaatcagtggtacaagaaatatttgacagactaaaaggtttctatgatcgtcatgccatctccaaggaagctatcaaactcagtggccatgccattaaccagatcgtcgtctctgtcaactgattgtagtagtcctatgccacaagtcaacattataatttgtgcgtaattccttaattatcaggaacacaatcaagaaaaatagcattggataatgaaataaagatgtgtgaaaaataaaaggatatttgttttc

SEQ ID NO: 34144 - protein, 445 aa, Arabidopsis thaliana
MASNGVTNCNANANVWRFKGNGATSDAAAVTLRKLAFGMFKNCTMNSGKTILFPTPGEPSAHSNFRTCPEAEEAVADAARSGMANSYAPSPGVFKARRAVAEYLNGELPTKLKAEDVYITGGCNQAIEIVIDSLAGNPSANILLPRPGYPHYDARAVYSGLEIRKYDLLPESDWEINLDGLEAAADENTVAMVIINPNNPCGNVYTYDHLNKVAEMARKLGIMIISDEVYDHVVYGDKPFIPMGKFASIAPVITLGSISKGWVNPGWRVGWIAMNDPNGIFVSTGVVQAIEDFLDLTPQPSFILQEALPDILEKTPKEFFEKKIKAMRRNVELSCERLKDIPCLFCPKKPESCSYLWLKLDTSMLNNIKNDFDFCTKLVSEESLILIPGVALGAENWVRISIGTDESVVQEIFDRLKGFYDRHAISKEAIKLSGHAINQIVVSVN

SEQ ID NO: 34145 - DNA, 1822 bp, Persea americana
  CDS (4)..(1455)
ctaatgggattcctacgaaaccaacaactactatcaaaaatggcaacaggaaacggacacggagaaaactcaccatttgaggggtggaaagcatacgacagcaatccttatcacgccatcaagaatccagatggagtcatccaaatgggtcttgctgaaaatcagctatcatttgacttggtggaagactggattaaggagaacccggagtcatccatctgcacactcaaaggagtttcccaattcaaagatattgctctcttccaggactatcatggcctgtctgctttcagaaatgccgtggcgaattttatgggaaaagtgagaggaggcaaagtcaagttcaacccggatcgaatagttatgagtggtggagcgacaggagcacatgagacaatggctttttgtttggccaacccgggcgatgcattcctcgtcccaacaccttattacgcagggtttgatagagatttgaggtggcgaacaggagtccaattgattccagtcgtctgtgaaagctcaaacggtttcaaagtcactagggacgccctcgaaatcgcatacaagaaagcccaagaagacaacatcaaagtaaaaggagtgctcataaccaatccatcaaacccactagggaccatcttagatagagagaccctgaaaagcatagtgagcttcatcaatgagcagaacatccaccttatctgcgatgagatctacgcggccactgtcttcagccaacctgatttcataagcatatctgagatattagaggaaggcatcacatgcaacttggacctcatccatgttgtttacagcctctcaaaagatcttgggttcccaggatttagagttggtgtgatctactcttacaatgatgatgtggtgaattgcgctcgcgagatgtctagtttggggctcgtctccactcaaacccaacatctcctctcggccatgctttccgacgaacaattcgtcgacaagctcatctctgagagtgcggaaaggctggcatcgaggcacaagatgttcaccattgagctaggaaaggtgggaatcagttgtttgaagagcaatgcggggctcttctgctggatggatttgagggccctcctcgaaaagaagacggtagagggagagatggcactctggcgtacaattatcgagaaggttaagctcaatgtatctcctggttcctccttccactgctcagagcctggttggtttagagtttgtttcgcgaacatggacgatgagacgatgaaagtagctcttgacaggatcattgattttgtgtttaaaccgaacaagaaggagattatggcacctaagaaggtgcaacaaaagtggcaggcaaatctacatctacgattgagcttatgcgggcgaagacacgaagaagtaaccaagaccccgtgtacaatgtcgccccactcacctcttgttcgtgctacttgagtatattacagaatatcatacacaaggatcgtttcggcaaatatagggttcggttataacggatttataacattacgataatataaatcctttccgaatccgactttgtctatggaagtctcttatatcttttagaagctagggtaaccccctacttctttcattattatacacacctattggattctttatgatctgattacatcaccacgtttgtaagtttttaacctctccaatggagaaaagtcacacaaaattgtgacatttctctaagaggcacttttctctttctttttgtaacttttgaataagatcaattcctgttgtactttttgctaaaaaaaaaaaaaaaaaaaaaaaaaaaaaa

SEQ ID NO: 34146 - protein, 483 aa, Persea americana
MGFLRNQQLLSKMATGNGHGENSPFEGWKAYDSNPYHAIKNPDGVIQMGLAENQLSFDLVEDWIKENPESSICTLKGVSQFKDIALFQDYHGLSAFRNAVANFMGKVRGGKVKFNPDRIVMSGGATGAHETMAFCLANPGDAFLVPTPYYAGFDRDLRWRTGVQLIPVVCESSNGFKVTRDALEIAYKKAQEDNIKVKGVLITNPSNPLGTILDRETLKSIVSFINEQNIHLICDEIYAATVFSQPDFISISEILEEGITCNLDLIHVVYSLSKDLGFPGFRVGVIYSYNDDVVNCAREMSSLGLVSTQTQHLLSAMLSDEQFVDKLISESAERLASRHKMFTIELGKVGISCLKSNAGLFCWMDLRALLEKKTVEGEMALWRTIIEKVKLNVSPGSSFHCSEPGWFRVCFANMDDETMKVALDRIIDFVFKPNKKEIMAPKKVQQKWQANLHLRLSLCGRRHEEVTKTPCTMSPHSPLVRAT

SEQ ID NO: 34147 - DNA, 1272 bp, Xanthomonas campestris
  CDS (1)..(1272)
atgtccaccgccccgcaaaagccgctcgccatccgcgagcgcctgtccgaagtccgctacgagatccggggcgaactggcgcggcgagcgcgggagttggaggcgcagggccgcaagctgatcaagctcaacatcggcaaccccggtgcattcgggttccgtgcgccggagcatctgcagcgtgcgattgccgacgacatgggccgcaccgatccctatacgcatcagcagggcctgccggaagcacgcgaggcgatcgcggccgcgtatgcgcgccgccagcatccggatgcacatccggaccggatctttatcggcaacggcgtcagcgaactgatcgacctgtcactgcgcgccctgctgaaccccggcgacgaagtgctggtgccctcgcccgattacccgctgtggtcggcggccaccatcctcaacgacggccgcccggtgtattaccgctgcgcgccggagaatggcttccagccggacccggtggaaatcgagacactggtgtcgtcgcgcacgcgcgccatcgtgctgatcaatccgaacaaccccagcggcgccagttattcgcgcgagttgctggagcgcatcgtcgccatcgcggtcaagcacaacctgctgttgatggtggacgagatctacgaccaggtgctgtatgacggtgcggcgtttgtgccggtggcaccgctggctggcgagcacccgtgcatcaccttcagcgggctgagcaaggtgcaccgcgcctgcggctggcgggtgggttgggcgctgttgtccggtgagcaatcgcgcatcaacgatctgcgcaacgccatggacctgctcggcgcgctgcgcctgtgcgcgaatgtgccgggccagtatgcaatcgacgcggcagtcaacgggccggacaccatctcggcgctgtgcgcgccgggtggacgcctgtacgagacccgccgcgcggtgatcgaagcatgcgcggccagctcacatctgtcgttggttgcaccggccggcgcgctgtatgcgttcccggcagtggtggggccggcggcgcgtgctttcgacgaccacaccttcgcgctggatctgatgaacgacgaaggcgtgctggtggtgccgggctccagcttcaacgtgccgtatcgccaccatttccgcgtgacgctgatgcccgaagctgcggtgatgcgcgatgtgtttgcgcgcatcgatcgcgccctgacgcgacgtgcagaggcggtgaccaaggtcgtgccgctcaagtcgcgcagcgtggcgtga

SEQ ID NO: 34148 - protein, 423 aa, Xanthomonas campestris
MSTAPQKPLAIRERLSEVRYEIRGELARRARELEAQGRKLIKLNIGNPGAFGFRAPEHLQRAIADDMGRTDPYTHQQGLPEAREAIAAAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRELLERIVAIAVKHNLLLMVDEIYDQVLYDGAAFVPVAPLAGEHPCITFSGLSKVHRACGWRVGWALLSGEQSRINDLRNAMDLLGALRLCANVPGQYAIDAAVNGPDTISALCAPGGRLYETRRAVIEACAASSHLSLVAPAGALYAFPAVVGPAARAFDDHTFALDLMNDEGVLVVPGSSFNVPYRHHFRVTLMPEAAVMRDVFARIDRALTRRAEAVTKVVPLKSRSVA

SEQ ID NO: 34149 - DNA, 1272 bp, Xanthomonas axonopodis
  CDS (1)..(1272)
atgtccactgccccgcaaaagccgctcgccatccgcgagcgtctgtccgaagtccgctacgaaatccggggcgagctggcgcgacgagcgcgggagctggaggcgcagggccgcaagctgatcaagctcaatatcggtaacccgggtgcgttcggcttccgtgcgccggagcatctgcagcgcgccatcgccgacgacatgggccgcaccgatccgtacacccatcagcaaggcctgccggaagcgcgcgaggcgatcgccaccgcatatgcgcggcgccagcatccggatgcgcatccggaccgcatcttcgttggcaacggcgtcagcgaactgatcgatctgtcgctgcgtgcgctgctcaatcccggcgacgaagtgctggtgccctcgcccgactatccgctgtggtcggccgcgaccatcctcaacgatggtcgtcccgtgtattaccgctgcgccccggaaaacggcttccagccggacccagtggagatcgagacgctggtgtcctcgcgcacccgcgccatcgtgctgatcaatccaaacaatcccagcggcgccagttattcgcgcgaactgctggagcgcatcgtggcgatcgccaccaagcacaatctgctcttgatggtcgatgagatctacgaccaggtgctgtacgacgacgcggccttcgtgccggtcgcgccgctggccggcgcgcacccgtgcatcactttcagcggcctgagcaaggtgcatcgcgcctgcggttggcgcgtgggctgggcactgctgtcgggcgaccaagcgcgcatcaacgacttgcgcaatgcgatggacctgctcggcgccttgcgcctgtgcgccaatgtaccaggccagtacgccatcgatgcggccgtgaacgggccggacaccatctcggcattgtgcgcacccggcggacggctgtacgaaacccgccgcgcggtgatcgaggcctgcgcggccagcgagcatctgtcgctggtggcaccggccggtgcgctgtatgcgttcccggcagtggtgggcgcggcggcgcgcaacttcgacgatcatgcgttcgccctcgatctgatgaacgaggaaggcgtgctggtggttcccggctccagcttcaacgtgccgtatcgccatcatttccgcgtgacattgatgccggaagccggtgtgatgcgcgatgtgttcgcgcgcatcgaccgtgcactggcacgccgcgccgaagcggtcaccaaggtggttccactcaagccacgcagcgtggcctga

SEQ ID NO: 34150 - protein, 423 aa, Xanthomonas axonopodis
MSTAPQKPLAIRERLSEVRYEIRGELARRARELEAQGRKLIKLNIGNPGAFGFRAPEHLQRAIADDMGRTDPYTHQQGLPEAREAIATAYARRQHPDAHPDRIFVGNGVSELIDLSLRALLNPGDEVLVPSPDYPLWSAATILNDGRPVYYRCAPENGFQPDPVEIETLVSSRTRAIVLINPNNPSGASYSRELLERIVAIATKHNLLLMVDEIYDQVLYDDAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNEEGVLVVPGSSFNVPYRHHFRVTLMPEAGVMRDVFARIDRALARRAEAVTKVVPLKPRSVA

SEQ ID NO: 34151 - DNA, 1167 bp, Thermoanaerobacter tengcongensis
  CDS (1)..(1167)
atgaatcctaataaatacatatctgatgtagtaaagaaaataccaccttctgggattaggaaattttttgaccttgttaccaactcaaaggatataatatcactgggcgtaggggaaccggattttgtaactccatgggaaataagaaaagaggggattgaaacactgtgcaggggaaataccacatacacatcaaatttaggcttgcttgaactgaggatagccatctcctattttttaaagacacattatgacttaaactacgaccctgaaaaagaaattatggttactattggtgcaagtgaggctattgatttagcacttagagctcttttaaatgatggagatgaggttttaattccggaacccagttacgtttcctatgctccttgcgtaattctcacaagaggtgtcccagtgtttatacctacagacgaaaaaaacaattttatactcactcctgatgatttaagatccaaaataacttcaaagacaaaagcattaatcttactctatcctaacaatcctacaggtgcaatcatgaaaaaagaagacctggaagagattgtagatgtaataattgaaaaagaccttattgtaatttctgatgaaatatacagcgagctgacttatgaaggaaaacacgtaagcatagcctctcttccagggatgaaagaaaggacaatcctcataaacggtttttcaaaagcttttgccatgactggatggaggttagggtacattgcggcagagcatgaatttatagaagcgatgaacaaaatccaccaatatacaacaatatgtgctccgataactgcccagtacgcagccataaagggtatatacgaatgcgaagaagatataataaaaatgagggaaacctacgaccaaagaaggcggtttatcgtaaatggattccgcgaaataggtcttgactgttttgaacccaaaggagcgttttacatttttccttcaataaaaaagacaggcatgacttctgaagagttctgcgaaaaacttttaaaagaagaaaaagtagcagtagtacccggaaatgcctttggtccaagtggtgaaggttatgttagggtctcgtatgcgtattctatagataaaatagcaaaggcacttgaaaggataaaacgctttgctgaaaaaatattataa

SEQ ID NO: 34152 - protein, 388 aa, Thermoanaerobacter tengcongensis
MNPNKYISDVVKKIPPSGIRKFFDLVTNSKDIISLGVGEPDFVTPWEIRKEGIETLCRGNTTYTSNLGLLELRIAISYFLKTHYDLNYDPEKEIMVTIGASEAIDLALRALLNDGDEVLIPEPSYVSYAPCVILTRGVPVFIPTDEKNNFILTPDDLRSKITSKTKALILLYPNNPTGAIMKKEDLEEIVDVIIEKDLIVISDEIYSELTYEGKHVSIASLPGMKERTILINGFSKAFAMTGWRLGYIAAEHEFIEAMNKIHQYTTICAPITAQYAAIKGIYECEEDIIKMRETYDQRRRFIVNGFREIGLDCFEPKGAFYIFPSIKKTGMTSEEFCEKLLKEEKVAVVPGNAFGPSGEGYVRVSYAYSIDKIAKALERIKRFAEKIL

SEQ ID NO: 34153 - DNA, 1188 bp, Thermoanaerobacter tengcongensis
  CDS (1)..(1188)
atgaatttatctcaaaatgctttacaaattactccttcaatgactttagagataacggcaaaagcaaaacagctgaaagcccaaggagtggatgtcatagactttggagtcggtgaaccggattttgatactccttcctacataaaagaagctgctattgacgctataaagagaggatatactaaatacactccttcatcaggaattcccgagttaaaaaaggctatatgcgaaaaattgctaaaagataacggacttagttacactcccgaacaaattgtggtttcaaacggcgcaaaacattcgatatacaatgctctttctgcaattttaaatcctggcgatgaagtgataatacctgtaccttactggctcagttatcctgaaatggtaagattagcctacggaaaacctgttttcgttcatacaaaggaagaaaatgattttaaaataaccgctgaagagttagaaaatgccataactccaaagacaaaagctataattttaaatagcccaaacaatccttcaggagctgtctacactaaagaagagttagaagaaattgccagagtagttgaagaagcaaatatttttgtgatttctgatgaaatatacgaaaaactcatatacgaaggagaacacgttagcattgcttcatttggagaaaaaatcaaagaactcacaattgtagttaatggcatatcaaaggcctatgccatgactggatggagaataggctatacggcttcttcactagaagttgcaaaagtcatgtcaaatattcaaagtcacactacatcaaaccccaattcaattgcccagtacgctagcgttgctgctttacaaggaggagaagaagaaatagaaaaaatgaaagaagaatttaacagaagaaggctttatatggtggagagggtaaataaaataaaagatttgaaatgttctactccaaaaggagccttttatgtgatggtaaatatagaaaaatacattggtagggagttaaatggaaagacaataaacggttctttggactttgcaagtgctttgattgacggagcaaatgtagctgtggtacctgctttgccttttggaatggacaactatataaggatgtcctacgctacatctcttgaaaatattaagaagggccttgacagaattgaggattttttaagtaaaagctaa

SEQ ID NO: 34154 - protein, 395 aa, Thermoanaerobacter tengcongensis
MNLSQNALQITPSMTLEITAKAKQLKAQGVDVIDFGVGEPDFDTPSYIKEAAIDAIKRGYTKYTPSSGIPELKKAICEKLLKDNGLSYTPEQIVVSNGAKHSIYNALSAILNPGDEVIIPVPYWLSYPEMVRLAYGKPVFVHTKEENDFKITAEELENAITPKTKAIILNSPNNPSGAVYTKEELEEIARVVEEANIFVISDEIYEKLIYEGEHVSIASFGEKIKELTIVVNGISKAYAMTGWRIGYTASSLEVAKVMSNIQSHTTSNPNSIAQYASVAALQGGEEEIEKMKEEFNRRRLYMVERVNKIKDLKCSTPKGAFYVMVNIEKYIGRELNGKTINGSLDFASALIDGANVAVVPALPFGMDNYIRMSYATSLENIKKGLDRIEDFLSKS

SEQ ID NO: 34155 - DNA, 1167 bp, Thermoanaerobacter tengcongensis
  CDS (1)..(1167)
atgaactttgaagacaggattgccaaaagagcaaaggccatagaaatatccacaattaggtatttttttaacatggctagagaagttgaaggggcgatttctcttgccattggagagccagattttataacaccagagcacataagaaatgcggcaaaaaaggctttagatgagggcatgacagggtacactgtgaacgcaggactcattgagcttagaagagaaattgcagattatctaaaaagaaggtatagcctatattatgaccctgaaaaagaaattttagttacaataggggctacagaagcaatatatgtaactttaagcaccttggcagaagaaggggacgaagtgctaataccagaaccctcttttgtagcttatcatccctgcactgttatagctggagcaaaatcagtttttgttcctacttatgaagaagacgactttatattaagagcagatgtgctggaaaaatatataaccgaaaggtcaaaagtcttgatattaccctatccaaacaatcctacaggagcagtaatgccaaaagaggctttagaggagatagccaaagtagtagaaaaacatgaccttattgtagtaacagatgagatttactccgaattggtatacggtggatttaagcatacaagttttgcctccctgcctggcatgtgggaaagaactattaccattaacggattttcaaaatcctacgctatgacgggatggcgtctcgggtatatagctgctcctgagcattttaccaaacatatagctaaacttcatcaatacgctgttacagctgcggctacaatgtgtcagtatgcgggaattgaggctatgagaaatggggatgaggatataataaaaatgagagaagaatatgacaagaggagaaagttcttacttgaaagcgtaagggagatggggctttcctgttttgagcctaaaggggcattttatatattcccatcgataaaaactacagggcttacatcaatggaatttgcaaaaaggcttctttatgaggcgaaagttgcagttgtgccgggcaatgcctttggggaacatggagaagggtatgtgcggctggcctatgccacatcaatggaaaacttagaagaagcggtaaagaggatgaaagaatttatggcaaaactttaa

SEQ ID NO: 34156 - protein, 388 aa, Thermoanaerobacter tengcongensis
MNFEDRIAKRAKAIEISTIRYFFNMAREVEGAISLAIGEPDFITPEHIRNAAKKALDEGMTGYTVNAGLIELRREIADYLKRRYSLYYDPEKEILVTIGATEAIYVTLSTLAEEGDEVLIPEPSFVAYHPCTVIAGAKSVFVPTYEEDDFILRADVLEKYITERSKVLILPYPNNPTGAVMPKEALEEIAKVVEKHDLIVVTDEIYSELVYGGFKHTSFASLPGMWERTITINGFSKSYAMTGWRLGYIAAPEHFTKHIAKLHQYAVTAAATMCQYAGIEAMRNGDEDIIKMREEYDKRRKFLLESVREMGLSCFEPKGAFYIFPSIKTTGLTSMEFAKRLLYEAKVAVVPGNAFGEHGEGYVRLAYATSMENLEEAVKRMKEFMAKL

SEQ ID NO: 34157 - DNA, 1191 bp, Fusobacterium nucleatum
  CDS (1)..(1191)
atgagaatttcagatagagtcaaaaatatgaaatattcagctgttagaaaattagcccctttggctgctgaggcagaaaaaaaaggaataaaagtttatagattaaatataggacaacctaatatagaaacaccaaaattgttttttgaaggtttaaaaaatatacctgatcatgttataagatatgcagattcaagaggaatatctattttattagaacaagttattgaggtttatgcaagagatggacatattttaaagaaagaagatataattgtgacagaaggtggtagtgaagctttaacatttgcaatgcttgctatttgtaatccaaatgatgaagttttaattccagaacctttttattcaaattataaaagtttcttagatattgcaggagctaaaattattcctataccaacagatataaaaaatgattttgctttgcctaaaaaagaagaaatacaaaaactgattacttctaaaacaaaagcaattttatattcaaacccttgtaacccaacagggaaagtatatacagaagaagaagttaaattactagctaatttagcagcagaaaatgatttgtttgttattgccgatgagccatatagagaattcatatatgatgataatgacaaacattattctttattagatatagagaaagctaaggagaatgttattattatagatagtgtttctaaacattacagtgcttgtggagcaagagttgggtttttaatatcaaaaaataaagactttatgacatatataatgaaactttgtcaagctagacttgctgcaccaactgttgaacaatatgcagtggccagtttaatgaaagctcctaaggaatattttaaagaaatcaaagaaatttataaaagaagaagagatataatagtaaattctttaaataagatagagggtgtaacttgttcaactccaaaaggggcaatttatgcttttgcaaaacttcctgtggaaagttcagaagatttttgtaaatggcttttaactgagtttgtctatgataactcaacagttatgcttgcacctggggaaggtttttatgaaacagaaggtttaggaaaaaatgaagtaagattttctttctgtgttggagaaaatgatatagaaaaggcaatgagagtgcttgaagaggcattaaaagtttataaaaagtag

SEQ ID NO: 34158 - protein, 396 aa, Fusobacterium nucleatum
MRISDRVKNMKYSAVRKLAPLAAEAEKKGIKVYRLNIGQPNIETPKLFFEGLKNIPDHVIRYADSRGISILLEQVIEVYARDGHILKKEDIIVTEGGSEALTFAMLAICNPNDEVLIPEPFYSNYKSFLDIAGAKIIPIPTDIKNDFALPKKEEIQKLITSKTKAILYSNPCNPTGKVYTEEEVKLLANLAAENDLFVIADEPYREFIYDDNDKHYSLLDIEKAKENVIIIDSVSKHYSACGARVGFLISKNKDFMTYIMKLCQARLAAPTVEQYAVASLMKAPKEYFKEIKEIYKRRRDIIVNSLNKIEGVTCSTPKGAIYAFAKLPVESSEDFCKWLLTEFVYDNSTVMLAPGEGFYETEGLGKNEVRFSFCVGENDIEKAMRVLEEALKVYKK

SEQ ID NO: 34159 - DNA, 2695 bp, Drosophila melanogaster
  CDS (342)..(2048)
cttttgcccgcaagaaaaacatatagtcggtaaatactgccagcacttcattttccatctcggtgcggtttcagttcttgttgtcagttccttaattgcgtctagcggccaaagagctttgattatttgatacgattctgattggagctcgcacgccgcacatattcgcacacacacacacacgtacgcgcacacacacgcagccaagcaagcacacacgtttttattaggtattttatatacagacatatcgcgtttattaataagtttatgcaagttcttgggatcacaacaaacgccgttagataatcgccacgcccacttgcgcccatcaagaaataatgagtcgaatgctaattaaacctgctgccgccacagtttcggccgctttgcagcagcaccagcgccagcagcaacagtacgttattcgccgctggaaatcgttcctgcacaacaacagcaacaatgccaatcgacgtgcggcgaaatcaacggcaacagcaacggtgacggcggcagcgacgtcgcagcgccatggaacaagcggcgatttcattcaaccgttagacgtccgccgttccttttcaaccagccacaaaatgccgtcgtcgtcgaaagcgctcacactggataacataaatcccaactttattgccatggaatatgccgttcgcggtcctctggtgattcgtgctggggaaatcgagaaggaactggaaaagggtgtcaagaagccattcgaccaggtgatccgtgccaacatcggtgattgccatgcgatgggccagcagcccttgaccttcctgcgacagctgttggcgctgaccttcgagaaacgtctgctggattcacccgattatcccgaggacgtcaagaagcgcgcctgtgccattttgaacggctgccagggtcaatcggtgggctcgtacaccgactccgccggtctggaggtggtgcgtcgccaggttgctcagtacatcgagaaaagggatggcggcatcgcctccaattggcaggacatctatctaaccggcggtgcctctcccggcatcaagagcattctctccatgatcaacgccgaggtgggatgcaaggcgccaggtgtcatggtgcccattccgcagtacccactgtactcggccaccatctctgaatatggcatgaccaaggtggattactatctggaggaggagaccggttggagcctggacaggaaggagctgcaacggtcctacgatgaggcgaagaaggtctgcaatccgcgtgccctggtcgtgatcaatccgggcaatcccaccggacaggtactgacccgcgagaacatcgaggagatcattaagttcgcacacgataacaaggtgctggtgctggccgatgaggtgtaccaggacaatgtctacgacaagaactccaagttctggtcgttcaagaaggtggcctacgaaatgggcgacccctatcgtaatctggaaatggtcagtttcctgtccacctcgaagggctatctgggcgagtgcggcattcgcggcggttacatggaggttctcaatcttgatcccaaggtcaaggccatgctgaccaagtcgataacggcggcgctttgcagcaccaccgctggccaggtggccgtgagtgccctggtcaatccaccgcagcccggagagccatcatacgatctgtacaagaaggagcgcgatggcattctggccgctctaaaagaacgggccgagctcgtccacaaggcactgaacagcttcgaaggctacaaggttaaccccgtacagggcgccatgtacgtctttccacagatcgagatcccgcccaaggcgatcgaggcggccaaggccaagggcatggcccccgatgttttctacgcatttgagctgctcgagacgagcggcatttgcattgttcctggcagtggatttggtcagaagcccggtacgtggcatttccgaagcacgatcctcccgcaaacggacaagctgaagctgatgatggagaagttccgcgtgttccacgccgagttcatgaagaagtacaagtagatcagctgccaacttccccgtcctcgatccctgtgttaagtgtcaatcctccggcttaggattaaaaatttaaattaccctaattgttttttttttttcctctttgttactgtgtcatagctgaatgcttctaagctcttctttatatgcatatatagatatatatgagaaatatataaaaacatttttaaaaccctatgatttgtgaacccaacccgcgcaggttttatcgccacgataacgtttccagttagcaattaacccactcaaccatgtagtctttgattcttaattgaacgaaaactcctggcggagatttgacaataatttttgttagaaccaaaagtagtttaccatcttttggtcggcgcataattgaaaattctgatattgttctaaacgaaagttatttgcattgtgtatatttatatttatctacacataaatatatatagccctgcatgtgcttatcccccgcgaatcgatcacgaaaatcatatgatgtgtgtgcgttcaagtcattactaattgttatagacaagaagaaactttgaaaataaataaataattattattgttaaaaaaaaaaaaaaaaaaaaaaaaaaaaaaaaaaaaaaaaaaaaaaaaaaaaaaaaaaaaaaaaaaaa

SEQ ID NO: 34160 - protein, 568 aa, Drosophila melanogaster
MSRMLIKPAAATVSAALQQHQRQQQQYVIRRWKSFLHNNSNNANRRAAKSTATATVTAAATSQRHGTSGDFIQPLDVRRSFSTSHKMPSSSKALTLDNINPNFIAMEYAVRGPLVIRAGEIEKELEKGVKKPFDQVIRANIGDCHAMGQQPLTFLRQLLALTFEKRLLDSPDYPEDVKKRACAILNGCQGQSVGSYTDSAGLEVVRRQVAQYIEKRDGGIASNWQDIYLTGGASPGIKSILSMINAEVGCKAPGVMVPIPQYPLYSATISEYGMTKVDYYLEEETGWSLDRKELQRSYDEAKKVCNPRALVVINPGNPTGQVLTRENIEEIIKFAHDNKVLVLADEVYQDNVYDKNSKFWSFKKVAYEMGDPYRNLEMVSFLSTSKGYLGECGIRGGYMEVLNLDPKVKAMLTKSITAALCSTTAGQVAVSALVNPPQPGEPSYDLYKKERDGILAALKERAELVHKALNSFEGYKVNPVQGAMYVFPQIEIPPKAIEAAKAKGMAPDVFYAFELLETSGICIVPGSGFGQKPGTWHFRSTILPQTDKLKLMMEKFRVFHAEFMKKYK

SEQ ID NO: 34161 - DNA, 1113 bp, Methanosarcina acetivorans
  CDS (1)..(1113)
atgaaggaaatcagtttttcagaaaacgtatcccggatagatacttccgggatcagaaagattttcgaagctgcaggttcaaatgccatcaaccttgggctcggacagcctgacttcgataccccggtacacataaaaaccgcagcaatcgaagccataaatgaaggttttacgggttataccgtaggcccgggaatccctgaactgagagaagccctgagccagaaattcctggaggaaaatggtttttctgtttctcctcaggaaataattgtaacctcaggcgcatctgaagctcttaccattgcccttgcagccctccttaatgtcggagatgaagttctgatctcaaaccccggctttgtgtcctacaacgccctgactgagatcctgaacggaaaggtggtaagcgttcccctggcagaagaccttaccatgaagccggacgctgtcctcgagagaataactcctaagacaaaagcccttatccttaactctccatccaaccctacaggtgcggtctcaagcagggcagatatcaaagcccttgccgagattgcagatgaccataacataaccatcatttctgacgaggtctacgagtacttcatctatgaaggcgaacacgtaagccctgccagctattcggataatgtggtcactataaacgctacctcaaaaagctattccatgacaggctggaggctcggatatcttgcagccaggaaagagtacatagcccagatgaacaaagtccaccagtacatacaggcctgtgcaaattcaattgctcagaaggctgcctatgccgcagttaccggcccgaaagactcggtcaatgcaatgcgtgaagagttccgaaaacgcagggacttactcgtaaaagggctcaatgagctgggaatggagtgtgcttttccgaaaggggctttttacgcctttccgaaagttgaaaactcagctgaggtcgcctctaaaatgatctcaaacggggttgtagttgtcccgggaacagccttcggaagcgaaggtgacggctatataagaatttcctatgcagcctcaatgaaagatattgaaaaatcccttgccattatggaaaaagtgctctga

SEQ ID NO: 34162 - protein, 370 aa, Methanosarcina acetivorans
MKEISFSENVSRIDTSGIRKIFEAAGSNAINLGLGQPDFDTPVHIKTAAIEAINEGFTGYTVGPGIPELREALSQKFLEENGFSVSPQEIIVTSGASEALTIALAALLNVGDEVLISNPGFVSYNALTEILNGKVVSVPLAEDLTMKPDAVLERITPKTKALILNSPSNPTGAVSSRADIKALAEIADDHNITIISDEVYEYFIYEGEHVSPASYSDNVVTINATSKSYSMTGWRLGYLAARKEYIAQMNKVHQYIQACANSIAQKAAYAAVTGPKDSVNAMREEFRKRRDLLVKGLNELGMECAFPKGAFYAFPKVENSAEVASKMISNGVVVVPGTAFGSEGDGYIRISYAASMKDIEKSLAIMEKVL

SEQ ID NO: 34163 - DNA, 1170 bp, Pyrococcus furiosus
  CDS (1)..(1170)
atggcacttagcgacaagcttgatttagttaatccctctgagattaggaagctcttcgatttggccgctggcatgaaggatgtaatttcattgggaattggagagcccgactttgacactccagctcatataaaggaatatgcaaaggaaggccttgacaaaggcttgacccattatggtcctaacgttggattacctgaacttagggaagccatagcagagaagttaaagaaacagaatggaattgaggcagatccaaacagtgagataatggttttagttggggcgaatcaagcctttctaatgagcctagcaacctttctaaaggatggggaggaggtattgatcccaagtccaatgttcgtgagttatgctcccgcggtaattttagcaggtggaaagccagtggaagttcccacatatgaggataacgagtttagaataaacgtcgatgatctgaaaaaacacgttagcgaaaagacaagagcgttaataataaactcaccaaataatcccactggagcagtgctaactaaaaaagacctcgaagaaatagctgactttgcaaatgagcatgatctaatgataataagcgatgaagtttatgaacacttcatatatgacggagctaagcattacagtatagcagccttggatggaatgtttgggagaacaataacagttaatggcttctcaaaaacgtttgcaatgaccggatggagacttggctttgtagtagcgccttcctgggtaattgaaaagatggtaaagttccaaatgtacaacgcaacgtgtccagtaacctttatacaatacgcagcagccaaagcactaagagacgagagaagctggaaggcagttgaggaaatgagaaaggaatatgagaggagaaggaatctagtgtggaaaagacttaatgaaatgggactgcccacagttgaacctaaaggagcattttacatctttccaagaatcaaggacactggattgagtagcaaggagttcagcgaactaatgctgatggaggcaaaggtggctgttgtcccaggaagcgcctttggaagagctggggaaggatacataagaataagctatgcaacggcatatgaaaagttagaagaagcaatgaatagaatggaaaaagttctaaaggagaaaaagctcatctga

SEQ ID NO: 34164 - protein, 389 aa, Pyrococcus furiosus
MALSDKLDLVNPSEIRKLFDLAAGMKDVISLGIGEPDFDTPAHIKEYAKEGLDKGLTHYGPNVGLPELREAIAEKLKKQNGIEADPNSEIMVLVGANQAFLMSLATFLKDGEEVLIPSPMFVSYAPAVILAGGKPVEVPTYEDNEFRINVDDLKKHVSEKTRALIINSPNNPTGAVLTKKDLEEIADFANEHDLMIISDEVYEHFIYDGAKHYSIAALDGMFGRTITVNGFSKTFAMTGWRLGFVVAPSWVIEKMVKFQMYNATCPVTFIQYAAAKALRDERSWKAVEEMRKEYERRRNLVWKRLNEMGLPTVEPKGAFYIFPRIKDTGLSSKEFSELMLMEAKVAVVPGSAFGRAGEGYIRISYATAYEKLEEAMNRMEKVLKEKKLI

SEQ ID NO: 34165 - DNA, 1173 bp, Pyrococcus furiosus
  CDS (1)..(1173)
atgaaagaaaagaggaaatattttatggcccacagaattggagttatccagcgttcaaagattagagagttgtttgaaagagcatctaaaatggaaaacgtgatatctcttggtataggtgagcctgactttgataccccgaataacataaaggaagctgcaaagagagccttagacgaagggtggactcattacactccaaatgccggaattccagagctaagagaagctatcgcggaatactacaagaagttctatggaattgatgtggaagtagacaacgttttggtgactgctggagcttatgaagccacatatcttgcatttgagaccatgctagagcagggggatgaggtaattataccagacccagcattcgtttgttatgttgaagatgcgaagcttgcagaggcaaagcccataagactacctctaagggaggaaaatgacttcaagccagatatagacgagctactagaaagaattacaaagagaactaggatgatagtcataaactatccaaacaacccaaccggagcagttttagataaggagacagccaaagctatagcggatgttgctgaggattataacatttacattctgagtgatgaaccctatgagcacttcttatatgatgatgcaaagcactatccaatgataaaatttgctcccgacaataccattctcgcaaactcattctcgaagactttcgcaatgactggatggagacttggatttgtcatagcacctacccaaataataagggaaatgattaaactccacgcctacataatagggaatgttgcttcgttcgtccaagttgctggaatagaagctctcagaagtaaagaaagttggaaggcagtggaagagatgagaaaagaatacaacgagagaagaaaactagtcctacaaagattgagaaaaatgccatacataaaggtaagagagcccaagggagcattctacgtattccccaatataagcgagaccgagatgagtagcgaggaattcagtgagtggttgctagagaaggccaaggtagtagtgatcccaggaacggcctttggagaaaatggagagggatatgtgagaattagctatgcaacaagcagagaaaaacttatagaggcaatggacaggatagaaaaggccctagaagaaatatag

SEQ ID NO: 34166 - protein, 390 aa, Pyrococcus furiosus
MKEKRKYFMAHRIGVIQRSKIRELFERASKMENVISLGIGEPDFDTPNNIKEAAKRALDEGWTHYTPNAGIPELREAIAEYYKKFYGIDVEVDNVLVTAGAYEATYLAFETMLEQGDEVIIPDPAFVCYVEDAKLAEAKPIRLPLREENDFKPDIDELLERITKRTRMIVINYPNNPTGAVLDKETAKAIADVAEDYNIYILSDEPYEHFLYDDAKHYPMIKFAPDNTILANSFSKTFAMTGWRLGFVIAPTQIIREMIKLHAYIIGNVASFVQVAGIEALRSKESWKAVEEMRKEYNERRKLVLQRLRKMPYIKVREPKGAFYVFPNISETEMSSEEFSEWLLEKAKVVVIPGTAFGENGEGYVRISYATSREKLIEAMDRIEKALEEI

SEQ ID NO: 34167 - DNA, 1306 bp, Arabidopsis thaliana
  CDS (1)..(1275)
atggctagccaaggatgcgtagattggcagttcagtggcagtgatgcagccgaaaaggccgcccaagcctccctaggcacttactcttctgaaatcttcagtctgtgtgaccctcaaggaaagcctattttgcctccactaagtgaagaggcagagaccagccataccgccgaaaaggcggttgttaaggctgtcctttgcggtacgggaaacgcctatgctccaagtattggcctcccggttgccaaacgtgctgtggcggaatatctaaaccgagatcttgacaataagctaacgggagatgacgtatatatgactgttggatgcaaacaagcaatcgagctcgcggttagtattctggctaaaccgaaagccaacatcttgcttccgaggccaggcttcccatgggacatggtccactctatctacaaacaccttgaggtccgaaggtatgagttcatccctgaaagagactttgagatcgatttcaacagcgttagagagatggtagacgagaacacttttgcgatatttataatcaacccccacaatcccaatgggaactactacactgaggctcatcttaagcagctcgctacattggcacgggaactcgggataatggtcgtttcggatgaagtatatagatggtccgtattcgggagtaatccatttgttccaatggggaaattctcctcgatagtaccagtgattacactcgggtccatatcgaaaggatggattgtcccaggatggcgaacgggctggctcgcgttacacgatctaaatggtgtctttagatccacaaaggtcttaaaagctgcgaaagaatttctggagattacttccaaaccaccaactgtcatccaggcggctattcccacaatcttggagaaaactcctcaagattttttcgagaagagggggatttttctaaaagacaaagtggattttggatattctaagctcaagaacataccaactctcacctgctacatgaaacctgaatcatgcaccttcttatggaccaagctggacccattgcattttgtagacattgaagacgatcacgacttctgcaggaagcttgctaaggaagaaaatctcgttgttttaccaggaattgcatttggtcagaataactggttgaggcattctatcgacatggagactccaagattggaggatgcatttgaaagattaaagagcttctgtgaacgccattccgttatagttgaagcttcttcactcaaagacgtcaatggcgtcaactaaagggtcaatataaatttctttgccttaagtc

SEQ ID NO: 34168 - protein, 424 aa, Arabidopsis thaliana
MASQGCVDWQFSGSDAAEKAAQASLGTYSSEIFSLCDPQGKPILPPLSEEAETSHTAEKAVVKAVLCGTGNAYAPSIGLPVAKRAVAEYLNRDLDNKLTGDDVYMTVGCKQAIELAVSILAKPKANILLPRPGFPWDMVHSIYKHLEVRRYEFIPERDFEIDFNSVREMVDENTFAIFIINPHNPNGNYYTEAHLKQLATLARELGIMVVSDEVYRWSVFGSNPFVPMGKFSSIVPVITLGSISKGWIVPGWRTGWLALHDLNGVFRSTKVLKAAKEFLEITSKPPTVIQAAIPTILEKTPQDFFEKRGIFLKDKVDFGYSKLKNIPTLTCYMKPESCTFLWTKLDPLHFVDIEDDHDFCRKLAKEENLVVLPGIAFGQNNWLRHSIDMETPRLEDAFERLKSFCERHSVIVEASSLKDVNGVN

SEQ ID NO: 34169 - DNA, 1179 bp, Clostridium perfringens
  CDS (1)..(1179)
atgatactagagaatatgatattagataatgtgaaaaatatgccaccttcaggtattagaaaatattttgacttaataaatgaaatggaagatgttatttctttaggggttggggaacctgattttgtaactccatggaatgttagagaggcaggaatttattctctagagcaaggacatactcactattcatcaaatgcaggatttatagagttaagagaagagatatcaaagtatttaaatagaagattttctcttagatataatccaaaggatgaaatacttgttactgttggaggaagtgaagggatagatttagcacttagagctttagtaggtcctggagatgaggttataatacctgagccaagctttgtagcttataagggatgtacagcatttacaggagcaactgccaagacaatagatttaagagcttgtgatgattttaaattaactccagaacttttagaagaggctataactgagaaaacaaaggtggtaataattccattccctaataatcctactggagcaataatgaataaagaagagcttcaaaagattgtggatgttttaaaggataaggatgtaataattatttctgatgaaatatatgcagaattatcctatgatgaggaccatgtttcaatagctagtttccaagaggtaaaggaaaaaactatagtaataaatggattctctaaagcttatgctatgactggatggagattaggatatgtatgtgctcataaagttttaatagacgctatgaaaaagatacatcagtatgcaataatgtgttcaccaacaacggctcagtatgctgctattgaggctcttaaaaatggtgatgagagcgtttttgaaatggcaagggaatataatagaagaagaagagtattagttgatggatttagaagtatgggattagattgctttgaaccattaggagctttatatgtattcccatgtattaagtcaactggtatgagttcagatgaattttgtgaaaaacttcttcttgaagagaaggtactagctgttccaggaaatgcttttggagagtgtggagaaggttttataagagcttgttatgctgcttcaatggaagacataatggaggctataaagagaataagaagatttgttgaaagaaataatatgcaagggaaatag

SEQ ID NO: 34170 - protein, 392 aa, Clostridium perfringens
MILENMILDNVKNMPPSGIRKYFDLINEMEDVISLGVGEPDFVTPWNVREAGIYSLEQGHTHYSSNAGFIELREEISKYLNRRFSLRYNPKDEILVTVGGSEGIDLALRALVGPGDEVIIPEPSFVAYKGCTAFTGATAKTIDLRACDDFKLTPELLEEAITEKTKVVIIPFPNNPTGAIMNKEELQKIVDVLKDKDVIIISDEIYAELSYDEDHVSIASFQEVKEKTIVINGFSKAYAMTGWRLGYVCAHKVLIDAMKKIHQYAIMCSPTTAQYAAIEALKNGDESVFEMAREYNRRRRVLVDGFRSMGLDCFEPLGALYVFPCIKSTGMSSDEFCEKLLLEEKVLAVPGNAFGECGEGFIRACYAASMEDIMEAIKRIRRFVERNNMQGK

SEQ ID NO: 34171 - DNA, 1242 bp, Ralstonia solanacearum
  CDS (1)..(1242)
atgaaaacgatccagaaatccgccaagctcaacaacgtctgctatgacatccgcggccccgtgctggagaaggccaagcagatggaggaagagggccaccagatcatcaagctgaacatcggcaacctggccccgttcggcttcgatgccccggaagagatccagcaggacatgatccgcaacctgcccaactcggccggctactcggattccaagggcatcttcgcggcgcgcaaggcggtgatgcactatacgcagcagcagggcatcaagaacgtcacgctggacgacatctacctgggcaacggcgcctccgagctgatcgcgctggccaccaacgcgctgctcgacgccggcgacgaactgctgctgcccgcacccgattacccgctgtggaccgccatgaccagcctgtcgggcggcacgccggtgcattacctgtgcgacgagtccaacggctggatgcccgacctggacgacatccgcgccaagatcacgcccaacaccaagggcatcgtcgtcatcaacccgaacaatccgaccggtgcgctgtattcggacgcgctgctgcacgacatcatcgccatcgcacgcgagcacgggctggtgatctttgccgacgaggtgtacgacaaggtgctgttcgacgacaatcggcacaccgcgatggcctcgctgtcggaggatgtgctgaccgtcacgttcaacagcctgtccaagagctaccgctcgtgcggctaccgcgcgggctggatggtggtgtcgggcgacaagcgtccggccaaggactacatcgaaggcctgaacatgctgtcgtcgatgcgcctgtgcgccaatgtgccggggcagtgggcgatccagacggcgctgggcggctatcagagcatcaacgacctggtggcgccgggcggccgcatgcgccgccagcgcgacctggcctacgaactgatcaccgccattcccggcgtgagctgcgtcaagccgaaggcggcgctgtacatgttcccgcgcctggatccgtcggtgtacccgatcgacgacgatcagaccttcattcgccaactgctggaggaagagcgcgtgctgctggtgcagggcacgggcttcaactggcattcgccggaccacttccgcatcgtcttcctgccgcacgaggacgacctgcgcgaggccatcggccgaattgcgcgcttcctggagcggtaccgtcagcgtcacggtactggcatccgggccgcctga

SEQ ID NO: 34172 - protein, 413 aa, Ralstonia solanacearum
MKTIQKSAKLNNVCYDIRGPVLEKAKQMEEEGHQIIKLNIGNLAPFGFDAPEEIQQDMIRNLPNSAGYSDSKGIFAARKAVMHYTQQQGIKNVTLDDIYLGNGASELIALATNALLDAGDELLLPAPDYPLWTAMTSLSGGTPVHYLCDESNGWMPDLDDIRAKITPNTKGIVVINPNNPTGALYSDALLHDIIAIAREHGLVIFADEVYDKVLFDDNRHTAMASLSEDVLTVTFNSLSKSYRSCGYRAGWMVVSGDKRPAKDYIEGLNMLSSMRLCANVPGQWAIQTALGGYQSINDLVAPGGRMRRQRDLAYELITAIPGVSCVKPKAALYMFPRLDPSVYPIDDDQTFIRQLLEEERVLLVQGTGFNWHSPDHFRIVFLPHEDDLREAIGRIARFLERYRQRHGTGIRAA

SEQ ID NO: 34173 - DNA, 1212 bp, Streptomyces coelicolor
  CDS (1)..(1212)
atgcaggtgatccagtcgaccaagctcgccaacgtctgttacgagatccggggcccggtgctcgaggaggcgatgcggctggaggcggccgggcaccgcatcctgaagctgaacaccggcaatccggcagccttcggcttcgagtgcccgccggagattttggaggacatcctccgcaacgtctccacggcgcacggctacggcgacgcgaagggcctgctggcggcgcgccgggcggtcgtcatgcacaaccagaccctcggcatcgagacggacgtcgagcacgtcttcatcggcaacggcgtctccgagctgatcgtgatggcgatgcagggcctgctcgacgacggcgacgaggtcctcgtcccggcccccgactacccgctgtggacggccgccgtctcactgtccggcggtacggcggtgcactaccgctgcgacgagcagtccgactggatgcccgacctcgcggacgtggagcggaagatcaccgaccgcaccaaggccctggtgatcatcaatccgaacaacccgacgggcgcggtctacgacgacgcgatgctgcgcggactgacggacatcgcccgccggcacaacctgctggtctgctcggacgagatctacgacaagatcctctacgacgacgccacccacaccccgaccgccgcgatcgcccccgacctgctcaccctcaccttcaacggcatgtcgaaggcgtaccgggtggccggttaccgggtcggctggatgtcgatctccgggccgcgcgcgcacgccgagtcctacatcgagggcctgacgatcctggcgaacatgcgcctgtgcgccaacatgccgggccagcacggcgtggtcgcggcgctcagcgggcggcagaccatcaacgagctggtgctgccgggcgggcggctgcgcgagcagcgcgacgccgcccacgaggcactgaccagcattcccggcgtgacctgcgtgaagccgaagggtgcgctgtacctcttcccgcggctcgaccccaaggtcttcaagatcaaggacgaccggcggatggtcctggacctgctgcgccaggagaagatcatggtcgtccagggcaccggcttcaactggcccgagcccgaccacttccgggtggtgaccctgccgacggccgcggacctgcgcgaggcggtggaccggatcgggaacttcctggacgggtacagccagccctga

SEQ ID NO: 34174 - protein, 403 aa, Streptomyces coelicolor
MQVIQSTKLANVCYEIRGPVLEEAMRLEAAGHRILKLNTGNPAAFGFECPPEILEDILRNVSTAHGYGDAKGLLAARRAVVMHNQTLGIETDVEHVFIGNGVSELIVMAMQGLLDDGDEVLVPAPDYPLWTAAVSLSGGTAVHYRCDEQSDWMPDLADVERKITDRTKALVIINPNNPTGAVYDDAMLRGLTDIARRHNLLVCSDEIYDKILYDDATHTPTAAIAPDLLTLTFNGMSKAYRVAGYRVGWMSISGPRAHAESYIEGLTILANMRLCANMPGQHGVVAALSGRQTINELVLPGGRLREQRDAAHEALTSIPGVTCVKPKGALYLFPRLDPKVFKIKDDRRMVLDLLRQEKIMVVQGTGFNWPEPDHFRVVTLPTAADLREAVDRIGNFLDGYSQP

SEQ ID NO: 34175 - DNA, 1446 bp, Arabidopsis thaliana
  CDS (1)..(1446)
atggctctcaaggcattagactacgatactctgaatgaaaacgtcaagaagtgtcagtatgccgtaagaggtgaactttatctccgagcttctgagctgcagaaagaaggcaaaaagattattttcacaaacgttgggaaccctcatgctttaggacagaagccattgacatttcctcgccaggtggttgcgctttgccaagctccgtttctactagatgacccaaatgttggaatgctatttccagctgatgctattgcaagagctaaacattatctttccttgacttcaggcggtttaggtgcttacagtgattcaagaggccttccaggagttaggaaagaggttgctgagttcattcaacggcgtgatgggtatccaagtaacccagaactcatctttctcactgatggagctagcaaaggtgtgatgcaaatcttgaattgtgttatacgcggtaatggagatgggattctagttccggttccacagtatccactttactcagctaccatatcactgttaggtggtactcttgttccttactatcttgatgagtctgaaaactggggacttgatgttgctaaccttcgacaatccgttgctcaggctcgttctcaagggataacagtaagggcaatggtgatcattaaccctgggaacccaactggccagtgtctaagcgaagctaacataagagagatattgaagttctgttataacgagaaactggttcttctgggagacgaggtttatcagcagaacatataccaggatgagcgtccctttatcagctccaagaaggttttgatggaaatgggttcgccgttcagcaaggaagttcagcttgtatcttttcacacagtctctaaaggatattggggtgaatgtggacagcgaggtggatactttgagatgaccaacctccctccaagggttgttgaggagatatacaaggttgcatcaattgccctcagccctaatgtctctgcgcaaatctttatgggtttgatggttaatcctccaaagcctggagacatttcatatgaccagttcgcccgtgaaagcaaggggattcttgaatctttgagaagaagagcaaggctcatgacagatggattcaacagctgcaaaaacgtcgtgtgcaatttcacagaaggtgcaatgtattcgtttcctcaaatacggttaccaacgggagctctccaagctgcaaaacaagctggaaaagtgccagacgttttctactgtctcaagctcttagaagccacaggaatctccacagtacctggctctggatttggacagaaagaaggtgtgttccatctgaggacaacaatcctgccagcagaagatgagatgccggagatcatggatagcttcaagaagttcaacgacgagttcatgactcagtatgataataactttggttattcgaaaatgtga

SEQ ID NO: 34176 - protein, 481 aa, Arabidopsis thaliana
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSNPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 34177 - DNA, 1600 bp, Arabidopsis thaliana
  CDS (87)..(1475)
atttgtaaagttttttttttcccaaatagtactttttttttgtttggccttcttatagaaagaaaaactcaaagcacagagagaagatgagcgaagaacaaccacacgccaatctagcggttcccgcgtttaaaactgagaaagagcccataacgcaaacacgaaatggtcaaagtagcgtttggcgtttcggtggaagtgataaggcagcgaaagcatccaccgtaacgcttagaggtgtcatctacatgctcttcgacaactgcggcaaagacgtcaataagaccattttacccctcggccacggtgacccttccgtctacccttgcttccgtacctgtatcgaagctgaagacgccgtcgtcgacgtccttcgctccggcaaaggcaattcttacggtcccggagctgggattctccccgcaagacgagccgttgctgattatatgaaccgagatcttccgcacaagttaacgcctgaagatatttttctgaccgctggatgcaaccaagggatagagatcgtgttcgaatcgttggctcgaccaaacgcaaacatcttgctcccacgtcctggcttccctcactacgacgctcgtgctgcttacagtggtctcgaggttcgcaagtttgatcttcttcccgagaaagaatgggagattgatcttgaaggtatcgaagccattgcagacgagaacactgtggctatggttgtaattaaccccaacaatccctgtggaaatgtctactctcacgaccatctcaaaaaggttgcagagacggctaggaagctcgggataatggtgatctcagacgaagtatatgaccgaactatattcggagacaatccatttgtttcaatggggaagtttgcttcgatagtccctgtattgacactagcaggcatatctaagggatgggttgttcctggatggaaaattggctggatcgccttgaatgatcccgagggcgttttcgagaccaccaaggtgttacaatccatcaaacagaatcttgacgtaactcctgaccctgccacaataattcaggctgcacttccagcgatcctggagaaagcggacaaaaacttctttgcaaagaagaacaagatactcaaacataatgttgatttggtgtgtgataggctcaaggacatcccctgtgtcgtctgtcccaagaaacctgagtcttgcacttacttattgacaaagttggagctgtcattgatggataatatcaaggacgatatagatttttgcgtaaaactggccagagaggagaatctcgtgtttctaccaggggatgctctgggtttgaagaactgggtgaggataaccatcggagtcgaagctcatatgcttgaggatgcacttgagagactgaagggtttctgtacacgtcatgccaagaagacagagacagaaactgagtcacttcaagctttgaaactgagtgataataatctcgaaatgtaaaacagaagaggatgtgtgtgcccaaaagaatattcttatgatagataattttgattcttgcttttccatttgatttcccaaagtatttgattatctacattaataaaaactatggttatttgtcg

SEQ ID NO: 34178 - protein, 462 aa, Arabidopsis thaliana
MSEEQPHANLAVPAFKTEKEPITQTRNGQSSVWRFGGSDKAAKASTVTLRGVIYMLFDNCGKDVNKTILPLGHGDPSVYPCFRTCIEAEDAVVDVLRSGKGNSYGPGAGILPARRAVADYMNRDLPHKLTPEDIFLTAGCNQGIEIVFESLARPNANILLPRPGFPHYDARAAYSGLEVRKFDLLPEKEWEIDLEGIEAIADENTVAMVVINPNNPCGNVYSHDHLKKVAETARKLGIMVISDEVYDRTIFGDNPFVSMGKFASIVPVLTLAGISKGWVVPGWKIGWIALNDPEGVFETTKVLQSIKQNLDVTPDPATIIQAALPAILEKADKNFFAKKNKILKHNVDLVCDRLKDIPCVVCPKKPESCTYLLTKLELSLMDNIKDDIDFCVKLAREENLVFLPGDALGLKNWVRITIGVEAHMLEDALERLKGFCTRHAKKTETETESLQALKLSDNNLEM

SEQ ID NO: 34179 - DNA, 1527 bp, Oryza sativa
  CDS (1)..(1527)
atggccactggtgtttctgttgagaacataaaccccaaggttatactagggccatcatcgatcgctgagtgcatagtcacaaatgctagaagagaaattaatagatatctcacatttttcttccagcacctacaacagcagctacagacacaacctggttctcttccatttgatgagatcgtgtattgcaacatcgggaaccctcagtccttgggtcaaaaaccaatcacattcttcagggaggttcttgcactttgcaatcatccaaatctgctggagagagaggaaattaaatcattgttcagcactgatgctattgctcgggcaaagaaaattctttccatgattcctggaagagccaccggggcatatagtcatagccagggtatcaagggactgcgtgatgagattgctgctgggattgcctcccgtgatggtttccctgcaaatgcagatgatatattcctaactaatggagcaagtcctggtgtacacatgatgatgcagttgctgataaggaacaacagagatggcattatgtgtccaattcctcaatactcattgtactcagcatccctagcacttcatggcggagctcttgtgccatattatcttgatgaatcctcaggatggggtttggaggtttctaagcttaagaatcaacttgaagatgccaggtcaaaaggcataactgttagggcgttggtggtgatcaatcctggaaatcctactggacagattcttgatgagcaacagcaatatgagctagtaaagttctgcaaggacgaggaacttgttcttctggcggatgaggtataccaagagaacatttatgttaccaacaagaagatcaactctttcaagaagatagcaagatccatgggatacaatggagacgatttacaattagtatcattgcattctgtttctaaaggatattacggagagtgtggcaagagaggcggttacatggaggtcactggcttcagcactccagttagagaacaactctacaaaattgcatctgttaacttgtgttcaaatatcaccggccagatccttgcgagcctcataatggatccaccaaaggctggggacgcatcttatgacctctacgaggaagagaaagacaacatcctaaaatctttatctcgtcgtgcaaaggcaatggagtctgcatttaacagtattgatggaattacatgcaacaagacggaaggggcgatgtatctgttcccacggatttatctaccacagaaggcaattgaggctgccagggctgtcaacaaagcacctgatgtattctacgctctacgtcttcttgataccaccggcatcgttgtgactcctggatctggttttggacaaatcatcagatgttatctgttcacctgcaattctgaattcctgaccactcaagtttggtcctttgtgaaaggttgcagggacatggcacgtgagatgcacgatcctgccgcaggaggagaagataccttcgatgatctcccgcttcagggaattccatga

SEQ ID NO: 34180 - protein, 508 aa, Oryza sativa
MATGVSVENINPKVILGPSSIAECIVTNARREINRYLTFFFQHLQQQLQTQPGSLPFDEIVYCNIGNPQSLGQKPITFFREVLALCNHPNLLEREEIKSLFSTDAIARAKKILSMIPGRATGAYSHSQGIKGLRDEIAAGIASRDGFPANADDIFLTNGASPGVHMMMQLLIRNNRDGIMCPIPQYSLYSASLALHGGALVPYYLDESSGWGLEVSKLKNQLEDARSKGITVRALVVINPGNPTGQILDEQQQYELVKFCKDEELVLLADEVYQENIYVTNKKINSFKKIARSMGYNGDDLQLVSLHSVSKGYYGECGKRGGYMEVTGFSTPVREQLYKIASVNLCSNITGQILASLIMDPPKAGDASYDLYEEEKDNILKSLSRRAKAMESAFNSIDGITCNKTEGAMYLFPRIYLPQKAIEAARAVNKAPDVFYALRLLDTTGIVVTPGSGFGQIIRCYLFTCNSEFLTTQVWSFVKGCRDMAREMHDPAAGGEDTFDDLPLQGIP

SEQ ID NO: 34181 - DNA, 1200 bp, Sulfolobus tokodaii
  CDS (1)..(1200)
atgccagtagatgatttttccctttcggcaaatagtatatcaggagaatctaccctagtatatcaagatgttgcaagacaagtacagaagactaagggaataagaatcataaattttggtataggacaaccggatttgcctacatttgccagaataagagaagctgcaaagaaatcattggatgaaggatttactggctatacatcagcttatggaattgatgaattaagacaaaagatagcagagcatttaagcagtaaatatgagagtgtgagaaaggaagaagttattgtaactcctggggcaaaaacggcactttacttagcctttttattatacataaatcctggagacgaagttataatatttgacccttcattttactcttatgcagaagtagtaaagatgttaggaggagtcccagtttatgttaaaatgaagtttaatgagagtactggattttctcttaacttatcggaattagaatctaaaataaataaaaaaacaaaaatgatagtattaaataatcctcataatccaacaggtatggtgtttgatccaatagaaattgaaaagctaatggagattactaaggaaaagaaagttcttcttctatcagatgaaatatatgattattttatttatgaaggaaagatgaagagtgtactagaagatccagattggagagactatgttatttatgtaaatggattcagtaaaacgttctctatgactggttggaggttagggtatgtagtagctaaagaaaaagtgattaagaaaatggcagagattgctgcaaatatttatacttgtcctactagttttgctcagaaaggtgcattagcagcttttgaatcttttgatgaagttaaggaaatgatatcattatttaaaaagagaagggatataatgtacgaagaacttaagaaaataaaaggaatacaagtgcataaaagtcaaggagcgttctacatgtttccatttattggcgagattctaaaaaaggctaatcttagtgttaaagacttttcgttaaagttaattgaggaaaaaggagtaaccaccataccgggtgaagtattcccattagaagttggtaaagattttgttaggcttagttttgctgtaaaagaagatgatataagagaaggtataaaaaggatgaaagagtttattgatatgttgatgacaccctga

SEQ ID NO: 34182 - protein, 399 aa, Sulfolobus tokodaii
MPVDDFSLSANSISGESTLVYQDVARQVQKTKGIRIINFGIGQPDLPTFARIREAAKKSLDEGFTGYTSAYGIDELRQKIAEHLSSKYESVRKEEVIVTPGAKTALYLAFLLYINPGDEVIIFDPSFYSYAEVVKMLGGVPVYVKMKFNESTGFSLNLSELESKINKKTKMIVLNNPHNPTGMVFDPIEIEKLMEITKEKKVLLLSDEIYDYFIYEGKMKSVLEDPDWRDYVIYVNGFSKTFSMTGWRLGYVVAKEKVIKKMAEIAANIYTCPTSFAQKGALAAFESFDEVKEMISLFKKRRDIMYEELKKIKGIQVHKSQGAFYMFPFIGEILKKANLSVKDFSLKLIEEKGVTTIPGEVFPLEVGKDFVRLSFAVKEDDIREGIKRMKEFIDMLMTP

SEQ ID NO: 34183 - DNA, 1215 bp, Pasteurella multocida
  CDS (1)..(1215)
atggcgcattttcctaaatcagataaattagaacacgtttgttacgatattcgcggacctgttcataaagaagcacttcgtttagaagaagaaggacataaaattctcaagcttaatattggtaatcccgccccttttggttttgaagcaccagatgaaatcttagttgatgtcattcgcaacttacccaccgcacaaggctattgtgactcgaaaggcttgtattctgcacgtaaagctattgtgcaatattaccaatcaaaaggcattcacggggcgacggtgaatgatgtgtacattggtaatggggtgtctgaattaatcaccatgtcattacaagcgttgctcaatgacggcgatgaagtgctgattccgatgccagactatccgctttggactgccgcggcgactttagccggtggtaaaccagtgcactatttatgtgatgaagaagcgaattggtttcctgatgtgaatgatatcaaaagcaaaatcacaaagcgtactaaagcgattgtggtaattaatcccaataacccaacgggtgcggtatacagtcaagatttgctgttagagatcattgaagtggcgcgccaacataaattgattatttttgccgacgagatctacgataaaattttatatgatgatgcagtgcaccaccatattgccgctctcgcaccagatattttaaccgtcacttttaatgggttgtcgaaagcctaccgtgtcgcgggtttccgccaaggttggatgatcttaaacggaccgaaaaaagccgctgcgggttatattgaagggctcgatatgttggcgtctatgcgactttgcgccaatgtaccaatgcaacatgcgattcaaactgcgctaggtggctatcaaagtattaatgaatttatccttcccggtgggcgtttgcttgagcagcgcaataaagcctatgagttaattaatcaaatccctggggtaagttgcatcaaaccgcaaggtgcgatgtatatgttcccgaaaatcgacatcaaaaaatttaatatctatgatgatgaaaagatggtgtttgatttgttggcacaagaaaaagtgttattagtacatggacgtggtttcaactggcattcccctgatcatttccggattgtcactttacctcatgttcatcaaattgaagaggcgctcacgaaacttgctcgtttcttagcccactatcatcaataa

SEQ ID NO: 34184 - protein, 404 aa, Pasteurella multocida
MAHFPKSDKLEHVCYDIRGPVHKEALRLEEEGHKILKLNIGNPAPFGFEAPDEILVDVIRNLPTAQGYCDSKGLYSARKAIVQYYQSKGIHGATVNDVYIGNGVSELITMSLQALLNDGDEVLIPMPDYPLWTAAATLAGGKPVHYLCDEEANWFPDVNDIKSKITKRTKAIVVINPNNPTGAVYSQDLLLEIIEVARQHKLIIFADEIYDKILYDDAVHHHIAALAPDILTVTFNGLSKAYRVAGFRQGWMILNGPKKAAAGYIEGLDMLASMRLCANVPMQHAIQTALGGYQSINEFILPGGRLLEQRNKAYELINQIPGVSCIKPQGAMYMFPKIDIKKFNIYDDEKMVFDLLAQEKVLLVHGRGFNWHSPDHFRIVTLPHVHQIEEALTKLARFLAHYHQ

SEQ ID NO: 34185 - DNA, 2024 bp, Arabidopsis thaliana
  CDS (117)..(1748): n means a or g or c or t/u
gagaagacaggaattgggaagtttcgtctttcgagcaaaactatcgaaatctaaatttagattgagaaacaagccaacaagctttttagtataaatcccataccacacaatcacaaatgcggagattcgtgattggccaagctaaaaatctcatagatcagagtcgtcgtcgtcaacttcatcatcacaaaaatctcagctttgtctctcttattcctcctttttctgctccttccgattcttcatcgcgccacttgtcttcttcttcttcttctgatatgtctgcttctgattcctcttcctctcttcccgttactcttgacaccatcaaccccaaggttatcaaatgtgagtatgctgtccgtggagaaattgtcaacattgctcagaaattgcaagaagatttgaagactaacaaggacgcttatccctttgatgagattatctactgtaatatcgggaatcctcaatctcttggtcaacagcctataacattcttcagagaggttcttgctttatgttcctacacagccctgttggatgagagtgcaacacacggtttgttcagttctgattcgattgagcgtgcttggaagattctggaccaaattcccgggagagcgactggtgcttacagccacagccagggtatcaaggggttacgtgatgcaattgctgatggaatcgaagcccgtgatggtttccctgctgatcctaatgatatattcatgacagatggtgcaagtccaggggttcatatgatgatgcaacttctcataacttcagagaaagatggaatcctttgtcctattcctcagtatccattgtactcagcttcaattgcccttcacggtggaactttggttccatactaccttgatgaagcatcaggatggggtcttgaaatatctgagctgaagaaacaacttgaagatgctaggtcaaagggcatcactgtgagagctttggctgtcattaaccctggaaacccgacagggcaggttctttcggaagaaaaccagcgtgacgttgttaatttctgcaagcaagagggtttagttcttttagcagacgaggtttatcaagagaatgtctatgtccctgacaaaaagttccattccttcaagaaagtagcccgctctatgggctacggtgagaaggatcttgccttagtctctttccaatctgtctccaaagggtactatggagagtgtgggaaaagaggtggttacatggaggttactggattcacttctgatgtaagagagcagatatacaaaatggcttctgtgaatctttgttccaacatctctggtcaaattcttgctagcctcatcatgagcccacccaagcctggtgacgactcctatgaatcatacatagcagagaaggatggaattctctcatctttggcaagacgtgcaaagactcttgaagaggctctgaacaagctagagggagttacatgcaatagagcagaaggagctatgtatctattcccttgccttcaccttccacaaaaggcaattgcagctgctgaggcggaaaagacagcaccagacaatttctactgcaaacgccttctaaaagctactggaatagtcgttgtccctggttctggctttagacaggtacctggaacatggcatttcaggtgcactatacttccccaagaggataagattccagcgattgttgatcgtctaactgcgttccaccagagcttcatggacgagttccgcgactaagcattctgttttcaagatccctctatagattatatgagtaataataagaaaaaggtcccatgccgtttctttttcatcgactttgtgtttacagaagctaagatgtgagagcattagttagtgctctctttcttattcactttttgttctgttctctttatagtgaaaaaccataatataaattgagagagtttcttataaacggttagtcaaaatgtaatctcatcaagaaaacacaagatngaaccattgttgaattccaaaaaaaaaaaaaaa

SEQ ID NO: 34186 - protein, 543 aa, Arabidopsis thaliana
MRRFVIGQAKNLIDQSRRRQLHHHKNLSFVSLIPPFSAPSDSSSRHLSSSSSSDMSASDSSSSLPVTLDTINPKVIKCEYAVRGEIVNIAQKLQEDLKTNKDAYPFDEIIYCNIGNPQSLGQQPITFFREVLALCSYTALLDESATHGLFSSDSIERAWKILDQIPGRATGAYSHSQGIKGLRDAIADGIEARDGFPADPNDIFMTDGASPGVHMMMQLLITSEKDGILCPIPQYPLYSASIALHGGTLVPYYLDEASGWGLEISELKKQLEDARSKGITVRALAVINPGNPTGQVLSEENQRDVVNFCKQEGLVLLADEVYQENVYVPDKKFHSFKKVARSMGYGEKDLALVSFQSVSKGYYGECGKRGGYMEVTGFTSDVREQIYKMASVNLCSNISGQILASLIMSPPKPGDDSYESYIAEKDGILSSLARRAKTLEEALNKLEGVTCNRAEGAMYLFPCLHLPQKAIAAAEAEKTAPDNFYCKRLLKATGIVVVPGSGFRQVPGTWHFRCTILPQEDKIPAIVDRLTAFHQSFMDEFRD

SEQ ID NO: 34187 - DNA, 1416 bp, Arabidopsis thaliana
  CDS (6)..(1268)
aaaaaatgggagaaaacggagccaagcgatggaacttcggagctaacgaggtcgtcgaacgatctaactcacttaccattcgtgattaccttaacaccttaatcaattgtctcgacggtggtgatgtaagacccgtcatcccactaggtcacggcgatccttctccgttcccgagctttcgtaccgatcaagccgctgttgaagccatctgtgatgctgtccgttcgaccaagtttaacaactactcttcttcttccggtgttcctgtcgctaggaaggctgttgcagagtacctctctagtgatctctcttaccagatatcaccaaatgatgttcatatcacagctggttgtgtgcaagccattgagattttgatatccgctctcgcaattcctggagctaacattctgctacctaggcctacttacccgatgtacgattcccgagcggctttttgccaactcgaggttcgttatttcgacctcctaccggaaaatggttgggatgttgatctagatggagttgaagctcttgcggatgacaaaaccgttgctatacttgttatcaacccttgcaatccatgtgggaatgttttctctcgccaacatcttcaaaagattgcagagacggcttgcaagcttggtatacttgtgatcgcagacgaagtctatgaccattttgcctttggggataaaccatttgtgtccatggcagagtttgcagagctagtgcctgttattgtcttaggtgctatatctaaaagatggtttgttcctggatggagacttggttggatggtgactcttgaccctcatggcatcatgaaagattctgggtttgttcagactcttatcaatgttgtcaacatgtcgacggatcctgcaacgtttattcagggagcaatgcctgatatcattgggaatacaaaggaagagttcttctcatcaaaacttgaaatggtgaaaaaatgtgcagagatttgttatgaggagcttatgaagattccttgcatcacttgcccctgcaaacccgagggctcaatgttcacgatggtgaagttaaacttttcactactcgaagatatcagtgatgatttggacttctgctccaagctggctaaagaggaatctatgatcatcctaccaggtcaagctgttgggcttaagaactggctacgtatcacctttgcagttgagcttgagcttctcatagaagggttttccaggctaaagaactttactgagagacactccaagaatcagccatgagacgtattaagactctctctctctttctccacagccaaagcaaattagattttgctgtgaggctattttacatactattgttggctttataaaatatttgcacaaacaatgaatcactaatgccaagaagcagccatgaccattcggt

SEQ ID NO: 34188 - protein, 420 aa, Arabidopsis thaliana
MGENGAKRWNFGANEVVERSNSLTIRDYLNTLINCLDGGDVRPVIPLGHGDPSPFPSFRTDQAAVEAICDAVRSTKFNNYSSSSGVPVARKAVAEYLSSDLSYQISPNDVHITAGCVQAIEILISALAIPGANILLPRPTYPMYDSRAAFCQLEVRYFDLLPENGWDVDLDGVEALADDKTVAILVINPCNPCGNVFSRQHLQKIAETACKLGILVIADEVYDHFAFGDKPFVSMAEFAELVPVIVLGAISKRWFVPGWRLGWMVTLDPHGIMKDSGFVQTLINVVNMSTDPATFIQGAMPDIIGNTKEEFFSSKLEMVKKCAEICYEELMKIPCITCPCKPEGSMFTMVKLNFSLLEDISDDLDFCSKLAKEESMIILPGQAVGLKNWLRITFAVELELLIEGFSRLKNFTERHSKNQP

SEQ ID NO: 34189 - DNA, 1710 bp, Trypanosoma brucei
  CDS (1)..(1710)
atggatatatatttattttccgtttggtttatacagaacgaggaaaagtgtttggattttctaaacattagtaagaagaacaaagccaagtcgagcgtacaacacattggcgggttagcgcgaaaacagaatcctgaacccacaaaatcaatttttgtgtcgagatacggagcacgatcactgaagacctcgacaatgaaaggtaaccaggaattttttcagaagggtggggcccacgtttccaagggcgttcacatcaacccacgcgtaaagaaggctcagtatgccgtgcgcgggcttgtgccgatgcgagccgacgaaatcagggaggaaatccgttcaggcacggggaagtcgaagttctccttcaacgaactggtttactgcaacattggcaacccccaagccctggagcagaagccgcttacctttcaccgccaagtgatgtcgcttatcgatgctccatttctgcttgaggataacgccgtcgtctctcgatatccctctgatgctgtttcccgtgcgcgtctctacttgggccacatcggccaacgtactggcgcctacacggactccgcaggctatgcctttgtacgtgacatcgtcgcgcagtatgtgaatgagcgtgacgcctatgtaaaaccgcttcaggaggcatcgtcgattgtgcttacagacggcgcaagcactggtgtgcgcataatcttacagacgcttgtgggcgatgagaaggacgctgtgatgattcccatcccgcagtatccgctgtacacggcacagattgcattgttgggaggtacccccgcgatgtattaccttcgtgagagcgaaggctgggcgctgaacgttggagagctcgaggcagtatacaaagactgtgtggcgaacggaaacgcgacgccccgcgtgctcgtcgtgattaaccctggtaaccctacaggtggcgtgttggagcgcactgtgatggaggaggttgccaagttctgttgcgatcacggtgttgtgctcatggccgatgaggtttaccaggaaaatatctacaccgcgaccaagcggtttgagagttttcggaagattgtgctcgaacttccaccaccatacaacaccgacaccgtgcttgtttccttgcactccgtgtcgaagggtattatcggtgagtgtggtcgccgtggtgggtacttcacactcacaaacgctccgcctgagttagtggagcaggtgatgaaattgtgctctattaacctctgcagcaacgtcaacggtcagcttatgacggcactgatgtgctccccgccgaaacctggcgatgcgagcttcgaccactacacggcagagtacagtggcatttttgaaagccttaagcgccgtgctgacctgcttgcaaaggaactgaacaacatccgtggtttcaagtcccaatctgttgagggcgccatgtacgctttccccactattgagctccctcccaagtacgtgaagcacaacgatgagatgaactcaaaggagggccgacagcttgcgccggacgcgcgttgggcactggagcttctcgagagcaccggtattgttgtggtgccgggttctggctttgggcagcagcctgggacactgcacttccgcacgacgatcctcccacccgaagcgcatatggagcgtgtggtgaaggctctgcgccagttccaggagggcatttgggccaagtatgcataa

SEQ ID NO: 34190 - protein, 569 aa, Trypanosoma brucei
MDIYLFSVWFIQNEEKCLDFLNISKKNKAKSSVQHIGGLARKQNPEPTKSIFVSRYGARSLKTSTMKGNQEFFQKGGAHVSKGVHINPRVKKAQYAVRGLVPMRADEIREEIRSGTGKSKFSFNELVYCNIGNPQALEQKPLTFHRQVMSLIDAPFLLEDNAVVSRYPSDAVSRARLYLGHIGQRTGAYTDSAGYAFVRDIVAQYVNERDAYVKPLQEASSIVLTDGASTGVRIILQTLVGDEKDAVMIPIPQYPLYTAQIALLGGTPAMYYLRESEGWALNVGELEAVYKDCVANGNATPRVLVVINPGNPTGGVLERTVMEEVAKFCCDHGVVLMADEVYQENIYTATKRFESFRKIVLELPPPYNTDTVLVSLHSVSKGIIGECGRRGGYFTLTNAPPELVEQVMKLCSINLCSNVNGQLMTALMCSPPKPGDASFDHYTAEYSGIFESLKRRADLLAKELNNIRGFKSQSVEGAMYAFPTIELPPKYVKHNDEMNSKEGRQLAPDARWALELLESTGIVVVPGSGFGQQPGTLHFRTTILPPEAHMERVVKALRQFQEGIWAKYA

SEQ ID NO: 34191 - DNA, 1197 bp, Pyrococcus furiosus
  CDS (1)..(1197)
atgataagggcctcaaagagagctctctctgtggagtatgctattagagatgtcgttctacctgcaagggaacttgaaaaaaagggaatcaaggtaattaggctaaacataggcgatcctgtaaagttcgactttcaaccacccgagcacatgaaggaagcatattgtaaagcaattaaagaggggcacaattactatggagatagtgagggattacccgagttaagaaaagctatagtagaaagggaaaagaggaagaatggagtggacataactcccgatgacgtgagggttacagctgcagtcactgaagctctccagctaatttttggagctctattagacccaggagatgaaattctagttcctgggcccagttatcctccctatacagggcttgtaaagttctacggtggaaagcctgtggaatatagaactattgaagaggaagactggcaacctgatattgacgacattaggaagaagataacagacagaacaaaagctatagcagttataaaccccaacaacccgactggagcgctctacgacaaaaagacacttgaggaaatcttgaacatcgcaggggaatatgaaattcctgttataagcgacgagatatacgatttgatgacatacgagggagaacacatttctcccggatcattaaccaaagatgttcctgtaatagttatgaacggattatccaaagtctactttgccacagggtggagacttggatacatgtactttgtcgatccagagaataaattgagtgaggtcagagaggcaatagatagattggcaaggattagactgtgtccaaatacccccgcacaattcgcagctatagcaggactaacgggcccaatggattatctcaaagaatacatgaaaaagctcaaggagagaagagattacatctacaagaggctaaatgagatcccaggaataagcacgacaaaaccacaaggagcattttacatattccccaagatagaggtgggaccgtggaagaatgataaagaattcgttcttgacgttctccacaatgctcacgttctatttgttcacggttcaggatttggagagtatggtgcaggccactttagagcagtgttcttgcctccaatagaaatcctggaagaggctatggatagattcgaaaagttcatgaaagaaagactgaaagaatga

SEQ ID NO: 34192 - protein, 398 aa, Pyrococcus furiosus
MIRASKRALSVEYAIRDVVLPARELEKKGIKVIRLNIGDPVKFDFQPPEHMKEAYCKAIKEGHNYYGDSEGLPELRKAIVEREKRKNGVDITPDDVRVTAAVTEALQLIFGALLDPGDEILVPGPSYPPYTGLVKFYGGKPVEYRTIEEEDWQPDIDDIRKKITDRTKAIAVINPNNPTGALYDKKTLEEILNIAGEYEIPVISDEIYDLMTYEGEHISPGSLTKDVPVIVMNGLSKVYFATGWRLGYMYFVDPENKLSEVREAIDRLARIRLCPNTPAQFAAIAGLTGPMDYLKEYMKKLKERRDYIYKRLNEIPGISTTKPQGAFYIFPKIEVGPWKNDKEFVLDVLHNAHVLFVHGSGFGEYGAGHFRAVFLPPIEILEEAMDRFEKFMKERLKE

SEQ ID NO: 34193 - DNA, 1894 bp, Lactococcus lactis
  CDS (137)..(1318)
gggtttcacctgcaagcctaacgactaaagataccaaatcagttgttttagcgctttacaaagggaaaccagcctgggaagtaaataatagcaatggatttaaagtttatgactttgagtcaggaaaagagttgatatgaaaaaatgttctgattttgtattaaaaatggatgagtctgtgacccttgcggcggccaatcgtgccaaagcattaaaagcacaaggacgagatattatcgacttgacccttggtcaaccagactttccaactcctaaaaaaattggtcaagcggccatcgaagcgataaataatggacaagctagtttttatacacaagctggtggacttccagaacttaaaaaagccgttcaacattattggacacgtttttatgcttatgaaattcaaacaaacgaaatattaattacggctggggcaaagtttgccctctacgcttactttatggcaactgttgatcctttagatgaggtaatcataccagcaccttattgggtttcttatgtcgaccaagtaaaaatggctggtggaaatccagtaattgtagaagctaagcaagaaaataactttaaagttacggttgagcaattagaaaaagcaagaacaagcaaaactaagattttattactaaattcgccttcaaatccaacaggaatgatttattctaaagaagaattaacagccattggagaatgggcagttgctcatgatttattgattttggccgatgatatctatcatcgtttggtttataatggagcagaatttacagcaatttcaagcctgtctgatgaaatcagaaacagaacaacagtgattaatggtgtttctaaaacatttgcaatgactggttggcgaattggtttagccgtaggtgatccagaaattattgctgcaatgactaaaattgccagtcaaaccacttcaaatccgaccgctgttgctcaatatgctgccatagaggcatttgaagaaaatgataaaagttttgagaaaatgcatgctgcatttgaagaacgcttaaataaaatttatcttcaactttcagaagttcctggttttgaacttgtgaaaccaaatggtgctttctatttgttcccgaaagtgaccaaggctatggcgatgaaaggctatacagatgtgactgattttacgacagccattcttgaagaagctggggtagctttagttacaggagcaggttttggttctccagaaaatgttcgtttgagttatgcaacaagtcttgaaactctggaagctgcagtaacaagattaaaggattggatgaatgattgataaaaaagaagcaaaatcagcttataaactctctaaaaaaataggggcagttgttgcttataaaaatttagaaacaaatgaacgctatattgatatagcaccagacttagcaggtgtaaaaaatcgttttgaatttgctaaaaagactgggattggtttgccttatgccattgaaaaagcagcaaaaacggctgattttgaattagaagttcttgaagaactagaaaaagatgaacttcaaacgacgaaagaattcaaagaagatttaaaaaccttaaaagaaatctggcttgaaaagtcataaaagtatgatttaaaaaatataaaataaaaatttagaaggatttatttatgaaagacttaatatcaatcattgatgtaaaagaccacgttggtgaaacagtaaaaatcggcgcttgggtcgctgacaaatcaggtaaagggaaacttcaatttcttcaacttcgcgatggaacagcgttttttcaagctgttgttttcaaaccaaatatgattgaaaaatttggtgaagaagaaggaacagctaaattcgatgaaatcaaacatttatcacaa

SEQ ID NO: 34194 - protein, 393 aa, Lactococcus lactis
MKKCSDFVLKMDESVTLAAANRAKALKAQGRDIIDLTLGQPDFPTPKKIGQAAIEAINNGQASFYTQAGGLPELKKAVQHYWTRFYAYEIQTNEILITAGAKFALYAYFMATVDPLDEVIIPAPYWVSYVDQVKMAGGNPVIVEAKQENNFKVTVEQLEKARTSKTKILLLNSPSNPTGMIYSKEELTAIGEWAVAHDLLILADDIYHRLVYNGAEFTAISSLSDEIRNRTTVINGVSKTFAMTGWRIGLAVGDPEIIAAMTKIASQTTSNPTAVAQYAAIEAFEENDKSFEKMHAAFEERLNKIYLQLSEVPGFELVKPNGAFYLFPKVTKAMAMKGYTDVTDFTTAILEEAGVALVTGAGFGSPENVRLSYATSLETLEAAVTRLKDWMND

SEQ ID NO: 34195 - DNA, 1290 bp, Methylobacillus flagellatum
  CDS (1)..(1290)
atgcaagaaatttccaagtccagcaagctcagcaacgtatgctacgacattcgtggcccggtgctggaccgagcgcggcagatggaggaggacgggcaccgcatcatcaagctcaatatcggcaatcctgcgccttttggttttgccgcgcccgaggaaatcctgcaggacgtgattcgcaacatggattccgcttccggttatacggattccaagggtctgttcgccgcacgtaaggcgattatgcattacacccagcagaagaatatccagggtgtgaccatcgatgacatcatcatcggcaatggcgtttccgagctgatcgtcatggccatgcaggcattgctcaacaacggtgaccaggtactggtgccgatgcctgattatccgttgtggactgcggcagtgaacctggcgggcgggacggcgcggcactatgtctgcgacgagcagactggctggctacccgacctccgggatatcgagaacaaaatcacggcgaatacgcgcggcatcgtcattatcaacccgaacaacccgacgggtgccttgtatccgcgggaaacgctggaaggcatcatcgagatcgcacgccatcacggcctggtgattttcgcggacgaaatctacgacaaggtattgttcgacggcaatacgcacacctcgattgcttcattggctgatgatgtgctgttcgtgaccttcaacggtctgtccaagaattatcgtacctgcggttaccgcgccggttggctggtgatctcgggagagaagcggcatgcgggagactacatcgaggggttgaacatgctggcttcgatgcgcctgtcgcgccaatgtgcccgggcagttggcgatccagaccgcgctgggcgctaccagagcatagacgaccttgtggcgccgaccggccggttatgcaagcagcgcgaccttgcctacaagatgctgaccgatattcctggtgtaagttgcgtcaagcccaaggctggcctgtacctgtttccgcgccttgatcccaaaatatatcccatccaggatgaccagcaattcatcctcgacctgttgctggaggagaaagtcctgctggtgcagggcacgggcttcaactggcgcgcgccggatcatttccgcgtcgtgttcctgccgaatgtggatgacctcaccgaggcatttacccgaattgcccgcttcctggaaaattaccgcaagcagcacagcaccatcaccatagtggaagcaaagcctcgaaagagggcacaaacaacctcccaaagcgcgtcggcatga

SEQ ID NO: 34196 - protein, 429 aa, Methylobacillus flagellatum
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLSRQCARAVGDPDRAGRYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEAKPRKRAQTTSQSASA

SEQ ID NO: 34197 - DNA, 1821 bp, Oryza sativa
  CDS (69)..(1520)
gaaacccaacccgtcaacgctgccgctgaatctcactttctctctctgttcttggtgcttccgccgccatggctgctcccagcgtcgccgtcgacaacctcaaccccaaggttttgaattgtgagtatgcagtgcgtggagagattgtgatccatgctcagcgcctgcagcaacagctacagactcaaccagggtctcttccttttgatgagatcctatactgcaacattgggaatccccagtctcttggtcagaagccagttacattcttcagggaggttattgctctttgtgatcatccatgcttgttggaaaaggaggaaaccaaatcattgttcagtgctgatgccatttctcgagcaacaacaattcttgcctcgattcctggaagagcaactggagcatacagccacagccagggcatcaaagggctgcgtgatgcaattgctgctggaattgcatcacgtgacggataccctgcaaatgcagacgacattttccttactgacggagcaagccctggagttcacatgatgatgcagttactgataaggaacgagaaagatggcattctctgcccaattcctcaatatcctttgtactcagcctccattgctcttcatggtggagctcttgtcccgtattatcttaatgaatcaacaggctggggtttggagatctctgaccttaagaagcaactcgaagattctcggttgaaaggcattgatgttagggctttggtagttatcaatccaggaaatccaactgggcaggttcttgctgaggaaaaccaacgggacatagtgaagttctgcaaaaatgagggacttgttcttctggctgatgaggtgtaccaagagaacatctatgttgacaacaagaaatttaactctttcaagaagatagcgagatccatgggatacaacgaggatgatctccctttagtatcatttcaatctgtttctaagggatattatggtgaatgtggcaaaagaggaggctacatggagattactggcttcagtgctccagttagagagcagatctacaaagtggcgtcagtgaacttatgttccaatatcactggccagatccttgccagcctcgtcatgaatccaccaaaggctggagatgcatcatatgcttcatacaaggcagagaaagatggaatcctccaatcattagctcgccgtgcaaaggcattggagaatgctttcaacagtcttgagggaattacatgcaacaaaactgaaggagcaatgtacctcttccctcagcttagtctgccacaaaaggcaattgacgctgctaaagctgctaacaaagcacctgatgctttctatgcccttcgtctcctcgaggcaaccggaattgttgttgtccctggatctggatttggccaagttcctggcacatggcacatcagatgcacaatcctgccacaggaggagaagatccccgcgatcatctcccgcttcaaggcattccatgagggcttcatggcagcgtaccgcgactgaattgccattcaccattgaacagatggggagttctatacaagcctgatggattttccccaggccttctttttttttgtccccatgatagcatcatcgtgtagaccaaaacaaaataaatcaaagccagacatgcttttttttagtgtgctaatcacagagggtactgaaaaactgatgccttcgatggcaaattgaggagaaatttacctgccatttcgttgttgtgcctgttactgtataaatgttaagattttggtgcagaggcagctatagttttgagaaaaaaaaaaaaaaaaaaaaa

SEQ ID NO: 34198 - protein, 483 aa, Oryza sativa
MAAPSVAVDNLNPKVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIALHGGALVPYYLNESTGWGLEISDLKKQLEDSRLKGIDVRALVVINPGNPTGQVLAEENQRDIVKFCKNEGLVLLADEVYQENIYVDNKKFNSFKKIARSMGYNEDDLPLVSFQSVSKGYYGECGKRGGYMEITGFSAPVREQIYKVASVNLCSNITGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 34199 - DNA, 1347 bp, Lupinus albus
  CDS (1)..(1347)
atgggtcttgagattgagaaaggttgtgttaagctttcaaatattgctatttctgaaactcatggtgaagattctccttactttgctggatggaaagcttatgatgaaaacccttatcatgaaatcactaacccttcaggagtcatacaaatgggattggcagaaaatcaagtttcatttgatttgattgagaaatatttggaagaacactcagaggctgcaacatggggaaaaggagctcctagtttcaaagataatgctttatttcaagactatcatggacttaagtcatttagaacagcaatggcaagcttcatggaacaaataagaggagggagagccaaatttgacccttctagaattgtcctcactgcaggtgcaactgcagccaatgaactcttaactttcattattgctaatccaggagatgctttacttcttcctaccccatactatcctggatttgatagagatttaaggtggagaactggagtaaacatagttccaattcactgtgacagttcaaacaattttcagataactccaaaagcattagaggctgcatacaaagaagcagaagccatgaacatgaaagtgaagggagtactaatcacaaacccctcaaacccattaggtgcaacaatccaacgcaaggttcttgaagagattcttgactttgtgactctcaagaatatccatcttgtctcagatgaaatctactcaggttcagttttctcctcctcagagttcataagcatagcagaaatccttgaagcaagaaaatataaaaatgcagaaagagttcacattgtttatagtctctcaaaggatcttggtcttcctggcttcagagttggcaccatttattcatacaatgataaggttgtgaccacagctagaagaatgtcaagtttcacattaatatcctcacaaacacaacaacttctggcttcaatgttatctgataaggttttcactgagaactacattaagacaaatagagagaggttgagaaagagatacacaatgatcattgaagggttgataagtgcagggattgagtgtttgaaagggaatgcagggttgttttgttggatgaatctaagtccattactagtgttggagaataaggtaacaagggaaggtgaattggagctttggaatgaaactttgcatgaaatgaagcttaatatctcaccaggatcttcttgtcattgttctgaaccaggttggttcagggtttgctttgcaaatatgagtgaacaaactttggaattagcattgcaaaggatacgtgacttcatggcaaaaagatcaggaacagaaaagatgatcttccaaaactaa

SEQ ID NO: 34200 - protein, 448 aa, Lupinus albus
MGLEIEKGCVKLSNIAISETHGEDSPYFAGWKAYDENPYHEITNPSGVIQMGLAENQVSFDLIEKYLEEHSEAATWGKGAPSFKDNALFQDYHGLKSFRTAMASFMEQIRGGRAKFDPSRIVLTAGATAANELLTFIIANPGDALLLPTPYYPGFDRDLRWRTGVNIVPIHCDSSNNFQITPKALEAAYKEAEAMNMKVKGVLITNPSNPLGATIQRKVLEEILDFVTLKNIHLVSDEIYSGSVFSSSEFISIAEILEARKYKNAERVHIVYSLSKDLGLPGFRVGTIYSYNDKVVTTARRMSSFTLISSQTQQLLASMLSDKVFTENYIKTNRERLRKRYTMIIEGLISAGIECLKGNAGLFCWMNLSPLLVLENKVTREGELELWNETLHEMKLNISPGSSCHCSEPGWFRVCFANMSEQTLELALQRIRDFMAKRSGTEKMIFQN

SEQ ID NO: 34201 - DNA, 2203 bp, Oryza sativa
  CDS (113)..(1741)
ggccaacccaacccaacccaatccctccacaccccccgcctatgcacgcccgccgcgcgtggcgccgggcggcggggtgacgtgacgtcatctcctcgtcggtcggcgtcccatgaggcggagcggcaacggcggcgcggcgaagaagaagaagaagaggagcgcgagcgcggcgtccgagaggaggccgcgggcggacggcgggatgcgcatcgtggtgccgctgcagggggtggtgcagggacgcggggggctcgtgctcggctccctcatcccctgcgccctcttctacttcttccagctctacatcaagcgcaaccgcgcctcgccgccgccgccgcccggatcccccacggccgcctccgccgcggcggtgtcgccgatccaccgctcgctctcgcgcggcctcctcgccccgcgcgccgcgctcccggccatctccgcgcgcggcgcctccgtccgcgacgacgactcgctctactacgccggcctccgccgctgcgccgccgacccctaccacccggtcaccaacccctccggcatcatccagctcggcctcgccgagaactacctgtcgctggatttggttgggagatggatggaggagcacgcggcggaggcggcgtccatggcgggcggagaagacgaggacgagagggagctctccatcagaggcctcgccgcctaccagccgtacgacgggatacttgccttgaagatggctcttgctggatttatgaggcaaatcatgcaaggatcagtgtcctttgaaccatctcaggtggttataacatctggtgcaactcctgcaatggaaatactgagtttctgccttgctgatccaggaaatgcatttcttgttccatcaccatactaccctgggtgggacagggacataaaatggcgcactggaattgagttgatacctgttccttgccgtagcactgacaacttcaacattagtatcactgctctagaaatagcctacaatcaggcaaagaagcgaggaataaaggttcgtggggttctcatatccaacccaaataaccctacaggaagctttgtgcccaagcaaacactgcatgatcttctagagtttgctgcagagaagaacatccacttgatatctgatgaagtgtttgctggctcaacatatggatctggaaaatttgtaagtgtggcagaggttgttgatgatctagaagactttgacaaaggcagggtgcacataatatatggactctcgaaagacctatctcttgccgggtttcgggttggggtaatatattcctataatgaaagcatcgtgacagcagctgctaagattgctaggttctcgtctgtgtcaactccaacacaacgcttgcttgttgccatgctctcggaccaaaagttcatttcagattacctaaaagttaatagagagagattgcgcaagatgtaccatttgtttgttgatgctttggatcaagtggggattgagtgctacaagagcagtggagggttctactgctgggcagacatgagcaagttcatcaggtcttacagcgagaaaggggagcgcaagctttgggataggttattggaggaggcaaaggtcaatgtcactccaggttcatcttgccattgcatcgagcctggatggttcaggtgttgcttcacgacattgagcgaacatgatatccctgtcttagtgcaaaggctcaggacgattacagatagccataaaccgaatcattgaaacaccaggattatcctctcgagcttgtcatggaatggaataactgctttgccaggtactccacagagaatccagggggcatagaggaaaaagatggtataatcctctttaccatgggaactactcctaacaaccagtaggagcaatcgtacgcctttgctggaacaaagacaaatcaggaccatgtttgtattgatctgttgaagaacaacagttcttttgaaagttgttgctgagttgcttttattgatctgtaggtctcagctgcttccattgtaggggtttcagatagaaaattgcccatctgttgataggttaaatcaagcataagttcattctctctgtaggtccattgtgacataagctagtgttgggtttttgttttgtgagtttgtaaatcagttcctgcttgtgccagggttttggacgcgactcatatgttgtcatcaaaattatttattt

SEQ ID NO: 34202 - protein, 542 aa, Oryza sativa
MRRSGNGGAAKKKKKRSASAASERRPRADGGMRIVVPLQGVVQGRGGLVLGSLIPCALFYFFQLYIKRNRASPPPPPGSPTAASAAAVSPIHRSLSRGLLAPRAALPAISARGASVRDDDSLYYAGLRRCAADPYHPVTNPSGIIQLGLAENYLSLDLVGRWMEEHAAEAASMAGGEDEDERELSIRGLAAYQPYDGILALKMALAGFMRQIMQGSVSFEPSQVVITSGATPAMEILSFCLADPGNAFLVPSPYYPGWDRDIKWRTGIELIPVPCRSTDNFNISITALEIAYNQAKKRGIKVRGVLISNPNNPTGSFVPKQTLHDLLEFAAEKNIHLISDEVFAGSTYGSGKFVSVAEVVDDLEDFDKGRVHIIYGLSKDLSLAGFRVGVIYSYNESIVTAAAKIARFSSVSTPTQRLLVAMLSDQKFISDYLKVNRERLRKMYHLFVDALDQVGIECYKSSGGFYCWADMSKFIRSYSEKGERKLWDRLLEEAKVNVTPGSSCHCIEPGWFRCCFTTLSEHDIPVLVQRLRTITDSHKPNH

SEQ ID NO: 34203 - DNA, 1895 bp, Hordeum vulgare
  CDS (76)..(1731)
cgcgctactagtagtattcctggtgtagtctagtagtactctcctcctcctccttctcctcctacccgtttcctcatggccaccgtacgccagagcgacggagtcgccgcgaacggccttgccgtggccgcagccgcgaacggcaagagcaacggccatggcgtggctgccgccgtgaacggcaagagcaacggccatggcgtggatgccgacgcgaacggcaagagcaacggccatggcgtggctgccgacgcgaacggcaagagcaacggccatgccgaggccactgcgaacggccacggcgaggccactgcgaacggcaagaccaacggccaccgcgagagcaacggccatgctgaggccgccgacgcgaacggcgagagcaacgagcatgccgaggactccgcggcgaacggcgagagcaacgggcatgcggcggcggcggcagaggaggaggaggcggtggagtggaatttcgcgggtgccaaggacggcgtgctggcggcgacgggggcgaacatgagcatccgggcgatacggtacaagatcagcgcgagcgtgcaggagaaggggccgcggcccgtgctgccgctggcccacggggacccgtccgtgttcccggccttccgcacggccgtcgaggccgaggacgccgtcgccgccgccgtgcgcaccggccagttcaactgctaccccgccggcgtcggcctccccgccgcacgaagcgccgtggcagagcacctgtcgcagggcgtgccgtacatgctatcggccgacgacgtcttcctcaccgccggcgggacccaggcgatcgaggtcataatcccggtgctggcccagaccgccggcgccaacattctgctccccaggccaggctacccaaactacgaggcgcgcgccgcgttcaacaggctggaggtccggcatttcgacctcatccccgacaaggggtgggagatcgacatcgactcgctggaatccatcgccgacaagaacaccaccgccatggtcatcataaaccccaacaacccgtgcggcagcgtttactcctacgaccatctgtccaaggtcgcggaggtggcgaaaaggctcggaatattggtgattgctgacgaggtatacggcaagctggttctgggcagcgccccgttcatcccaatgggagtgtttgggcacatcacccctgtgctgtccatagggtctctgtccaagtcatggatagtgcctggatggcggcttggatgggtagcggtgtacgaccccagaaagatcttacaggaaactaagatctctacatcaattacgaattacctcaatgtctcgacagacccagcaaccttcattcaggcagctcttcctcagattcttgagaacacaaaggaagatttctttaaggcgattattggtctgctaaaggaatcatcagagatatgctacaaacaaataaaggaaaacaaatacattacatgtcctcacaagccagaaggatcaatgtttgtcatggtgaaactgaacttacatcttttggaggaaatagacgatgacattgatttttgctgcaagctcgcaaaagaagaatcagtaatcttatgcccagggagtgttcttggaatggcaaactgggtccgcattacttttgcttgtgttccatcttctcttcaagatggtctcggaaggatcaaatcattctgtcaaaggaacaagaagagaaattcgagcgatgattgctagttgtatatctgactgaagctgtaaatcattcccagtatccccatctatatctttcaataaaatggaacttttagttctctatgaatagaagtcaacatctccttgaatatgttctggttgttgtggcctggacgaaacatagtgaatgttatgttagtgaagtt

SEQ ID NO: 34204 - protein, 551 aa, Hordeum vulgare
MATVRQSDGVAANGLAVAAAANGKSNGHGVAAAVNGKSNGHGVDADANGKSNGHGVAADANGKSNGHAEATANGHGEATANGKTNGHRESNGHAEAADANGESNEHAEDSAANGESNGHAAAAAEEEEAVEWNFAGAKDGVLAATGANMSIRAIRYKISASVQEKGPRPVLPLAHGDPSVFPAFRTAVEAEDAVAAAVRTGQFNCYPAGVGLPAARSAVAEHLSQGVPYMLSADDVFLTAGGTQAIEVIIPVLAQTAGANILLPRPGYPNYEARAAFNRLEVRHFDLIPDKGWEIDIDSLESIADKNTTAMVIINPNNPCGSVYSYDHLSKVAEVAKRLGILVIADEVYGKLVLGSAPFIPMGVFGHITPVLSIGSLSKSWIVPGWRLGWVAVYDPRKILQETKISTSITNYLNVSTDPATFIQAALPQILENTKEDFFKAIIGLLKESSEICYKQIKENKYITCPHKPEGSMFVMVKLNLHLLEEIDDDIDFCCKLAKEESVILCPGSVLGMANWVRITFACVPSSLQDGLGRIKSFCQRNKKRNSSDDC

SEQ ID NO: 34205 - DNA, 1844 bp, Drosophila melanogaster
  CDS (339)..(1844)
aacgacttgaaagtactagcccatatcaaccatataccgtgtatccaaagggaatccaacgaaaacaagaatcgtctgtccaacacagtgattgaccaaagatcacagctctaatgctcgtctggaacgataaacaggatacaaatttttcattcatttgagcagagtgctccatttgccagaaatcgggaccggagacatcgtcgtaatcaaaaatattagcaatatttgtttgtgctttttttttgtttttgtttattttgattcgatttggtttggtttggtttggctattcgattttctttcgttgaatcgggaaaagggccggcctggtgataatgcccagcagttttgccaacgagagtcagttccgataccagagcagccgcaatcgtgccagctgcacaagccggagtcccagcgagccggaatccccggcgccggtgacgcccaattgcgatgtagtcgatcaggcgctggccgagctgcagctccaatcgcaggacatacgcaagcaacaggacctggtggacaccacagccacgagcagcagcagccgaaagcgttccggatgggagataaagggctccaagctatcccttaacacgcacaatcgcattcggaacattgtcgagtcgctaaagatcaaaccgaatccggagaagcccatgataccgctgtccattggtgatcccacaacctttggcaatctaaaagccgccgatgagacaatgaaggcggtgctgcattccctggagagcggcaagtacaatgggtatgccagcacccagggtcacgagatagcccgcaaagcggtggccaaatacagtgcccaccagcgtcccgacggagagatcgatgccaacgaggtggtgctgtgcagcggctgctcctccgccttggagtactgcatcctggcgctggcggatcgtggtcagaatgttctggtgccgcgaccgggtttctgtttgtactatacgctggcccagggcttggatatcgaggtgcgctactacgatcttctgcccgatcagcagtggcgcgccgatctcgttcagctagagagcctgatcgatgagaacaccgccgcccttttgatcaacaatccgagcaatccctgtggcagcgtcttcgatgagaagcatctgcgcgagttgatagccatctgcgaacgccactatctgcccatcattgccgatgagatctatgagcactttgtgttccccggctccaagcacttggccgtgagcagcctgaccacggaggttccagttctctcctgtggcgggttgaccaaacgcttcctggttcccggttggcgaatgggttggatcatagtgcacgatcgcaagaatcgtttgcgcgatgccattgtcggtctaaagaacatgtgtggtcgcattctgggctccaataccatcattcagggtgccctgcccgatatcctgaccaagacaccgcagtcttattttgacggcgtgattgatgtgctccactcgaatgccatgctggcctacaagatgctgaaacaggtgcgtggcctcgatcccgtaatgcccaatggagccatgtacatgatgataggcgtgagcatcgaacgcttcccggaattcaaggacgacacccactttgtccaggagatggtgaatgagcagagtgtcttctgtctgccgggcagctgctttgagtacccgggatacgtgcggatcgtacttactgtgcccggggcaatgatcgaggaggcgtgctccaggattgccgagttctgcgatcgccactacaaaaaggagtcgcgcaatttcattgagcacggactgctcgactgcgatgatgtggccttttga

SEQ ID NO: 34206 - protein, 501 aa, Drosophila melanogaster
MPSSFANESQFRYQSSRNRASCTSRSPSEPESPAPVTPNCDVVDQALAELQLQSQDIRKQQDLVDTTATSSSSRKRSGWEIKGSKLSLNTHNRIRNIVESLKIKPNPEKPMIPLSIGDPTTFGNLKAADETMKAVLHSLESGKYNGYASTQGHEIARKAVAKYSAHQRPDGEIDANEVVLCSGCSSALEYCILALADRGQNVLVPRPGFCLYYTLAQGLDIEVRYYDLLPDQQWRADLVQLESLIDENTAALLINNPSNPCGSVFDEKHLRELIAICERHYLPIIADEIYEHFVFPGSKHLAVSSLTTEVPVLSCGGLTKRFLVPGWRMGWIIVHDRKNRLRDAIVGLKNMCGRILGSNTIIQGALPDILTKTPQSYFDGVIDVLHSNAMLAYKMLKQVRGLDPVMPNGAMYMMIGVSIERFPEFKDDTHFVQEMVNEQSVFCLPGSCFEYPGYVRIVLTVPGAMIEEACSRIAEFCDRHYKKESRNFIEHGLLDCDDVAF

SEQ ID NO: 34207 - DNA, 1365 bp, Mustela vison
  CDS (1)..(1365)
atggacccgtatgtgattcagatgaatggcaacagcagcctcccctccgttctggatatgcatgtcaacattggtgggagaagctccttaccagaaaaaaggaaaggcaggaaggccagatggtctgtgaagccttcagacatgtccaacaaaactttcaatcccatccgggccatcgtggacagcatgaaggtgaagccaaatccagacaaaaccatgattgctctgtcgattggtgaccctactgtgtttggaaacctgcctacagaccccgaagttacccaagccatgaaagatgccctggactcggggaaatataacggctatgccccctccattggctacttatccagtcgggaggagattgcttcttactaccaccggccagaggcacccctggaagctaaggatgtcattctgactagtggctgcagtcaggctattgaactttgtttagctgtgttggccaacccaggacaaaacatcctagttccgagacctggtttctctctctacaggactttggctgaatcgatgggaattgaggtcaaactctacaatttattgccagagaagtcttgggaaatcgacttgaaacaactggaatctttaattgatgaaaagacagcttgtctcatcgttaacaacccatcaaacccctgtgggtcagtgttcagtagaagtcatctccagaaaattctggctgtggctgcaaggcagtgtgtacccatcttagctgatgagatctatggcgacatggtgttttcggattccacatttgagcctctggccaccctcagcagcaacgtgcccatcctgtcctgtggaggtctggccaagcgctggctggttcctggctggaggttgggttggatcctcattcatgaccgaagagacatttttggcaacgagatccgagatgggctggtgaagctgagtcagcggatcctgggaccctgcaccattgtccagggagctctgaaaagcatcctgcatcgcacccctcaggagttctaccacaacaccctgagcctcctgaagtccaatgctgatctttgctatggggcattggctgccatcccaggactccagccagtccgcccttctggggccatgtacctcatggttggaattgagatggaacatttcccagaatttgagaatgatgtggagttcacggagcggttagttgctgagcaatcagtccactgcctcccagcaacgtgcttcgagtacccgaatttcttccgagtggtaatcacggtccccaaagtgatgatgctggaggcctgtagccggatccaggagttttgtgagctgcactaccattgtgctgaagggagccaggaggagtgtgacaaatag

SEQ ID NO: 34208 - protein, 454 aa, Mustela vison
MDPYVIQMNGNSSLPSVLDMHVNIGGRSSLPEKRKGRKARWSVKPSDMSNKTFNPIRAIVDSMKVKPNPDKTMIALSIGDPTVFGNLPTDPEVTQAMKDALDSGKYNGYAPSIGYLSSREEIASYYHRPEAPLEAKDVILTSGCSQAIELCLAVLANPGQNILVPRPGFSLYRTLAESMGIEVKLYNLLPEKSWEIDLKQLESLIDEKTACLIVNNPSNPCGSVFSRSHLQKILAVAARQCVPILADEIYGDMVFSDSTFEPLATLSSNVPILSCGGLAKRWLVPGWRLGWILIHDRRDIFGNEIRDGLVKLSQRILGPCTIVQGALKSILHRTPQEFYHNTLSLLKSNADLCYGALAAIPGLQPVRPSGAMYLMVGIEMEHFPEFENDVEFTERLVAEQSVHCLPATCFEYPNFFRVVITVPKVMMLEACSRIQEFCELHYHCAEGSQEECDK

SEQ ID NO: 34209 - DNA, 1488 bp, Arabidopsis thaliana
  CDS (1)..(1488)
atgaggttgatagtacctctccgtggagtaattcaaggccgtggtggtctcttcgtcggctctctcattccttgttgtctcttctactttctccagctctaccttaaacgacgccgtcctcctccctccgacccgacggacttaccgagaactttttcacggactaatctcttctctcgcgggaactcgatcggacgagttcgagtctcctcccgagcagttcctgtagctaaaccttccgattcgccttattacattgggttggagagagtcaaaacggatccgtacgatcggattacgaacacggatgggattattcagcttggattagccgagagtacgctgtgctttgacttgctacagagatggatgtcagagaatttgatggagtcaatgatgcaatctgatgatggtgaatttgatattagtagtatcgccatgtataaaccttttgaaggattacttgaactcagagtggcttttgctgatttcatgtcacgaataatgggaggtaatgtgtcatttgatccctcaaatatggttataacagccggtgggactcctgctattgaagtattggccttctgtttggctgatcatggaaatgcttttctaattccgacgccatattatccaggctttgatagggatattaaattccggacaggagtggagcttataccagtacactgccgtagctctgacaattttactgtaacggtttccgcactggaacaagctttgaatcaggctagaaaacgaggaagcaaggtttctggcatcctcttttcaaacccgtcaaatcctgttggaaacatactatcaagggagacgctttgtgatattttgagatttgctcaagagaagaacatccatgttatttctgatgaaatatttgcgggttctgtttacggggacaaagagtttgttagcatggctgagatcgctggctcaggggaatttgataagactagggttcatatcatatatggcttgtcaaaagacctttcaattcctggttttagagctggagtcatctactcctttcatgaagacgtagtaaatgctgcaaagaagctgatgagattttcatcagtgccagttctagttcaaaggatacttatctctctactatctgatgtaagattcattgagggatacatggcagcacacaggcaaaggatccgggataagcatattcggtttgtggaaggtttgaaacaattaggaataccatgtgctgagagtggtggtgggttgtattgttgggtagacatgagcagtttactgacatcttacagtgagaaaggagaactcgagttatttgagaagctattgactgttgctaagattaatgccactccaggaacagcctgttattgtatagaaccaggttggttcaggtgctgtttcaccgctttagctgatgaagatatcccagtgattatggaacgaatcagacagcttgctgaatcatttagatcttga

SEQ ID NO: 34210 - protein, 495 aa, Arabidopsis thaliana
MRLIVPLRGVIQGRGGLFVGSLIPCCLFYFLQLYLKRRRPPPSDPTDLPRTFSRTNLFSRGNSIGRVRVSSRAVPVAKPSDSPYYIGLERVKTDPYDRITNTDGIIQLGLAESTLCFDLLQRWMSENLMESMMQSDDGEFDISSIAMYKPFEGLLELRVAFADFMSRIMGGNVSFDPSNMVITAGGTPAIEVLAFCLADHGNAFLIPTPYYPGFDRDIKFRTGVELIPVHCRSSDNFTVTVSALEQALNQARKRGSKVSGILFSNPSNPVGNILSRETLCDILRFAQEKNIHVISDEIFAGSVYGDKEFVSMAEIAGSGEFDKTRVHIIYGLSKDLSIPGFRAGVIYSFHEDVVNAAKKLMRFSSVPVLVQRILISLLSDVRFIEGYMAAHRQRIRDKHIRFVEGLKQLGIPCAESGGGLYCWVDMSSLLTSYSEKGELELFEKLLTVAKINATPGTACYCIEPGWFRCCFTALADEDIPVIMERIRQLAESFRS

SEQ ID NO: 34211 - DNA, 1572 bp, Bacillus stearothermophilus
  CDS (368)..(1549)
gtcgacgtgaagaaagtctatacatattatggcgatgaagcatgcaccgtattcatcggccggacgaaacaagaggagacagacgtcgttgtttgggtgccggaaaaaaagggggatatcgtcgtcaagaaagcaaatagcggcatgtaacgttaagcgagagcacgcgccatgttacaacgcgaccgacatccgcaaccgtgattgacgtgacgccttggcatggaaaagggcgttatcctctttgggagttgacatatatcgatgcgagaaggaaggtattcgttttattacctccattttgccgatggttcattcttaaagaggtacagttttcaacgttgagcatatgagggggaaggaaacgatgaaattggcaaaacgggtggcgtcgctgacgccatcggcgactttggccattacggagaaagcaaaagaactaaaagcggccgggcatgacgtgattggtctcggagctggcgaaccggatttcaacacgccacagcacattcttgatgccgccatcaaggcaatgaacgaaggacatacgaaatatacaccatcgggcggtttgccggcgttaaaggaggaaattataaaaaaattcgcccgcgaccaaggcttggattatgagccggctgaagtgattgtatgcgtcggagcgaagcacgccctttacacgctgttccaagtattgctcgatgaaggcgacgaagtgatcattccgacgccatactgggtgagctatccggaacaagtgaaactggcgggcggtgttccggtttacgtcgaagggcttgaacaaaatcattttaaaattacgccggagcagctgaaacaggcaatcacgccgcggacgaaagcggttatcatcaactcgccgagcaacccgactggcatgatttatacagccgaagagttgaaggcgcttggtgaggtgtgcctagcgcatggtgtattgatcgtgtcagatgaaatttacgaaaaattgacttacggcggggcgaagcatgtgtccatcgctgagttgtcgccggagctgaaggcgcagacagtcatcattaacggcgtgtcaaagtcgcattcgatgacgggctggcgcattggttatgcggcggggccgaaagatattattaaggcaatgacagatttggcgagccacagcacgtccaacccgacgtcaatcgcccaatacgcggccatcgctgcttacagcgggccgcaggagccggtcgaacaaatgcgccaagcgtttgaacaacggctcaatatcatttacgacaagctcgtgcaaattccaggattcacgtgcgttaagccacaaggggcgttttatttgttcccgaacgcccgcgaagcggctgcaatggccggctgccgcacggtcgacgagttcgtcgctgccttgttggaggaagcgaaagtcgcgcttgtgcccggctctgggtttggagcgccggataacgttcgcttgtcatacgcgacatcgctcgatgcactggaaaccgccgtggaacgcatccaccggtttatggaagcgcgcgcttaacaagcggcggctttgccaaagca

SEQ ID NO: 34212 - protein, 393 aa, Bacillus stearothermophilus
MKLAKRVASLTPSATLAITEKAKELKAAGHDVIGLGAGEPDFNTPQHILDAAIKAMNEGHTKYTPSGGLPALKEEIIKKFARDQGLDYEPAEVIVCVGAKHALYTLFQVLLDEGDEVIIPTPYWVSYPEQVKLAGGVPVYVEGLEQNHFKITPEQLKQAITPRTKAVIINSPSNPTGMIYTAEELKALGEVCLAHGVLIVSDEIYEKLTYGGAKHVSIAELSPELKAQTVIINGVSKSHSMTGWRIGYAAGPKDIIKAMTDLASHSTSNPTSIAQYAAIAAYSGPQEPVEQMRQAFEQRLNIIYDKLVQIPGFTCVKPQGAFYLFPNAREAAAMAGCRTVDEFVAALLEEAKVALVPGSGFGAPDNVRLSYATSLDALETAVERIHRFMEARA

SEQ ID NO: 34213 - DNA, 1215 bp, Haemophilus influenzae
  CDS (1)..(1215)
atgcgattattcccaaaatccgacaaattagaacacgtatgttatgacattcgcggacctgtgcataaagaagcactacgcttagaagaagaaggcaataaaattttaaaacttaatatcggcaatcccgcacctttcggctttgaagcaccagatgaaattttggtggacgtattgcgtaatttgccgtcagctcaaggctactgcgattcaaaaggattatattctgctcgtaaagccattgttcaatattaccaatcaaaagggattctcggcgcgaccgtcaatgatgtgtatattggtaacggcgtatctgagcttatcacaatggcaatgcaagcattgctcaatgatggcgatgaagtgcttgtgccgatgcctgattatccgctttggactgctgcggtaaccctttctggcggtaaagcagtgcattatctctgtgatgaagacgcaaattggtttcccactattgatgatattaaagcaaaggtgaatgcgaaaactaaagcgattgtcatcatcaacccgaacaacccaacgggtgctgtgtatagcaaagaattattacaagaaattgtggaaatcgcgcgtcaaaataatttaattatcttcgctgacgaaatctacgacaaaattttatatgatggcgcggtgcatcatcacattgccgcacttgctcctgatttattaaccgttacattgaatgggttatcaaaagcttatcgagttgcaggcttccgccaaggctggatgattttgaacggcccaaaacataatgcgaaaggttatattgaaggcttggatatgctggcatcaatgcgtttatgtgccaacgtaccaatgcaacatgcaattcaaaccgcacttggtggctatcaaagtattaatgaatttattttaccaggcggtcgattacttgagcaacgaaacaaagcctatgatctcatcactcaaattccaggcattacttgcgtgaaaccaatgggggcgatgtatatgttcccgaaaattgatgtgaaaaaattcaatattcacagtgatgaaaaaatggtgctggatttactccgccaagaaaaagtactacttgtgcacggtaaaggatttaattggcattcaccagatcacttccgtattgttactcttccttatgtgaatcagcttgaagaagccattacaaaattagcaagatttttgtcggattaccgtcaataa

SEQ ID NO: 34214 - protein, 404 aa, Haemophilus influenzae
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPTIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 34215 - DNA, 1491 bp, Homo sapiens
  CDS (1)..(1491)
atggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctag

SEQ ID NO: 34216 - protein, 496 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVYQDNVYAAGSQFHSFKKVLMEMGPPYAGQQELASFHSTSKGYMGECGFRGGYVEVVNMDAAVQQQMLKLMSVRLCPPVPGQALLDLVVSPPAPTDPSFAQFQAEKQAVLAELAAKAKLTEQVFNEAPGISCNPVQGAMYSFPRVQLPPRAVERAQELGLAPDMFFCLRLLEETGICVVPGSGFGQREGTYHFRMTILPPLEKLRLLLEKLSRFHAKFTLEYS

SEQ ID NO: 34217 - DNA, 25 bp, Primer
atgttatcactgtctgccaaaaatc

SEQ ID NO: 34218 - DNA, 25 bp, Primer
tcagtcacggtattggtcaaaaaat

SEQ ID NO: 34219 - protein, 428 aa, consensus
  MISC_FEATURE (1)..(428): consensus for the disclosure of xaa see table XV
NXGXXXXXXXXPXXXXRXXXXXXXXXXXXXXXXXXXXXXXXXXXXXXXXXXXXXXXXXXXXXGXYXXXXGXXXXXXXXAXXXXXRXXXXXXXXXXXXXXXXXGAXXXXXXXXXXXXXXXXXXXXXXXXXXPXXPLYXXXXXXXXXXXXXYXLXEXXXWXXXXXXXXXXXXXXXXXXXXXXXXXXXINPXNPTGXXXXXXXXXXXXXXXXXXXXXXXXDEVYQXNXXXXXXXXFXSXXXXXXXXXXXXXXXXXXXXXXXSXXXXSXXXXXECGXRGGYXXXXXXXXXXXXXXXXXXXXXXXXXXXXXXXXXXXXXPPXXXXXXXXXXXXEXXXXXXXXXXXXXXXXXXXXXXXXXXXXXXXGAXYXXPXXXXXXXXXXXXXXXXXXXXXXXXXDXXXXXXLLXXXGXXXXXGXXFXXXXXXXHXRXTXL

SEQ ID NO: 34220 - protein, 496 aa, consensus
  MISC_FEATURE (1)..(496): consensus for the disclosure of xaa see table XV
NXXVXXXXXYAVRGXXXXXAXXXXXXXXXXXXXXXXXFXXXXXXNXGXXXXXXQXPXTFXRXVXXXXXXPXLLXXXXXXXXXXXXXXXDXXXRAXXXLXXXXGXXXGAYSXSXGXXXXRXXXAXXIXXRXXXXGXXXXXXXIXLTXGASXXXXXXXXXXXXXXXXXXXGXXXPXPQYPLYXAXXXXXXXXXXXYYLXEXXXWXXXXXXXXXXXXXXXXXXXXXXXXXXXINPGNPTGXXXXXXXXXXXXXXXXXXXXXXXADEVYQXNXXXXXXXXFXSXKKXXXXXXXXXXXXXXXXXXLXSXXSXSKGXXGECGXRGGYXEXXXXXXXXXXXXXKXXSXXLXXXXXGQXXXXXXXXPPXXGXXSXXXXXXEXXXXXXXLXXXAXXXXXXXXXXXXXXCXXXXGAMYXFPXXXXPXXXXXXXXAXXXAXXXXXXPDXFYXXXLLEXTGIXXVPGSGFGQXXGXXHXRXTXLPXXXXXXXXXXXXXXFXXXFXXXY

SEQ ID NO: 34221 - protein, 73 aa, consensus
  MISC_FEATURE (1)..(73): consensus for the disclosure of xaa see table XV
XXXXXGXXXXXXXXXXXXXXXXXXXXXXXXXXXXXXXXXXXXXXXXXXXXXXXXXXXXXXXXXXXXXPXXXXX

SEQ ID NO: 34222 - protein, 45 aa, consensus
  MISC_FEATURE (1)..(45): consensus for the disclosure of xaa see table XV
XXXXXPXNPXGXXXXXXXXXXXXXXXXXXXXXXXXXDXXXXXXXX

SEQ ID NO: 34223 - protein, 74 aa, consensus
  MISC_FEATURE (1)..(74): consensus for the disclosure of xaa see table XV
XNXXXXXXXXYAVRGXXXXXXXXXXXXXXXXXXXXXXXXXXXXXXNXGXXXXXXQXPXXXXRXXXXXXXXPXXX

SEQ ID NO: 34224 - protein, 96 aa, consensus
  MISC_FEATURE (1)..(96): consensus for the disclosure of xaa see table XV
GXYXXXXGXXXXRXXXAXXIXXRDXXXXXXXXXXXXXXXXGAXXXXXXXXXXXXXXXXXXXXXXXXXXPQXPLYXXXXXXXXXXXXXYXLXEXXXW

SEQ ID NO: 34225 - protein, 61 aa, consensus
  MISC_FEATURE (1)..(61): consensus for the disclosure of xaa see table XV
XXXINPGNPTGXXXXXXXXXXXXXXXXXXXXXXXXDEVYQXNXXXXXXXXFXSXXXXXXXX

SEQ ID NO: 34226 - protein, 73 aa, consensus
  MISC_FEATURE (1)..(73): consensus for the disclosure of xaa see table XV
XXSXXXXSKXXXXECGXRGGYXEXXXXXXXXXXXXXKXXXXXXXXXXXXQXXXXXXXXPPXXXXXXXXXXXXE

SEQ ID NO: 34227 - protein, 92 aa, consensus
  MISC_FEATURE (1)..(92): consensus for the disclosure of xaa see table XV
GAXYXXPXXXXPXXXXXXXXXXXXXXXXXXXXDXXXXXXLLXXXGXXXXPGSGFXQXXGXXHXRXTXLXXXXXXXXXXXXXXXXXXXXXXXX

SEQ ID NO: 34228 - DNA, 723 bp, Escherichia coli; identical to SEQ ID NO: 417
  CDS (1)..(723)

SEQ ID NO: 34229 - protein, 240 aa, Escherichia coli; identical to SEQ ID NO: 418

SEQ ID NO: 34230 - DNA, 723 bp, Listeria innocua; identical to SEQ ID NO: 453
  CDS (1)..(723)

SEQ ID NO: 34231 - protein, 240 aa, Listeria innocua; identical to SEQ ID NO: 454

SEQ ID NO: 34232 - DNA, 798 bp, Yersinia pestis; identical to SEQ ID NO: 2052
  CDS (1)..(798)

SEQ ID NO: 34233 - protein, 265 aa, Yersinia pestis; identical to SEQ ID NO: 452

SEQ ID NO: 34234 - DNA, 744 bp, Salmonella enterica subsp. enterica serovar Typhi; identical to SEQ ID NO: 2054
  CDS (1)..(744)

SEQ ID NO: 34235 - protein, 247 aa, Salmonella enterica subsp. enterica serovar Typhi; identical to SEQ ID NO: 460

SEQ ID NO: 34236 - DNA, 714 bp, Listeria innocua; identical to SEQ ID NO: 455
  CDS (1)..(714)

SEQ ID NO: 34237 - protein, 237 aa, Listeria innocua; identical to SEQ ID NO: 456

SEQ ID NO: 34238 - DNA, 723 bp, Listeria monocytogenes; identical to SEQ ID NO: 457
  CDS (1)..(723)

SEQ ID NO: 34239 - protein, 240 aa, Listeria monocytogenes; identical to SEQ ID NO: 458

SEQ ID NO: 34240 - DNA, 729 bp, Listeria monocytogenes; identical to SEQ ID NO: 429
  CDS (1)..(729)

SEQ ID NO: 34241 - protein, 242 aa, Listeria monocytogenes; identical to SEQ ID NO: 430

SEQ ID NO: 34242 - DNA, 729 bp, Listeria innocua; identical to SEQ ID NO: 2062
  CDS (1)..(729)

SEQ ID NO: 34243 - protein, 242 aa, Listeria innocua; identical to SEQ ID NO: 432

SEQ ID NO: 34244 - DNA, 729 bp, Bacillus subtilis; identical to SEQ ID NO: 421
  CDS (1)..(729)

SEQ ID NO: 34245 - protein, 242 aa, Bacillus subtilis; identical to SEQ ID NO: 422

SEQ ID NO: 34246 - DNA, 747 bp, Bacillus halodurans; identical to SEQ ID NO: 445
  CDS (1)..(747)

SEQ ID NO: 34247 - protein, 248 aa, Bacillus halodurans; identical to SEQ ID NO: 446

SEQ ID NO: 34248 - DNA, 723 bp, Bacillus halodurans; identical to SEQ ID NO: 433
  CDS (1)..(723)

SEQ ID NO: 34249 - protein, 240 aa, Bacillus halodurans; identical to SEQ ID NO: 434

SEQ ID NO: 34250 - DNA, 714 bp, Bacillus halodurans; identical to SEQ ID NO: 427
  CDS (1)..(714)

SEQ ID NO: 34251 - protein, 237 aa, Bacillus halodurans; identical to SEQ ID NO: 428

SEQ ID NO: 34252 - DNA, 810 bp, Corynebacterium glutamicum; identical to SEQ ID NO: 29186
  CDS (1)..(810)

SEQ ID NO: 34253 - protein, 269 aa, Corynebacterium glutamicum; identical to SEQ ID NO: 462

SEQ ID NO: 34254 - DNA, 732 bp, Bacillus subtilis; identical to SEQ ID NO: 425
  CDS (1)..(732)

SEQ ID NO: 34255 - protein, 243 aa, Bacillus subtilis; identical to SEQ ID NO: 426

SEQ ID NO: 34256 - DNA, 744 bp, Caulobacter crescentus; identical to SEQ ID NO: 2076
  CDS (1)..(744)

SEQ ID NO: 34257 - protein, 247 aa, Caulobacter crescentus; identical to SEQ ID NO: 442

SEQ ID NO: 34258 - DNA, 711 bp, Streptococcus pneumoniae; identical to SEQ ID NO: 2078
  CDS (1)..(711)

SEQ ID NO: 34259 - protein, 236 aa, Streptococcus pneumoniae; identical to SEQ ID NO: 436

SEQ ID NO: 34260 - DNA, 729 bp, Streptococcus pneumoniae; identical to SEQ ID NO: 2080
  CDS (1)..(729)

SEQ ID NO: 34261 - protein, 242 aa, Streptococcus pneumoniae; identical to SEQ ID NO: 438

SEQ ID NO: 34262 - DNA, 708 bp, Streptococcus pneumoniae; identical to SEQ ID NO: 2082
  CDS (1)..(708)

SEQ ID NO: 34263 - protein, 235 aa, Streptococcus pneumoniae; identical to SEQ ID NO: 450

SEQ ID NO: 34264 - DNA, 717 bp, Escherichia coli; identical to SEQ ID NO: 423
  CDS (1)..(717)

SEQ ID NO: 34265 - protein, 238 aa, Escherichia coli [sequence omitted]

SEQ ID NO: 34266 - DNA, 708 bp, Lactococcus lactis subsp. lactis; identical to SEQ ID NO: 443
  CDS (1)..(708)

SEQ ID NO: 34267 - protein, 235 aa, Lactococcus lactis subsp. lactis; identical to SEQ ID NO: 444

SEQ ID NO: 34268 - DNA, 756 bp, Escherichia coli; identical to SEQ ID NO: 439
  CDS (1)..(756)

SEQ ID NO: 34269 - protein, 251 aa, Escherichia coli; identical to SEQ ID NO: 440

SEQ ID NO: 34270 - DNA, 732 bp, Clostridium acetobutylicum; identical to SEQ ID NO: 2090
  CDS (1)..(732)

SEQ ID NO: 34271 - protein, 243 aa, Clostridium acetobutylicum; identical to SEQ ID NO: 448

SEQ ID NO: 34272 - DNA, 747 bp, Bordetella parapertussis; identical to SEQ ID NO: 2092
  CDS (1)..(747)

SEQ ID NO: 34273 - protein, 248 aa, Bordetella parapertussis; identical to SEQ ID NO: 510

SEQ ID NO: 34274 - DNA, 747 bp, Bordetella bronchiseptica; identical to SEQ ID NO: 2094
  CDS (1)..(747)

SEQ ID NO: 34275 - protein, 248 aa, Bordetella bronchiseptica; identical to SEQ ID NO: 508

SEQ ID NO: 34276 - DNA, 738 bp, Bacillus cereus; identical to SEQ ID NO: 503
  CDS (1)..(738)

SEQ ID NO: 34277 - protein, 245 aa, Bacillus cereus; identical to SEQ ID NO: 504

SEQ ID NO: 34278 - DNA, 732 bp, Bacillus anthracis; identical to SEQ ID NO: 2098
  CDS (1)..(732)

SEQ ID NO: 34279 - protein, 243 aa, Bacillus anthracis; identical to SEQ ID NO: 502

SEQ ID NO: 34280 - DNA, 738 bp, Bacillus anthracis; identical to SEQ ID NO: 499
  CDS (1)..(738)

SEQ ID NO: 34281 - protein, 245 aa, Bacillus anthracis; identical to SEQ ID NO: 500

SEQ ID NO: 34282 - DNA, 765 bp, Streptomyces avermitilis; identical to SEQ ID NO: 2102
  CDS (1)..(765)

SEQ ID NO: 34283 - protein, 254 aa, Streptomyces avermitilis; identical to SEQ ID NO: 498

SEQ ID NO: 34284 - DNA, 756 bp, Enterococcus faecalis; identical to SEQ ID NO: 2104
  CDS (25)..(756)

SEQ ID NO: 34285 - protein, 243 aa, Enterococcus faecalis; identical to SEQ ID NO: 496

SEQ ID NO: 34286 - DNA, 708 bp, Enterococcus faecalis; identical to SEQ ID NO: 2106
  CDS (1)..(708)

SEQ ID NO: 34287 - protein, 235 aa, Enterococcus faecalis; identical to SEQ ID NO: 494

SEQ ID NO: 34288 - DNA, 675 bp, Shigella flexneri; identical to SEQ ID NO: 2108
  CDS (1)..(675)

SEQ ID NO: 34289 - protein, 224 aa, Shigella flexneri; identical to SEQ ID NO: 506

SEQ ID NO: 34290 - DNA, 723 bp, Shigella flexneri; identical to SEQ ID NO: 491
  CDS (1)..(723)

SEQ ID NO: 34291 - protein, 240 aa, Shigella flexneri; identical to SEQ ID NO: 492

SEQ ID NO: 34292 - DNA, 927 bp, Pseudomonas putida; identical to SEQ ID NO: 2112
  CDS (1)..(927)

SEQ ID NO: 34293 - protein, 308 aa, Pseudomonas putida; identical to SEQ ID NO: 490

SEQ ID NO: 34294 - DNA, 711 bp, Lactobacillus plantarum; identical to SEQ ID NO: 487
  CDS (1)..(711)

SEQ ID NO: 34295 - protein, 236 aa, Lactobacillus plantarum; identical to SEQ ID NO: 488

SEQ ID NO: 34296 - DNA, 699 bp, Streptococcus mutans; identical to SEQ ID NO: 485
  CDS (1)..(699)

SEQ ID NO: 34297 - protein, 232 aa, Streptococcus mutans; identical to SEQ ID NO: 486

SEQ ID NO: 34298 - DNA, 699 bp, Streptococcus agalactiae; identical to SEQ ID NO: 2118
  CDS (1)..(699)

SEQ ID NO: 34299 - protein, 232 aa, Streptococcus agalactiae; identical to SEQ ID NO: 484

SEQ ID NO: 34300 - DNA, 747 bp, Oceanobacillus iheyensis; identical to SEQ ID NO: 481
  CDS (1)..(747)

SEQ ID NO: 34301 - protein, 248 aa, Oceanobacillus iheyensis; identical to SEQ ID NO: 482

SEQ ID NO: 34302 - DNA, 756 bp, Escherichia coli O6; identical to SEQ ID NO: 479
  CDS (1)..(756)

SEQ ID NO: 34303 - protein, 251 aa, Escherichia coli O6; identical to SEQ ID NO: 480

SEQ ID NO: 34304 - DNA, 699 bp, Escherichia coli O6; identical to SEQ ID NO: 477
  CDS (1)..(699)

SEQ ID NO: 34305 - protein, 232 aa, Escherichia coli O6; identical to SEQ ID NO: 478

SEQ ID NO: 34306 - DNA, 765 bp, Streptomyces sp; identical to SEQ ID NO: 2126
  CDS (1)..(765)

SEQ ID NO: 34307 - protein, 254 aa, Streptomyces sp; identical to SEQ ID NO: 468

SEQ ID NO: 34308 - DNA, 714 bp, Streptococcus mutans; identical to SEQ ID NO: 2128
  CDS (1)..(714)

SEQ ID NO: 34309 - protein, 237 aa, Streptococcus mutans; identical to SEQ ID NO: 476

SEQ ID NO: 34310 - DNA, 762 bp, Streptomyces griseus; identical to SEQ ID NO: 2130
  CDS (1)..(762)

SEQ ID NO: 34311 - protein, 253 aa, Streptomyces griseus; identical to SEQ ID NO: 466

SEQ ID NO: 34312 - DNA, 726 bp, Clostridium perfringens; identical to SEQ ID NO: 471
  CDS (1)..(726)

SEQ ID NO: 34313 - protein, 241 aa, Clostridium perfringens; identical to SEQ ID NO: 472

SEQ ID NO: 34314 - DNA, 726 bp, Streptococcus pyogenes; identical to SEQ ID NO: 469
  CDS (1)..(726)

SEQ ID NO: 34315 - protein, 241 aa, Streptococcus pyogenes; identical to SEQ ID NO: 470

SEQ ID NO: 34316 - DNA, 705 bp, Pseudomonas fluorescens; identical to SEQ ID NO: 463
  CDS (1)..(705)

SEQ ID NO: 34317 - protein, 234 aa, Pseudomonas fluorescens; identical to SEQ ID NO: 464

SEQ ID NO: 34318 - DNA, 765 bp, Streptomyces coelicolor; identical to SEQ ID NO: 2138
  CDS (1)..(765)

SEQ ID NO: 34319 - protein, 254 aa, Streptomyces coelicolor; identical to SEQ ID NO: 474

SEQ ID NO: 34320 - DNA, 23 bp, Primer
atgggacacaagcccttataccg

SEQ ID NO: 34321 - DNA, 23 bp, Primer
ttatcgcgatgattttcgctgcg

SEQ ID NO: 34322 - protein, 222 aa, consensus; identical to SEQ ID NO: 29256
  MISC_FEATURE (1)..(222): consensus for the disclosure of xaa see table XV

SEQ ID NO: 34323 - protein, 23 aa, consensus
  MISC_FEATURE (1)..(23): xaa in position 2 is Arg, Ile or Val, xaa in position 3 is any amino acid, xaa in position 5 to 11 is any amino acid, xaa in position 13 to 22 is any amino acid.
SXXTXXXXXXXLXXXXXXXXXXG

SEQ ID NO: 34324 - DNA, 1224 bp, Escherichia coli; identical to SEQ ID NO: 1403
  CDS (285)..(1166)

SEQ ID NO: 34325 - protein, 293 aa, Escherichia coli; identical to SEQ ID NO: 514

SEQ ID NO: 34326 - DNA, 882 bp, Yersinia pestis; identical to SEQ ID NO: 525
  CDS (1)..(882)

SEQ ID NO: 34327 - protein, 293 aa, Yersinia pestis; identical to SEQ ID NO: 526

SEQ ID NO: 34328 - DNA, 882 bp, Salmonella typhimurium; identical to SEQ ID NO: 1407
  CDS (1)..(882)

SEQ ID NO: 34329 - protein, 293 aa, Salmonella typhimurium; identical to SEQ ID NO: 524

SEQ ID NO: 34330 - DNA, 882 bp, Escherichia coli; identical to SEQ ID NO: 519
  CDS (1)..(882)

SEQ ID NO: 34331 - protein, 293 aa, Escherichia coli; identical to SEQ ID NO: 520

SEQ ID NO: 34332 - DNA, 864 bp, Vibrio cholerae; identical to SEQ ID NO: 531
  CDS (1)..(864)

SEQ ID NO: 34333 - protein, 287 aa, Vibrio cholerae; identical to SEQ ID NO: 532

SEQ ID NO: 34334 - DNA, 879 bp, Buchnera aphidicola str. APS (Acyrthosiphon pisum); identical to SEQ ID NO: 1413
  CDS (1)..(879)

SEQ ID NO: 34335 - protein, 292 aa, Buchnera aphidicola str. APS (Acyrthosiphon pisum); identical to SEQ ID NO: 528

SEQ ID NO: 34336 - DNA, 852 bp, Haemophilus influenzae; identical to SEQ ID NO: 533
  CDS (1)..(852)

SEQ ID NO: 34337 - protein, 283 aa, Haemophilus influenzae; identical to SEQ ID NO: 534

SEQ ID NO: 34338 - DNA, 879 bp, Buchnera aphidicola str. Sg (Schizaphis graminum); identical to SEQ ID NO: 537
  CDS (1)..(879)

SEQ ID NO: 34339 - protein, 292 aa, Buchnera aphidicola str. Sg (Schizaphis graminum); identical to SEQ ID NO: 538

SEQ ID NO: 34340 - DNA, 861 bp, Pasteurella multocida; identical to SEQ ID NO: 535
  CDS (1)..(861)

SEQ ID NO: 34341 - protein, 286 aa, Pasteurella multocida; identical to SEQ ID NO: 536

SEQ ID NO: 34342 - DNA, 882 bp, Escherichia coli; identical to SEQ ID NO: 1421
  CDS (1)..(882): r means g or a

SEQ ID NO: 34343 - protein, 293 aa, Escherichia coli; identical to SEQ ID NO: 1422
  misc_feature (288)..(288): Xaa can be Ala or Thr

SEQ ID NO: 34344 - DNA, 870 bp, Haemophilus ducreyi; identical to SEQ ID NO: 539
  CDS (1)..(870)

SEQ ID NO: 34345 - protein, 289 aa, Haemophilus ducreyi; identical to SEQ ID NO: 540

SEQ ID NO: 34346 - DNA, 777 bp, Vibrio vulnificus; identical to SEQ ID NO: 1425
  CDS (1)..(777)

SEQ ID NO: 34347 - protein, 258 aa, Vibrio vulnificus; identical to SEQ ID NO: 530

SEQ ID NO: 34348 - DNA, 879 bp, Xanthomonas axonopodis (pv. citri); identical to SEQ ID NO: 543
  CDS (1)..(879)

SEQ ID NO: 34349 - protein, 292 aa, Xanthomonas axonopodis (pv. citri); identical to SEQ ID NO: 544

SEQ ID NO: 34350 - DNA, 879 bp, Xanthomonas campestris (pv. campestris); identical to SEQ ID NO: 541
  CDS (1)..(879)

SEQ ID NO: 34351 - protein, 292 aa, Xanthomonas campestris (pv. campestris); identical to SEQ ID NO: 542

SEQ ID NO: 34352 - DNA, 22 bp, Primer
atgatgcgaatcgcgctcttcc

SEQ ID NO: 34353 - DNA, 24 bp, Primer
ttacttcaggtattcacccgtacg

SEQ ID NO: 34354 - protein, 290 aa, consensus
  MISC_FEATURE (1)..(290): consensus for the disclosure of xaa see table XV
RXXLFLXTNXAVXXXXXXXXXXXXXXXGXXXXXXXGLXXMXXXFGFXGXXXSLXXSKXMALRSVXXXVIXXPRNXXEXWLXXTVXXQXXXXGIXMPXXAIYXXXDXNAFATGAXXXXXLVAVSTGLLXNMXXXEAEAVXAHEXXHXXNGDMVTMXLXQGVXNTFVIFXSRXXXXXXXXXXXXXXXXXXXXXXXXXXYXXXXXXLEXXFGXLAXXIXMWFSRXREFXADAGXAXLVGXXKMIAALXRLXXXXEXXXXXXXXXAFXIXGXXXXXXXXLFXXHPPLXXRIXAL

SEQ ID NO: 34355 - protein, 136 aa, consensus; identical to SEQ ID NO: 545
  MISC_FEATURE (1)..(136): consensus for the disclosure of xaa see table XV

SEQ ID NO: 34356 - protein, 46 aa, consensus; identical to SEQ ID NO: 546
  MISC_FEATURE (1)..(46): consensus for the disclosure of xaa see table XV

SEQ ID NO: 34357 - DNA, 366 bp, Escherichia coli (strain K-12); identical to SEQ ID NO: 30283
  CDS (1)..(366)

SEQ ID NO: 34358 - protein, 121 aa, Escherichia coli (strain K-12); identical to SEQ ID NO: 30284

SEQ ID NO: 34359 - DNA, 363 bp, Yersinia pestis CO92; identical to SEQ ID NO: 30285
  CDS (1)..(363)

SEQ ID NO: 34360 - protein, 120 aa, Yersinia pestis CO92; identical to SEQ ID NO: 30286

SEQ ID NO: 34361 - DNA, 366 bp, Shigella flexneri 2a str. 301; identical to SEQ ID NO: 30287
  CDS (1)..(366)

SEQ ID NO: 34362 - protein, 121 aa, Shigella flexneri 2a str. 301; identical to SEQ ID NO: 30288

SEQ ID NO: 34363 - DNA, 378 bp, Photorhabdus luminescens subsp. laumondii TTO1; identical to SEQ ID NO: 30289
  CDS (1)..(378)

SEQ ID NO: 34364 - protein, 125 aa, Photorhabdus luminescens subsp. laumondii TTO1; identical to SEQ ID NO: 30290

SEQ ID NO: 34365 - DNA, 381 bp, Erwinia carotovora subsp. atroseptica SCRI1043; identical to SEQ ID NO: 30291
  CDS (1)..(381)

SEQ ID NO: 34366 - protein, 126 aa, Erwinia carotovora subsp. atroseptica SCRI1043; identical to SEQ ID NO: 30292

SEQ ID NO: 34367 - DNA, 363 bp, Yersinia pseudotuberculosis IP 32953; identical to SEQ ID NO: 30293
  CDS (1)..(363)

SEQ ID NO: 34368 - protein, 120 aa, Yersinia pseudotuberculosis IP 32953; identical to SEQ ID NO: 30294

SEQ ID NO: 34369 - DNA, 363 bp, Erwinia chrysanthemi; identical to SEQ ID NO: 30295
  CDS (1)..(363)

SEQ ID NO: 34370 - protein, 120 aa, Erwinia chrysanthemi; identical to SEQ ID NO: 30296

SEQ ID NO: 34371 - DNA, 369 bp, Salmonella typhimurium; identical to SEQ ID NO: 30297
  CDS (1)..(369)

SEQ ID NO: 34372 - protein, 122 aa, Salmonella typhimurium; identical to SEQ ID NO: 30298

SEQ ID NO: 34373 - DNA, 25 bp, Primer
atgaaccatgcaccgcatttatatt

SEQ ID NO: 34374 - DNA, 25 bp, Primer
ttaaaagaggttatcctgcggagcc

SEQ ID NO: 34375 - protein, 106 aa, consensus; identical to SEQ ID NO: 30301
  MISC_FEATURE (1)..(106): consensus for the disclosure of xaa see table XV

SEQ ID NO: 34376 - protein, 106 aa, consensus; identical to SEQ ID NO: 30302
  MISC_FEATURE (1)..(106): consensus for the disclosure of xaa see table XV

SEQ ID NO: 34377 - protein, 44 aa, consensus; identical to SEQ ID NO: 30303
  MISC_FEATURE (1)..(44): consensus for the disclosure of xaa see table XV

SEQ ID NO: 34378 - protein, 48 aa, consensus; identical to SEQ ID NO: 30304
  MISC_FEATURE (1)..(48): consensus for the disclosure of xaa see table XV

SEQ ID NO: 34379 - DNA, 1644 bp, Escherichia coli
  CDS (1)..(1644)
atggaacttcttgtacttgtctggcggcagtatcgctggccatttatcagtgtgatggcgctaagcctcgccagtgcggcattaggcattggcttaattgcttttatcaatcagcgccttatcgaaacggcggataccagtctgctggtgttgccggagtttctgggattattgctgctgttgatggcagtcactctcggatcgcaactggcgctcaccactttggggcatcacttcgtttaccgactgcgtagtgaatttatcaagcggattctggatactcacgtcgagcgcattgaacaactcggtagcgcctcgttgctggcggggttaaccagcgatgtgcgcaatatcaccattgcttttgtgcgtctgccggaactggtgcaggggatcattctcactatcggttcagcggcgtatctgtggatgctgtcgggcaaaatgttgctggtaacggctatctggatggcgatcaccatctggggcggttttgtgctggtggcgcgggtgtacaaacatatggcgaccctgcgtgaaaccgaagacaagctgtacacggattttcaaactgtacttgaagggcgcaaagagctgactctgaaccgggaacgcgccgagtatgtgtttaacaacctctacattcctgatgcgcaagagtatcgccaccatattattcgcgcagacaccttccatcttagtgccgtgaactggtcaaacatcatgatgctgggcgcaatcggcctggtgttctggatggcgaacagcctcggttgggctgataccaacgttgccgcgacctattcgttgacgcttttattcctgcgtacgccgctgctttcggcggttggcgcattgccgacgctgctgacggcgcaggtggcgtttaacaagctgaacaaattcgcgctcgcgcctttcaaagcagagtttccgcgcccgcaggcgtttcccaactggcaaacgctggagctgcgtaacgtgacgtttgcttatcaggataacgcgttttccgttggtccgattaatctcaccatcaaacgtggcgagctgctgtttctgattggcggcaacggtagcggaaaatcgacgctggcgatgttgttgacgggcttgtatcagccacaaagcggcgaaatcttgctggatggcaaacctgtcagcggcgaacaaccggaagattatcgcaaactgttttcggcagtgtttaccgatgtctggctgtttgatcaactgctggggccggagggtaaacccgctaacccgcaactggttgagaagtggctggcgcagctgaaaatggctcataagcttgagttaagcaacgggcgtattgttaacctgaagttatcaaaagggcagaaaaaacgcgtggcgctgttgctggcgctggcagaagaacgcgatattatcctgctggatgaatgggcggcggatcaggatccacacttccgtcgtgagttttatcaggtgttgctgccgctgatgcaggagatgggtaaaactattttcgctatcagtcatgatgatcattactttatccacgccgaccgcctgctggaaatgcgcaatgggcaacttagcgagctgacgggcgaagagcgcgatgccgcttcgcgtgatgccgttgcccggacggcataa

SEQ ID NO: 34380 - protein, 547 aa, Escherichia coli
MELLVLVWRQYRWPFISVMALSLASAALGIGLIAFINQRLIETADTSLLVLPEFLGLLLLLMAVTLGSQLALTTLGHHFVYRLRSEFIKRILDTHVERIEQLGSASLLAGLTSDVRNITIAFVRLPELVQGIILTIGSAAYLWMLSGKMLLVTAIWMAITIWGGFVLVARVYKHMATLRETEDKLYTDFQTVLEGRKELTLNRERAEYVFNNLYIPDAQEYRHHIIRADTFHLSAVNWSNIMMLGAIGLVFWMANSLGWADTNVAATYSLTLLFLRTPLLSAVGALPTLLTAQVAFNKLNKFALAPFKAEFPRPQAFPNWQTLELRNVTFAYQDNAFSVGPINLTIKRGELLFLIGGNGSGKSTLAMLLTGLYQPQSGEILLDGKPVSGEQPEDYRKLFSAVFTDVWLFDQLLGPEGKPANPQLVEKWLAQLKMAHKLELSNGRIVNLKLSKGQKKRVALLLALAEERDIILLDEWAADQDPHFRREFYQVLLPLMQEMGKTIFAISHDDHYFIHADRLLEMRNGQLSELTGEERDAASRDAVARTA

SEQ ID NO: 34381 - DNA, 1833 bp, Idiomarina loihiensis L2TR
  CDS (1)..(1833)
atgttttcctggtttgagcgccgattaaacccttttcctacggaggaaccgactcaggctcctaccggattttttgcattctgctggcatttcaccaaaggggcgaccccttttattgcagtcaccgcagctcttatggccgctattgccattgccgaagtctggttgtttggctttttagggcaaattgttgactggctgtcagcacaggataaagaaaccctattaaacgatcagttctggccactggctggcatgagcgctctggtgttagtcggtttgcccttgctggtctggttccactctatgctgacccaccagacattgctgggcaacttccccatgcgcattcgctggctgggtcaccgctatttgatgaagcagtctatgagttactatcaggacgagtttgccggccgggtcgccaccaaattaatgcaaacttcactcgcgctacggcaatgcatcatgacctttattgaggtggtgaactacgtcgctgtctacttcctcgggatgtttgtcattattggtaatgccgactggcgaatgatgctgccgctggcttgctggcttattctgtacgctctgttgttacgctactttgtgcctaaactgggtaaaatatcagccgaacaggcagatgcccgttctaatatgaccggacgcattgtcgactcctataccaatattcaaaccgttaaattgttctcacactccctgcgcgaggcttcttttgcgcacgagggcatggacacttttctgggaacagtacataagcaaatgcgcctggttactcagctttacggcttcctctattttataaactgcgcattgttgttcagctctgctgctacggccattgtgctgtggatggataatgctgtgactttaggcgctgttgctgtagttatcggtctggttctgcgcttgtttggtatgtcgcaaatggtcatgtggcaaatgtcgacgctgtttgaaagcattggtaccgttcaggacggtattggctctattgcggtgccacagcgcattatcgatgaacccaatgcgcccgctttaaacgtgacttccggcgacattaattttgaccatgttcgcttccattatggcaaaggtcatggcgttatggatgactttaatctgcacattaaatcgggtgaaaaagtcggtattgtcggacgctcaggggcgggtaagtccactctggtcaatttgctgttacgcttctacgacgttgagagcggcgaagttcgtattgatgataagcccattcataaagtgcagcaggacagtttgcgcgcgaacattggcatggtgactcaggacacttctttgctgcatcgctcagtacgtgacaacattttgtatgggcgccccgatgccagtgaagaggacttaatgaaggcggtgcgtcaggcacattgtgaggaatttattgcagacttaagtgacagcaagggtcgtaccggtctggatgcccatgtcggcgagcgcggcgtgaaactctcaggtggtcaacgccagcgaattgctattgcccgagtcatgctaaaagatgcacccattctgattctggacgaagcaacctcagcgctggattcggaagtagaaaacgccattcaggaaaacctgtataagctcatgcagggcaaaacggttattgctattgcccaccgcttatccactattgcagctatggacaagctggtagtgatggatcagggggagattattgagcagggcagccacgaacagctgcttgctcaggatggactctacgccaaattgtggcgccaccagtccggtggctttttagcggaagaagcttaa

SEQ ID NO: 34382 - protein, 610 aa, Idiomarina loihiensis L2TR
MFSWFERRLNPFPTEEPTQAPTGFFAFCWHFTKGATPFIAVTAALMAAIAIAEVWLFGFLGQIVDWLSAQDKETLLNDQFWPLAGMSALVLVGLPLLVWFHSMLTHQTLLGNFPMRIRWLGHRYLMKQSMSYYQDEFAGRVATKLMQTSLALRQCIMTFIEVVNYVAVYFLGMFVIIGNADWRMMLPLACWLILYALLLRYFVPKLGKISAEQADARSNMTGRIVDSYTNIQTVKLFSHSLREASFAHEGMDTFLGTVHKQMRLVTQLYGFLYFINCALLFSSAATAIVLWMDNAVTLGAVAVVIGLVLRLFGMSQMVMWQMSTLFESIGTVQDGIGSIAVPQRIIDEPNAPALNVTSGDINFDHVRFHYGKGHGVMDDFNLHIKSGEKVGIVGRSGAGKSTLVNLLLRFYDVESGEVRIDDKPIHKVQQDSLRANIGMVTQDTSLLHRSVRDNILYGRPDASEEDLMKAVRQAHCEEFIADLSDSKGRTGLDAHVGERGVKLSGGQRQRIAIARVMLKDAPILILDEATSALDSEVENAIQENLYKLMQGKTVIAIAHRLSTIAAMDKLVVMDQGEIIEQGSHEQLLAQDGLYAKLWRHQSGGFLAEEA

SEQ ID NO: 34383 - DNA, 1971 bp, Silicibacter pomeroyi DSS-3
  CDS (1)..(1971)
atgtcttcacaagcccgagaccgccccgaacacttgcaccctgcccgccacctgcttaaatgggccggtcatggtttctatcctgccccctctcccccacatgaaggccgaaagatgagcgctaaaccgatgtcctcgcgcgagctggtgggctggctctggcagaattatctaaaaagccggatgggcctcttgggcgtggcctttctgttcatgctgctcgaaggttcgatggtcggcgcgatcagctacatgatgcagccgatgttcgacgagatcttcgtcaacggcaatggcgatgcgctggtctgggtcagcctcgcctttctggtgatcttctcgctgcggggcatggccagcgtcgggcaaaaggtgctgctggcgcgcatctcgcaggaaaccgccgctcatctgcgcttcgacctgctcaaacggctgatccagcaggataccgcctttcaccagacccatccgcccggcttcctgatccagcgggtgcaggtggatgttggctcggtcaatcaggtctggcaggtgatcatcaccggcgcgggcaaggacctggtctcgctggtggtgctgatcggggtggcgatcaatgtcgatctgatctggacgctggtcatgctggtgggcgtgccgatcgcgtttctgccgattgcggcggcacaacgatatgtgcgcaagaaggccgcaatggcgcgcgaccagggcgcgacgctggcgacccggctggacgagattttccacggcatcgtgccgatcaagctgaacgcgctggagcgctatcagctggaccggttcgacggccatatgaagacctatgtccgctccgaggtgcgcgcctcgttcgggaccgcctcgatcaccggtttggtggatgtgatggcgggcctgggtttcatgggcgtgctgctttatggcggcgccgagatcatcgccggggaaaagagcgttggtcagttcatgagcttcttcaccgccatcgggctcagctttgacccgatgcggcgactggcctcgatctcgggcacctggcaggcggcggcggcggcgctggagcggatcaaggatctgctcgacgcgccgatcctgctgctgtcgccgcccaaaccggtggccgcaccctcgggcctgccggcgatccggcttcaggatgtctcgctctcctatggcgacgcgcaggtgctgcgcaacctgtcgctgacggccgaggccggcaagaccaccgcgcttgtgggcgcatcgggggcgggaaaatcgaccattttcaacctgctcacccggctcgtcgacccgcaatcgggcgccgtcaccgtgggcgacgttgcggtcgagaagatgtcgctcgaaaaactgcgcagtctgttctcggtggtcacgcaagaggcgcttctgttcgacgaaaccctgcgcgaaaacatcctgctggggcgcaccgatgtcagcgaggcacggctgcaagaggtgctggatgccgcccatgtgtcggatttcctgcccaagctggaacatgggctcgaaactttggtggggccgcgcggctcggccctgtcgggcggacagcggcaacgggtggtgatcgcgcgcgccctgctgcgcgacacgccgatcctgctgctggacgaagcgacctcggcgctcgacgcgcaatcggaaaaggtggtgcaggccgcgctcgatcaactgtcgggcgggcgcacgaccctggtcatcgcgcaccggctgtcgaccatccgcaacgccgacaagatcgtggtgatggagcgcggcgaagtggtggatcagggcagccatgaagagttgctggctcgcggcggcatctatgccgatctttaccggctgcaattcgaaggcggcaaggaactggtggacccggtcggcgttgctgcccaggaacgccccggcaccgaagaaccgcaacgcgcctcggcctggtaccggcggctgatgtcacgcatcctgggctaa

SEQ ID NO: 34384 - protein, 656 aa, Silicibacter pomeroyi DSS-3
MSSQARDRPEHLHPARHLLKWAGHGFYPAPSPPHEGRKMSAKPMSSRELVGWLWQNYLKSRMGLLGVAFLFMLLEGSMVGAISYMMQPMFDEIFVNGNGDALVWVSLAFLVIFSLRGMASVGQKVLLARISQETAAHLRFDLLKRLIQQDTAFHQTHPPGFLIQRVQVDVGSVNQVWQVIITGAGKDLVSLVVLIGVAINVDLIWTLVMLVGVPIAFLPIAAAQRYVRKKAAMARDQGATLATRLDEIFHGIVPIKLNALERYQLDRFDGHMKTYVRSEVRASFGTASITGLVDVMAGLGFMGVLLYGGAEIIAGEKSVGQFMSFFTAIGLSFDPMRRLASISGTWQAAAAALERIKDLLDAPILLLSPPKPVAAPSGLPAIRLQDVSLSYGDAQVLRNLSLTAEAGKTTALVGASGAGKSTIFNLLTRLVDPQSGAVTVGDVAVEKMSLEKLRSLFSVVTQEALLFDETLRENILLGRTDVSEARLQEVLDAAHVSDFLPKLEHGLETLVGPRGSALSGGQRQRVVIARALLRDTPILLLDEATSALDAQSEKVVQAALDQLSGGRTTLVIAHRLSTIRNADKIVVMERGEVVDQGSHEELLARGGIYADLYRLQFEGGKELVDPVGVAAQERPGTEEPQRASAWYRRLMSRILG

SEQ ID NO: 34385 - DNA, 1830 bp, Francisella tularensis subsp. tularensis
  CDS (1)..(1830)
atggctaatatgattgataaaatagatcttaagtctcagggatctagtaatctaagtggagaaatgacaaaccatcagaaagtaggcactctttataaaaggttgttactccaagttaagcatttatggcattttctgcttttggctgctatcggaagtatatttttctcagcggctgatgcctcaatgatatatctgattaatccgattttgaattatggttttggtcctggtggcgggattactaaacaaagtgctactatactaatgcttatgggtgttggcatggttggtttactagcgttaagatcagtaggttcatttgtgtcacagtactttataggttctttaggtcaaaaagttgtttataaatttaggaaagatatttataaaaggttaatggatctaccagctagtttctttgataagcactcaacaggacagattatctcaagattattatacaatgttgatcaggttatagaggctacttctacagcaattataacagttgttcaggatggaacttttgttattgggctaattgttgtaatgtttgtctcaagctggcaattgtcactatttttaatagttgtcggaccatttctgggattatttatatctataattaataaaaagtttaggaatttaagtagaaatactcagtcatcaatgggtaatgttacgcatactgctgaagagacgattagaaactataaagaaataagaatttttggtgcgcaacaaaaacaacaaaataaattctttaaaaatcttgattatacatactcacagcaaattagaacgatagcattagatgctctgacatcaccagtaatacaaattatagcttcattagttttggctttttcattatttacgatagctatatttggtactaatgagggcgatggttcatcttggttaaccgcgggttcttttgcttctttctttgcagctgcagcagctattctaaaaccgattaagaatcttactaaagtaaatgttgttatccaaaaggcggtagcagcaactgaggatatattttatatccttgattatccagcagagaaagaaactggtagtaaggaattagctaaagttgatggtaatgtaactatcaaagatctaagttttgcttttggtgaacataaagtacttagtggcgtaagtgttgatatcaaagcaggtcagactgtagcatttgttggtaagtcaggaagtggtaaaactactttgaccagtattatatcgagattttacactcagcatgaaggtgagattcttcttgatggagttgatacaagagaattaactttggagaatctaaggtcgcacttgtctatagtttcacagaatgttcatttatttgatgatacagtttataataatatagcttttggcctttcaagagaggtttccgaagaagaagtaatcgatgcgctaaaaagagctaatgcatatgagtttgtccaagaattatctgatggtattaatactaatataggtaataatggttcaaagctatcaggaggtcagcgtcaaagaatatcaatagcaagagctttgttaaaaaatgctcctgtattaatatttgatgaggcaactagtgctcttgataatgaatctgagagagtagtacagcaagctcttgagagtttgactaaatcatgtactactatagttatagctcatagacttagtaccgttgaaaatgctgataaaattgtcgtgatggatggtggtagggttgttgaaagtggtaagcatcaagaattgctagagcaaggtggactttatacgaggctctatcaatcaggacttcaatag

SEQ ID NO: 34386 - protein, 609 aa, Francisella tularensis subsp. tularensis
MANMIDKIDLKSQGSSNLSGEMTNHQKVGTLYKRLLLQVKHLWHFLLLAAIGSIFFSAADASMIYLINPILNYGFGPGGGITKQSATILMLMGVGMVGLLALRSVGSFVSQYFIGSLGQKVVYKFRKDIYKRLMDLPASFFDKHSTGQIISRLLYNVDQVIEATSTAIITVVQDGTFVIGLIVVMFVSSWQLSLFLIVVGPFLGLFISIINKKFRNLSRNTQSSMGNVTHTAEETIRNYKEIRIFGAQQKQQNKFFKNLDYTYSQQIRTIALDALTSPVIQIIASLVLAFSLFTIAIFGTNEGDGSSWLTAGSFASFFAAAAAILKPIKNLTKVNVVIQKAVAATEDIFYILDYPAEKETGSKELAKVDGNVTIKDLSFAFGEHKVLSGVSVDIKAGQTVAFVGKSGSGKTTLTSIISRFYTQHEGEILLDGVDTRELTLENLRSHLSIVSQNVHLFDDTVYNNIAFGLSREVSEEEVIDALKRANAYEFVQELSDGINTNIGNNGSKLSGGQRQRISIARALLKNAPVLIFDEATSALDNESERVVQQALESLTKSCTTIVIAHRLSTVENADKIVVMDGGRVVESGKHQELLEQGGLYTRLYQSGLQ

SEQ ID NO: 34387 - DNA, 1782 bp, Synechococcus elongatus PCC 6301
  CDS (1)..(1782)
atgccgaggtctgataggttgagacgtgaccccgtgttctcctcaacctccttgcagaagcacgccagctacaacctcctttggccttatctgcggccccaaacgaagaccattgttcaggccttgctctgtacgctggtcttcacggcattttggccgatcttggctttcttggcaggccagatggtcaatctgctggtacagggaaaagtatgggaactggcacggctggcagcgatcacgatcgtcggcttcctcatccataaagctgctcagtatggacaagactccttaatggcgaaggcggcgcttcagatcgcctacaacctgcgggtcaatacctatcgacacatccaaagcctgagcctcagctacttcgagaaggccaaaactggcgacctcacctaccggatgaccgaggacatcgatcgcgttggggaagtcgtcaataaggtctttcacgatgcgacaccctcgatcctgcagctgatcgtcgtgctcagctacatgatctatctgaactggacgctgacgctggcgatcctagtgattgcgccgatcatgggtttcttggtcggctggtttgggcagcaaatgttggtgtttccgcggcgcagtcagtcgcggatctcaaacttatcttctctgctaacggaagtctttagcggcattcgtctggtgcgggcctttgctgcggaaccctacgaaatcgagcgcttcagccgcgaggccgagcgtaaccgtgaggcccgctatcgcacggcttggctgcgggccattcaatatcccgtcattggctttctgcaggccgctagcattctcttcattgtcgtgctgggcagttggcagatttccacgggccagctcaacgggccaaatttgggcagctatgtggcagcgatcgccatgttaattgacccgatcgtccacctgatcgataacttcaacgagttcaagcaggggcaggcttcccttgatcgcattgatgaactgctgagcattgagcctgcggttcaagaggatccccagtcacggatgctgccgccgattaccggcaaggtggaattccgacaggtgagcttcagctatcgcagcgacagtgcgccggtgttgcgccaactcaatctgacggtcgaaccaggtgaagcggttgccttggttggggcttcaggtgcgggcaaatcaaccctcgtcaatctgatcccgcgtttctacgacccgcaggatggcgaaattttggtggatggcattcccattcgcagtgtcaccctcggcagtctgcggcgacagatcggtatcgtcccccaagagacaatcctgttctccggcacgattgcccagaacattgcctttggtcagaggcagttcgatcgcgctgccgtggaagaagccgcacgcattgccaacgcccatcaattcatcagccaaatgcccgatggctatgacacatgggtgggagagcgcggcgtcaacctctccggcggtcagcggcagcggctggcgatcgcccgcgcggtcttgctggatccacgcattttaattctggatgaggcgacttcggcgcttgattccgagtccgaaaccttggtgcaagaggccctagaacgggtgatgcagggacggacggtctttatcattgctcaccgtctggctacggttcgtaatgccagccgcatcttggtgatggagcgcggccagattgttgaggcaggcaatcacgatgcgctgttggcagaggctggccgctatgcgcgatactacgcacagcaatttcgtgcctga

SEQ ID NO: 34388 - protein, 593 aa, Synechococcus elongatus PCC 6301
MPRSDRLRRDPVFSSTSLQKHASYNLLWPYLRPQTKTIVQALLCTLVFTAFWPILAFLAGQMVNLLVQGKVWELARLAAITIVGFLIHKAAQYGQDSLMAKAALQIAYNLRVNTYRHIQSLSLSYFEKAKTGDLTYRMTEDIDRVGEVVNKVFHDATPSILQLIVVLSYMIYLNWTLTLAILVIAPIMGFLVGWFGQQMLVFPRRSQSRISNLSSLLTEVFSGIRLVRAFAAEPYEIERFSREAERNREARYRTAWLRAIQYPVIGFLQAASILFIVVLGSWQISTGQLNGPNLGSYVAAIAMLIDPIVHLIDNFNEFKQGQASLDRIDELLSIEPAVQEDPQSRMLPPITGKVEFRQVSFSYRSDSAPVLRQLNLTVEPGEAVALVGASGAGKSTLVNLIPRFYDPQDGEILVDGIPIRSVTLGSLRRQIGIVPQETILFSGTIAQNIAFGQRQFDRAAVEEAARIANAHQFISQMPDGYDTWVGERGVNLSGGQRQRLAIARAVLLDPRILILDEATSALDSESETLVQEALERVMQGRTVFIIAHRLATVRNASRILVMERGQIVEAGNHDALLAEAGRYARYYAQQFRA

SEQ ID NO: 34389 - DNA, 1842 bp, Mesorhizobium loti MAFF303099
  CDS (1)..(1842)
atgtcgaaatcctcgatccttcgcctgtcgctgtttcgcgatgtcgccgcgttcggcgccgtcatcgcccagatcggcgggcggcgaacctggacggcgctactgttcctgatcctcggcagcctgacggaaggcatttcgatcttgctgcttgtgccgctgctgcatctggtcggccgcgccgaccaggatttcgcggtgcggctgccgagcaatgatttcgtgcgctggctggtgccggacggaacgctgcagctgaccaccgtgctgtgcgcgctggtcgggctcgttgccgtgcaggcagcgttcaaccgcttcaagtcggtctacatggccaggcttctcttcgatttcatcaaccgtttgcgcatgaacctgttcgagagcatcggcaaggcgcgctggggcgtcttctcgcgcatgcgcagttccgatctcgaccatgccctgaccggcgacatcgatcgcgtccagggcgccgccttctcgcttttgatgctggtgcagatcgcggtgcttttggtgggctatctcgtgatctcgatgttcatctcgccggtcatgacggcgtttgcgatcgtcatcggcatcatgatgttcatagcgctgcagccgtttcgcgcgcgcgcgaccgctttcgggcgtgtcctgaccagcaaccgccaggatcagtaccgcacggtctcggagttcctcggcggcatcaaggtggccaagagcctgaatgtcgaggccagttatttcgcgcagttgcagtcgacgctggaaaagatgaaggccgacaacatcgactatgtccgcaacagttcgatcggcaccgccgtgttccaggtggcgagcgttgtgggcctcagcctgttcatctatgtggcgctggtccgcttcaacctgtcactggccgagattgtcgtgctgcttctcgtcttcatgcgcatcgcgccgcgcttcatggacatgcagacgcaggcccagcaggtgctgatcaacctgcccgcctatacggccatgcgcagcctgcaggcccgtttcgacgccgagcgcgagcccggccatgcccaatccgaggatatgcaaaagctgtcgctcgataccgggctgaacattcgcggcgtctccttcagctacgatgactcgggcaaggcggtggtgagcgacatcaccttcggcctgccggccggcaaggtcacggccctgatcggcccttcgggatcgggcaagagcacgatcgccgacatgctgctcgggctgctcgagccgaccgccggcaagatcctggtcgacggcgtcgagatcgatgccggcaatcgccggcgctggcgcgatcaggtggcctatgtgccgcaggacgtgttcctgctgcatgacacgatcgcggcgaacctgcgcctggccgcgccccaggccagcgacgacgatctgtggacagtactgcgcgccgcgcatgccggtgacttcgtcgaacggctcgaccagcggctcgagaccgtggtcggcgatcgcggcgtgcggctctccggcggcgagcgtcagcgcatcgcgctggcgcgtgcgttgctgcgcaagccgtcgctgctcatcctcgatgaggcgaccagcgcgctcgactggcagaaccagtcgctgatcgcccggtcgatcgacggattgcgcggcgcgatgaccatcctgaccatcgcgcaccggccatcgatgattgctttcgccgactgggtggtggcgatggaagacggccgcatcgtggaggtcggccagtatcagcgcctgaaggcgaagccggcgagccggctgtcgaggatgctgtcgggggaacagtcggaaaccgaacccgccaatgtggcctga

SEQ ID NO: 34390 - protein, 613 aa, Mesorhizobium loti MAFF303099
MSKSSILRLSLFRDVAAFGAVIAQIGGRRTWTALLFLILGSLTEGISILLLVPLLHLVGRADQDFAVRLPSNDFVRWLVPDGTLQLTTVLCALVGLVAVQAAFNRFKSVYMARLLFDFINRLRMNLFESIGKARWGVFSRMRSSDLDHALTGDIDRVQGAAFSLLMLVQIAVLLVGYLVISMFISPVMTAFAIVIGIMMFIALQPFRARATAFGRVLTSNRQDQYRTVSEFLGGIKVAKSLNVEASYFAQLQSTLEKMKADNIDYVRNSSIGTAVFQVASVVGLSLFIYVALVRFNLSLAEIVVLLLVFMRIAPRFMDMQTQAQQVLINLPAYTAMRSLQARFDAEREPGHAQSEDMQKLSLDTGLNIRGVSFSYDDSGKAVVSDITFGLPAGKVTALIGPSGSGKSTIADMLLGLLEPTAGKILVDGVEIDAGNRRRWRDQVAYVPQDVFLLHDTIAANLRLAAPQASDDDLWTVLRAAHAGDFVERLDQRLETVVGDRGVRLSGGERQRIALARALLRKPSLLILDEATSALDWQNQSLIARSIDGLRGAMTILTIAHRPSMIAFADWVVAMEDGRIVEVGQYQRLKAKPASRLSRMLSGEQSETEPANVA

SEQ ID NO: 34391 - DNA, 1743 bp, Pyrococcus abyssi GE5
  CDS (1)..(1743)
atggcggataaatcgtcactctctctgctcaaaaggttcattaaagaggcactctcggaaaggagaaccctagcaatagttgtggttagcatagtgggttcagcgttagcgaaccttgcgtctccctatattttgagggttgcaattgatcactacataatcccgggaaggtacaaggagcttggattcatcgcgatgctttacctcctttccctcgtagcccagtggttctttacaacactccaaacattctatacagaggttttcggtcaaaaagttctaaggaacttaagaagtcagctccacgagaagattctacaatctaacctggactttttcaagacgaaatcaacaggtgacctcgtttcaaggataataaacgacaccaacgtcgttaacgacgttctagtttcaggtctcctgggagggctgggtagtatcttaagcttagctggtattattgtggcgatgctattactggacgttaagctaaccctcgtcacgctaacgagcgttcccttgatggtgattattgccctctactttggaggcaagatgagaagggcctaccgcgagacgaggcaaaagattgcaaagatatctagcgttgttgaggagagcgttgctggaatagaaactattagagcattcggaaaagaaaaagacgtggaaaaggagttctcaaaggtctccacagagacgataaaggcctatttaagggtggcaatatacatgggaatattctggcccctgatgaacatagcaagcttgctctcagttatagtggttatagcctatgggggttatctagcttacaagggagcagtaagcataggtgtcgtggttgcgttcattcaatacgctcagagatttagggggcccataaacaatgtagttagtatgtacgatagtttacaatccgctttagcggcccttgagaggatatacgagattcttgacgatgaaaacgtcgaggattacgaaggaattagcgtcgagaagcttaagggcgaaatagagttcagaaacgtttggttcgagtacgagaagggaaggccagttcttaaggacgttaacctctacatcccaccggcctcgaaggtagctatagttgggaagactggagcaggtaaaacaacgatagccaacctcataatgcgcttctatgatccaacgaagggtgaaattctttacgatggaattgatggaaagaagattagtagaaagagcttaaggaagaggataggctacgttccccaggaaacatatctcttccctggaaccataatggagaatatcctaatggcaaatccggaggccaaggaagaggatgtaataagggtctgcaaggaacttggaatccatgacttcataatgaaactaccaaagggctatgaaacatcggccggagaagcagggaagctactctctgttggagaaaggcaacttatctccctcgccagggccatgcttaaggaccccgacatagtcatcttggacgaagctctgtcaagcgtcgatccgaagaccgagcaactcgttcagaatgctatgataaagctcatggagggaagaaccagtataataatcgcccacagactatcgataacccgctttgcagacaaagttatcgtcgtggatgatggaagaattgtggaggagggttctccaggagagcttttaagcagaaagggttacttttacaaactttacacttcccaaatgcaggaagttcctggatga

SEQ ID NO: 34392 - protein, 580 aa, Pyrococcus abyssi GE5
MADKSSLSLLKRFIKEALSERRTLAIVVVSIVGSALANLASPYILRVAIDHYIIPGRYKELGFIAMLYLLSLVAQWFFTTLQTFYTEVFGQKVLRNLRSQLHEKILQSNLDFFKTKSTGDLVSRIINDTNVVNDVLVSGLLGGLGSILSLAGIIVAMLLLDVKLTLVTLTSVPLMVIIALYFGGKMRRAYRETRQKIAKISSVVEESVAGIETIRAFGKEKDVEKEFSKVSTETIKAYLRVAIYMGIFWPLMNIASLLSVIVVIAYGGYLAYKGAVSIGVVVAFIQYAQRFRGPINNVVSMYDSLQSALAALERIYEILDDENVEDYEGISVEKLKGEIEFRNVWFEYEKGRPVLKDVNLYIPPASKVAIVGKTGAGKTTIANLIMRFYDPTKGEILYDGIDGKKISRKSLRKRIGYVPQETYLFPGTIMENILMANPEAKEEDVIRVCKELGIHDFIMKLPKGYETSAGEAGKLLSVGERQLISLARAMLKDPDIVILDEALSSVDPKTEQLVQNAMIKLMEGRTSIIIAHRLSITRFADKVIVVDDGRIVEEGSPGELLSRKGYFYKLYTSQMQEVPG

SEQ ID NO: 34393 - DNA, 1656 bp, Helicobacter pylori 26695
  CDS (1)..(1656)
ttgaaactctttttcaagcgttattctaaataccttaaagagcattataaaagttttatagtggttttattttcttctttagtggtggctttaagcacggcttgggggacttatttagtcaagcccactttagatgaaatttttatcaataaagacactcacatgctcaaaatcctgccttttttagtgattttggcgtatttgggtaagagtgggggcatgtatttaggcacttatttcaccaacttcattgggcttgatattgtcaaaaaaatacgcaacactatgctagaaagccttcttaaaatggaaatggatttttttaacaggacgaaaaagggcgaattgatcgcaaggatcaccaatgatataggtttgattagagcgagtttgtccaattacctttcagagagcataagagaggggctaacgattgttgggttagtgggggtggtgatctatcaaagccctaaattagcgttagtggggttagtcatcatgccgttagctgctattcctatcagtaaaatcattcgtaaggttaaaaaactcgctaaatcccatcaagagagtaacgccaaaatcaccgctcgtttgagtgaagtttttaacaacgtggaagcgattaaaatctctaatggcgaaaaattagagcataaggcttttgtgaaagaaaatgaagcgttttttaaaatcggtatcaaaaacatcgccgtggctgaaatttcttcgcctttaatggagtttttaggttcaatcgctatagcgctagtgatttatttaggggggaatgaagtgattagaggccatattagcgtgggggcgtttttttctttcattacggccctttttatgctctatacgccgattaaacgcttaactaggattgtttctaattttcaagaagccttagtcgctagcgacaggatccatgagattttagaaagagagccggctattgttgatggggaattgacgctaaataacgccatacacaccatagaatttaaaaaggtatggctggcttatacgctagacaatcaagagcgttatgttttaaacgatattagtttgaagttccaacaaaatgaaatcatcgctttaaagggcgaaagcgggagcggtaaaagctcattagtgaatctgatcttacgcctttatgagccaagcaaaggcgaaattttcatcaacgatcaaaaaatagagagcatcactcaaaaatccttaagagaaaagattagcgttgtcactcaaagggtgtttatttttaacgggagcgtggctgaaaatgtggcgtatggtttagaaattgatgaggtaaaaatcaaagaatgcctaaaaaaagctcaagccttagattttgttgaaaaaatgcctcatgggatagagagcgttttagatgaatttggcgctaatcttagcggcggccaacgccaaagaatcgccattgcaagagctttgtataaagacgttcaagttttaatctttgatgaagccacttccgctttagacaataacacagaagagagcgttaaacaaagcattttagaattgaaacaaaaccgcttgatcattcttatttcgcacaacccaagcacgctaaaattagccactaagcatgtgaaattagagcatgggcgtttgacagaatgctaa

SEQ ID NO: 34394 - protein, 551 aa, Helicobacter pylori 26695
MKLFFKRYSKYLKEHYKSFIVVLFSSLVVALSTAWGTYLVKPTLDEIFINKDTHMLKILPFLVILAYLGKSGGMYLGTYFTNFIGLDIVKKIRNTMLESLLKMEMDFFNRTKKGELIARITNDIGLIRASLSNYLSESIREGLTIVGLVGVVIYQSPKLALVGLVIMPLAAIPISKIIRKVKKLAKSHQESNAKITARLSEVFNNVEAIKISNGEKLEHKAFVKENEAFFKIGIKNIAVAEISSPLMEFLGSIAIALVIYLGGNEVIRGHISVGAFFSFITALFMLYTPIKRLTRIVSNFQEALVASDRIHEILEREPAIVDGELTLNNAIHTIEFKKVWLAYTLDNQERYVLNDISLKFQQNEIIALKGESGSGKSSLVNLILRLYEPSKGEIFINDQKIESITQKSLREKISVVTQRVFIFNGSVAENVAYGLEIDEVKIKECLKKAQALDFVEKMPHGIESVLDEFGANLSGGQRQRIAIARALYKDVQVLIFDEATSALDNNTEESVKQSILELKQNRLIILISHNPSTLKLATKHVKLEHGRLTEC

SEQ ID NO: 34395 - DNA, 1665 bp, Aquifex aeolicus VF5
  CDS (1)..(1665)
atgaataattacagatggctctataacctatctaaaccttacattctcttattcttactctcgctcctcggatcccttattcagtcctctggagccacggctttagccctgctggtcaagcaggttgtggataacgtattaatcctcaaaaatcaggaagagcttttaaagtacgttctcctcttgttctcaagtgccctaataatacaggtgggcttctttatctcctcctttacgctatcttacatatccgaaaaggtaatatactccctcagaaacgagatttacgaaaagctcctgtacgcacccataaactacgttctctacacgccttcgggggagctcataagcaggatagtgagtgacttagaacagttaaggcaggtttttgcagattacataccgaagctactgagagaacctttagtagttctcgcgctcttcggtgtcctcctctacagggacctattcctcacccttttaatcctcctcttatttcccgtaatggctctatttactaagtacttttctgagaaaaagaagaaacacctctcaagacagagggaaaaggttgcactcctgacaagtatactctcggaaaccttgagaggatttgagaacataaaactcttccttgcggaaaatagatttataaaggacttcaaagaactgtctttcaggattttcagatcctctgtgaagataaacctttatgtggtgggaaatacggtcattaattacacctttggttacgccgtagtttccttgatcctctttgctggcggttacagaatagtaaagggagacataaccactggagactttatttccttcctgacagcactctttatgattcaaaaacccttaatggaaactcagaaggcgataatgaacctgaggggctcagcacctatttttgaaaggataaggaatctcttgaacgttccagaagaaaaggacggaagtgaagagtttgaaggtttgaaggaaaggattgagttcagagacgtgagcgtaaagattaacagaaaggaaattctcaaaaacgtaaatctttcagtttacagaggttcaaaagtcgggattaaagggcacacggggagcggaaaaagtactttcgttaaattaattccaagactccttgagtacgaaggggagatttttgtggaccacacggagctgagggagtttaaactcaagagtttgagggaaaaaataggatttttgagtcaggaagttatggtatttcgcggaagcgtcagggagaacctgctcatagcgaaaccagacgctacggaagaagaaatgttaaaggctctagagcttgcaaagtgtgactttgttctcaattcacctgaagggcttgacaagttcttagaagagggtgggaagaacctttctggcggggaaaaacagaggcttgcccttgcgaggatattcctcaaaaacccggagatagttatcttggacgaggctacatccgcattggacccgaaaacggaagaagaagttatatacaacctttataaatttttaaaagagaaaacaattttcgcggttgcacacaggccctttatttttaacttctgcgacgtgatacttgagtttgaaggggggagacttaaagagttttccacttctaaagaaaattctattaaattataa

SEQ ID NO: 34396 - protein, 554 aa, Aquifex aeolicus VF5
MNNYRWLYNLSKPYILLFLLSLLGSLIQSSGATALALLVKQVVDNVLILKNQEELLKYVLLLFSSALIIQVGFFISSFTLSYISEKVIYSLRNEIYEKLLYAPINYVLYTPSGELISRIVSDLEQLRQVFADYIPKLLREPLVVLALFGVLLYRDLFLTLLILLLFPVMALFTKYFSEKKKKHLSRQREKVALLTSILSETLRGFENIKLFLAENRFIKDFKELSFRIFRSSVKINLYVVGNTVINYTFGYAVVSLILFAGGYRIVKGDITTGDFISFLTALFMIQKPLMETQKAIMNLRGSAPIFERIRNLLNVPEEKDGSEEFEGLKERIEFRDVSVKINRKEILKNVNLSVYRGSKVGIKGHTGSGKSTFVKLIPRLLEYEGEIFVDHTELREFKLKSLREKIGFLSQEVMVFRGSVRENLLIAKPDATEEEMLKALELAKCDFVLNSPEGLDKFLEEGGKNLSGGEKQRLALARIFLKNPEIVILDEATSALDPKTEEEVIYNLYKFLKEKTIFAVAHRPFIFNFCDVILEFEGGRLKEFSTSKENSIKL

SEQ ID NO: 34397 - DNA, 1656 bp, Helicobacter pylori J99
  CDS (1)..(1656)
ttgaaactctttttcaggcgttattctaaataccttaaagaacattataaaagttttatagtggttttattttcttctttagtggtagctttaagcacggcttgggggacttatttagtcaagcccactttagatgaaatttttatcaataaagacactcacatgctcaaaatcctgccttttttagtgattttggcgtatttgggtaagagtgggggcatgtatgttggcacttatttcactaactttattgggcttgatattgtcaaaaaaatacgcaacgccatgttagaaagccttctcaaaatggaaatggatttttttaacaggactaaaaaaggcgaattgatcgcaaggatcaccaatgatataggtttgattagagcgagtttgtccaattacctttcagagagcctaagagaagggctaacgattgtgggattagtgggggtggtgatctatcaaagccctaaattagcgctagtggggctagtgatcatgccgctagccgccattcctattagtaaaatcattcgtaaggttaaaaaactcgctaaagcccaccaagagagtaacgccaaaatcaccgctcgtttgagtgaagtctttaacaatgtggaagcgattaaaatctctaatggcgaaaaattagagcatagggcttttgtgaaagaaaatgaagcgttttttaaaatcggtatcaaaaacatcgccgtggctgaaatttcttcgcctttaatggagtttttaggctctatcgctatagcgttagtgatctatttaggggggaatgaagtgattaagggtcatattagcgtgggggcgtttttttctttcatcacggccctttttatgctctatacgccgatcaaacgcctaactaggattgtctctaattttcaagaagccttagtcgctagcgataggatccatgagattttagaaagagagccggccattattgatggggaattgacgctggatgatgccatacacaccattgaatttaaaaaggtatggctggcttatgcgctagaagatcaagagcgttatgttttaagcgatattaatttgaaattccaacaaaatgaaatcgtcgctctaaaaggcgaaagcgggagcggcaaaagctcattagtgaatctgatcttacgcctttatgagccaagcaagggcgaaattttcatcaatgatcaaaaaatagagagcatcactcaaaaatccttgagggaaaagattagcgttgtcactcaaagggtgtttatctttaacgggagcgtggctgaaaatgtggcgtatggcttagaaattgatgaaataaaaatcaaagaatgcctaaaaaaagcccaagccttagattttgtggaaaaaatgcctcatgggatagagagcgttttagatgaatttggcgctaaccttagcggcgggcaacgccaaagaatcgccattgcaagagctttgtataaagacgctcaagttttaatctttgatgaagccacttccgctttagacaatcacacagaagagagcgtcaaacaaagcattttagaattgaaacaaaaccgcttgatcattctcatctcgcacaacccaagcacgcttaaattagccactaagcatgtgaaattagagcatgggcgtttgatagaatgttaa

SEQ ID NO: 34398 - protein, 551 aa, Helicobacter pylori J99
MKLFFRRYSKYLKEHYKSFIVVLFSSLVVALSTAWGTYLVKPTLDEIFINKDTHMLKILPFLVILAYLGKSGGMYVGTYFTNFIGLDIVKKIRNAMLESLLKMEMDFFNRTKKGELIARITNDIGLIRASLSNYLSESLREGLTIVGLVGVVIYQSPKLALVGLVIMPLAAIPISKIIRKVKKLAKAHQESNAKITARLSEVFNNVEAIKISNGEKLEHRAFVKENEAFFKIGIKNIAVAEISSPLMEFLGSIAIALVIYLGGNEVIKGHISVGAFFSFITALFMLYTPIKRLTRIVSNFQEALVASDRIHEILEREPAIIDGELTLDDAIHTIEFKKVWLAYALEDQERYVLSDINLKFQQNEIVALKGESGSGKSSLVNLILRLYEPSKGEIFINDQKIESITQKSLREKISVVTQRVFIFNGSVAENVAYGLEIDEIKIKECLKKAQALDFVEKMPHGIESVLDEFGANLSGGQRQRIAIARALYKDAQVLIFDEATSALDNHTEESVKQSILELKQNRLIILISHNPSTLKLATKHVKLEHGRLIEC

SEQ ID NO: 34399 - DNA, 1833 bp, Vibrio cholerae O1 biovar eltor str. N16961
  CDS (1)..(1833)
atgcgcatcactaaaataggatgcattctcattaatatgacgtatttcaacgacactattagccgctcttggctgataactcaagtaaaaaaacatcgcgccaaactgttgtttgctaactttattgccgtcgtcgcgacgctaatcagtgttcctatcccactgctcatgccgttaatggtggatgaagtgctgctcaatcatccggcaaaaggtgtggaggtgatgaaccagttcctgccacaagggtggcagaccgcaacgggttacatcatgctgactttgctgatggtggtggtgatgcgtattgccagtcagttgttgaatatcctacaaagtcgtcagttcaccttggtttctaagaccatcacttacgaaatgcgtcggaagatgattgaaaagctagggcggatcagtattcgtcagtatgaaacgcgcggcagtggcgggattaacgctcacctcatcacagatattgaaaccatcgaccaatttattggctcgacactgagtaaatttttgatttctttgcttactgtgattggtaccgccattgtattgctttggttggagtggcgacttggcctgtttattctgttagtgaacccgattgttatctacttttctcgaatgctgggcagccaagttaaacatttgaaaaaacgcgaaaaccaagcgtttgagcgttttcaaaaccgcttagtggaaacgttagatggtatctatcagttgcgtgccgcaaacaaggagcgcgagttcctcaaccgcctcatcagcgatgcggacgcagtacgcgaaaacgctgacaaatacgcatggcaatctgaagctgctggtcgcctctccttcttactgtttttactcggttttgaactgtttcgtgctgtggccatgttaatggtggtgttcagtgacctcaccataggccagattttcgcggtatttggctacttgtggtttatgctaagcccggtgcaagagctgttgggtattcagttttcttggtatgccgctaaggccgctttgaaaagaatcaatagcttattagagctagaagaagagtaccgacccatcagcaaagtcaatccctttactcagctgggagaagtcgatattgagatcaacaatatccatttctcctacgatggtgaaagccaagtcctgaatgatttgtcacttcatatcccagcggggaaaaaggtggcgttagtcggagccagtggcggagggaaatcgacgctgattcagctcttaattggcgtttatcgcgcgcaaagtggcgcaatccgctttaatggacaacactgtgatgacattagctttgacgtgattcgcgatcaaattgccgttgttttacaacaacctatactgtttaatgacactttgcggcataatctgacccttggtggtcaatttagcgatgatgtcttgtggcaagcgttggacatcgcccaactgcaagatgtgatcaccaaactcgaccaagggttagagagccaaattggtcgtaatggcattcgattgtcaggcggacaaagacagcggctagcgattgcgcgtatggtgctgagtaatccaaaattcgttattttggatgaagccacttccgccttggatacggctactgaagccgcattgcaccttgcgttgtcaaagtttttgcatggtcgaactaccttgattgttgcccatcgcctctcagcggtgaaacaagcggacttaatttatgtattggaagatggacatgtcagccagtcaggaactcaccacgagttactcgaacaagaaggcttgtaccaaaccctttatgggagtgttcagtcgcagcactaa

SEQ ID NO: 34400 - protein, 610 aa, Vibrio cholerae O1 biovar eltor str. N16961
MRITKIGCILINMTYFNDTISRSWLITQVKKHRAKLLFANFIAVVATLISVPIPLLMPLMVDEVLLNHPAKGVEVMNQFLPQGWQTATGYIMLTLLMVVVMRIASQLLNILQSRQFTLVSKTITYEMRRKMIEKLGRISIRQYETRGSGGINAHLITDIETIDQFIGSTLSKFLISLLTVIGTAIVLLWLEWRLGLFILLVNPIVIYFSRMLGSQVKHLKKRENQAFERFQNRLVETLDGIYQLRAANKEREFLNRLISDADAVRENADKYAWQSEAAGRLSFLLFLLGFELFRAVAMLMVVFSDLTIGQIFAVFGYLWFMLSPVQELLGIQFSWYAAKAALKRINSLLELEEEYRPISKVNPFTQLGEVDIEINNIHFSYDGESQVLNDLSLHIPAGKKVALVGASGGGKSTLIQLLIGVYRAQSGAIRFNGQHCDDISFDVIRDQIAVVLQQPILFNDTLRHNLTLGGQFSDDVLWQALDIAQLQDVITKLDQGLESQIGRNGIRLSGGQRQRLAIARMVLSNPKFVILDEATSALDTATEAALHLALSKFLHGRTTLIVAHRLSAVKQADLIYVLEDGHVSQSGTHHELLEQEGLYQTLYGSVQSQH

SEQ ID NO: 34401 - DNA, 1860 bp, Vibrio cholerae O1 biovar eltor str. N16961
  CDS (1)..(1860)
atgtttaagctatttgaaggtttcaccgacccttttcccaaaggtgaaccccaacgcccacccaacactttgtgggccttttgtcgccactacactcgcgggtttgaaaaaccattgatcgtgatggcgttactcagcacggcgatcgcgattatcgaggtctctctgtttggctttatgggccaactggtggactggctttccactagctcgccagacacatttttaaccgaaaaccagagcactttgattgggttaggcttattggtattggtcggtatgccgctactgatcgccttctattcactactgatccaccaatctttgctcggtaactacccgatgtcgatccgttggttggcgcaccgctatctgctcaagcaaagcgtgtcgttttatcaagacgagtttgcagggcgcatctcaaccaaagtgatgcaaacggcgctcgcggtacgtgaaaccgtgatgaaaagtctcgatgtgtttgtgtatgtgatggtttatttcaccgcgattgtagtgattttggcgcaggctgattggcgcttaatgatcccgatgctgatttggctggcgatttacgttacggtgcaaatgtattacgtgcctaagctgaaaaaagtcgcttccgagcaagccgatgcccgctcactgatgagcggccgtatcgtcgatagctacaccaacattatgactgtaaagctgttttcgcacagtcaacgtgaaacgcaatacgccgaagaaggcatgcaagattttctgggcaccgtccatcgccaaatgcgtttggtgaccggttttaatatttgggttgaaatggccaactacttattggtgtttaccattgctgccctgtcgatttatctgtggatcactagcgccatcagcgtcggtgccattgcggttgcggtcagtttatccttgcgtatcaacggcatgtctaagtggatcatgtgggaagtcagcgccctgtttgaaaacatcggtaccgttgtggatggcatgaccatgctgggcaaacccatcaccgtcaccgacaaacctgacgcgaaacccttggtggttaagcatggtggcattacctttgatgatgtgagcttccactacggtgaaaacaaaggcgtgatcaaccatctcaatctcaacattaaaccgggtgaaaaagtcggtttagtggggcgctctggagccggtaaatcgaccttggtgaacctgttactgcgttttcatgatgtagagagcggccgaattctcattgatggtcaacccatttcggaagtgacccaagaatcgctgcgcagcaaaatcggcatggtgacacaagatacgtcactgctgcaccgctccattcgcgacaacattttgtacggcaatccgaacgccaccgaggagcagcttttgaaagcaacggcgcaagcccacgctcatgagttcatcctcggtttgaccgatccgcacggcaacagtggttacgacgcacaggtcggtgaacgtggcgtcaaactctctggtggacaacgtcagcggattgcgatctctcgcgtactgctcaaagatgcgccactgttggtgctggatgaagcgacttccgcgctcgattctgaagtggaagcggcgattcaagagagcctcaatgagctgatgcagggcaaaaccgtgattgcgattgcccaccgtctgtcgaccatcgcagcgatggatcgcctgatcgtgctcgataaaggccaaattgttgagcaaggtactcaccaagagttgattgcgcaaaacggcatttatgctcacctgtgggcgcatcaaaccggtggctttatcggctgtgatgaagacgaagtagaagaagccatactggcataa

SEQ ID NO: 34402 - protein, 619 aa, Vibrio cholerae O1 biovar eltor str. N16961
MFKLFEGFTDPFPKGEPQRPPNTLWAFCRHYTRGFEKPLIVMALLSTAIAIIEVSLFGFMGQLVDWLSTSSPDTFLTENQSTLIGLGLLVLVGMPLLIAFYSLLIHQSLLGNYPMSIRWLAHRYLLKQSVSFYQDEFAGRISTKVMQTALAVRETVMKSLDVFVYVMVYFTAIVVILAQADWRLMIPMLIWLAIYVTVQMYYVPKLKKVASEQADARSLMSGRIVDSYTNIMTVKLFSHSQRETQYAEEGMQDFLGTVHRQMRLVTGFNIWVEMANYLLVFTIAALSIYLWITSAISVGAIAVAVSLSLRINGMSKWIMWEVSALFENIGTVVDGMTMLGKPITVTDKPDAKPLVVKHGGITFDDVSFHYGENKGVINHLNLNIKPGEKVGLVGRSGAGKSTLVNLLLRFHDVESGRILIDGQPISEVTQESLRSKIGMVTQDTSLLHRSIRDNILYGNPNATEEQLLKATAQAHAHEFILGLTDPHGNSGYDAQVGERGVKLSGGQRQRIAISRVLLKDAPLLVLDEATSALDSEVEAAIQESLNELMQGKTVIAIAHRLSTIAAMDRLIVLDKGQIVEQGTHQELIAQNGIYAHLWAHQTGGFIGCDEDEVEEAILA

SEQ ID NO: 34403 - DNA, 1806 bp, Bacillus halodurans C-125
  CDS (1)..(1806)
atgtcagaaggaaaacgtagagctcgctttcattatgcgagcgatcaagtgattgagaaaccatttaactgggcacagatgatgcgcttgcttacgtatatgaagccgtatgcagcatcactgcttccgaaaacggttgttgcgatgctgatcgtgaccgcagttcggctgttcgtgccgatcatcattggtgtgttagcgattgatcatgcgattgctgcaggggatctgaacgtcatgtatcagttggcagctcttgttttagggttgtatagtatttcatatgtggcaaacgtgttccgaattcgctggatgaatgagatcggacagcatgtgatttatgatattcgcgctgatctgtttaatcatatccaacgtctctcccaccgtttttttgatcaacgttcggcagggtccattcttgtccgagtcgtcaatgatgtgaactcgttgcaggatctatttacgaacggggttatcaacttattgatggatatcgtcattctgctcggaattatcgtgattttgttctcgttaagtccagagctggcgattttaatcttaatcgtcctgccgattatgtttttcatatcaacgaagctacggagaaacattcgcagatcgtggcagacggtgcgtctccgtcaatcaaagctcaattctcatttaaatgaaagcattcaaggcattcgtgtcactcaagccttttcacaagaaaaagaaaatatgcgtttttttcgtgacatcaacgaggaaaactttcaatcttggaaagacgccacgagaatgaatgcattattcaggccgtttgtggagatggcgagtgcgatcggggccgttgtcctcatttggtatggggtgagcttgatccagtcggaggtactaacggttggggtgttcgtctcctttgcattctacttagggatgttctgggagccaatctcaaggcttgggcaagtatacaaccaactgcttgtcgggatggcttcgtccgaacggatttttgaatttttagatgaaaagccgtcggttccagaaaaagagaatgcggtcaccttacatgagatgcgtggtcatgtgacgtttgagcaggtggaattttcgtatgatgacaaacggaaggcattaaatgacatcagtttcgaaataaaagcagggcaaaccattgcccttgtaggtcatacaggttcagggaaatcaacgattgtcaatttaattagccgcttctatgacccaacggccggtgtcatcaaaattgacggtgtggacttgcgtgacattcagctgaatagccttcgaacaaatgtgagctttgtgttgcaagatacgttcattttcgccggcacaattatggaaaacattcggttcggccggccgacagcgaccgacgaagaagtaaaggccgcagcagaagcgatcggggcaaatgattttattgaacgcttgccaaacggatacgacaccgaagtggaggaaaaaggaaatgtcctttcggttggtgaacggcagctactttcctttgctcgtgcactattagccgatccaaaaattttgattttagatgaggcgaccgcaagcattgatactgaaaccgaattgaaaattcaagctggtttaaagaaactacttcacgatcggacggccattatgattgcccatcggttgtcgaccattcgtgatgccgatcaaatcatcgtgctcgagcaaggggatattattgagcagggaacacatagtgaattaatggacgctcgtggaacgtattacggtctagtaaaagcacaatatgaagcgtcggctggctag

SEQ ID NO: 34404 - protein, 601 aa, Bacillus halodurans C-125
MSEGKRRARFHYASDQVIEKPFNWAQMMRLLTYMKPYAASLLPKTVVAMLIVTAVRLFVPIIIGVLAIDHAIAAGDLNVMYQLAALVLGLYSISYVANVFRIRWMNEIGQHVIYDIRADLFNHIQRLSHRFFDQRSAGSILVRVVNDVNSLQDLFTNGVINLLMDIVILLGIIVILFSLSPELAILILIVLPIMFFISTKLRRNIRRSWQTVRLRQSKLNSHLNESIQGIRVTQAFSQEKENMRFFRDINEENFQSWKDATRMNALFRPFVEMASAIGAVVLIWYGVSLIQSEVLTVGVFVSFAFYLGMFWEPISRLGQVYNQLLVGMASSERIFEFLDEKPSVPEKENAVTLHEMRGHVTFEQVEFSYDDKRKALNDISFEIKAGQTIALVGHTGSGKSTIVNLISRFYDPTAGVIKIDGVDLRDIQLNSLRTNVSFVLQDTFIFAGTIMENIRFGRPTATDEEVKAAAEAIGANDFIERLPNGYDTEVEEKGNVLSVGERQLLSFARALLADPKILILDEATASIDTETELKIQAGLKKLLHDRTAIMIAHRLSTIRDADQIIVLEQGDIIEQGTHSELMDARGTYYGLVKAQYEASAG

SEQ ID NO: 34405 - DNA, 1650 bp, Pseudomonas aeruginosa PAO1
  CDS (1)..(1650)
atgaccaatcccaagcgcggcgccattcgcgaactgctcgccctgctcaggccctttcgagcgatcgtggccgtctccatagcactgggcatggccggcggccttgccatcaccctgctgctggccagcatcaacaacgccttgcactcggaaaacggcctcggccaaggcgtactgctgtcgttcggcggactctgcctgctggcattggtcagttcgatcgtctccgacatcggtaccagctacgtcggccaacacatcatcgcgaagctgcgcaaggaactcggcgagaaagtcctctcggcgcccatcgagcagatcgagcgctaccggacccaccgtctcattccggtactgacacacgacattgacaccatcagcgacttctccttttccttcaccccactggccatcgccctgaccatcactttcggctgcctgggttacctcgcctacctatcggtcccaatgttcctgctgacagtcgtcgccatcgtcatcggcacggcagcccagtacctggcgcgctcccgcggtttcaaagggttctatgccgcccgcgatctcgaagacgaattgcagaagcactacaccgccatcgcttcgggcgcgaaggaactgcgcatccaccgcccccgtcgctatcgcatgcacaccggccgcatcagcgaaaccgcgaacaacatccgcgacctccacatcagctccatcaatatattcatcctggccaagaccttcggctcgatgctgttcttcgtggtgatcggtctggcgcttacgctccaggcctactggccttcgtccaatccggccgccatcactggcttcgtgatggtcctgctgtacatgaagggaccactcgaacaggtggtgaccatccttcccatcgtcagtcgcgcccaggtcgccttccagcgggtcgccgaactttccgagcgtttttcctctcccgaaccccatcttctgctcagcgaacaggaggccccggacaagaccgtcgacagcctggaactgcgcgacgttcgctacagcccccccgccgtcgaaggcagcgaaccgttccatctgggccctatcaatctgcgtatcgcccaaggtgacatcgtcttcatcgtcggcgagaacggctgcggcaagacgaccctgatcaagctgctgctcggcctctatcgcccgcagtccggcgagatccttctcaacggagaaccggtcagcgcggagacccgcgacgattaccgccagctcttcagcaccatcttcgccgactactacctattcgacgacctggtccagggcaagcaggcttcgttgcagaacgcgacccaatatctgcaacgcctggaaatcgcccacaaggtcagcgtcatggacggcaacttcagcaccaccgatctctccaccgggcagcgcaagcgccttgcgctgatcaatgcctggctcgaagagcgaccggtcctggtcttcgacgaatgggccgcagaccaggacccggctttccgcagggtcttctacaccgaactgttgccggacctgaaacgccagggcaagaccatcatcgtgatcagccacgatgatcgctatttcgaaatggcggaccagttgataaggctctcggcaggcaaggtcgtcaaggaaaccgagacggcgtga

SEQ ID NO: 34406 - protein, 549 aa, Pseudomonas aeruginosa PAO1
MTNPKRGAIRELLALLRPFRAIVAVSIALGMAGGLAITLLLASINNALHSENGLGQGVLLSFGGLCLLALVSSIVSDIGTSYVGQHIIAKLRKELGEKVLSAPIEQIERYRTHRLIPVLTHDIDTISDFSFSFTPLAIALTITFGCLGYLAYLSVPMFLLTVVAIVIGTAAQYLARSRGFKGFYAARDLEDELQKHYTAIASGAKELRIHRPRRYRMHTGRISETANNIRDLHISSINIFILAKTFGSMLFFVVIGLALTLQAYWPSSNPAAITGFVMVLLYMKGPLEQVVTILPIVSRAQVAFQRVAELSERFSSPEPHLLLSEQEAPDKTVDSLELRDVRYSPPAVEGSEPFHLGPINLRIAQGDIVFIVGENGCGKTTLIKLLLGLYRPQSGEILLNGEPVSAETRDDYRQLFSTIFADYYLFDDLVQGKQASLQNATQYLQRLEIAHKVSVMDGNFSTTDLSTGQRKRLALINAWLEERPVLVFDEWAADQDPAFRRVFYTELLPDLKRQGKTIIVISHDDRYFEMADQLIRLSAGKVVKETETA

SEQ ID NO: 34407 - DNA, 1695 bp, Campylobacter jejuni subsp. jejuni NCTC 11168
  CDS (1)..(1695)
gtgttaaaaaaacttttttttattttaagtaaggaagataaaaattttttatttttcttgcttgttttttcagtatttatttcttttatagaaacttttgcaatttctttggtaatgccttttatcactttggctagtgatttttcttattttgatcgtaataaatatttaatcagcctaaaagaatatcttaatatccctgtttttgaaatcattgtttattttggagtggggcttattgttttttatgtgtttagagctttgttaaatgcgtattattttcatcttttggcaagattttctaaagggcgttatcatgcgatcgcttataaggttttttctaaatttttaaatattaattatgaaaaatttactcaaaaaaatcaatctgaaattttaaagtccattacaggggaagtttataatctaagcactatgatttcatcatttttacttttgatgagtgaaatttttgtagtacttttgctttatgctttaatgcttttgattaattataaaatcactttgtttttaagtatttttatggtgttaaatgcctttattttagtgaaaattttaagccctatcattaaaaaagcaggagtaagacgcgaagaagcgatgaaaaatttctttgaaattttaaatacaaatttaaataatttcaaatttattaagcttaaaaccaaagaagatggagtattaagtctttttaaagcgcaaagtgaagctttttctaaagcaaatattaccaacgaaagcgtagctgcggtgcctagaatttatcttgaaggaataggcttttgcgtacttgtttttatcgtggtatttttggttttgaaaaatgaaagtgatatttcaggtattttatccacgatttctatttttgttttagcgctttatcgcttaatgccaagtgcaaatcgtattattacaagttatcatgatttgctttattatcattcttctttggatattatttatcaaaatttaagacaagaagaagaaaatttgggcgaggaaaaattaagctttaatcaagagcttaaaatttgcaatcttagctttggttatgagggaaaaaaatatttatttaaaaatcttaacttaaatattaaaaaaggcgaaaaaatcgcttttataggggagagtggttgtggaaaaagtaccttagtagatcttatcataggacttttaaaaccaaaagaagggcaaattttaattgatgagcaagaattaaatgcaaataatacaaaaaattatcgccaaaaaataggctatatcccgcaaaatatctatctttttaatgacagtatagctaaaaatatcacttttggagatgcggttgatgaagaaaaacttaatagggttatcaaacaagcaaatttagagcattttataaaaaatttacctcaaggagtgcaaacaaaagtgggcgatggggggagtaatttaagcgggggacaaaaacaacgcatagctatagcaagagctttatatttagagcctgaaatgttagtgcttgatgaagcaacttctgcgcttgatactcaaagtgaagcaaaaattatggatgaaatttataaaatttctaaagataaaaccatgattattatcgcacatcgcctttctacgataacacaatgtgataaggtttatcgtttagaacacggtaagcttaaagaggagaaatga

SEQ ID NO: 34408 - protein, 564 aa, Campylobacter jejuni subsp. jejuni NCTC 11168
MLKKLFFILSKEDKNFLFFLLVFSVFISFIETFAISLVMPFITLASDFSYFDRNKYLISLKEYLNIPVFEIIVYFGVGLIVFYVFRALLNAYYFHLLARFSKGRYHAIAYKVFSKFLNINYEKFTQKNQSEILKSITGEVYNLSTMISSFLLLMSEIFVVLLLYALMLLINYKITLFLSIFMVLNAFILVKILSPIIKKAGVRREEAMKNFFEILNTNLNNFKFIKLKTKEDGVLSLFKAQSEAFSKANITNESVAAVPRIYLEGIGFCVLVFIVVFLVLKNESDISGILSTISIFVLALYRLMPSANRIITSYHDLLYYHSSLDIIYQNLRQEEENLGEEKLSFNQELKICNLSFGYEGKKYLFKNLNLNIKKGEKIAFIGESGCGKSTLVDLIIGLLKPKEGQILIDEQELNANNTKNYRQKIGYIPQNIYLFNDSIAKNITFGDAVDEEKLNRVIKQANLEHFIKNLPQGVQTKVGDGGSNLSGGQKQRIAIARALYLEPEMLVLDEATSALDTQSEAKIMDEIYKISKDKTMIIIAHRLSTITQCDKVYRLEHGKLKEEK

SEQ ID NO: 34409 - DNA, 1632 bp, Campylobacter jejuni subsp. jejuni NCTC 11168
  CDS (1)..(1632)
atgccttttattatggaattacttaagcaaaataaattaaagttgatttcttttttgcttttttcttttattacaagcgctgttggagttttaactcttgtttttatcaatgattatttgcttaaaaatgcacaaaacattcctattttttattttattgttttgcttttgattttttttataagttctaccatagttgaacttggacttagtatttttggacaaaattttatttttaaaatgcaaaggcgcgtagtaaagcagatcttagacacccctttgttaagagtcgctaaagtaggtaaggctagaattttagcttctttgggaagtgatgtgagaaatatatcttttgggcttttaagattgcctgattttttacaatcaagtatattgattttatgcactagtgtttatttatgttatctttcaccacaaatttttgctttgtgtgtggtatggattatggttatttttattactaataattttttgatgatgaaagtatatcagtattttagaaaggcaagggaaaatgatgatgctttgcaaaataattaccaaaatatactagatggacataaagaacttttgatcaatcgtgatagagccaagctttattatgaagatgaatttgaaaataatgcaagattgaaaaagaaaaatagtactttaggtaatctttttaacaatctctcaaacaactggacaaatgtaactcttttggctttagtgggtgtagagttttacttagctttaaaatttgaatgggcaagtgttgcagatgctacaactatagctctttctattttgtttttacgaacccctttagtatctatgataggatcttttcctactttgcttttggcaaaaatcgctttggataagatcgcaaaattggaattagatgattatatagaaggttttaaaaaaacacattatatcagtgaatggaaaaaaatttcttttagaaatactcaatttgcttatgaagaaaattttcatttaaatcctgtaaatatagaacttaaaaaaggtgaattggtatttttaataggtaaaaatggaagtggtaaatccactttttgtatgcttttgacaggactttttaagccaagcaaaggcggaatttatgttgatgatacgcttatagatgataaaaatttagatgagtatagatctcttatttctgctgtttttagcgattttcatctttttactaaaaccttaaataaagaaaattttgcaagcgaagaaaaaattgctttttggttggagtttttagaacttaaaaataaaacaagtgtcaaagataatgaactgaccttaaccaaactttctacagggcaaaaaaagcgtttagctatgcttatagccttgcttgaagaaagggatattttagtgcttgatgaatgggcggctgatcaagatcctgtttttagaagatttttttataaaaaacttttacctttgctaaaagagcaaggtaaaacaatctttgctatcacacatgatgatgcatattttgatagtgctgatagaattttcttggctcaaaatggtgaaatcagcgaattaaagggtgagaatataaaggaattagctaaaaatttagtagaaaaatttgattaa

SEQ ID NO: 34410 - protein, 543 aa, Campylobacter jejuni subsp. jejuni NCTC 11168
MPFIMELLKQNKLKLISFLLFSFITSAVGVLTLVFINDYLLKNAQNIPIFYFIVLLLIFFISSTIVELGLSIFGQNFIFKMQRRVVKQILDTPLLRVAKVGKARILASLGSDVRNISFGLLRLPDFLQSSILILCTSVYLCYLSPQIFALCVVWIMVIFITNNFLMMKVYQYFRKARENDDALQNNYQNILDGHKELLINRDRAKLYYEDEFENNARLKKKNSTLGNLFNNLSNNWTNVTLLALVGVEFYLALKFEWASVADATTIALSILFLRTPLVSMIGSFPTLLLAKIALDKIAKLELDDYIEGFKKTHYISEWKKISFRNTQFAYEENFHLNPVNIELKKGELVFLIGKNGSGKSTFCMLLTGLFKPSKGGIYVDDTLIDDKNLDEYRSLISAVFSDFHLFTKTLNKENFASEEKIAFWLEFLELKNKTSVKDNELTLTKLSTGQKKRLAMLIALLEERDILVLDEWAADQDPVFRRFFYKKLLPLLKEQGKTIFAITHDDAYFDSADRIFLAQNGEISELKGENIKELAKNLVEKFD

SEQ ID NO: 34411 - DNA, 1809 bp, Deinococcus radiodurans R1
  CDS (1)..(1809)
atgaccccgcgttcaggccctcgcccggctgcttccgcgcgccgtgatgcccggcaacgcgacccccggcaattgcgccgcctgctcgcctacgcccggccctaccgcctgcccttcgtgctgggcgtgctcgccaccctgatttcgagcgggctgggactggtgtttccccggctgttcggtacgctgatcgacgcttcgtttctgaaggtgggcagcaccgacaccgggccgctcgaccgcaccgtgctgtcgctgttgggcattttcgcgctctcggcgtgcttcggggcggcgcaggcgtacctgctcgcgcgggtgggagcgggcgtggtggccgacctgcgccgggcgctgttttcgcatctgctgtcgctctcgccgcgctttttcggcaaccaccgcaccggcgacctgacgagccgcctcacctccgacgtgggcaccgtgcaggcggtgacgagcacggcgctcgcgcagctcgcctcgcaggggtttaccctcatcggctcagtgctgctgctggtgcagaccagcccgcgcctgagcctgctgaccctcgccatcattccactggtcatcggcacggcggtgaccatcgggcggcgcatccggcgggtcagccgcgaggtgcaggacgcggtggccgccgccaacgggcaggccgaggaagccatcagcggcgtgcgggtggtccagagctttaccgccgaggggttggaggaggagcgctacggccagggcgtgctcgccagtttccgcgccgcgctgcgccgggcccgtttgcaggcgctgatgaccggcgtcatgagcttcctgaccttcggggcgctcgcgctggtgctgtggttcggcgggcggcaggtcatgagcggcgcgctgacgccgggcaacctcgtcacgttcctgttctacgcgctgcaggtgggcggcacggtggcggcgctgaccggcgtgttcaaccagtttcaggaggcgctgggcgcgtcgagccgcattttcgagttgctcgacgagcgcagcgacctgcccgggcccgccgcgccgcggccgctctcccgcgccgagggccgggtgcgcttcgtggacgtggggttcacctatgccggggcgcccgccttgcaggacatcaccttcgacgtgcccgccgggcaggtggtcgcgctggtggggccgagcggcgcgggcaaaaccacgctggtcaacctgattccgcgcttctgggacgtgacggcgggccgggtggaggtggacggccacgacgtgcgcgcctacgccctggccgacctgcgccgtcaggtggggctggtgccgcaagaaaccctgctgttttcggggacggtggccgagaacatcctctacgggcgccccggcgcgtcgcaggccgaggtcgaagccgccgcgcacgccgcgcacgcccacgagttcatctgcgagctcgaaggcggctacggcgcggtggtcggcgaacgcggcgtcaagctctcgggcgggcagcgccagcgcgtcgccattgcccgcgccatcctcaaagacccgcgcatcctgattctggacgaggcgaccagcgcgctcgacaacgagtccgaggcgctggtgcaagcggcgctcgagcggctgatggtgggccgcacgaccttcgtcgtcgcgcaccgcctgagcaccattcgcagcgccgaccgcattctggtgatggacgccgggcgggtggtcgccgacggcacgcatgaggggttgatggcggcaggcggcctctaccgcgagttgtacgagttgcaattccggcagcagcaggaggcgcggcgctag

SEQ ID NO: 34412 - protein, 602 aa, Deinococcus radiodurans R1
MTPRSGPRPAASARRDARQRDPRQLRRLLAYARPYRLPFVLGVLATLISSGLGLVFPRLFGTLIDASFLKVGSTDTGPLDRTVLSLLGIFALSACFGAAQAYLLARVGAGVVADLRRALFSHLLSLSPRFFGNHRTGDLTSRLTSDVGTVQAVTSTALAQLASQGFTLIGSVLLLVQTSPRLSLLTLAIIPLVIGTAVTIGRRIRRVSREVQDAVAAANGQAEEAISGVRVVQSFTAEGLEEERYGQGVLASFRAALRRARLQALMTGVMSFLTFGALALVLWFGGRQVMSGALTPGNLVTFLFYALQVGGTVAALTGVFNQFQEALGASSRIFELLDERSDLPGPAAPRPLSRAEGRVRFVDVGFTYAGAPALQDITFDVPAGQVVALVGPSGAGKTTLVNLIPRFWDVTAGRVEVDGHDVRAYALADLRRQVGLVPQETLLFSGTVAENILYGRPGASQAEVEAAAHAAHAHEFICELEGGYGAVVGERGVKLSGGQRQRVAIARAILKDPRILILDEATSALDNESEALVQAALERLMVGRTTFVVAHRLSTIRSADRILVMDAGRVVADGTHEGLMAAGGLYRELYELQFRQQQEARR

SEQ ID NO: 34413 - DNA, 1752 bp, Deinococcus radiodurans R1
  CDS (1)..(1752)
atggctgccccttcccctaccctgaccgtgttacgaacttacctggggccgctccggggcgcggtggcggccctcgccgcgctgctgctcgtcggcacggggctgaacctgctgctgccgcaactgctttcgcgcttcgtggacgccgccaagctgggggcacaggccgacgtggcgctgctggtgcgcctcgccgtgacctacctcgtgctcgctgtgggcgtgcaactgctgagcgccggggcgacgtacctgggggcgcgggtgggctggcaggcgaccaaccggctgcgcgccgacctgaccgcgcacctgctgtcactcgacatgcaggaacacaaggaacgcacgcccggcgagatgatcgagcgcatcgacggcgacgtgacggccctgagcaacttcttctcgcagttcgcggtgagggtgttcggggccgcgctgctgctgaccggcgcggtggtcatgttctggcgcaccgactggcgggtgggagcgggcgtaaccgtcttcgtggccctgacgctgtgggcgatgaaccgcgtccgcaagggcggcgtggaacctacgcagcaggagcgcgaggcgagtgccaagctgttcggctacgtggaggagcggctcgccgggctcgacgatgtgcgctcgctcggcgcgggcgagtaccacctgcgcgggttcctgaaggtgcagcgcgagtttttcagccgctccatcttttcctggcggcgccgggcggtggtgtggcaactgagcatggcgctctttgccgtgggctacgtggcgctgctcgcctcggcggtggggctctacgcggcgggggccatcacgctcggcaccgccttcgcgctctaccagtacatgacgatggtggaagaacccattgatcagctcaccaaccagttgcaggacctgcaaaaagcgggggcgagcgtgatgagggtgggcgaactgctcgcgctgcggtcgcacctgccggaaggaacgcgcgagttgccccccggcccgctcgacctgcgctttgaccatgtgggcttcagctacggcggcgcagagggcacccctgtcctgcgggacgtggacctgacgctggaggctgggcagacgctggggctgctggggcgcactggcagcggcaaaacgacgctgacccgtctggtgtcgcgcctctacgaccccaccagcggcagcgtgcgcctcggcggcgtggacacccgcgacgtgaccctcgccagcctgcgctcgcgggtggcagtagtgacgcaggacgtgcagctgtttcaggcgagcgtgcgcgacaacctcagctttttcgacgagggcgtgagcgacgcgcaggtggaggcggcgctggccgaagtcggcctgggcgactggctttcgcgcctgccggaaggggtccgcacgccgctgcccgccggaagcctcagcgcggggcaggcgcaactgcttgcctttgcccgtgtgatgctgcgcgaccccgccgtcatcatcctcgacgagccgagcagccgcctcgaccccgccaccgaagcccagctcaccgccgccatgacccggctgctcgcgggccgcaccgccatcgtcatcgcccaccggctcgataccgtggcccgcgccgaccgcatcgtggtgctgggagccggtgaggtgctggaagacggtgcccgcaccgacctcgcccgcgatccgcgcagccactacgccggtctgctgcgcgccgggcgggaagccgaagcggtgctggcatga

SEQ ID NO: 34414 - protein, 583 aa, Deinococcus radiodurans R1
MAAPSPTLTVLRTYLGPLRGAVAALAALLLVGTGLNLLLPQLLSRFVDAAKLGAQADVALLVRLAVTYLVLAVGVQLLSAGATYLGARVGWQATNRLRADLTAHLLSLDMQEHKERTPGEMIERIDGDVTALSNFFSQFAVRVFGAALLLTGAVVMFWRTDWRVGAGVTVFVALTLWAMNRVRKGGVEPTQQEREASAKLFGYVEERLAGLDDVRSLGAGEYHLRGFLKVQREFFSRSIFSWRRRAVVWQLSMALFAVGYVALLASAVGLYAAGAITLGTAFALYQYMTMVEEPIDQLTNQLQDLQKAGASVMRVGELLALRSHLPEGTRELPPGPLDLRFDHVGFSYGGAEGTPVLRDVDLTLEAGQTLGLLGRTGSGKTTLTRLVSRLYDPTSGSVRLGGVDTRDVTLASLRSRVAVVTQDVQLFQASVRDNLSFFDEGVSDAQVEAALAEVGLGDWLSRLPEGVRTPLPAGSLSAGQAQLLAFARVMLRDPAVIILDEPSSRLDPATEAQLTAAMTRLLAGRTAIVIAHRLDTVARADRIVVLGAGEVLEDGARTDLARDPRSHYAGLLRAGREAEAVLA

SEQ ID NO: 34415 - DNA, 1722 bp, Escherichia coli O157:H7
  CDS (1)..(1722)
atgcgcgctttgctaccctatctggcactgtataaacgtcataaatggatgttaagtcttggtattgtgctggcaattgtgacgctgctcgccagtatcggtctgttgacactttccggctggttcctctcggcctcagcggttgcgggggttgccggactgtacagcttcaactatatgctacccgctgcgggcgtgcgtggtgcagcaatcacccgtactgccgggcgttattttgaacgtctggtaagtcacgacgcgactttccgcgtgttgcagcatctgcgcatttacaccttcagcaaattgttgcccctctcccctgccggactggcgcgctatcgtcagggcgaattgctcaaccgcgtggtggcggatgttgatacgctcgatcatctttacctgcgcgttatctcgccgctggtgggcgcttttgtggtgattatggtggtgacaatcgggttaagtttccttgattcccccctcgcctttacgctgggcggcattatgttactgacgcttttcctgatgccaccgctgttttatcgtgcgggaaaaagcaccgggcaaaatctgactcatcttcgcggacagtatcgccaacaactgacggcctggctgcaagggcaagctgagctgaccatttttggtgccagcgatcgttatcgcacgcaactagagaatacagaaattcaatggctggaagcgcaacgccgtcaatctgaactgaccgcattgtcgcaagcgataatgctgctcattggcgcgttagcggtgatcctgatgctgtggatggcgtctggcggcgttggcggcaatgctcaacccggcgcgttaattgccctgtttgtcttttgcgcgttagccgcgtttgaagcactggcaccagtaacgggtgcatttcagcatctggggcaagtcattgcctctgccgtacgtatctctgacttaacggatcaaaaaccggaggtcaccttccctgatacccaaactcgtgttgccgatcgcgtttcgctgacattacgggatgttcagttcacttatccggagcaatcccaacaggcacttaaagggatttctcttcaggtaaacgccggggaacatatagcgattctcgggcgaaccggatgcggcaaatcaacactgttacaactgctgacccgcgcatgggacccgcaacagggcgagattttgcttaacgatagccccatagccagcctgaatgaagcggctctacgacagaccatcagcgttgttcctcagcgagtgcatctgtttagcgccacgctgcgtgataatctgttactcgcctcgcctggcagtagtgatgaggctctggcggtgatcttacgtcgcgttggtctggagaagcagctcgaggatgcaggtctcaacagttggttaggtgaaggcggacgccagctctccggtggtgaactgcgccgtctggctatcgcccgtgcgctgttacatgatgcgccactggtgttgctggatgaacctaccgaaggcttagatgccacaaccgaaagccagatccttgaattgcttgcagaaatgatgcgtgagaaaacggtgttaatggtcacccatcgacttcgcggactctctcgtttccaacaaataatagtgatggacaacgggcaaattattgagcaaggtactcacgcagaactgcttgccagacaggggcgttattaccagttcaagcagggtttgtaa

SEQ ID NO: 34416 - protein, 573 aa, Escherichia coli O157:H7
MRALLPYLALYKRHKWMLSLGIVLAIVTLLASIGLLTLSGWFLSASAVAGVAGLYSFNYMLPAAGVRGAAITRTAGRYFERLVSHDATFRVLQHLRIYTFSKLLPLSPAGLARYRQGELLNRVVADVDTLDHLYLRVISPLVGAFVVIMVVTIGLSFLDSPLAFTLGGIMLLTLFLMPPLFYRAGKSTGQNLTHLRGQYRQQLTAWLQGQAELTIFGASDRYRTQLENTEIQWLEAQRRQSELTALSQAIMLLIGALAVILMLWMASGGVGGNAQPGALIALFVFCALAAFEALAPVTGAFQHLGQVIASAVRISDLTDQKPEVTFPDTQTRVADRVSLTLRDVQFTYPEQSQQALKGISLQVNAGEHIAILGRTGCGKSTLLQLLTRAWDPQQGEILLNDSPIASLNEAALRQTISVVPQRVHLFSATLRDNLLLASPGSSDEALAVILRRVGLEKQLEDAGLNSWLGEGGRQLSGGELRRLAIARALLHDAPLVLLDEPTEGLDATTESQILELLAEMMREKTVLMVTHRLRGLSRFQQIIVMDNGQIIEQGTHAELLARQGRYYQFKQGL

SEQ ID NO: 34417 - DNA, 1740 bp, Clostridium acetobutylicum ATCC 824
  CDS (1)..(1740)
atgaaaaaagggaccttatttagactggcgagttatgtgggaaagtataaaatgtacatgtttatatcattaatatttgccttaataagtaatgtacttatagcctttatgcctctaattgttggaaagggaattgataatataaaatctcaaggtaaggtggattttaataatttacttaaaataattattgttttggcagcagtttatttaattagttctatttttacatggctttttactgcagttgcgaacatattagcctataatactgtacgtgatttaaggaatgaagctttaagtaaaataagtacacttcctttaaaatactttgatgtaaatcctcatggtgatataatgagcaggcttacaaatgatatggatgctatttctgacggattgtttcaaggaataactcaattctttccggctattgtaactataataagttcaattctgcttatgctatctctaagtataaaattgacaggaataataatacttatgactccgttatgtttttttatagcatcatttattacaaaacgatctaataaaatgtttaagcagcagcaaaatactgttggagaattaaatggttatatagaagaaataatagggaatgaaaaaatagtaaaattattcggatatgaaaaaagagcagagaagaaattttccgagataaattcaagattatataattgcggacaactagcacaattttattcttcattaacaaatccatcaactagatttgttaataatattacatatgtgttagttggagctgtaggaggattacttgcagttttaagtggtttaagcataggtacaatttcaagctttttgacttactctacacagttttctcagcctataaataatgtaaccggggttgcaacacagcttcaagcggcatttgcttcagctgaaagggtattttcaattttagatgagattccagaaaaaaaggataatgaaggagctaaaaagttcgagcattgcgagggaaatataagctttaataatgtatcattttcatataataaaaaacagcctcttatagaaaattttagtgtagatataaaaaaaggaagcactatagcaatagtaggaccgacaggtgcaggaaaaacaacaatggttaatcttttaatgagattttacgacatagatggaggaaaaataaccatagatggtaaggatataaacaaaatgaaaagaaatgatgttagaggtcaatttggtatggtgcttcaggatacttggctttttgaagggactataaaggaaaatatagcctatggaaagcctgatgcttctatggaggaaattgagagtgctgcaaagaaagcatatattcacaattttataaaaaggctttcagatggatatgatacaaggataacagaatcaggtggtaatctttcagaaggccaaaagcagcttttaactatagctagagtaatgcttataaatccaccaatgcttatacttgatgaggcaactagcagtgtagatacgagaacagagataaaaatacaaaatgcttttcttaagatgatggaagggcgtacaagctttgtgattgcccatagactttctactatcaaagatgcagatttaattttagttatgaagaatgggcatatagtagaaaggggtaaacatgaagagcttgtaaatagcgaaggtttatatagagaaatctatgaaagtcaatttaaaaatgctgtataa

SEQ ID NO: 34418 - protein, 579 aa, Clostridium acetobutylicum ATCC 824
MKKGTLFRLASYVGKYKMYMFISLIFALISNVLIAFMPLIVGKGIDNIKSQGKVDFNNLLKIIIVLAAVYLISSIFTWLFTAVANILAYNTVRDLRNEALSKISTLPLKYFDVNPHGDIMSRLTNDMDAISDGLFQGITQFFPAIVTIISSILLMLSLSIKLTGIIILMTPLCFFIASFITKRSNKMFKQQQNTVGELNGYIEEIIGNEKIVKLFGYEKRAEKKFSEINSRLYNCGQLAQFYSSLTNPSTRFVNNITYVLVGAVGGLLAVLSGLSIGTISSFLTYSTQFSQPINNVTGVATQLQAAFASAERVFSILDEIPEKKDNEGAKKFEHCEGNISFNNVSFSYNKKQPLIENFSVDIKKGSTIAIVGPTGAGKTTMVNLLMRFYDIDGGKITIDGKDINKMKRNDVRGQFGMVLQDTWLFEGTIKENIAYGKPDASMEEIESAAKKAYIHNFIKRLSDGYDTRITESGGNLSEGQKQLLTIARVMLINPPMLILDEATSSVDTRTEIKIQNAFLKMMEGRTSFVIAHRLSTIKDADLILVMKNGHIVERGKHEELVNSEGLYREIYESQFKNAV

SEQ ID NO: 34419 - DNA, 2121 bp, Clostridium acetobutylicum ATCC 824
  CDS (1)..(2121)
atgagtgagagaaaaaaatccactggaatgagtaaaggcccaggtggcggtccaccaatgggaagaccagcagaaaaggcaaaggattttaaagggactttcagaaagcttcttaaatatttagcaccttttaaaatgagatttttaatagttgtaatagcagcaatatttagtgtatgttttaatgttcgttcacctaagattatgggtaatgcaacaacaaagcttgcagacggaattaaaggaaagattatattaagtaaaataaatcctcaagagaaaaaagtaaatgatgccgctaaaaagttaagtacacaaaaatcaaatttagatgctcaaaaggcaaaattagatgctcaaataaaagctaatcctatgatggctcaagttcctaaggtagctgaagcagaagctcaaatgacaaagggagaagagcagttaactaaggcgcaagctcaaataaaggcggctcagaaaaagattagtaatgctaaaaaagatacaattaataagtatggtagtaaaattgattttgatgctataggcgtaataattttagagcttataggactatatgcagtagcttcgttgtttagtttcttgcagtcatttgtaatggcaggagttgcacagaaaacagtttataacatgagaaaagatgtagatgagaagcttaatagacttccacttaagttctttgattcaaaaactcatggagaaatactaagccgtgttacaaatgatcttgatactgttgcaacaacgcttcaacagagtttaacacaacttataacagcaatacttcaagttataggtgtagttattatgatgcttacaataagtggatggcttacacttatatgtgttctaacacttcctgttgctggatttgtaactatgtttatagcaaagaaatctcaaaagttctttgcaggacagcaaaaagagcttggaatgataaatggacacgtagaagagatgttcactggacatattgtagttaaagctttcaataaagaacaagaatcgatagagaaattcaacgaaataaatgacagattatataaatcaggatggaaagcacaatttatttcaggaattatattcccacttatgaactttatcaataacattggatatgttgcagtgtgcgttgcaggtggaatatttgcaacaaagggaatgatatctataggagatgttcaggcattcttccaatacaataggttatttacaatgcctataattcaaactgcaaatatagcaaatataatacaatcaacaatggccgcagcagaacgtgtatttgaacttcttgaggaagaggaagaaattcaagatgctgaggattctaaaattgttgagttccctaagggtgcagttagatttgaaaatgttaaatttggttataaagaaggatctactttaattaacgatatgaacttagatgtaaaaccaggtcagacagtagctatagtaggaccaactggtgcaggaaagacaactatagtaaatctacttatgagattctatgaaataaatgcaggtaaaattactgtagatggtgtaaatacaaaagaaatgaagagaaatgaccttcgtggaatgtttggaatggttcttcaggatacttggttgtttaatggaacaataagagataatatagcttattcaaaggatggagcaactgaggaagagataataagggcagcaaaagcagcacatgcagatcactttataagaacgcttcctgatggatatgacactgtaataaatgaagaggcttcaaatatatcacagggacaaaaacaacttttaactattgcacgtgttatacttgcaaaccctcaaatattaatacttgatgaggcaacaagtagtgttgatactagaacagagcttgcaatacaaaaggctatgaataatcttatgcaaggaagaacaagttttgtaatcgcccacagactctcaactatacgtgatgctgatttaatacttgttatgaatcaaggttcagttatagagcaaggaaatcatgaagaattattagagaagaaaggcttctatgctgatctttataacagtcaatttacaagtggaaacaatgaagaaataggctaa

SEQ ID NO: 34420 - protein, 706 aa, Clostridium acetobutylicum ATCC 824
MSERKKSTGMSKGPGGGPPMGRPAEKAKDFKGTFRKLLKYLAPFKMRFLIVVIAAIFSVCFNVRSPKIMGNATTKLADGIKGKIILSKINPQEKKVNDAAKKLSTQKSNLDAQKAKLDAQIKANPMMAQVPKVAEAEAQMTKGEEQLTKAQAQIKAAQKKISNAKKDTINKYGSKIDFDAIGVIILELIGLYAVASLFSFLQSFVMAGVAQKTVYNMRKDVDEKLNRLPLKFFDSKTHGEILSRVTNDLDTVATTLQQSLTQLITAILQVIGVVIMMLTISGWLTLICVLTLPVAGFVTMFIAKKSQKFFAGQQKELGMINGHVEEMFTGHIVVKAFNKEQESIEKFNEINDRLYKSGWKAQFISGIIFPLMNFINNIGYVAVCVAGGIFATKGMISIGDVQAFFQYNRLFTMPIIQTANIANIIQSTMAAAERVFELLEEEEEIQDAEDSKIVEFPKGAVRFENVKFGYKEGSTLINDMNLDVKPGQTVAIVGPTGAGKTTIVNLLMRFYEINAGKITVDGVNTKEMKRNDLRGMFGMVLQDTWLFNGTIRDNIAYSKDGATEEEIIRAAKAAHADHFIRTLPDGYDTVINEEASNISQGQKQLLTIARVILANPQILILDEATSSVDTRTELAIQKAMNNLMQGRTSFVIAHRLSTIRDADLILVMNQGSVIEQGNHEELLEKKGFYADLYNSQFTSGNNEEIG

SEQ ID NO: 34421 - DNA, 1761 bp, Streptococcus pneumoniae R6
  CDS (1)..(1761)
atgcttatgaagatttacaaaaaactatttgcttatgtccaagataagaaatatcttggggttttggccataattttttctgctatatctgctctacttacagtatatggatattatttaatctacaaatttctagataagttaataattaattcaaatttatccggtgcagagagtatagcattaaaatctgttattacactaacaagtggagcgatattttattttgtctcaggaatgttttcacatatcttgggattcaggcttgaaacaaatttaagaaaaaggggaatcgatggtctggaaaaagcaagttttaggttctttgacttaaatccatctggtcaaataagaaagatcatagatgataatgcagcacaaactcatcaggtggtagcacacatgattcccgatagttctcaggcaataatcacacccgtacttgtacttgcacttggctttatagtaagtataagagttggcataattttgcttgctcttactataattggcggcttaattttaggggcaatgatgggcgagcaagaatttatgaagatataccaagaatccctatctaaactaagtgctgaaactgttgagtacgtgagaggaatgcaagttgtaaaaatatttaaagcaaatgtagagtcttttaaaagcttttataaggcgataaaagattactcaaagtatgcttatgattattccctatcttgtaaaaggccttatgttttgtatcaatggttattttttggactgattgcaattttaattattcctatagtttattttatgactagcttagctagcgcaaaggtgattttacttgagcttatcatgattttatttttatcaggagttctctttgtttcattcatgagaatgatgtggtactccatgtatatttctcaaggaaattatgcagtagatactttagaggcgctttacgaagatatgcaaaaagacaaattagtgcatggtaatatcaataattttaaaaactataatatagaatttgagaatgttagctttgcttataatgataaagctgtcattgaaaatttatcctttaatttagaagaaggaaagtcctacgcacttgtcggttcatctggatcaggcaaatcaacagtagcaaaacttatatcaggtttttataatgttaataaaggaagcataaagataggcgggatagcaataagtgaatattctgacgaagccttaattaaagccatttcctttgtttttcaagattcaaaattattcaagaagagcatttatgataatgtagctttagctaataaagatgcgacgaaagatgacgttatgagagccttaaaattagcaggatgcgatttaatattagacaaattcccagaaagagaaaatacaatcataggctcaaaaggtgtttatttatccggtggagaaaaacaaagaattgcaattgctagagcaattttaaaggattccaaaattattattatggatgaagcatcagcatctattgacccagataacgagtttgaattgcaaaaagcttttaaaaatcttatgaaggataaaacagttatcatgattgcacacaggctatctacaattaaagaccttgatgaaattattgtcatggatagtggaaaaattatagaaagagggtctgacaaagaattaatgtcaaaagatataaggtataagagcctgcaagagatgtttaacagtgcgaatgaatggagggtttcaaatgaaagagttttataa

SEQ ID NO: 34422 - protein, 586 aa, Streptococcus pneumoniae R6
MLMKIYKKLFAYVQDKKYLGVLAIIFSAISALLTVYGYYLIYKFLDKLIINSNLSGAESIALKSVITLTSGAIFYFVSGMFSHILGFRLETNLRKRGIDGLEKASFRFFDLNPSGQIRKIIDDNAAQTHQVVAHMIPDSSQAIITPVLVLALGFIVSIRVGIILLALTIIGGLILGAMMGEQEFMKIYQESLSKLSAETVEYVRGMQVVKIFKANVESFKSFYKAIKDYSKYAYDYSLSCKRPYVLYQWLFFGLIAILIIPIVYFMTSLASAKVILLELIMILFLSGVLFVSFMRMMWYSMYISQGNYAVDTLEALYEDMQKDKLVHGNINNFKNYNIEFENVSFAYNDKAVIENLSFNLEEGKSYALVGSSGSGKSTVAKLISGFYNVNKGSIKIGGIAISEYSDEALIKAISFVFQDSKLFKKSIYDNVALANKDATKDDVMRALKLAGCDLILDKFPERENTIIGSKGVYLSGGEKQRIAIARAILKDSKIIIMDEASASIDPDNEFELQKAFKNLMKDKTVIMIAHRLSTIKDLDEIIVMDSGKIIERGSDKELMSKDIRYKSLQEMFNSANEWRVSNERVL

SEQ ID NO: 34423 - DNA, 1923 bp, Sinorhizobium meliloti 1021
  CDS (1)..(1923)
atgggcgcgacagcgaaaacggattgcccggatttcagaaccgcctatatcggaacaatgctgcgcgccatcgtcaagattttcgagaactggattgacccctttgcgccgcgcgagcggttgcagccgccgcgaacgctctggggttttgcctggttttacgccagccaggcaaaaggtcctttcctcgccatggccgtgctcggcggtctggtggcgatgctggaagccggcctgttctatttcgtcggccggcttgtcgatgtgctcgatacgatccggccggaggacggctggcacggattgatttcgaccaacgggccggaactgctcttcatgctgcttacggtcctggtgttccgcttccttgcggtgacgcttgccgcactcgtggaggagcagtcgatcatcacggggttcctcaacctggtgcgctggcaatcctatgtccatgtcgcgcggcagtcgctcgccttctttcagaacgacttttccgggcggatcgttaccaaggtctggaccggcgcacaggcgacgagcgacctgatcgtctcgctgctgcaggtggtctggttcatcgtcatctacacggcttcgaccatggcgctgatcgcccagttggactggcggttggcggcgatggtcgccttctggatcgtgatcttcctggtgctcgcccgctatttcgtcccgcgtgtgcgaaagcatgcccgcgatacggcggagatggcgtcgatgctgaacggccgcatggtcgatgcctatgcgaacatccagactctgaagctcttcggcagtgacgaggagaacgatcgttacattcgggggggcttccaccgcttccagggagcagtcatccctttcacacgtctgctcaccggggtgagggcgtcgctcgcgcttttgtccggcatgatgatcgcggcgatcgcggtctactcggttcacttgtggctggcgggcgcggtcagttccggcgccgtcgcgttcacccttgcgctggtcctgcgcctcaacatgctgctcgggcggatgatgtcgcaattcaatgcgatcatgcgcaatatcggtacgatccagaattcggccgagctggtatcgcagccgatcgggctgaccgaccggcccggcgcaccggaactgcaggtcagccgcccggaaatccgcttcgaacatgtgacgtttcactacggcaggggcggcggggtcatcgacgacttttccctcaccatccgcccgggcgagaaagtcggcatcgtcggccgttcgggtgccggcaagtcgaccctcgtcaatctgctgttgcgcttctacgatctcgaagccgggcgaatcctcatcgacggacaggacatcgctgccgtccggcaggaatcgctgcgcagccagatcggcatggtcagccaggacacgtcgctcctgcaccgatcgatccgcgacaatatcctcttcgggcgaccgggggcgggcgaggagcagttgatcgaggcggcgcgcaaggcggaagcctatgacttcatcgtcgatctgcaggatcagcgcggccgtagaggcttcgatgcacatgtgggcgagcgcggagtcaagctttccggcggccagcgccagcgtatcgcgatcgcccgggtcatgctcaaggatgcgccgattctcgtgctggacgaggcgacttcggcgctcgattcggaagtggaagcggcgatccagtccaatctggagcggctgatgcagggcaagacggtgctggccatcgcgcatcggttatcgacgatcgcggcgctcgaccggctcgtcgtcatggacaggggccgtatcgtcgaggacggcacgcatgccgaactgatcgccaatggtggtctctacgccgatctctggtcgcgccagtcgggcggtttcatcgcgcgcgaagaggccgcggaatag

SEQ ID NO: 34424 - protein, 640 aa, Sinorhizobium meliloti 1021
MGATAKTDCPDFRTAYIGTMLRAIVKIFENWIDPFAPRERLQPPRTLWGFAWFYASQAKGPFLAMAVLGGLVAMLEAGLFYFVGRLVDVLDTIRPEDGWHGLISTNGPELLFMLLTVLVFRFLAVTLAALVEEQSIITGFLNLVRWQSYVHVARQSLAFFQNDFSGRIVTKVWTGAQATSDLIVSLLQVVWFIVIYTASTMALIAQLDWRLAAMVAFWIVIFLVLARYFVPRVRKHARDTAEMASMLNGRMVDAYANIQTLKLFGSDEENDRYIRGGFHRFQGAVIPFTRLLTGVRASLALLSGMMIAAIAVYSVHLWLAGAVSSGAVAFTLALVLRLNMLLGRMMSQFNAIMRNIGTIQNSAELVSQPIGLTDRPGAPELQVSRPEIRFEHVTFHYGRGGGVIDDFSLTIRPGEKVGIVGRSGAGKSTLVNLLLRFYDLEAGRILIDGQDIAAVRQESLRSQIGMVSQDTSLLHRSIRDNILFGRPGAGEEQLIEAARKAEAYDFIVDLQDQRGRRGFDAHVGERGVKLSGGQRQRIAIARVMLKDAPILVLDEATSALDSEVEAAIQSNLERLMQGKTVLAIAHRLSTIAALDRLVVMDRGRIVEDGTHAELIANGGLYADLWSRQSGGFIAREEAAE

SEQ ID NO: 34425 - DNA, 1815 bp, Sinorhizobium meliloti 1021
  CDS (1)..(1815)
gtgccaagacaagaaaaacaaacgccggcgcgcaggtccatacgcccgctcgcaaccgtgctgccttatctctcgcgttaccgcggcctcgcgatcggcgctgccgtctctctgaccattgcagcggccaccacgctgaccttgccgctggccgttcgccggatgatcgatcatggcttctccaattccgattccggcttcatcaacacctatttctccatgctgatggtgcttgcagtggtcctcgcccttgccagtgccgcccgctattacttcgtgatctcgctcggcgagcgcatcgtcgccgatctcaggcgcgacgtcttcgcacgcgtcatgcagctctcggcctcgttcttcgacgtcaatcagtccggcgagatcgtctcgcggctgacggccgacgcgacgcagatcaagtcggcggtgggtgcgacggcatccgtggcgctgcgcaacctgatcctctgtctcggcgcgatgggcatgatggtctatacgagcccgaagctttcgagcctcgtgcttgcggccatccccctcatcgtcttcccgctcgtcggcttcggacgctcggtacgccggcgctcccgcgaagcgcaggacatgctcgcagctgcctccgcctatgccggcgaagcgatcgccgccacccgcaccgtgcaggccttcaatggcgaggagagcgcgcgctcgcgctacggcagcgcggtggaggcggcctatcgcgccgcgcgcgctgcgaccagggcgcgctcggtgctgaccgcctttgccatcaccatggtcttcggaagcgtcgtcgccgtgctctggttcggtgcacgggacgtcctggcggactcgctttccgcgggtacgctcggtcagttcctgctctattccgtttttgcggcaggcagcctcggcgcactctcggaggtgtggggcgagctctcgcaggcggcgggcgccgccgagcgcctgaacgagctgctgaacgaagtgccggagatcgaggcgcccgagcatccggtcgcaatgcccgtccctgccacaggcgcggtcgagttcgagaacgtccacttcgcctatcccgcccggccggactataagagtcttaggggcttgagctttgcggtaagaccgggcgagacggtggccatcgtcggcccgtccggcgccggcaagagcaccgtcttctcgatgctcctgcgctattacgacccggcgaagggcaccatccgcgtcgacggtacggatgtgcgcgccgtcgatcccgaggagctgcgggagaggcttgcgatcgtgcctcaggacgtgaccatcttcgccacctcggtgcacgacaacatcgccttcggcgtgccggacgcaagccgcgaagcggtgcgcgccgccgccgttgcggcacaggccgacgagttcatcggcaggctggaccgcggctacgacacgctggtcggcgagcgcggagtgaccctttcgggcggccagcgccagcgcatcgcgattgcccgcgccatcctcaaaaacgctccgatccttcttctcgacgaggcgacctcagcgctcgatgcggagagcgaaacgctggtgcaaaaggcgctcgacgtcctgatgcaggagcgcacgacgctggtcatcgcccatcggctcgccaccgtgctcaaggccgaccgcatcctggtgatggagcatggccgtatcgtcgaggaaggcacccacgagtcgctgatccgccagggcgggctctacgcgaagcttgcgcggctccagttcgaccacggcgccgaagcactgttcgtcgcttcgcccgcgcctatttctccgtga

SEQ ID NO: 34426 - protein, 604 aa, Sinorhizobium meliloti 1021
MPRQEKQTPARRSIRPLATVLPYLSRYRGLAIGAAVSLTIAAATTLTLPLAVRRMIDHGFSNSDSGFINTYFSMLMVLAVVLALASAARYYFVISLGERIVADLRRDVFARVMQLSASFFDVNQSGEIVSRLTADATQIKSAVGATASVALRNLILCLGAMGMMVYTSPKLSSLVLAAIPLIVFPLVGFGRSVRRRSREAQDMLAAASAYAGEAIAATRTVQAFNGEESARSRYGSAVEAAYRAARAATRARSVLTAFAITMVFGSVVAVLWFGARDVLADSLSAGTLGQFLLYSVFAAGSLGALSEVWGELSQAAGAAERLNELLNEVPEIEAPEHPVAMPVPATGAVEFENVHFAYPARPDYKSLRGLSFAVRPGETVAIVGPSGAGKSTVFSMLLRYYDPAKGTIRVDGTDVRAVDPEELRERLAIVPQDVTIFATSVHDNIAFGVPDASREAVRAAAVAAQADEFIGRLDRGYDTLVGERGVTLSGGQRQRIAIARAILKNAPILLLDEATSALDAESETLVQKALDVLMQERTTLVIAHRLATVLKADRILVMEHGRIVEEGTHESLIRQGGLYAKLARLQFDHGAEALFVASPAPISP

SEQ ID NO: 34427 - DNA, 2022 bp, Bacillus subtilis subsp. subtilis str. 168
  CDS (1)..(2022)
atgaaaataggaaaaacgttatggagatacgcacttctttatcgaaaattgctgatcacagccgtccttttgctaactgttgccgtcggtgcagaactgactgggccctttattggcaaaaaaatgatagacgaccatatcctcggcattgagaaaacatggtatgaagctgcggaaaaagataaaaatgccgttcagtttcacggcgtctcatatgtcagagaggaccgattgcaggagcctgtttcaaaagcaaaagaagcgcatatttatcaagtgggaatggcgttctattttgttgatcaggctgtcagcttcgacgggaatagaacggtttctgacgggaagctgacgatcacaaacggagacaagagccgggcatatgctgccgaaaagctgactaagcaggaacttttccagttctatcagccggaaataaagggaatggtgttactgatctgcctgtatgggggcttgcttgtgttttcggtattctttcaatacggacagcattatctgctgcagatgagcgccaatcggattattcaaaagatgaggcaggacgtgttttcgcacatacagaaaatgccgattcgctattttgacaaccttccggccggaaaagtcgttgcgcggattaccaatgatacggaggctattagggatttatatgtcacagtgctttcaacatttgtgacaagcggaatctatatgttcgggatattcacggctttgtttctgcttgatgtgaagcttgcgtttgtatgtctggcaattgtgccgattatctggctgtggtcggtcatataccggagatatgcgtcatattacaaccaaaaaatccgctcgatcaacagtgacattaacgcaaaaatgaatgagtcaattcaaggcatgaccattattcaggctttccgccatcaaaaggaaacaatgagagaatttgaggaattaaatgaatcacatttttatttccaaaacaggatgctgaatttaaactccttaatgtcccataatctggtcaatgtcatccgcaatcttgcgttcgtctgtctgatctggcattttggcggtgcgagcctgaatgcggcggggattgtttctatcggtgtgctgtacgcgtttgtcgattatttgaaccggttatttcagccgatcacaggcatcgtcaatcagttttcaaagctggagcttgcaagggtctccgccgggcgtgtttttgaactgcttgaagaaaagaatacggaagaagcgggtgaaccggcgaaggagcgcgcgctggggcgggttgaatttcgtgatgtgtcatttgcgtatcaagaaggtgaagaggtattaaagcatatttcctttactgcgcaaaaaggcgaaaccgtagcgctcgtcggccataccggatcaggaaaaagctcgattttgaatcttctgtttcgtttttatgatgcgcaaaaaggtgatgtcttaattgatggaaaaagcatttacaacatgtcaagacaggaactcagatcccatatgggtattgtgcttcaggacccgtacttattctcgggcacaatcggatctaacgtaagtctggatgacgaaagaatgactgaagaagaaataaaaaatgcactgcggcaagtcggtgctgagcctcttcttaagaagcttccgaagggcattaatgagcccgtgattgaaaaaggcagcacgctatcctctggagagcggcagttaatttctttcgctagagctttggcgtttgatcccgcgatcttgattttagatgaggcaacggcgcatattgatacagagacagaggccgtgatccagaaggcgcttgatgtcgtcaaacaaggacgcaccaccttcgtcatcgctcaccggctttcaacaatcagaaatgctgatcagattttggttcttgataaaggagaaattgttgagagagggaaccacgaggaactgatggcattagaaggccaatattatcaaatgtatgaactgcaaaagggacagaaacattccattgcataa

SEQ ID NO: 34428 - protein, 673 aa, Bacillus subtilis subsp. subtilis str. 168
MKIGKTLWRYALLYRKLLITAVLLLTVAVGAELTGPFIGKKMIDDHILGIEKTWYEAAEKDKNAVQFHGVSYVREDRLQEPVSKAKEAHIYQVGMAFYFVDQAVSFDGNRTVSDGKLTITNGDKSRAYAAEKLTKQELFQFYQPEIKGMVLLICLYGGLLVFSVFFQYGQHYLLQMSANRIIQKMRQDVFSHIQKMPIRYFDNLPAGKVVARITNDTEAIRDLYVTVLSTFVTSGIYMFGIFTALFLLDVKLAFVCLAIVPIIWLWSVIYRRYASYYNQKIRSINSDINAKMNESIQGMTIIQAFRHQKETMREFEELNESHFYFQNRMLNLNSLMSHNLVNVIRNLAFVCLIWHFGGASLNAAGIVSIGVLYAFVDYLNRLFQPITGIVNQFSKLELARVSAGRVFELLEEKNTEEAGEPAKERALGRVEFRDVSFAYQEGEEVLKHISFTAQKGETVALVGHTGSGKSSILNLLFRFYDAQKGDVLIDGKSIYNMSRQELRSHMGIVLQDPYLFSGTIGSNVSLDDERMTEEEIKNALRQVGAEPLLKKLPKGINEPVIEKGSTLSSGERQLISFARALAFDPAILILDEATAHIDTETEAVIQKALDVVKQGRTTFVIAHRLSTIRNADQILVLDKGEIVERGNHEELMALEGQYYQMYELQKGQKHSIA

SEQ ID NO: 34429 - DNA, 1815 bp, Bacillus subtilis subsp. subtilis str. 168
  CDS (1)..(1815)
atgaaacaagcgaaaaaacagggggttttagagcgtttctattactcttcagatgaaatcattgaaaagccgtttaactgggctcaaatgtggcggctgctgagctatgtcaaaccatatcgaaaaacaattttgccgctttcttttctcactgtattgattggcactgctgtgaagcttgtgatccccattttgatcggcgtttatgttcttgatcaagcgattacagggagaaactcggagctgctgattcagctcatttttattattagcggtttatatgtcctcaattacgccgccaatgtgttaagaatcaggtggatgaatcagcttggccagcatgtcatttacgatttgcgacagcatttatttacccatgtgcagcgcttatcccatcgattttttgatcagcggtcggcgggatcgatcttagtcaggatcatgaatgatattaactctcttcaggagctctttacaagcggagtcatcaatttgttgaccgacttgctgcttctggccggcgtgattattattttgtttacgctgagccctgagctgactatagccatcatggtgacattgccgattatgttttttatttcaacaagtctcagaaaaaaaatacgccgatcctggcaaacggtacggctgaagcaatcgaagctcaactctcatctaaacgaaagcattcagggcatccgggtcacgcaggcatttacgcaggaagaagaaaacatggcgtattttgacggtgtcaatcaggagaactacgaatcatggcgggaagcaactagaaaaaatgccatgttccgtccgcttgtagaaatgacgaatgcgattgggacggctgtcttgatttggtatggagccacactcatcatgaatgaaaccattacgattggcgtcttcgtttcttttgctttctatctgggaatgttttgggaacctatttcgagactgggtcaggtctataatcagctgttaatggggatggcatcatcagaacggatttttgagtttctggacgaacagccaaatgtcaaggagaagccgaatgccattcataatgaaaagataaatggggagatcagttttgaagaggttgaattttcgtatgatgaaaaacgaaaagcccttcacgccgtttctttctctattcctgcgggatcgacgcttgcgcttgtcgggcatacagggagcgggaagacgacgattgccaatttaatcagccgtttttatgatgcggccggaggcaccattaaaatagacggtataccgattaaggatctttcccttgccagtctgcgctctcaaatcagcattgtcctgcaagatacatttattttctccgggaccatcatggaaaatattcgttttggaaggccaaatgcttcggatgaagaggtgatgaaagcgtcccaagcggtcggagcggatgagtttatttccgatttagcggaaggatacgcaacagaggtagaggaaaggggcagcgtactgtctgccggtcagcgccagctcatttcatttgcaagagcattgctcgccgatccggctattatcatccttgacgaagcaacggcaagcattgatacagagacagaagtaaaaattcagcaagcgttaaaaacgcttctgaaagggcgtacagcagtgatgatcgctcacagattgtctacgatccgcgacgccgaccgcatcattgttcttgatcacggcaggaaaatagaagaagggaaccatgatcagctgctcgctaaaggaggcatttatgccgggcttgtgaaagcgcaatacagcacagcgatagaataa

SEQ ID NO: 34430 - protein, 604 aa, Bacillus subtilis subsp. subtilis str. 168
MKQAKKQGVLERFYYSSDEIIEKPFNWAQMWRLLSYVKPYRKTILPLSFLTVLIGTAVKLVIPILIGVYVLDQAITGRNSELLIQLIFIISGLYVLNYAANVLRIRWMNQLGQHVIYDLRQHLFTHVQRLSHRFFDQRSAGSILVRIMNDINSLQELFTSGVINLLTDLLLLAGVIIILFTLSPELTIAIMVTLPIMFFISTSLRKKIRRSWQTVRLKQSKLNSHLNESIQGIRVTQAFTQEEENMAYFDGVNQENYESWREATRKNAMFRPLVEMTNAIGTAVLIWYGATLIMNETITIGVFVSFAFYLGMFWEPISRLGQVYNQLLMGMASSERIFEFLDEQPNVKEKPNAIHNEKINGEISFEEVEFSYDEKRKALHAVSFSIPAGSTLALVGHTGSGKTTIANLISRFYDAAGGTIKIDGIPIKDLSLASLRSQISIVLQDTFIFSGTIMENIRFGRPNASDEEVMKASQAVGADEFISDLAEGYATEVEERGSVLSAGQRQLISFARALLADPAIIILDEATASIDTETEVKIQQALKTLLKGRTAVMIAHRLSTIRDADRIIVLDHGRKIEEGNHDQLLAKGGIYAGLVKAQYSTAIE

SEQ ID NO: 34431 - DNA, 1824 bp, Sinorhizobium meliloti 1021
  CDS (1)..(1824)
ttgcggggacgggactatttgaacgtcaaggatcgaaaagagcgcgaagtcgataatgaaacgatcgctgggatcctaaggcgcgtcattgccgaaaacggccgcgaccatatcggcggctatgcttttgccattgcctgcctgatggtcgtggctgcaacgaccgctttcacggcgtggatcagtgaaacggtgatcaacgaagctttcgcccacaagcgcggcgacgtcgttctactcgtctgcttctcgatatttgctgcctttgtgctgagaggccttgcgacttatgggcaagccgtcgctttatcgaaaattggcaacagtattgtcgcaagctataagcggcggctttatacgcatctgatggcgttgagcattggctttttccaggagaagcgctccgcgcacctcaccgccaagattaaccagaacatctccggcatccgcgacgtgctcaacatgacagtcacgtcggtcgcccgcgatgtcctgactctggtcggtcttgtcggcgtgatgataagcaaggactggctgctctcgctcatcacctttgtgggggcccctccgttgctcctcgggctccgctacatttccaggcggctgcgtctggcgacgcgcgaggcggtcgaggccaacagccgcgtgctaggcgcgatgcaggaaaccatccagggcatttccatcgtcaaagccttcacgatggaggacgagttgggccgcaaggtcgagggcatcatcaagggcgcggagaaccgcgccaaccgcatcgcgcgcttgagcgaacggacggcgccgttgacggagacctttgcaggcctggcaatttcgggcgtgcttgcctatgcggcctttcgcaccatctacagcaacgtggccccgggtgccttgttcgcctttgtaacggcgcttctcttggcatacgacccggtgcgacgcctagctcgcctgcaggtgtccctggagcgcgctgccgtcaacgcccgcatgctttacgaaattttggacacggttccgcatcaacgggacctgcccggggcgcgtcaactggccttcagcgaagcgaccgtcgagtttcgcgacgtgcggttctcctatggcaatggcgaggaggtcctcaagggtgtcagtttcctggcggaaggtggcaagactaccgcgctcgttggcccgtccggagccggcaaatcgacgatcatcagcctcattccacgcttctacgatccacaatcgggcgtgatcctgatcgacgggcaagacatagccgctgttaccaagcagtctctgcgcaacgggctcgcctatgtctcacaacaggcttacctctttgaaggttccatccgcgataacatccgctacggccggcccgaagcgacggacgcggaagtagaggaagcggcccggcttgcctatgcgcatgatttcatactcgcgcagccacaggggtacgatacacctgtgggtgaacaaggcatgacgttatccggcggccagcgccagcgcctctcgatcgcccgagcgctcgtccgcaacgcgcctattctgcttctggacgaggctacctcggctcttgatacggagtcggaagcagctgtccagaaggcactcgatcaggcgatgagcggccgcaccgtcattgtgatcgctcaccggctttccaccgtcgttaatgccgacaagatcgtcgtgatgaacgaagggctggtcgtggaggaggggacgcacgaggaactcgcgcgccgtccggacggcgtctacgctcgcctccacaacatccaaggtggctttctggaattgactgtaggagcggcggccacttag

SEQ ID NO: 34432 - protein, 607 aa, Sinorhizobium meliloti 1021
MRGRDYLNVKDRKEREVDNETIAGILRRVIAENGRDHIGGYAFAIACLMVVAATTAFTAWISETVINEAFAHKRGDVVLLVCFSIFAAFVLRGLATYGQAVALSKIGNSIVASYKRRLYTHLMALSIGFFQEKRSAHLTAKINQNISGIRDVLNMTVTSVARDVLTLVGLVGVMISKDWLLSLITFVGAPPLLLGLRYISRRLRLATREAVEANSRVLGAMQETIQGISIVKAFTMEDELGRKVEGIIKGAENRANRIARLSERTAPLTETFAGLAISGVLAYAAFRTIYSNVAPGALFAFVTALLLAYDPVRRLARLQVSLERAAVNARMLYEILDTVPHQRDLPGARQLAFSEATVEFRDVRFSYGNGEEVLKGVSFLAEGGKTTALVGPSGAGKSTIISLIPRFYDPQSGVILIDGQDIAAVTKQSLRNGLAYVSQQAYLFEGSIRDNIRYGRPEATDAEVEEAARLAYAHDFILAQPQGYDTPVGEQGMTLSGGQRQRLSIARALVRNAPILLLDEATSALDTESEAAVQKALDQAMSGRTVIVIAHRLSTVVNADKIVVMNEGLVVEEGTHEELARRPDGVYARLHNIQGGFLELTVGAAAT

SEQ ID NO: 34433 - DNA, 1782 bp, Synechocystis sp. PCC 6803
  CDS (1)..(1782)
gtgactaaacccattgcccccctcctcagccttttaaattacagccgggtccaccgtgccaaaatttactgggcggtaacctgctcattgctgaacaaaatttttgatctggctcccccggccctaattggtttagccgtggatgtggtgatcaaacagcaggattctttcctgtcccgttggggcattgtttccgtacaaagccaactgttggtgctgacggtggcttcggcggttatttgggccctggaatcaatttttgagtatgcctacgagcggctttggcgtaacctcgcccaggatatccaacacgatctgcgcctggatgcctatgcccatttgcaacagctagacctggcctatttcgaggaaaggagtacggggcggctgatggccattctcaacgatgacatcaaccagttggagcggtttttggatgtgggggccaacgaaattttgcaggtgctgaccacagtggtggtgattggtggagcattttttgtcattaccccggacattgcttggatggcggtggtgcccatgccctttgtgctgttggggtcgatctattttcagtctttgctcacttcccgttatgccctagtgcgggaaaaggtcagtaatttgaacagccgtttgtccaataacctcagcggcattatgaccatcaaaagttttgccaccgaagcggaagaggtggaacggctccggcaagacagtgatgcctatcgggacagtaatcaacgggcgatcgccttgagtgcggcctttgtgcctttaattcgggtgattatttttgccggtttttccaccattctctacttcggtggtttggatgcggtgcggggtaatttggcggtgggcagttacagtatgttggtctttttaacccaacgactactctggccgctgacgggtttgggcaaaactctggatttatatcaacgggccatggcttccacccagcgggtgatgcaacttttagcaactcctattcaagctcatccgggggaattaagcctccatcctagccaggtgcaaggggaattagttttccaaaatattagctttgcctatccccatcgttcagcggtgttgaaaaatgtttccctaagggtaccggcggggcaaaccatcggcattgtgggggcaacggggtcgggaaaaagcactctggtcaaactattactgcgactgtacgaatgggatagcggtgacattctcctagacggggtggatctgaagaaatatttcctgggggatttacggcgcagtgtcggtttagtaagccaggacgtgtttttattccacggtacggtgcgggagaatattgcctacggcagtgctgacgccactttggcccaaattgaacgggcggccaacctagcggaggcagaggaattcatcaaccagttaccccagggctacgacaccattattggcgaacggggacaaaaactttccggtggtcaacggcaacggttggcgatcgccagggctattttaaaaaatcctcccattctgattttggatgaagccacgtcagcggtggacaacgaaacagaggcggccattgtccgttccctggaaaaaatcaccaaaaatcgcaccaccattaccattgcccatcgcctttccactgtgcgctatgccgatcaaatttacgtgctggaaaacggcatggtacaagaaatgggcagccacgaaagcctactggctcaccaaggactatatgccaaactgtggcgggtgcaaacggggctaaggagtggggttagttag

SEQ ID NO: 34434 - protein, 593 aa, Synechocystis sp. PCC 6803
MTKPIAPLLSLLNYSRVHRAKIYWAVTCSLLNKIFDLAPPALIGLAVDVVIKQQDSFLSRWGIVSVQSQLLVLTVASAVIWALESIFEYAYERLWRNLAQDIQHDLRLDAYAHLQQLDLAYFEERSTGRLMAILNDDINQLERFLDVGANEILQVLTTVVVIGGAFFVITPDIAWMAVVPMPFVLLGSIYFQSLLTSRYALVREKVSNLNSRLSNNLSGIMTIKSFATEAEEVERLRQDSDAYRDSNQRAIALSAAFVPLIRVIIFAGFSTILYFGGLDAVRGNLAVGSYSMLVFLTQRLLWPLTGLGKTLDLYQRAMASTQRVMQLLATPIQAHPGELSLHPSQVQGELVFQNISFAYPHRSAVLKNVSLRVPAGQTIGIVGATGSGKSTLVKLLLRLYEWDSGDILLDGVDLKKYFLGDLRRSVGLVSQDVFLFHGTVRENIAYGSADATLAQIERAANLAEAEEFINQLPQGYDTIIGERGQKLSGGQRQRLAIARAILKNPPILILDEATSAVDNETEAAIVRSLEKITKNRTTITIAHRLSTVRYADQIYVLENGMVQEMGSHESLLAHQGLYAKLWRVQTGLRSGVS

SEQ ID NO: 34435 - DNA, 1833 bp, Synechocystis sp. PCC 6803
  CDS (1)..(1833)
atgaaccgtgcctcccccatgacccaagctgtgccaggcctctgggcagtgatcaccaccttttggccccaaattcgtgcccagtggcgactcttgctggtagcgatggtgactttgctggcggatgtggggttgcgactgttggaaccctggcccctcaagctgctcattgacggggtactgattcccactcaaacccagccgagtctttctctctggggctttactaacctcaatgccgcttggctgttgatgttaatcgccgttggggtgattatcattgccgtcagtcgggcgatcgctacctattggaataccgtcagtttggcgatcgttggtagtcgcgtcatggcccaggtgcgggatcaactctatgggcatttgcaaaggctttccctgcgttaccattaccaagcccgcagtggcgatctgattatccgagtcagtagcgatgccaaccgtctccaggaaattttgctcacagcagctttgcccctggtggtcagccttttaactttgggcggcatggtgggggtgatggcctggctagacctaaaattaacccttttgtccttggcaacttttcccctgttttggttggccgccaatcgtttaagtgccaaaattcgccatgcttccctcacccaacgtcaccaggaaggggccgttgcctccaccgccgctgaatccctctccgccattaaacttgtccaagctctctccctggaacaagcctttgccgatttgtttagccgccaaaatcaacggagcctccaagaaaacattgaaactaagcgtttagccgccaacctggagcgattggtggacgtgttgattgccttcggtacagctttggtgatgggttacggaggccatctggtcattgaagatgctctgacagcgggaacggttttggtgtttttaacctatctacgcaatgcctacaaaccggtgcagaattttgctaaatacacaggtcgtctggctaaagcggcggcatcgggggagcgaattttgaatattttggcggaaacccccgatattcaggacaaaccaggggctattcctgccccatttttccaggggcgcattgaatttaaatatgtttcctttggctatcatccagatcaagccattcttgacgggttgaatttaacagtgcgaccaggggagaaaattgcccttgttggtgcttctggcagtggtaaatctactcttttaagtcttttactgcgcctgtatgacccaacagcagggaaaattttcattgatggccatgatctgcgggattatcaactgacgagcctacggaaccaaatggcagtggtattacaggagagtttattatttgcggccacgatccgggaaaatatcgcctacggcatcgagggggcgacaatggcagagattgaagcggcggcccgtttagccaatgcccataaatttattctggaactgccccagggttacgacacagtagtgggagaaaggggcactactctctctggtggccagcgacaacggttggcgatcgccagggccgccatgcgacaaacccccattctgatcctggatgaacccaccagcggcttggataaagttaatgaacagttggtttttgaagccctagaacggttagcggaaaatcgcaccacttttttggtaacccataatctgcagttggcgatcgccgctgaccaaattctttacctctaccaggggcaaatcagggaacagggtacccacgccgaattactggctcgtcagggggtctatgctgatctctttcaacggcaaaccctcgcaaccgtcaccaaatccctggggcgttaa

SEQ ID NO: 34436 - protein, 610 aa, Synechocystis sp. PCC 6803
MNRASPMTQAVPGLWAVITTFWPQIRAQWRLLLVAMVTLLADVGLRLLEPWPLKLLIDGVLIPTQTQPSLSLWGFTNLNAAWLLMLIAVGVIIIAVSRAIATYWNTVSLAIVGSRVMAQVRDQLYGHLQRLSLRYHYQARSGDLIIRVSSDANRLQEILLTAALPLVVSLLTLGGMVGVMAWLDLKLTLLSLATFPLFWLAANRLSAKIRHASLTQRHQEGAVASTAAESLSAIKLVQALSLEQAFADLFSRQNQRSLQENIETKRLAANLERLVDVLIAFGTALVMGYGGHLVIEDALTAGTVLVFLTYLRNAYKPVQNFAKYTGRLAKAAASGERILNILAETPDIQDKPGAIPAPFFQGRIEFKYVSFGYHPDQAILDGLNLTVRPGEKIALVGASGSGKSTLLSLLLRLYDPTAGKIFIDGHDLRDYQLTSLRNQMAVVLQESLLFAATIRENIAYGIEGATMAEIEAAARLANAHKFILELPQGYDTVVGERGTTLSGGQRQRLAIARAAMRQTPILILDEPTSGLDKVNEQLVFEALERLAENRTTFLVTHNLQLAIAADQILYLYQGQIREQGTHAELLARQGVYADLFQRQTLATVTKSLGR

SEQ ID NO: 34437 - DNA, 2202 bp, Synechocystis sp. PCC 6803
  CDS (1)..(2202)
atggtatcgcttaagcaaaatttacttggtgtaaaaaatcgcattacttgcatggctaaatatcaatgggttcaacaacagagtggtgaggactgtgcggcggcaagtttggcgatcattgcaaagcatcacggacgcaatatcagaattaatcgaattagggcgctggtggggactcgccaagggggaaccactttactcgggcttaagtatggggcgcaggaactgggctttataacctcagccatccaagcagaaccggaaattctcgacgaattggatgagtgggctttaccggcaattattttttggaagggatatcatttcgttgttttgtacgggcaggaaaaagataaatacgtcattgcagatccggcgatcggggttcgttatttagaccgccaagaggtaattaaggggtggcaagggggcatgatgctcctattagagccagatcccaaaggatttatttctcaacttgatgaagatcctgttcatcccgttgataatctgctcaaacgactgtgggaatatcgagaaatttttggcaaattatttcccctgaatttggccgtcggtattttttccttatctacacccttattacttaaatttttaacggatagcgttctgactaaatcagatacccaaaaattaacctgggttgccattggcgttattttgattacagtggttaatgctatttgttcatttttacaatccaatctcgttgcctcctttgcggaagaattgcaaaaaggtctcaagctagaatttggcctgcaaatcttgaatttgcccattacctaccatgaagcccgtcgcagtggtacggcaattcgtcgtctttccgatattcaacggattaatttattagtttctcagttagttattgatctccccatcaagacatttattggtcttgtggcccttggttttatcgtcttttatagttggcagttagcggcaatcgtggcggcgatcgggggcattatgaccttatcaaccattgcttttcagcccattgtccgccagacaacctatcgttccatcactatggcgggggaaaatgctggactcctggctgaatcatttaatggagccttggccaccaaaacaacggcggcttctccccaattatggctagaaattcaacatcgcttgcaacgggaatttaagcttaattaccgcactgctcaaattcgcattatcaacaatactttttcgcaattaatggcggggataggcacagtaattatgctgtggtatggcagtgttttggtttttggcaatcaactcagcatcggtcaacttatcgctatctatggtctgcaacaaagttttttacttttgattacaactttagtgcagttttttaccgatttcacccaagttaaagctatcactcgactcctggcggagttatttgagtacgaaccagaaaatcaaggggatgatctcaaagaccccattgaaatttctccccaggacgacattgattgtcaaaacattagtttttattatcccggtcgagtcaagttgatagaagatttgtccgttaccatccccggcggcaaagttgtcggccttatcggaaaatcaggctgtgggaaaagtaccttagcaaaaattttaaccggtctttattcagtgcaagctggggaaattaacattgggaaccatagtctcggggatttttccttgatctgcctacgaaaacaggtagtgttagtttcccaagatgcttttttcttccatcgttccattattgacaatttccgtttaagctcaccagatattactttggagcaagttatatcagcttgccaaatcgcccaagcccatgaatttgttagtcaatttccagagcaatatgaaacaattctcggtgcggtggcggcaaatatttccggaggacaaaaacaacgcttggcgatcgccagggcaattgtaaacgatccagcggttttgattctagatgagtcaacagctaatcttgatccggtgacggaagctgaagtactcaatagtttgctgaccaagcgccaaggaaaaacaacgattttaattagccatcgtcctaaggttatcaattgtgcagattggattatatttttagaatcgggaaaggttaaatttagcaatacaataaaaaaatttcgttctgaatttggaaatgcctctgattttttatccccttaa

SEQ ID NO: 34438 - protein, 733 aa, Synechocystis sp. PCC 6803
MVSLKQNLLGVKNRITCMAKYQWVQQQSGEDCAAASLAIIAKHHGRNIRINRIRALVGTRQGGTTLLGLKYGAQELGFITSAIQAEPEILDELDEWALPAIIFWKGYHFVVLYGQEKDKYVIADPAIGVRYLDRQEVIKGWQGGMMLLLEPDPKGFISQLDEDPVHPVDNLLKRLWEYREIFGKLFPLNLAVGIFSLSTPLLLKFLTDSVLTKSDTQKLTWVAIGVILITVVNAICSFLQSNLVASFAEELQKGLKLEFGLQILNLPITYHEARRSGTAIRRLSDIQRINLLVSQLVIDLPIKTFIGLVALGFIVFYSWQLAAIVAAIGGIMTLSTIAFQPIVRQTTYRSITMAGENAGLLAESFNGALATKTTAASPQLWLEIQHRLQREFKLNYRTAQIRIINNTFSQLMAGIGTVIMLWYGSVLVFGNQLSIGQLIAIYGLQQSFLLLITTLVQFFTDFTQVKAITRLLAELFEYEPENQGDDLKDPIEISPQDDIDCQNISFYYPGRVKLIEDLSVTIPGGKVVGLIGKSGCGKSTLAKILTGLYSVQAGEINIGNHSLGDFSLICLRKQVVLVSQDAFFFHRSIIDNFRLSSPDITLEQVISACQIAQAHEFVSQFPEQYETILGAVAANISGGQKQRLAIARAIVNDPAVLILDESTANLDPVTEAEVLNSLLTKRQGKTTILISHRPKVINCADWIIFLESGKVKFSNTIKKFRSEFGNASDFLSP

SEQ ID NO: 34439 - DNA, 1722 bp, Salmonella typhimurium LT2
  CDS (1)..(1722)
atgcgcgcgctactcccttatctgacgctttataaacgccataaatggatgctaacgctgggaattgcgctggcaatcctgacactgcttgccagtatcgggctgctgacgctttccggctggttcctgtccgcgtccgctatcgcaggcttcgcgggaatttacagttttaactatatgctcccggcagccggcgtgcgcggcgcggccattacccgtaccgctggtcgttattttgaacgtctggtaagtcatgacgccacgttccgcgtactgcaacatctgcgtatttatacctttagcaaacttctaccactctcccccgcgagtctggcgcgttatcagcaaggtgaactgctgaaccgcatcgttgccgacgtcgacacgctggaccatctctatttgcgcgtcatctccccgctggtcggcgcttttgtagtgattatgattgtcaccctggggcttagcgttctcgacgtgacgctggcgatcacgctgggcggcattatgctgttgacgctgtttattatgccgccggtgttttatcgcgccggcaaaaataccggccaaaatctgacgcatctacgcggtcagtatcgccagcagctcacgtcatggttacagggccaggcggaactcaccatttttggcgccagcaaacgctatcgggcgcaaatggaagccaccgaattacaatggcatgaggcccaacgccgacagtctgaactcaccgccttatcgcaggcgttaatgctgctgattggtgcgctggcggtgatgttaatgttgtggatggcctccggcggcgttggcggcaatacgcagcccggcgcgctcatcgcgctgtttgtcttctgcgcgctggcggctttcgaggcgcttgcgcccgttaccggcgcattccagcatctggggcaggttatcgcctctgcgcttcgtatcactgaattaacggagcaaaaaccggaggtgacctttccgcaagcagaaactcccgcgccggaaaaggtcacactcaccctgcgggacgtttcgtttcgttatcccgaccagccgattaatgcgctcaatgccctctcattacaggctaatcctggcgagcatgtcgctattctggggcgtaccggctgcggaaaatcaacgctgttgcagctactcacccgcgcctgggacccgcaacaaggcgaaattctgctcaacgatcttccgctatcctcgctgagcgaatccgccttacgccggactatcagcgtggtgccgcagcgtgtccacctgttcagcgccacgctgcgtgataatttattactggcggcgcccaatgccagcgacgaagccctttccgacatgctgcgtcgcgtcggcctcgaaaatctgctcgaagatagtgggcttaatagctggctcggcgaaggcggtcgtctgctatccggcggcgaacttcgtcgtctggccatcgcccgcgcgctgttgcacgatgccccgttgatgctgttggatgagcctactgaggggctggatgcgaccaccgagagcgaaatgctggaattacttgccgatgtgatgcgcgagaaaaccgtcctgatggtgactcaccgtttgcgcggcctggcccgttttgatcaaatcatcgtaatggacgacgggcacatcattgagcgaggcactcatgcagaattgttagccggacaagggcgctattatcagtttaaacaacgtctgtaa

SEQ ID NO: 34440 - protein, 573 aa, Salmonella typhimurium LT2
MRALLPYLTLYKRHKWMLTLGIALAILTLLASIGLLTLSGWFLSASAIAGFAGIYSFNYMLPAAGVRGAAITRTAGRYFERLVSHDATFRVLQHLRIYTFSKLLPLSPASLARYQQGELLNRIVADVDTLDHLYLRVISPLVGAFVVIMIVTLGLSVLDVTLAITLGGIMLLTLFIMPPVFYRAGKNTGQNLTHLRGQYRQQLTSWLQGQAELTIFGASKRYRAQMEATELQWHEAQRRQSELTALSQALMLLIGALAVMLMLWMASGGVGGNTQPGALIALFVFCALAAFEALAPVTGAFQHLGQVIASALRITELTEQKPEVTFPQAETPAPEKVTLTLRDVSFRYPDQPINALNALSLQANPGEHVAILGRTGCGKSTLLQLLTRAWDPQQGEILLNDLPLSSLSESALRRTISVVPQRVHLFSATLRDNLLLAAPNASDEALSDMLRRVGLENLLEDSGLNSWLGEGGRLLSGGELRRLAIARALLHDAPLMLLDEPTEGLDATTESEMLELLADVMREKTVLMVTHRLRGLARFDQIIVMDDGHIIERGTHAELLAGQGRYYQFKQRL

SEQ ID NO: 34441 - DNA, 3798 bp, Caenorhabditis elegans
  CDS (1)..(3798)
atgaaaagccgaaaaaacgagcccacttgggtgactaagcctctgcttaaacgctctcattcaagtgactcttcaatcgatgaatcaactgttaaactcacaaattatgggatattctattacactcaaggagttgatctacttcttttaattactggaacagttgcagcagttattcatggagctggttttccgttacttgctattgttctcggaggaatgacaacagtgtttttacgagctcaaaactcggatttcgtcgttggtgtggataatgtgaacccggaaggattggtcccgatatctctagatgaattcaactcggaagttgtcaagtattgtatctactacctggttcttggtgtactcatgttcttcacttcatatgtacaaatcgcttgttttgagtcgtacgcagagagattggtgcataaattaagacaaaactacctgaaagccatactcagacaacaaattcaatggttcgacaaacaacagaccggaaatttaacggctagactcacggacgatttggagcgtgtccgtgaaggattaggtgacaaattcgcccttcttgttcaaatgtttgctgctttcttggctggatacggagttggcttcttttatagttggtcaatgacactggttatgatgggatttgctccgttgattgtgctctctggtgccaaaatgagcaaaagcatggcaacgcgaacaagagttgaacaagaaacgtatgcagtcgctggtgcaattgcagaagaaacattctcttcgattagaacagttcattcattaaatggacataaaagagaattggatagattttataacgcattggaagttggaagacaaactggaattgttaaatattgttatatgggtattggagttgggttcagtaatttgtgtatgtactcttcatatgcattggcattttggtatggaagtactctgattatcaatgatcctacttttgatcgcggtcttatttttacggttttcttcgcagttctctcgggttctacatctctcggtggcgcccttccacatcttgcaagttttggaacagctcgcggagcagcttcaacagtattacgtgtaatcaactcgcacccaaaaatcgatccatattcacttgaaggaattctcgtggacaatatgaagggagatatttcattcaaagatgttcatttccgatatccatctcgaaaagatattcatgtattaaaaggaatttctctggaactgaaagctggtgataaaattgctttggtcggttcaagtggttgtggaaaatcaacaattgttaatttacttcaaagattctatgatccaacaaaaggaagagttttaattgatggagttgatttacgagaagtaaatgttcatagtcttcgtgaacaaattggaattgttagtcaagagccagtacttttcgatggaacaatttatgaaaatattaaaatgggaaatgagcatgctactcatgatcaagtcgttgaagcgtgtaaaatggcaaatgcaaatgattttatcaaaagattgcctgatggatatggaacaagagttggagaaaaaggagttcaattaagtggaggacagaaacaaagaattgccattgcacgtgctcttgtcaaaaatccaaaaatccttttgctcgacgaagccacatccgctctcgacacggaagctgagagagaagttcaaggtgcattggatcaggcacaagctggaagaacgacaattatcgtagctcaccgattgagcacaattcgaaatgttgacagaatattcgtgttcaaagctggaaatattgttgaatctggaagtcatgaggaattaatgagcaaacaaggaatcttctacgatatgacacaggctcaagttgttcgacaacagcaacaggaagcaggaaaagatattgaagacactatttctgagtcagctcattcccatctcagcagaaagtcttccacaagaagtgccatttcaattgcaacatctattcatcagctcgctgaggaggttgaggaatgcaaggctccacccacctcaatgttcaaaatattcaaattcaacggagacaaagtcggatggtttattggtggaatttttggagcatttatttttggatcagttactccagtttttgctcttgtatatgctgaaattttcaatgtatactctttgccagctgatcaaatgcaagcaaatgtgtatttctggtgtggaatgtttgttcttatgggaatcactttcttcgttggattcttcacttctgcaaattgcctcggacgatgtggagagtcactgacaatgaagttgagatttgaagcattcaagaatttattaagacaagatatcgctttttatgatgatttgagacatggaactggaaaattgtgcacaagatttgcaactgatgctccgaatgttcgatatgtattcacaagacttccagttgttttagcatcaattgtgactatttgtggagctctgggaattggattctattacggatggcaacttgccttgattcttgtcgtaatggttccactacttgtaatgggaggatatttcgaaatgcaaatgagatttggaaaacaaataagagatactcaattgttggaagaagctggaaaagtagcttcacaggctgttgaacacattcgaacagttcatagtttaaatcgtcaggaacaatttcatttcacatactgtgaatatcttcgggaaccattcaatactaatctgaaacatgcacatacatatggagctgtatttgcattctctcaatctcttattttcttcatgtatgctgctgcattctatcttggaagtatttttgtaaatcaacaagctatgcaaccaattgatgtctatcgagtattctttgctatttcattctgtggacaaatgattggaaatactacatcttttattcctgatgtcgtaaaagctcgtcttgctgcttctcttttgttctatcttattgaacatccaacacctattgattctctatctgatagtggaattgtgaagccgataactggaaatatttcaatcagaaatgtatttttcaattatccaacaagaaaggataccaaggttttacaaggattcactcttgatatcaaagccggtaaaactgttgcacttgtcgggcactcaggatgtggaaaatctacaattatgggactgctggagagattctataatcaagataaaggaatgattatgattgatggtgataacatccgtaacctaaacatcagttcacttcgcgaacaagtatgtattgtaagtcaagagccaacgttgtttgattgcacaattggagaaaatatttgctacggaacaaatcgaaatgttacatatcaagaaattgttgaagctgccaaaatggcaaatattcacaatttcattctaggattgccagatggttatgatactcatgtcggagagaaaggaactcaactttcgggtggtcaaaaacaaagaattgccattgcacgggcacttgttcgatctccttctgttttacttttggatgaagcaactagtgcattagatacggaaagtgaaaagattgtacaagaagcattggacgccgcaaaacaaggtcgcacgtgtcttgtcattgctcatcggttgagcacaattcaaaatagtgacgtcattgcgatcgtcagtgagggtaaaattgtggaaaagggaacacatgacgagttgataaggaagagtgaaatatatcagaaattctgtgaaacgcagaggattgtcgaaagtcaataa

SEQ ID NO: 34442 - protein, 1265 aa, Caenorhabditis elegans
MKSRKNEPTWVTKPLLKRSHSSDSSIDESTVKLTNYGIFYYTQGVDLLLLITGTVAAVIHGAGFPLLAIVLGGMTTVFLRAQNSDFVVGVDNVNPEGLVPISLDEFNSEVVKYCIYYLVLGVLMFFTSYVQIACFESYAERLVHKLRQNYLKAILRQQIQWFDKQQTGNLTARLTDDLERVREGLGDKFALLVQMFAAFLAGYGVGFFYSWSMTLVMMGFAPLIVLSGAKMSKSMATRTRVEQETYAVAGAIAEETFSSIRTVHSLNGHKRELDRFYNALEVGRQTGIVKYCYMGIGVGFSNLCMYSSYALAFWYGSTLIINDPTFDRGLIFTVFFAVLSGSTSLGGALPHLASFGTARGAASTVLRVINSHPKIDPYSLEGILVDNMKGDISFKDVHFRYPSRKDIHVLKGISLELKAGDKIALVGSSGCGKSTIVNLLQRFYDPTKGRVLIDGVDLREVNVHSLREQIGIVSQEPVLFDGTIYENIKMGNEHATHDQVVEACKMANANDFIKRLPDGYGTRVGEKGVQLSGGQKQRIAIARALVKNPKILLLDEATSALDTEAEREVQGALDQAQAGRTTIIVAHRLSTIRNVDRIFVFKAGNIVESGSHEELMSKQGIFYDMTQAQVVRQQQQEAGKDIEDTISESAHSHLSRKSSTRSAISIATSIHQLAEEVEECKAPPTSMFKIFKFNGDKVGWFIGGIFGAFIFGSVTPVFALVYAEIFNVYSLPADQMQANVYFWCGMFVLMGITFFVGFFTSANCLGRCGESLTMKLRFEAFKNLLRQDIAFYDDLRHGTGKLCTRFATDAPNVRYVFTRLPVVLASIVTICGALGIGFYYGWQLALILVVMVPLLVMGGYFEMQMRFGKQIRDTQLLEEAGKVASQAVEHIRTVHSLNRQEQFHFTYCEYLREPFNTNLKHAHTYGAVFAFSQSLIFFMYAAAFYLGSIFVNQQAMQPIDVYRVFFAISFCGQMIGNTTSFIPDVVKARLAASLLFYLIEHPTPIDSLSDSGIVKPITGNISIRNVFFNYPTRKDTKVLQGFTLDIKAGKTVALVGHSGCGKSTIMGLLERFYNQDKGMIMIDGDNIRNLNISSLREQVCIVSQEPTLFDCTIGENICYGTNRNVTYQEIVEAAKMANIHNFILGLPDGYDTHVGEKGTQLSGGQKQRIAIARALVRSPSVLLLDEATSALDTESEKIVQEALDAAKQGRTCLVIAHRLSTIQNSDVIAIVSEGKIVEKGTHDELIRKSEIYQKFCETQRIVESQ

SEQ ID NO: 34443 - DNA, 1902 bp, Caenorhabditis elegans
  CDS (1)..(1902)
atgcgaatcagttgttcaaaatcagtgcctttttcagatttaataaatataaatacaggcgctgccggggaaatcgtggataaaaatgacgatgaagaagaaaaccgactcccattatccgaacatttatgggaaattgtgaagttatgtgggaagcagtggagatggtttgttccagcatatacacttctgattctggattgtgctttgaaccttatcgaaccagccttgtatggtcaaatgatgacaaatgcgattcaaatgaaatcttttgatattatcaaacgagcctgcctactgctggcactcatccaattctcagaagctacatgcaaatcggcttgttactttttcatgcaatacgctgaaaagttaactgcaaggaatattcgtatccaacttttccgttcaattctccatcaggaaatctcattttttgatgagaataaaacaggacaattggtgtcaagaatcacacatgactcggaatccatttcaaatactcttccagttcacattgaaacacttgtcaacaatctattcatgttttttggatccattccaatcatgttttgttattcatggcagttgacattaacttcattcattgaatttccaattactctgttaatgacaagatattatggattggcagtggagaagctatcagaaaaggaaaatgatgcaactgcagcttcaaatgaaactgttgaagaagtactttcagctatccgaacagttagatcattcgctgctgagaatttcgaacaaaaacgatacactaagaatacggaagactggttcaagattagcacaaagactgtgacacttggaactatctacaactatttttgggctcttatgttacgttcgcaagatgttattcgatatttatatggaggatatttggcattaaatgggagaatggctccggaggcattgctaacttttatcttttatcactggagacttcatactgcgatcaatgcgttcagttccctattctctggcgtcatgaaaaccattggtctatcccgaaaagtgatacatctgatcaatagaaaaccacaacttgactatgattttgggactgaaactccagaaattcaaggaaaaattgagtttgaagtagttgaatttgcatatccgactcggaaaacagtaaatgtaataaatggaatcaacttatcaattgaatcaggaaaaactgttgccttggttggaccgagtggaaatgggaaatctactttggtttctttaattcaacaattttatactccacaatctggaagaatattgactgatggaattccaattcagaatattaatcatcaacattatcactcaaatattgcccttgttgctcaagaaccaacattattctcaggaactatcagagaaaatattctttttggaattgaaaatggaacagaagaagctatgttgaaagccgctgaaatggcaaatgttcatgaatttgtgtcaaaaatggatgatggatatgatacaaagtgtggagagaagggtgttcaaatgtctggaggtcagaagcaacgaattgcaatcgcaagagctcttatcagaaatccacgtgttttaatccttgatgaagccacgtcagcattagattcagaatctgaaggaatggttcaagaagcattgaataaatgtgcaaaagaacgtactgttatagtgattgcacatcgcctttcaactgtacgaaaagcccagaaaattgctgtaattgaaaatggaagtgtgaaggagatgggatgtcatgatgaattgatggagaatcaggatgggctttactacaaattagttagcaagcaacttggttcaattgttgatacaaatatttttaactgcttcgatatgctaatattttttgtccttttttag

SEQ ID NO: 34444 - protein, 633 aa, Caenorhabditis elegans
MRISCSKSVPFSDLININTGAAGEIVDKNDDEEENRLPLSEHLWEIVKLCGKQWRWFVPAYTLLILDCALNLIEPALYGQMMTNAIQMKSFDIIKRACLLLALIQFSEATCKSACYFFMQYAEKLTARNIRIQLFRSILHQEISFFDENKTGQLVSRITHDSESISNTLPVHIETLVNNLFMFFGSIPIMFCYSWQLTLTSFIEFPITLLMTRYYGLAVEKLSEKENDATAASNETVEEVLSAIRTVRSFAAENFEQKRYTKNTEDWFKISTKTVTLGTIYNYFWALMLRSQDVIRYLYGGYLALNGRMAPEALLTFIFYHWRLHTAINAFSSLFSGVMKTIGLSRKVIHLINRKPQLDYDFGTETPEIQGKIEFEVVEFAYPTRKTVNVINGINLSIESGKTVALVGPSGNGKSTLVSLIQQFYTPQSGRILTDGIPIQNINHQHYHSNIALVAQEPTLFSGTIRENILFGIENGTEEAMLKAAEMANVHEFVSKMDDGYDTKCGEKGVQMSGGQKQRIAIARALIRNPRVLILDEATSALDSESEGMVQEALNKCAKERTVIVIAHRLSTVRKAQKIAVIENGSVKEMGCHDELMENQDGLYYKLVSKQLGSIVDTNIFNCFDMLIFFVLF

SEQ ID NO: 34445 - DNA, 1668 bp, Ralstonia solanacearum GMI1000
  CDS (1)..(1668)
atgcggatcacgaaactgctgcttggccgttccaacgggtccaccatgctcatggtggccgcctcgcaggctgcggccggcctgggcggcgccggcctgctggcgatcctgacccatgccgccggcgaagcggacaggtcgctgatgtggcgctacctgccgtgggccgcggcggcgctgacgctgttcgtcctggcccagggcatcacgtcgcggctcaccaccgcgtgcgtggaacaggcgattcatgcggtgcgcctgcgcatcatgggcaagctcgcctcggcgcccctgcagaccttcgagcgcatcagcgagggccacctgctgacccgcctcgagaaagacctgaaggtggtgtccgccacctcctccgccatcctggccgccagccaggccggcatgctgttcctctgttccatcgcctatctggcgtatctgtcgcccatggcgttcggcatctgcatggtcgtggtcgtgctgagcctgctgctgcatgccatcaggatgcgggtgatccacgccaggatggaagccgcgacccaggccgagaccgatctgctcggcctgaccgggcacctggtgggcggcttcaaggaactcaagctgcatgcccgccggcaacgcgagctccacgccgagctggccgccgcttccgggcacagcgccgagcgcaaccgcgcggcctacgtgaccgtcagcgatcacctgatcctgatccagatcatcctgtacagcctgatcggctcggtggtcttcatcctgccgctgctggatgcgacgcagccgctgctgctggtgaaaatcgtggccgtgatcctgttcctggccggcgcgctcaaccagttcgccggcatcctgccgatgtacacgcaggccgatgcggccgcccggcatatcgaggcgctggagcaccagctcacgaacgagccggccgccgacggccagaccgcacagccgcagcccgcaccggtactgtccggcatcgaactggaagccgtccgctacgcctatctgcccgtcaacggccagggcttcgaggtgggccccgtcaacctgtcgatccggcgcggcgagatcgtcttcatcaccggcagcaacggttcgggcaagtcgaccttcctgaagctgctgaccggcttgcaggcgcccgatgccggccgcatccgctggaacggcaatcccgtcgatccggacagcctcgagcgctatcgcggcctgttctccgcgatcttctcggactaccacctgttcccgacgctctggggcctggacgcgccggccccgggcgcgatcgacgcgcacctgcagcgcctggccctgcaggccctgaccgcgctgaacggacgctcgttctcaccgctcaagctctccaccggccagcgcaagcgcctcgcgcacctggtggccctgctggaagaccggcccatctacgtcttcgacgaatgggcggccgaccaggacccggcgttccggcgctggttctatcacacggagctgccacgcctgaaggcgctcggcaagaccgtgatcgcggtcacccatgacgagccgtacttcggctgcgccgaccgctggctgcacttcgaggaagggcgctgcgtcgagcgcgcgccggcgtcgggcctgccgacagcatccgcgccggtcacgctggcggcgacgtag

SEQ ID NO: 34446 - protein, 555 aa, Ralstonia solanacearum GMI1000
MRITKLLLGRSNGSTMLMVAASQAAAGLGGAGLLAILTHAAGEADRSLMWRYLPWAAAALTLFVLAQGITSRLTTACVEQAIHAVRLRIMGKLASAPLQTFERISEGHLLTRLEKDLKVVSATSSAILAASQAGMLFLCSIAYLAYLSPMAFGICMVVVVLSLLLHAIRMRVIHARMEAATQAETDLLGLTGHLVGGFKELKLHARRQRELHAELAAASGHSAERNRAAYVTVSDHLILIQIILYSLIGSVVFILPLLDATQPLLLVKIVAVILFLAGALNQFAGILPMYTQADAAARHIEALEHQLTNEPAADGQTAQPQPAPVLSGIELEAVRYAYLPVNGQGFEVGPVNLSIRRGEIVFITGSNGSGKSTFLKLLTGLQAPDAGRIRWNGNPVDPDSLERYRGLFSAIFSDYHLFPTLWGLDAPAPGAIDAHLQRLALQALTALNGRSFSPLKLSTGQRKRLAHLVALLEDRPIYVFDEWAADQDPAFRRWFYHTELPRLKALGKTVIAVTHDEPYFGCADRWLHFEEGRCVERAPASGLPTASAPVTLAAT

SEQ ID NO: 34447 - DNA, 1731 bp, Clostridium perfringens str. 13
  CDS (1)..(1731)
atgatgatagacaagaggcttttaaacttgtgtaaggaatctaagaaatacataggtttaactgttttaatgaattggatttctgtaatttgtaatctgatgacaataatagttattggatttagcattcaggaactttttagtttagggaatattgaaaacttaaataaaaaagtattaattttagttggtcttttaggtgtaagattttgtgtgaatttattaagtggacacttctcatataaatcttcagagatggttaagattacccttagagataagatatatgagaagcttttaaaacttggaatgagatatgataaggtagattctacatcttcaattgttcaaatggctgttgaaggggtggaggctttagaggtttattttagtaaatacttacctcagttaatatattctattttagcgcctttaactttattttgtgctttagcatttatttcatttaaagcagctttagtatttatactttgtctgcctttaataccaatatcaataatattaataatgaaaatagcaaagaaaatattaaaggaatattggggacagtattcagatttaggaaacacattcttagaaaaccttcaagggcttacaacattaaaggtttttgatatggataatgaaagacatgaacttatgaatgaagaggctgaaagctttagaaagataactatgaaagttttaagtatgcaattaaactcaataaatgttatggatttaattgcttttggaggagctgcccttggaagtatagtggctttattacaatttagagcaggaacagtaagccttggaggaatgatagtaattttattaatatcagcagaatttttcatacctcttagattattaggatcatatttccacattgctatgaatggaatagttgctgcagatagaattttcaaagttttagaagctgatgaaagcaaggtttcttcagatagtaatcttaatgaaatatcaaacatctctcttgagaatgtaagtttctcttatgatggaaaaagagaagttttaaaggatatatctttatcaataaataaaggagactatgtagcaatagttggtgaaagtggaagtggaaaaagtactatagcttcattgattttaaataactataaggcttcaaaaggaaagataactttaaacggaactgatataaataatattgatttttcaaagctttataatagggtatccataatatcaactaacagttatatatttaatggaacagttagggataacttattaatagctaagaaggatgcaactttagaagagataaattacgccttaaaaaaggctaaccttttagattttgtgaattctaaaaaggaaaaattagatttagaagttggtgaaggtggatcaaagctttcaggaggacaaaagcaaagacttgctttagctagaactatattagcaaatagagaagtaataatctttgatgaagcaacttcaaatattgatgttgaaagtgaaaatatgatttggaaatctataaatgaaatatcaaaagagaaaacagtaatagttatttctcatagacttgctaatgttaaaaatgcagatagaatttatatgctagataaaggagttctagttgaagagggaagtcataaggatcttatggaaagaaagaacaaatattatggcatggtaaattatcaaaatgaattagaagtaggaggtgttatataa

SEQ ID NO: 34448 - protein, 576 aa, Clostridium perfringens str. 13
MMIDKRLLNLCKESKKYIGLTVLMNWISVICNLMTIIVIGFSIQELFSLGNIENLNKKVLILVGLLGVRFCVNLLSGHFSYKSSEMVKITLRDKIYEKLLKLGMRYDKVDSTSSIVQMAVEGVEALEVYFSKYLPQLIYSILAPLTLFCALAFISFKAALVFILCLPLIPISIILIMKIAKKILKEYWGQYSDLGNTFLENLQGLTTLKVFDMDNERHELMNEEAESFRKITMKVLSMQLNSINVMDLIAFGGAALGSIVALLQFRAGTVSLGGMIVILLISAEFFIPLRLLGSYFHIAMNGIVAADRIFKVLEADESKVSSDSNLNEISNISLENVSFSYDGKREVLKDISLSINKGDYVAIVGESGSGKSTIASLILNNYKASKGKITLNGTDINNIDFSKLYNRVSIISTNSYIFNGTVRDNLLIAKKDATLEEINYALKKANLLDFVNSKKEKLDLEVGEGGSKLSGGQKQRLALARTILANREVIIFDEATSNIDVESENMIWKSINEISKEKTVIVISHRLANVKNADRIYMLDKGVLVEEGSHKDLMERKNKYYGMVNYQNELEVGGVI

SEQ ID NO: 34449 - DNA, 1782 bp, Clostridium perfringens str. 13
  CDS (1)..(1782)
atgaataaatttaaatcagtagtaaaaaagatttctccttttgttggtaagtataagtgggcttttttaggagctattttatttataatttcagcagctgttttcactgccatagcaccaagaacagaaggattaataataactcaattaactaaggattttgagggaattataagaggagtttctggagcttcagttaactttaattatatttttaaggtattaatcttattattcttagtttatgcaggtggtacaggatcaactcttatagcaagtttcttattaactaatgcaattcaaaataccatgaaaaatattagaaatgaagttgagaaaaaaataaatagacttccaataagatattttgatggtaatagttatggagatgtattaagtagaatcactaatgatgtagatacaatctctaatgcattgcagcaaagttttgtacaggtaataaatgcatttttatctgtaggattagctttgataatgatgtattccataaatattaagctagcattgattgcaaccttaataatacctttaagtattttaattacaaagataatagtttctaaatctcagaaattatttaatagtcaacaaaaggccttaggaaatcttaatggaaaagtacaagaaatgtacacaggctttaatgaattaaagttatatggaaaagaagatgatgccttaaatgaatttgtaaaggtaaatgaagagttaagagaaacaggttttaaagctcaatttatatcaggtataatgtcacctttaataagtcttgttacttatttaggaatagctgtggtaggggtagtaggttctataatagctatagctggtggaattaccgttggtaatcttcaagcctttatacgttatatttggcaaataaatcagcctttatctcaagtaactcaattatcatcagcaatacaatcagcagtggctgctgctaatagggtttttgaattcttagaggaagaagaagaggttaaagatcctaataatgctataaaaattgagaagccaaagggagatgtaacttttgaccatgttaaatttggatataaggaagataagccacttataaaagatttaagcgtagatgtcaaaagtggtcaaatggttgctattgttggaaaaactggagcaggtaaaactactcttattaatcttttaatgagattttatgatgttcaaggaggttcaattaaaatagacggtgttgatattagagatatgaaacgtgaagatttaagagctatgtttggtatggttcttcaagatacttggctatttaatggaactatttatgataatattaggtatggtagattcgatgccactaaagaggagataatagaggcagcaaaagttgcaaatgttcatcattttattaaaacattacctggtggatataatatgttattaaatgaagaggcttcaaatgtatctcagggagaaaagcaacttttaactatagctagagcaattttaaaagatccagctatattaatactagatgaggccacaagttcagttgatactagactagaattattacttcaaaaggccatgagaaatataatgaaggatagaaccagttttgttatagctcacaggctttcaactataagaagtgcagatttaatattagtaatgaatgatggtaatataattgaacagggaacccatgaagagttaatgaagcaaggtggttattacgaaagtctttataatagtcagtttgctagtaaagaagcaaattaa

SEQ ID NO: 34450 - protein, 593 aa, Clostridium perfringens str. 13
MNKFKSVVKKISPFVGKYKWAFLGAILFIISAAVFTAIAPRTEGLIITQLTKDFEGIIRGVSGASVNFNYIFKVLILLFLVYAGGTGSTLIASFLLTNAIQNTMKNIRNEVEKKINRLPIRYFDGNSYGDVLSRITNDVDTISNALQQSFVQVINAFLSVGLALIMMYSINIKLALIATLIIPLSILITKIIVSKSQKLFNSQQKALGNLNGKVQEMYTGFNELKLYGKEDDALNEFVKVNEELRETGFKAQFISGIMSPLISLVTYLGIAVVGVVGSIIAIAGGITVGNLQAFIRYIWQINQPLSQVTQLSSAIQSAVAAANRVFEFLEEEEEVKDPNNAIKIEKPKGDVTFDHVKFGYKEDKPLIKDLSVDVKSGQMVAIVGKTGAGKTTLINLLMRFYDVQGGSIKIDGVDIRDMKREDLRAMFGMVLQDTWLFNGTIYDNIRYGRFDATKEEIIEAAKVANVHHFIKTLPGGYNMLLNEEASNVSQGEKQLLTIARAILKDPAILILDEATSSVDTRLELLLQKAMRNIMKDRTSFVIAHRLSTIRSADLILVMNDGNIIEQGTHEELMKQGGYYESLYNSQFASKEAN

SEQ ID NO: 34451 - DNA, 1746 bp, Pyrococcus furiosus DSM 3638
  CDS (1)..(1746)
atgtccagctcactatcccagttaaggagactgcttgggtacctaagaaaccacaaactggaattcttaactggcattatattagttgtattcatgtcctatgcaagcagtgtaatccccatccttataaaagaggcaatagacaaggggatctcaactaaaaactatgaatttgccctaagatatagtctcataattttgggagttgccgttttgcaaggagcttttagcttcactgcacgttatttacttgtaaaatccgcgcaacacgctgtttatgaccttagaatggatgcctttagagccatacagaggcataacattgagttctttgacaaaacgtattctgggcaactaataagtagaataactaacgatacagagagaataacgagattcctatcctttagaattaggatgttcgtttactctatgttcctcatagcaatgtccctttactatatgagcagaatgagtggaatcttatcagctgtagcctttgtaacaattatcattgttgtcctaataaacacaacatatgcaaaaaaagtaaggccaatttatgacaaggtaaggcatcaaacgggagtcatagcttcagtagcaacggcctcaatatctggtataaagacaattaaggccctagccgctgaaagatttattcaggggaaattctcaaatgaaaatgagaaattatacaagttcaacatagatgccacaaggataacggcaatctatggaaatgcgtcatttcttgttttagggcttgcaatgggaactatggtttattatggaggaaaaggaataattgaaggattactaacagtgggagaacttgcagctttcttgacatatatgctaacattaatgtggccactgagagctttaggatttacaataggggacatacaaaggagtttagctgcagcctccaggctctttgagataattgatagtgcaccaaagtctatcgatcctccagatgctgtagagataaagaatcctaaaggaaaaatcgagttcaaggatgtctggtttacttatcacactgggaaaacagtgctaaaaggaataaatctgacaataaactcaggagagaaagttctaataactggacctcctgggtctggtaaaagtacaatccttaaacttattgccagattttacgagcccaccaaggggcagatactaattgatgacattgacataaggaaaataaaaacagaaaacttgagaaaaatcgttgcctacgttccccaagagcccttcatatttaacagaaccattagagaaaacattgcattggcaaagcctcatgccgaaataaatgaaattattaaggctgcaaaaatagccaaaatccacgactttatatctactcttccaaacggttacgagaccatagttggagaaaaaggagttacgctctcaggcggccagagacagagaattgctttagcgagagcattacttttagaacccaagattatacttcttgatgatcccgtgtcgaacttagatgccaaaacagaaaaagagcttgttgaggatctaaaggatattcttaaggacaagaccgcaataatagtctcccaacgtctttctttggcaaagatagttgatagagttgttgttatgaaagatggaaacatcgttgaggaaggctcccccgaagaattggcaaagaaaggaggactgttcagcgagatgctagcaagtatgaagggtgagaaaaatggagagtaa

SEQ ID NO: 34452 - protein, 581 aa, Pyrococcus furiosus DSM 3638
MSSSLSQLRRLLGYLRNHKLEFLTGIILVVFMSYASSVIPILIKEAIDKGISTKNYEFALRYSLIILGVAVLQGAFSFTARYLLVKSAQHAVYDLRMDAFRAIQRHNIEFFDKTYSGQLISRITNDTERITRFLSFRIRMFVYSMFLIAMSLYYMSRMSGILSAVAFVTIIIVVLINTTYAKKVRPIYDKVRHQTGVIASVATASISGIKTIKALAAERFIQGKFSNENEKLYKFNIDATRITAIYGNASFLVLGLAMGTMVYYGGKGIIEGLLTVGELAAFLTYMLTLMWPLRALGFTIGDIQRSLAAASRLFEIIDSAPKSIDPPDAVEIKNPKGKIEFKDVWFTYHTGKTVLKGINLTINSGEKVLITGPPGSGKSTILKLIARFYEPTKGQILIDDIDIRKIKTENLRKIVAYVPQEPFIFNRTIRENIALAKPHAEINEIIKAAKIAKIHDFISTLPNGYETIVGEKGVTLSGGQRQRIALARALLLEPKIILLDDPVSNLDAKTEKELVEDLKDILKDKTAIIVSQRLSLAKIVDRVVVMKDGNIVEEGSPEELAKKGGLFSEMLASMKGEKNGE

SEQ ID NO: 34453 - DNA, 1737 bp, Pyrococcus furiosus DSM 3638
  CDS (1)..(1737)
atggagagtaactcaacactttttctcatcaaaagattcatcggagaagtaactaggcagaagaaaatacttggaataatactcctttcaataataggattaacgttaacaaacttagcttctccctacattttaagaattataattgacgaataccttgtccctaggaagctggaaggcctggggtttattacagcactgtaccttttaacgttgataggccagtgggcgtttatgactctccaaacctactacattgaggtatttggtcaaagagtgctgagagagttaaggagtaaattgcatgaaaaaatgttaatctccaaccttgatttttttaagaacaaatctacgggagatttagtttctagaataataaatgatactaatatggtaaatgatgtcttggtttcaggacttttgagcggggttagtagcattctaagcctgtctggaataatcatagcgatgttcctactagatgttagactgacactcgtaacattgacaagcgtcccattaatggtagctatagccctttactttggaggaaagatgagaagagcttatagggagacgagagagaaaatagcaaggatatcaaccatagtagaagaaagcgttgctggtattgaaaccataaaggcatttggaaaagaaagggatgtagagaaggacttttccctcgcatcaatagaaactataaaggcttacctcagagttgctgtatatatgggtatcttctggcctctaatgaacataactagcctactttcagttataattgtcatagcctacggaggatatttagcgtataagggagccgtaagcataggtgttgtagttgccttcattcagtatgcccagagatttagaggaccaattaataacgtcgtaagtatgtatgacagcttacagtctgcattagcggcattagagagaatatatgaaattttagacgatgaaaacgttgaagattacaaaggaattaacgttgaaagattaactggagaaataaaatttgaaaacgtgtggtttgaatacgaaaaaggaatacccgtattaaagaacattaacctccatatttcacctggaagcaaagttgcaatagttggaaagactggagcaggaaaaacaactatgattaacctaattttaagattctacgatcctaatcagggaagaattctctacgacggcattgaaggaagaaaaataagtagagaaagccttaggaagaggattggatatgtcccccaagagacgtatctcttcccaggaaccattatggaaaatattctaataggaaatccggaagcaaaagaagaagatgtagttaggatatgcaaagagcttggaatccatgatttcataatgaaacttcccaatgggtatgaaactacggcaggagaagctggaaagttgttgtcagtaggagagagacaactaatttccatagcaagggctctcctaaaagatccagatattgttattctagatgaggccctctctagtgtagatcctaaaaccgaaagtcttgtacaacgggcaatgttaaagcttatggagggaagaacaagcataataattgcccatcgcttgacaataacgcagtatgcagacaaaattgtagttctcgaggatggaaaaatcgtggaagagggtagccctcaagagttacttgagaaaagaggatacttctacaccttatacaccacccaggttgaggaaatctaa

SEQ ID NO: 34454 - protein, 578 aa, Pyrococcus furiosus DSM 3638
MESNSTLFLIKRFIGEVTRQKKILGIILLSIIGLTLTNLASPYILRIIIDEYLVPRKLEGLGFITALYLLTLIGQWAFMTLQTYYIEVFGQRVLRELRSKLHEKMLISNLDFFKNKSTGDLVSRIINDTNMVNDVLVSGLLSGVSSILSLSGIIIAMFLLDVRLTLVTLTSVPLMVAIALYFGGKMRRAYRETREKIARISTIVEESVAGIETIKAFGKERDVEKDFSLASIETIKAYLRVAVYMGIFWPLMNITSLLSVIIVIAYGGYLAYKGAVSIGVVVAFIQYAQRFRGPINNVVSMYDSLQSALAALERIYEILDDENVEDYKGINVERLTGEIKFENVWFEYEKGIPVLKNINLHISPGSKVAIVGKTGAGKTTMINLILRFYDPNQGRILYDGIEGRKISRESLRKRIGYVPQETYLFPGTIMENILIGNPEAKEEDVVRICKELGIHDFIMKLPNGYETTAGEAGKLLSVGERQLISIARALLKDPDIVILDEALSSVDPKTESLVQRAMLKLMEGRTSIIIAHRLTITQYADKIVVLEDGKIVEEGSPQELLEKRGYFYTLYTTQVEEI

SEQ ID NO: 34455 - DNA, 1752 bp, Streptomyces coelicolor A3(2)
  CDS (1)..(1752)
atgacacagctgcccgtcgccgagggcgccgacgtccgccgggccgcggccggcctcgtgcgcaccgaccggaggtccttcgcggtcgtcctcggtctcaacgcgctggccgcactggccggcctggcgggtccgtggctgctgggccggatcgtcgacgaggtgcgcggcgggggcggggtcggcgccgtggaccggatggccctcgccatcctgctgtgctcgctggcgcagttgctgctggcccgctgggcgcggtacgtggggcaccggttcggggagcggaccctcgcccgggtgcgggagcggtacgtggaacgggcgctggcgctgcccgcgtcggtcgtggagcgggcggggtccggggacctgacgacgcgcggcaccgccgacgtgaccgccgtcggcacgacgctgcgcgacgccggtcccgagctgctggtcaacgcggtgcaggcgctgttcctcaccgccgcggtgttcgtgctcgacccgctgctcggcctggccggggtgctggggctgactccggcctggatcgcgctgcgctggtatctgcgccgggcgcgggcggcctacctcgccgagggcgcggccaactccgacgtcgcggagagcctggcggccacggtggcgggggcccgcacggtcgaggcgttcgggctggccgagcggcgcgtcgccaccaaccgcggggcgctggaggtctcgctgcgcacccggttgcggacgctgttcctgcgcagtgtgttcttcccggcggtggacatctcctacgtccttcccgtggcgggcgtgctgctgctcggcggggtcctgcacgcgcacgggtcggcgagcctcggcgcggtggtgtcctgcgccgtgtatctccagcagctggcggggccgctcgacgaggtgctgatgcgggtcgagcaactgcaggccggtgccgcctcgttcgcccgggtggaggggctggcgcgggccccgcgggcgacggcggacgaggcggcggttccggacggcgaccgtatcgacgtgtccggggtgcggtacgcctacgaccggggcggggaggtgctgcgcggagtggacctcaccgtgcggccgggcgagcggctggcggtggtggggccgtcgggggcgggcaagacgacgctgagcaggctcctggcgggcgtcgacgcgccgacggagggttcggtgacggtgggcggggtgcccgtggtcgccctgggtccggagcggctgcgccggcaggtggtgctggtcacccaggagcaccatgtgttcctggggacggtccgcgacaatctcctgatcgccgaaccgggggccgccgacgaggagttgtgggccgcgctcgccgcggtgggcgccgagggatgggtgcgggagctgcccgggggcctgggcgccgagctgggcgcgaaggggcactccccggacggctcgcaggcccagcagctcgccctggcccgggtggtgctggccgacccgcacacgctgatcctggacgaggccacggccctgctggacccgacgacggcccggcacacggagcaggcactggccgccgtactgaagggccgcaccgtcatcgccatcgcgcaccgcctgcacaccgcgcacgacgccgaccgggtggcggtgatggaggacggtctgctgaccgagctgggcacgcacgacgagctggtggcggcgggcggggcgtacgcggccctgtggggctcctggcacggggagccgtccgccggttactga

SEQ ID NO: 34456 - protein, 583 aa, Streptomyces coelicolor A3(2)
MTQLPVAEGADVRRAAAGLVRTDRRSFAVVLGLNALAALAGLAGPWLLGRIVDEVRGGGGVGAVDRMALAILLCSLAQLLLARWARYVGHRFGERTLARVRERYVERALALPASVVERAGSGDLTTRGTADVTAVGTTLRDAGPELLVNAVQALFLTAAVFVLDPLLGLAGVLGLTPAWIALRWYLRRARAAYLAEGAANSDVAESLAATVAGARTVEAFGLAERRVATNRGALEVSLRTRLRTLFLRSVFFPAVDISYVLPVAGVLLLGGVLHAHGSASLGAVVSCAVYLQQLAGPLDEVLMRVEQLQAGAASFARVEGLARAPRATADEAAVPDGDRIDVSGVRYAYDRGGEVLRGVDLTVRPGERLAVVGPSGAGKTTLSRLLAGVDAPTEGSVTVGGVPVVALGPERLRRQVVLVTQEHHVFLGTVRDNLLIAEPGAADEELWAALAAVGAEGWVRELPGGLGAELGAKGHSPDGSQAQQLALARVVLADPHTLILDEATALLDPTTARHTEQALAAVLKGRTVIAIAHRLHTAHDADRVAVMEDGLLTELGTHDELVAAGGAYAALWGSWHGEPSAGY

SEQ ID NO: 34457 - DNA, 1962 bp, Chlorobium tepidum TLS
  CDS (1)..(1962)
atgagaatgggcgcaggagcggcatcgggattccgcacgcagcaggacgaaaccctcggcaatcggaaaaagggttccgttgaccgctatattatcaagcagctgctcggctacatcaagcccttcaaggggctggtggcgggcgcggtggcgctgaccgccttcggcgcgatcctgacgccgctgcgcccctggctgacccgcatcgccatcgacgaccacatcgccaagggcgaccacaagggccttgccgtcatcagcctgttgatgctgctcgtaatcgtgctcgacggcgtcaagcagtacgccgccacctggctgacacagctcatcggccagaaagcggtctatgccatccgcctcgacatcttccgccacttgcagcgcctgccgatccgctacttcgaccgaaacccggtggggcgcatcatcacccgcaccaccaacgacgtcgaggcgctcaacgaaatgttgtcaagcagcctcatcaccatcatcggcgacatgctgcaactgctcttcatcgtggcgatgatgttcctgaccgactggcggctgacgctggtcgtgctgagcattttgccggtgatgatctactcgaccatctttttcaagaacaagatgcgccaggcgtttctcgatgtccggacgcatctggcccgcctgaacgcctttttccaggagcacatcaccggcatgaaggtggtgcagctcttctcgcgcgaagaggccgagttcatgaagcactccgccatcaacgccgaccaccgcgacgccaacatcaaaacggtcttctacttttcgatctactccccgctgatcgagttcctcagctcggcggcggcgggtctggtggtctggttcagcgcgacgcgcatcatgcagaccgatctgtcggtgggcgtggtagtgtcattcgtgcagttcatctggctcttcttccgcccgttgcagcacctctccgaccagttcaacattatgcagaccgccatcaccagctccgaccgtatcttccggctgctcgaagagccgctcgatgccgaaccgacggagagcgctcactcactcgattcttttcgggatcggatccgtttcgacaaggtgtggttcgcctacgacgaggagcactgggtgctgcgcgacatttcgctggagatcaaggcgggcgaaaccgtggccatcgtcggcgcaaccggcagcggcaagaccacactcatcaacattctttcgagattttatccctacgcaaagggttcagtgaccatcgacggcatcgagctgagcgacattccccgccacgatctgcgcaagctcgtaggagtagtgatgcaggatgtggtgctcttcaccggttcgatccgtgagaatctctcgttcggcgatccatcgatttcggacgaaacgattcacgaggcggcacgcatcgtaggcgctgaccgtttcatcgaaaagctgccggacggctacgactaccgcatccgcgagaacggctccggcctctcggcgggccagaagcagcttctcgccttcgtgcgggcgctgctctacaacccggacattctcgtgctcgacgaagccaccagctcggtcgacaccgaaaccgagtcgctcatcgaacaggcaaccgaccggctgatgaagcaccgaacctcgatcatcatcgcccaccgcctctcgacgatccagcacgccgacaaaatcgtggtgctgcacaaaggcaccatccgcgaaaccggcacccaccaggagctgctcgcccagcgcggtttgtactacaagctgtatttattgcagcacccggagcgcggcagaatggaaggcgcgggggtgaagaattcgccaggtcagtcggataagtccgagccggccgatcttccctctacaaattgctctcccgcaacaccgtcaccggctccagccttgctgcccggagcgaaggaatcgctgccgcaatcgtgctga

SEQ ID NO: 34458 - protein, 653 aa, Chlorobium tepidum TLS
MRMGAGAASGFRTQQDETLGNRKKGSVDRYIIKQLLGYIKPFKGLVAGAVALTAFGAILTPLRPWLTRIAIDDHIAKGDHKGLAVISLLMLLVIVLDGVKQYAATWLTQLIGQKAVYAIRLDIFRHLQRLPIRYFDRNPVGRIITRTTNDVEALNEMLSSSLITIIGDMLQLLFIVAMMFLTDWRLTLVVLSILPVMIYSTIFFKNKMRQAFLDVRTHLARLNAFFQEHITGMKVVQLFSREEAEFMKHSAINADHRDANIKTVFYFSIYSPLIEFLSSAAAGLVVWFSATRIMQTDLSVGVVVSFVQFIWLFFRPLQHLSDQFNIMQTAITSSDRIFRLLEEPLDAEPTESAHSLDSFRDRIRFDKVWFAYDEEHWVLRDISLEIKAGETVAIVGATGSGKTTLINILSRFYPYAKGSVTIDGIELSDIPRHDLRKLVGVVMQDVVLFTGSIRENLSFGDPSISDETIHEAARIVGADRFIEKLPDGYDYRIRENGSGLSAGQKQLLAFVRALLYNPDILVLDEATSSVDTETESLIEQATDRLMKHRTSIIIAHRLSTIQHADKIVVLHKGTIRETGTHQELLAQRGLYYKLYLLQHPERGRMEGAGVKNSPGQSDKSEPADLPSTNCSPATPSPAPALLPGAKESLPQSC

SEQ ID NO: 34459 - DNA, 1803 bp, Yersinia pestis KIM
  CDS (1)..(1803)
atgaaagacaataatcctgcggataacctggcctggcgcgtcatctggcgccagcttatctccagcgttggcagtcaggccaggatgctgcgacgcagtatgctggcgctgttgctggcggcattcatgcaggggatcgcctttgcctgtctttatccgatcattgatgcgctgttacggggagacgcgccgcaacttcttaactgggctatggccttcagcgtcgccgcaattgtgacgctggtgctacgctggtatggcctgggctttgaataccgtggtcatctggcgcaggccacccatgagttgcgcctgcgacttggcgagcagttacgccgcgtgccgctggagaagctccagcgcggcagggcgggtgaaatgaacgccttgctgctgggcagcgtggatgaaaacctcaattatgttattgcgatagccaatattttgctgctcaccattgtcacgccgctgacggcgtcgctggcgacattgtggatagactggcggctggggctggtgatgttgctgatcttccctctgctggtgccgttttattactggcgccgcccggcgatgcggcgacaaatgcagacgctgggggaagcgcaccagcgtctgagcggcgatatcgttgaatttgctcaggggatgatggtattgcgcacctgcggcagcgatgccgataaaagccgggcgctgctggcgcatttcaatgcgctggaaaacttacagacccgcactcaccgtcagggcgctggcgcgacgatgctgatcgccagcgtcgtggagttgggcctacaggtggtggtgttatccgggatcgtctgggtagtgacgggcactctgaacctcgcctttttgattgccgccgtcgcgatgattatgcgcttcgcagaaccgatggcgatgtttatcagctacacctcggttgtggaactgatcgccagcgccctgcaacggattgagcggtttatggcgatagcaccgcttcccgtcgcagagcaaagcgagatgccggaacgttacgatatccgctttgacaacgtcagctatcgctacgaagaaggcgacggccacgcgcttaatcatgtttctttgacgttcccggcagccagtatgagcgcgctggtgggtgcctccggcgcaggcaaaactacggtcaccaaactgttaatgcgctatgccgatccgcagcaagggcagatttctattggcggcgtcgatattcgccgcctgacgccggaacagctcaatagcctgatttctgttgttttccaggatgtctggctgtttgatgacacgctgctggcgaatatccgtatcgcgcgcccacaggcgacgcggcaggaggtagaagaggccgcccgcgcggcgcagtgccttgagtttatttcccgtcttccgcaaggctggctgacgccaatgggagagatgggcggccagctatcgggcggcgagcgccagcggatttccattgccagagcgttattgaaaaacgcgccggtcgtcattctcgatgaaccgactgccgcgctggatattgaaagcgagctggcggtgcaaaaagcgatcgataacctggttcacaaccggacggtgattatcatcgctcaccgtttatccaccatcgccggggccggaaacattctggtgatggaagagggacaggtggttgagcagggtactcatgcgcaattgctctcacatcatggacgttatcaggcgctgtggcaggcgcaaatggccgcgcgcgtgtggcgcgacgacggggtttccgcgtctggagagtgggtgcatgagtga

SEQ ID NO: 34460 - protein, 600 aa, Yersinia pestis KIM
MKDNNPADNLAWRVIWRQLISSVGSQARMLRRSMLALLLAAFMQGIAFACLYPIIDALLRGDAPQLLNWAMAFSVAAIVTLVLRWYGLGFEYRGHLAQATHELRLRLGEQLRRVPLEKLQRGRAGEMNALLLGSVDENLNYVIAIANILLLTIVTPLTASLATLWIDWRLGLVMLLIFPLLVPFYYWRRPAMRRQMQTLGEAHQRLSGDIVEFAQGMMVLRTCGSDADKSRALLAHFNALENLQTRTHRQGAGATMLIASVVELGLQVVVLSGIVWVVTGTLNLAFLIAAVAMIMRFAEPMAMFISYTSVVELIASALQRIERFMAIAPLPVAEQSEMPERYDIRFDNVSYRYEEGDGHALNHVSLTFPAASMSALVGASGAGKTTVTKLLMRYADPQQGQISIGGVDIRRLTPEQLNSLISVVFQDVWLFDDTLLANIRIARPQATRQEVEEAARAAQCLEFISRLPQGWLTPMGEMGGQLSGGERQRISIARALLKNAPVVILDEPTAALDIESELAVQKAIDNLVHNRTVIIIAHRLSTIAGAGNILVMEEGQVVEQGTHAQLLSHHGRYQALWQAQMAARVWRDDGVSASGEWVHE

SEQ ID NO: 34461 - DNA, 1815 bp, Thermosynechococcus elongatus BP-1
  CDS (1)..(1815)
atgacagcagcaacacgctccacggattggcaacttttgcaacgactgcttccttacctcaagccctatcgctggggactggtgggaagtggcttgcttttgattcccttggcggcagccgcagcattacaaccgatcatcattgggcaggcgatcgccctcctgaagggggaagagagtacctacggctttttgaaaaccttaacgctgacccaagggattgatctactgagcatggcgctgttggtaaccgtggtgctgcgctttggggtgcaggcagcccaggggtactggattcaaaaaattggtcaaaacattactgccgatcttcgccatgacttatttgaccacgtgctgcggttatcctcccgcttctttgaccgcactcccgtcggtaagctcattacccgcttgaccagtgatgtggatgccttaggggatgtgtttgccactggcgctgtgggggttctcagtgatgtcttctcgatgctggtggtcatcctgacgatgtttttcattgaccgcctgttggcaacactgctgctggccttggttctgccgatcgctgccctgattatctattttcaacattgctatcgcgtcgccaactacaagtcccgcgaggagctgtcgctactgaatgccgatcttcaggaaaacattgttggtattacggtggtgcaattgtttcgccgtgaggccttcaatagtcaactgtttcggcggcgcaatcagcgctacatcaaagaggtcgatcggacgattttctatgattcagcggtatcagcgaccttagagtggattgcctttgtggcgatcgcgggggttctctggctcggcggcgccttagtgcagcagcgcacgattgactttggcaccttagccacgtttatcctcttttcacagcgcgtctttgatccactgcggcagttggcggagaaatttaccacagtgcaagcgggcttaaccgccattgagcgcatccatgatctgctctcagaacccattgaaattcacgatcccgatcgcacctttttgcgtttgccccagatagaaaatacagcccctgccgttgagtttcgtgatgtctggctggcctacaaagacgatgactatgtcctcaagcagctttcctttcaaattcatgctggcgagaaggtggccattgttggccccacgggtgcaggcaaaagttcgattattcgcttgctctgtcgtctttatgagccaacgcgcggtgaagtcctcattggtggtcgcaatgtgcgcgactttacccaagcagaactgcggcagcacattggtgtgattttacaggagagctttctcttctctggggatgtcaaaggcaacattgcccttggcgacaactacacccttgccgaaattcagcgagtggccgcagaaatgaacattgctgagttcattgagcagttgccccaaggctatgacacagccctgcggcagcggggcacaaacctctcggcggggcagcgacaacttttggcctttgcgcgggtcgccattcgcaatccagaaattcttgtccttgatgaggcaacggccaatttggatgtgggcaccgaggcactgattcaggaggccttgaaccgtctcttggtgaatcgaaccgcaatgattattgcccaccgcctcgccacaatccgccatgtggatcgcatttttgtgctcaaacggggacaactggtggagcagggcagccacagtgaactgttggctcgcaatggcgtgtacgcccatctctaccggttgcaggcactcaccaaagacgtagcccctcaacaggatgcctaa

SEQ ID NO: 34462 - protein, 604 aa, Thermosynechococcus elongatus BP-1
MTAATRSTDWQLLQRLLPYLKPYRWGLVGSGLLLIPLAAAAALQPIIIGQAIALLKGEESTYGFLKTLTLTQGIDLLSMALLVTVVLRFGVQAAQGYWIQKIGQNITADLRHDLFDHVLRLSSRFFDRTPVGKLITRLTSDVDALGDVFATGAVGVLSDVFSMLVVILTMFFIDRLLATLLLALVLPIAALIIYFQHCYRVANYKSREELSLLNADLQENIVGITVVQLFRREAFNSQLFRRRNQRYIKEVDRTIFYDSAVSATLEWIAFVAIAGVLWLGGALVQQRTIDFGTLATFILFSQRVFDPLRQLAEKFTTVQAGLTAIERIHDLLSEPIEIHDPDRTFLRLPQIENTAPAVEFRDVWLAYKDDDYVLKQLSFQIHAGEKVAIVGPTGAGKSSIIRLLCRLYEPTRGEVLIGGRNVRDFTQAELRQHIGVILQESFLFSGDVKGNIALGDNYTLAEIQRVAAEMNIAEFIEQLPQGYDTALRQRGTNLSAGQRQLLAFARVAIRNPEILVLDEATANLDVGTEALIQEALNRLLVNRTAMIIAHRLATIRHVDRIFVLKRGQLVEQGSHSELLARNGVYAHLYRLQALTKDVAPQQDA

SEQ ID NO: 34463 - DNA, 1737 bp, Thermosynechococcus elongatus BP-1
  CDS (1)..(1737)
atgctgggcaaaaccagttatcgttttcttcttccctatgtattgcgctattggcgaaccctctccctagcactgctgtgtacggtgggctttgtgggcacggcccccttggctgctcagttagtgggtcaaacctcggaactagtggggacaggcaatgtgaggcagttattaccgtgggcaggggctgccatcctgctctttctggggcgggggatctgtcaatttggtcaagatgtgttgatggccgatgctgcttttcgggtggtttacgatattcgtttaattttgtatgcccacctgcatcgccttggggtggatttttttgagcgcatgggcagtggtgatctcacctaccgattaacgggggatgtggaggcgatcgccatggtcatcactagagtatttcaacaacttttgcctgctttgttaacagcgatcgccctcatggcctatatgttttatctcaactggccactcaccctagcggctttgatcatcactcccctgatggtggccgcaatcagttggtttggtgagcgcttacgcactgcttcgcggcgtaaccaagatgcccttggcggactgtcctcctaccttacggaaaccttcgcgggaattcgcttaatcaaggcatttgccacggaggagaccatcttgcaccgctttcagcaagaggcggaaaagaaccgccgggcctatttccaaattgctcggattcagtcaacgcagtaccctgtggtgggtttcttagaagccttgagtatcatgagcttgtttttgctggggacatggcaaattggcgccggcaatctcacacccgcccaattgattagctttggcgccgctgccgctttactcatcgatcccgtcaatcaaatctccagcagctatagctccctcaaagttgctgaagcctctttagatcggagttttagcctattggcgattgcaccgaatgtgcaggaagtcagggatgcccaacccctaccccccattactggcaaggtggaataccgccatgtgtggtttgcctatgagcttgatcaacccgtgctgcaggacttcaatctcctggtgcagcctggggaagtggtggcgctggttggccattccggggcaggcaagtcaaccctcattaacctcctgctgcggttctacgatccccaagcggggcaaattctcattgatggcattgatattaaaaccgtcaccctcaagagtttacggcggcaaattgggattgttcctcaggaaacgattcttttctcagggaccattgcccaaaatattgcttttggtgactccgaaccggattgggaacgactcattgaggcagccaaaattgccaatgcccacgacttcattgaccgctttcccgatggctatcagacatgggtgggagaaaggggaattaacctttctgggggtcagcgccaacgcctggcgatcgcccgcgctgtttatgccgatccacggattttaattttggatgaggcgacctccgctttggactccgaatcagagaccttagtgcaaaatgccttggagaaggcaatgagggggcgcactgtctttatgattgcccaccgtttggccacggttcgtcgggccgatcgcattcttgttctagagcaggggcggatcattgaaagtggcagccatcaagaactgctggcccagtctgcccgctatgcccagttctacacccagcagtatctcccagacgggaaatga

SEQ ID NO: 34464 - protein, 578 aa, Thermosynechococcus elongatus BP-1
MLGKTSYRFLLPYVLRYWRTLSLALLCTVGFVGTAPLAAQLVGQTSELVGTGNVRQLLPWAGAAILLFLGRGICQFGQDVLMADAAFRVVYDIRLILYAHLHRLGVDFFERMGSGDLTYRLTGDVEAIAMVITRVFQQLLPALLTAIALMAYMFYLNWPLTLAALIITPLMVAAISWFGERLRTASRRNQDALGGLSSYLTETFAGIRLIKAFATEETILHRFQQEAEKNRRAYFQIARIQSTQYPVVGFLEALSIMSLFLLGTWQIGAGNLTPAQLISFGAAAALLIDPVNQISSSYSSLKVAEASLDRSFSLLAIAPNVQEVRDAQPLPPITGKVEYRHVWFAYELDQPVLQDFNLLVQPGEVVALVGHSGAGKSTLINLLLRFYDPQAGQILIDGIDIKTVTLKSLRRQIGIVPQETILFSGTIAQNIAFGDSEPDWERLIEAAKIANAHDFIDRFPDGYQTWVGERGINLSGGQRQRLAIARAVYADPRILILDEATSALDSESETLVQNALEKAMRGRTVFMIAHRLATVRRADRILVLEQGRIIESGSHQELLAQSARYAQFYTQQYLPDGK

SEQ ID NO: 34465 - DNA, 1629 bp, Thermosynechococcus elongatus BP-1
  CDS (1)..(1629)
gtgaagctgtttcagattctcctggaagccgcctggccgacgattgttgcagcagcgatcgccgggctgctcaacggtggcagcacagctgcgctcattgccctcattaatgccaccctgcagaaaacccctgccctccaacgcctcttgccttgggggtttattctccttggtacactcctgctgttgacccactttagctcccaagtgctgctggtgcgggctgcccaacaggcggtttatgaaatgcgcctcctcctcagtcgccagattctcgcttcacccctacgccagttagaaaccattggtcatccccagctgctggcaacgctgacagaggatgtggatgccgtctcccgttccttttccgtgttgcccaatctttttaatgccattgccattgtgattggctgtcttatttacatgggttggttgtcgccgcccctcttttttgcccttgtcgccttaattgtcattggtactggcagctacttatttctagcgggcagagcaaaaaaattcctagagcaggcgcggcagcaacaggatcacctttttcaccactttcggacactcaccgagggcaacaaagaactcaagctcaatcggcaacggcggctcgccttcttctatggggaattgacacccacagctcaaaaaacacggcagcaaaatgaactagggtacatggtctttgccattgctgccagttgggggcagttgctattgtttgtgacgattggcttttttctctttacactgccccatttgctgggagccacacccacggttctctcaggctatgtcctcacaattatttacctcatgctgccaatgcaacaggtgattgatgccattcccgtgtttagccgtgccagcgttgccctcaagaaagtggaatccctgcaactcagccttggggatccgcgccaagatatcaataataggggtgagcttcctcccttgggttggaaaaccctctctctacggcagatttgccatcagtaccgcggtagccatgaggatgaacccgccacctttaccctaggccccttaagtttgaccattgaggccggagaactggtctttattgtcggtggtaatggcagcggcaaatcgaccctcgccaaaattattacaggactctacattcccgatcagggggaaatttgggtggatgatcactgtttgcagcttcaggactacgaatggtatcggcaacactttgtcgctgtctttagtgacttttacctctttgactccctgttgggaattgaatctccagagcgcctagccctcatcccacattaccttgaaaaactgcgcctcagtcacaaagttcgcctagaaggtaatcgcttttcaacaacttccctctctcaaggggagcgcaagcgtttggcgttgttgctggcctatctcgacgatcgccctgcctacctttttgatgaatgggcagcggatcaagatcccatgtttcgcgatattttctaccgccaactcctaccagaactcaaagcccaaggcaaaacggtgtttgttattagccatgacgatcgctattttgatgttgccgatcgcctcattaaactggactatggccaactggtgctggcctctcacccctag

SEQ ID NO: 34466 - protein, 542 aa, Thermosynechococcus elongatus BP-1
MKLFQILLEAAWPTIVAAAIAGLLNGGSTAALIALINATLQKTPALQRLLPWGFILLGTLLLLTHFSSQVLLVRAAQQAVYEMRLLLSRQILASPLRQLETIGHPQLLATLTEDVDAVSRSFSVLPNLFNAIAIVIGCLIYMGWLSPPLFFALVALIVIGTGSYLFLAGRAKKFLEQARQQQDHLFHHFRTLTEGNKELKLNRQRRLAFFYGELTPTAQKTRQQNELGYMVFAIAASWGQLLLFVTIGFFLFTLPHLLGATPTVLSGYVLTIIYLMLPMQQVIDAIPVFSRASVALKKVESLQLSLGDPRQDINNRGELPPLGWKTLSLRQICHQYRGSHEDEPATFTLGPLSLTIEAGELVFIVGGNGSGKSTLAKIITGLYIPDQGEIWVDDHCLQLQDYEWYRQHFVAVFSDFYLFDSLLGIESPERLALIPHYLEKLRLSHKVRLEGNRFSTTSLSQGERKRLALLLAYLDDRPAYLFDEWAADQDPMFRDIFYRQLLPELKAQGKTVFVISHDDRYFDVADRLIKLDYGQLVLASHP

SEQ ID NO: 34467 - DNA, 1770 bp, Oceanobacillus iheyensis HTE831
  CDS (1)..(1770)
atgaataacgagaaaaataattatagtaagatgcagcatatcgtaaaaagattattcaaatatattactccttacaaaaggaaactgataatcgttgtcatactagcagtgttaggcacttcttttactattttcagtcccgtgattttaggtttagctgtgacggagttatatgagggaatggtcaatggcggaagtaatgtgaatatgcagtacatcctacttatagtcggtattttagcagttttatatttgttaagctctgtatttacctatatacaagagtatcttctgataggtgtgtctcagaaagttatttatacgcttagaaatgaagtgaataaaaagttatataagttaccaattgcatactttgataataatagtcatggggatttactaagtagggcgataaatgatattgagaaggtgaatagtacatttaaacagataatcagccaatttttcacatctgttataacattactagggatcacgattattatgctttctataagtccattcataacagtcgttgtatttcttattatccctgggagtatatttattactaagaaggttattaagaaatcacaattatattttaaaaacgaacagcatattttaggcaaccttaatggttttgtggaggaaacgtatgctgggcaagaagctataaaatcgtttaatctagaaagtttttcagatcaaagcttccaaaaaagaaataatctattatacgaatatggctggaaagcacaatatatatctagcacgataacccctttactaagattgttacaaaacatggtttatatcgtagtttgtgtaataggaagtatctttgtaataaatcaggtgctaactttgggaaatatacaggcttttattatgtatgtacgtcaatttcagcaaccaattaataaaatggcgacaattacaaataccattcaatcaacgattgctgcatcagagcggatatttgaattgttagacgaggaagagaagcctattttttcgggacaagctactaagtataatgccaatgcgtttattcaatttgaaaatgtaagtttttcttataacaatattcactcaacgattaaggatatccatttagaaattaataagggagaaacggtagctataatcggttccaatggagcaggtaagtctactttatctttattgttgcttggactgttaaccccgagtaaagggaagattttaatcaatgggatggatattcatcaaatgaaggaacatgaaaaattagaattgtttggaacagttttacaagaagattggttgttccgtagaagtataagggaaaatatcgcctatggttccaataacaatcaggtgacggacgaagcgattgaaagagcagctaaattagcacaagcagattactttattcgtaatttaccgaatggttatgacaccgtcatgaatgaatctagttccaatctatctgaaggagaaaagcaattaatagctattgcacgggcggtattggcacaaccagagatcttggtattagatgaagcgacaagtcatgttgataaagaaatggatgaacgcatacaatctgggttacaagagttaatgaaaggaagaacaacatttatcattgcgcatcatccatctacattaaaaaatgcggatcaaattcttgttttagataaaggtaaaatcattcaagaaggcaaccgcgaagaactaatggatcaacatgattattatgaggattttttgtttcagagttaa

SEQ ID NO: 34468 - protein, 589 aa, Oceanobacillus iheyensis HTE831
MNNEKNNYSKMQHIVKRLFKYITPYKRKLIIVVILAVLGTSFTIFSPVILGLAVTELYEGMVNGGSNVNMQYILLIVGILAVLYLLSSVFTYIQEYLLIGVSQKVIYTLRNEVNKKLYKLPIAYFDNNSHGDLLSRAINDIEKVNSTFKQIISQFFTSVITLLGITIIMLSISPFITVVVFLIIPGSIFITKKVIKKSQLYFKNEQHILGNLNGFVEETYAGQEAIKSFNLESFSDQSFQKRNNLLYEYGWKAQYISSTITPLLRLLQNMVYIVVCVIGSIFVINQVLTLGNIQAFIMYVRQFQQPINKMATITNTIQSTIAASERIFELLDEEEKPIFSGQATKYNANAFIQFENVSFSYNNIHSTIKDIHLEINKGETVAIIGSNGAGKSTLSLLLLGLLTPSKGKILINGMDIHQMKEHEKLELFGTVLQEDWLFRRSIRENIAYGSNNNQVTDEAIERAAKLAQADYFIRNLPNGYDTVMNESSSNLSEGEKQLIAIARAVLAQPEILVLDEATSHVDKEMDERIQSGLQELMKGRTTFIIAHHPSTLKNADQILVLDKGKIIQEGNREELMDQHDYYEDFLFQS

SEQ ID NO: 34469 - DNA, 1749 bp, Oceanobacillus iheyensis HTE831
  CDS (1)..(1749)
ttggaaacatttaagaaactgaagcgtttttattggccatacaaaaaatattttatatggtcgatactgtttatgttagttgttacttcgattactgtcgtttatccgatcatgctacaaattacgattgatgatgttgtggttcagtcacgttatgaattaattccatggatctgtggacttttcttagggttaatggttatcaaaggtttctctactttttcattccaatatttaggcgatttatttggaatgacttccgtttataagttaagagaatctctttatgataagttacaaacgttagcattcaaatattatgataatgctaaaaccggagatattatgtctaggttaactgctgatgtagaaggattcaggtttttcctttcagttggatttgcggaattgttacgaattatatcacttatacttattagtttatctattatgttttattactctgtaccattagcacttgtaacaatggcagctatgccttttttagcaattgttgtttttcaattcgataaacgtgtacatccagcttttcgtaatgtaagaaaatcttttggacagttaaatacaagagtccaagagaatataagcgggatgaatactgtcaaatcattatctagagaagactttgaaattgggagattttctaacagtaatgataattatcggcagaagtatttatttacatcaaaattgtgggcacgattctttccgatgatggagtttatcggtaatgtatccgcagtagttttacttgcttatggcggttacttagttatcaatgaaaccatgaatccgggagaattggtcgcttttttcagtttagtgtggtatatcatggggccgctaatgaatttagggtttattattaatcaattttctcaagcgaaagcatctggagagagattattagaaatattagaagcgaaggaagatattgttgagaaggaatcagcaatagaaacaactatcaaagggcatgttgagtttaatgatgtcactttaacttatattaaggatgatgatgaagcattaaagaacattagctttgatgctccgccaggaaaaacgattggattaattggggctaccggatctggaaaaacaagtattacccaattaattactcgattttatgaaccggaacaaggagaagtattgcttgatgggcgcccggtaagtgattataagttaaagacacttcgaagtcagattgggtttgtgctacaagagccgttccttttttctacaacaattcgagagaatatatcttatggaaatcctgaggttacagaagatcaaatagttcaggctgcaaaaatggctcaggcacatgattttattatggagctacctaatgggtacgatacacttttaggagagagagggatgggattatcaggaggtcaaaaacaaaggatagcaattgcgcgtgcaatttgtattgatccaagtattctcattctcgatgatgctacttctgcagtggatatgcagacggaatttaagattcaaaaagcattacgtgaagtaatgaaaaatcgtacttcctttattatagctcatcgtatttcttcattaaaacacgcagatgaaattttagtattagaagatggagaaattgtagagagaggtacacatgatgacctcgtaaacaataatggtccgtatgaacggatatttaatatccaatatcaagatcgagaagaaatcttgagtgcggtaaaatag

SEQ ID NO: 34470 - protein, 582 aa, Oceanobacillus iheyensis HTE831
METFKKLKRFYWPYKKYFIWSILFMLVVTSITVVYPIMLQITIDDVVVQSRYELIPWICGLFLGLMVIKGFSTFSFQYLGDLFGMTSVYKLRESLYDKLQTLAFKYYDNAKTGDIMSRLTADVEGFRFFLSVGFAELLRIISLILISLSIMFYYSVPLALVTMAAMPFLAIVVFQFDKRVHPAFRNVRKSFGQLNTRVQENISGMNTVKSLSREDFEIGRFSNSNDNYRQKYLFTSKLWARFFPMMEFIGNVSAVVLLAYGGYLVINETMNPGELVAFFSLVWYIMGPLMNLGFIINQFSQAKASGERLLEILEAKEDIVEKESAIETTIKGHVEFNDVTLTYIKDDDEALKNISFDAPPGKTIGLIGATGSGKTSITQLITRFYEPEQGEVLLDGRPVSDYKLKTLRSQIGFVLQEPFLFSTTIRENISYGNPEVTEDQIVQAAKMAQAHDFIMELPNGYDTLLGERGMGLSGGQKQRIAIARAICIDPSILILDDATSAVDMQTEFKIQKALREVMKNRTSFIIAHRISSLKHADEILVLEDGEIVERGTHDDLVNNNGPYERIFNIQYQDREEILSAVK

SEQ ID NO: 34471 - DNA, 1800 bp, Brucella suis 1330
  CDS (1)..(1800)
atgaatcgcgaattgactgcagaagaaggccgtaaacgccgctcgctgaaaccgctgaagagaatgatgccattcctggcgccctataaggttctggttgccggggcgcttttttcattggtgctggctgcggtcacgacccttgccgttccggtggcgctgcggcgcatgatcgatcacggttttaccggctcgaatgcggtcttcgtcaataattacttcggtatgctggtgctgctggcgtttgccctcgctctggcttcgggcctgcgttatttctttgtgatctcgcttggtgagcgcgtggtggcggacctgcgcaatgccgtcttttcgcatgtcaccgcgctttcgccggaatttttcgaccgttcgcagtctggcgaaatcgtgtcgcggctttcgtccgacacgacgcagatcaagtcggtcgtcggggcaaccgcatcggtggcgctgcgcaatatgatactgggtatcggtgcgctggcgatgatggtcgtgacgagcccgaaactttccgctctggtcattgccgctattccgattatcgttattccgcttatcgccttcgggcgctcggtgcgccgccgctcccgcatgacgcaggacatgctggcgagagccaatgcctatgccagcgaacagattggcgcgatgcgcacgctacaggccttcaccaatgaaagcatggtggtgggcagttttgcccatgccgtggaaaaggcctatcaggcggcccgctcctccattcaggcgcgcgccatcctcactgcttttgcgatttttctggttttttccagtattgttgccgttctgtggttcggctcgcgcgatgtgctggcgggcaccatgtcggcgggcacgctcggccagtttgtgctctatgcggtgtttgcgggcagttccttcggggccttgtcggaagtcggcggcgaacttgcgcaagcggccggtgcaaccgagcgcctcgtggaaattctcgatgagaagccgggcattaccgcgcctgcccatccggttgcgctgccgaagccgccgcgtggtgagattgccttcgagaatgtttatttttcctaccccacacgccccgatgcgccgtcgctgaacggccttggcttcacggtcaagccgggcgagacggttgccattgtcggcccatccggggcaggcaaaagcacgatcttctcgctcgtcatgcgctattacgatccgcaatcggggcgcgtcctgatggatggcgtggcgctgccgaatgccgatccgcatgatgtgcgcagtcgcatcgccatggtgccgcaggatgtggccatttttgccaccacgattcgcgaaaatatcggtttcggcaagccgggggccagcgatgcggaaatcatcgctgccgccaaggctgcgcttgcgcatgagttcattatggcgctcgacaatggctatgacacggaagtcggcgagcggggcataacgctttccggcggccagcgccagcgcatcgccattgcacgcgcgcttttgcgcgatgcgccgatcctgcttctggacgaggcgacatccgcgctcgatgccgagagtgaaatgctggtgcaaaaggcgttggatgggctgatggccgatcgcacgacgctcgttgtcgcgcatcggctggccacggtattgaaggccgaccgcatcctcgtgctcgatcatggccgcattgtagaagaaggcacacacgagagccttgtcgcgaagggcggcatctatgcccgccttgccaagctgcaattcgaggcgggtgcgggagcctttgctgcccagtga

SEQ ID NO: 34472 - protein, 599 aa, Brucella suis 1330
MNRELTAEEGRKRRSLKPLKRMMPFLAPYKVLVAGALFSLVLAAVTTLAVPVALRRMIDHGFTGSNAVFVNNYFGMLVLLAFALALASGLRYFFVISLGERVVADLRNAVFSHVTALSPEFFDRSQSGEIVSRLSSDTTQIKSVVGATASVALRNMILGIGALAMMVVTSPKLSALVIAAIPIIVIPLIAFGRSVRRRSRMTQDMLARANAYASEQIGAMRTLQAFTNESMVVGSFAHAVEKAYQAARSSIQARAILTAFAIFLVFSSIVAVLWFGSRDVLAGTMSAGTLGQFVLYAVFAGSSFGALSEVGGELAQAAGATERLVEILDEKPGITAPAHPVALPKPPRGEIAFENVYFSYPTRPDAPSLNGLGFTVKPGETVAIVGPSGAGKSTIFSLVMRYYDPQSGRVLMDGVALPNADPHDVRSRIAMVPQDVAIFATTIRENIGFGKPGASDAEIIAAAKAALAHEFIMALDNGYDTEVGERGITLSGGQRQRIAIARALLRDAPILLLDEATSALDAESEMLVQKALDGLMADRTTLVVAHRLATVLKADRILVLDHGRIVEEGTHESLVAKGGIYARLAKLQFEAGAGAFAAQ

SEQ ID NO: 34473 - DNA, 1830 bp, Shewanella oneidensis MR-1
  CDS (1)..(1830)
atgtttaaacgatttgaatcttgggtggaagccctaccggatggcgaaccaactaaacctcctacgggggtctatgcattttgccgacactacactaagggttatgaattaccacttatcttgatgtcagtgttaacggctttcatcgccatgctcgaagtttcactctttggctttatgggacaattagtcgattggttagtgaaaaaaagcccagagacgctctatcaagatgaaggttcaacgctgatcttaatgggcgttatggtcttagtggtgatgccattgctagtgttatttcatgcgctaatcatgcatcaaaccttactgggcaattatcccatgtcgatccgctggcttgcgcaccgttatttactcaagcaaagcgtgtccttctatcagaatgattttgcgggccgtattgccactaaggtgatgcaaacttcacttgcggtgcgtgaaaccgtgatgaaattactcgatgtattggtgtatatcctcgtgtacttcacctcaatgctggtcatggtggccagtgccgatgtgcgtctagtgatcccaatgttgatttggttggcgctctatattggcttgcaatggtattttgtgccgcgtcttaaaacggtttcaaccgagcaggccgatgcccgctcgacgatgacagggcggattgtcgacagttacaccaatatcaccacggtgaagctctttgcccatacggataaagaagctgattacgccaaagcaagtatgcgcagtttcctcgatacggtttatcgccaaatgcgcctcgtcacggggatcagcgtcagtgtacaaatcattaactacatgctcgccttcagcattgccgccgtgtcaatcgcgctgtggagtgacaatgccatctcggtcggtgcaattgcaattgccgtgagtttagcgctgcgccttaatgggatgtcgcagtggatcatgtgggaaatcagttcattatttgaaaatatcggtacggttaccgacgggatgaacaccctttccaagaccacactcatccaagactcgccggatgcaaataccttagtcgtgaagcaaggccagatcgattttaatcaggtgagctttcattatggcgaagacgctggcgtgatcgacgaactcaacctcaatatcaaagcgggtgagaaggtcggccttgtcggccgctcgggcgcgggtaaatccaccctagtcaatctgttaatgcgcttttacgatgttgagaaaggccatatttgtattgatggacaagacattaaggcggtcaaacaggattcgctacgttcacagattggtatggtcacccaggatacctccctactccatcgcaccattcgggagaatattctttacggtaaccctggggcaagtgaaatccaactcgaacatgcgataaaacaggcacaggcacatgattttattaatgaactgactgatcctaatggcaatcatggtttggatgctcaagttggggaacgtggggtaaaactctccggcggacagagacagcgtgtagccattgccagggtgctattaaaaaatgccccgattttactgcttgatgaggccacctcagcattggactccgaagtggaagccgccattcaagaaagcttgtacgaattaatgcaaggcaaaacggtgattgctatcgcccatcgattatcgactattgctgcaatggacagattaatcgtgctcgatcaaggtcgtatcgtcgagcaaggtacgcatcaggagttgattgccgcaggcggtatttatgcccagctatgggctcaccaaaccggcggatttttaggggttgaatag

SEQ ID NO: 34474 - protein, 609 aa, Shewanella oneidensis MR-1
MFKRFESWVEALPDGEPTKPPTGVYAFCRHYTKGYELPLILMSVLTAFIAMLEVSLFGFMGQLVDWLVKKSPETLYQDEGSTLILMGVMVLVVMPLLVLFHALIMHQTLLGNYPMSIRWLAHRYLLKQSVSFYQNDFAGRIATKVMQTSLAVRETVMKLLDVLVYILVYFTSMLVMVASADVRLVIPMLIWLALYIGLQWYFVPRLKTVSTEQADARSTMTGRIVDSYTNITTVKLFAHTDKEADYAKASMRSFLDTVYRQMRLVTGISVSVQIINYMLAFSIAAVSIALWSDNAISVGAIAIAVSLALRLNGMSQWIMWEISSLFENIGTVTDGMNTLSKTTLIQDSPDANTLVVKQGQIDFNQVSFHYGEDAGVIDELNLNIKAGEKVGLVGRSGAGKSTLVNLLMRFYDVEKGHICIDGQDIKAVKQDSLRSQIGMVTQDTSLLHRTIRENILYGNPGASEIQLEHAIKQAQAHDFINELTDPNGNHGLDAQVGERGVKLSGGQRQRVAIARVLLKNAPILLLDEATSALDSEVEAAIQESLYELMQGKTVIAIAHRLSTIAAMDRLIVLDQGRIVEQGTHQELIAAGGIYAQLWAHQTGGFLGVE

SEQ ID NO: 34475 - DNA, 1788 bp, Shewanella oneidensis MR-1
  CDS (1)..(1788)
gtgtctcaacaatcttcttacgcctcggttagccagcgggcggtgttaccttggatttggcaatttcttaagccctatcgcccgcgggttgtcgcggcgattgtattcttattgatcggttctttggcttggttatccctcggccaaggtgtgcgtttgatggtggacgaggggtttattaaggataacgcccagcgccttaatgagatcattctgttcgtactggtgattactgctgtgagtggcactgcggtgttctgccgcttttatctgatgacatggcttggggagcgtgtcagtgccgatattcggcttgcggtttacaatcaattacttaagttatctccggcgttttatgccaaggtgcgtactggcgaggtgatttcgcgttttaccgccgattccactttactgcaaacagtggtcggctcgagtctttctatggcactgcgctccggcgtgacggttattggtgggctggcgatgatgggaatcaccagcgtgaagatgacactactggtgctactggcggtacctttagtgcttggaccggttagtttttttggcagaaaggtgcgcaccttagcgcgcgagagccaagatagggtggcggatctcggtgcctatgtggatgaaaccttgcatgagatccacacagtgcaggcctatggccatgaggataaggaccgcagtttatttaacggccgtgtcgaagatgtgatgaccgccgccagcggccgcattcgttaccgcgcgctgctgatttcatcagtgatgttcctcagtattgccgctattgcgctagtgacttgggtcggcgcccacgatgtgatgtcgggtaagatgacgggcggcgaactctcagcctttatgttttatgccgtgatggtcgctggcgcggttgcgaccattagtgaagtggtgggggaaatccaacgcgcctcgggcgccgccgaacgtttaatcgagttggctgagactgaggtcgatattccggcgccgctggtgcctaaaactttgcccacgaaagtgcgtggcgagctgcaattacatcagctgaacttccattatcccgagcaaactcagttagtgctcagcgacttaaaccttgtaataaatgccggcgagcgggtggctttggtcggcccgagtggtgccggtaagagtaccctgtttcagttattgcagcggttttatgtgccttcatcgggcagtatcttattggatgggattgatattgctgcgctttcaccacaggatttacgggcacagtttgcgctggtgccgcaggattcggttatttttgccaccagtgtgctggaaaacgtgcgctatggccgcgtcgatgctagcgagcaagaagtgattgatgcctgtattgcagcccgagcacatgagtttatcagtgaatttagcgagggatatcaaacctatttgggtgagcgtggcgtgcgtttatctggcgggcaaaaacaacggattgccattgcgagggccattttagccgacagacccatcctattactcgatgaggccaccagtgcactcgatgccttgagtgagcaaaaagtcaaacaggcgctcgatgagttaatggcaggtaaaaccacgctaatcatcgcccatcggctagccaccgtaattaatgcggatcggattattgtgtttgataaggggcgaatcgttgccagcggcaaacatcaagatttaattaaaaccaatgctttataccgcgagtttgcgactctgcagctattgacggatgaggctatgccactgagtgattaa

SEQ ID NO: 34476 - protein, 595 aa, Shewanella oneidensis MR-1
MSQQSSYASVSQRAVLPWIWQFLKPYRPRVVAAIVFLLIGSLAWLSLGQGVRLMVDEGFIKDNAQRLNEIILFVLVITAVSGTAVFCRFYLMTWLGERVSADIRLAVYNQLLKLSPAFYAKVRTGEVISRFTADSTLLQTVVGSSLSMALRSGVTVIGGLAMMGITSVKMTLLVLLAVPLVLGPVSFFGRKVRTLARESQDRVADLGAYVDETLHEIHTVQAYGHEDKDRSLFNGRVEDVMTAASGRIRYRALLISSVMFLSIAAIALVTWVGAHDVMSGKMTGGELSAFMFYAVMVAGAVATISEVVGEIQRASGAAERLIELAETEVDIPAPLVPKTLPTKVRGELQLHQLNFHYPEQTQLVLSDLNLVINAGERVALVGPSGAGKSTLFQLLQRFYVPSSGSILLDGIDIAALSPQDLRAQFALVPQDSVIFATSVLENVRYGRVDASEQEVIDACIAARAHEFISEFSEGYQTYLGERGVRLSGGQKQRIAIARAILADRPILLLDEATSALDALSEQKVKQALDELMAGKTTLIIAHRLATVINADRIIVFDKGRIVASGKHQDLIKTNALYREFATLQLLTDEAMPLSD

SEQ ID NO: 34477 - DNA, 1773 bp, Streptococcus mutans UA159
  CDS (1)..(1773)
atgaagaaaaaatcaacaatggcttggatatctgagttcattgcaccctatagatttcattatatagcaagtgtgcttttagcctttgcttccgttatttgtggttttctgccttatttttatattggacggattattcgtgatttgttcaatggtcttaaaaatgggcagctttatttacaagcatgtctgtggatggctgttttttggttggcttatgccatttgtcatgctctatcaacggctctttcgcatagagctacttttattgttttagcggacattcgttttcgtttaacagaaaaattagctaagattcctttaggatctgtctttgcgcaatcgtctggatcctataaaaatattatcgttgagcgtgtggatgaagctgaaacaaccctagctcatattattccagaattcacggcgtccttatttggtcctttaattgttttaatttatatgataagattggattggcgtttgacccttttatctcttttaaccttgccaatcggcattttattttatgtcaatatgttgcgtaagagtaagggagattttgaaaatacagtggttaagactaaggctttaaatgatacagctgttgaatatatcaatggcattgaagtgatcaaggtatttggaaaggaaaaattttcctatcagaaatttgtcacagcagctaaagaaggagctgactgttttattgattggatgcgtaagtgtcaatttgatatggcagcagtcattgttatcatgccttcgatcttagctatccttttacctgttggtgcttattttgtttacagtggcagtttatcccaagacaatttcattttactaatgattttatcaatgggattgctgacgcctttgataacactgggaacttatatggatgacattagaaaagtggggaccatttttggtgaaattacggaaattttggaacatcctgatttacaacggccacaagaattggagcaacctttacaaggaaacgatattcttttagaaaaggtttcttttgcctatgaagaggacaaggatgtactgcatgatatttctttgaccatcaaatctgggacagttaatgccttggtcggtccttctggctctgggaagtccactttagccaaattaattgcttctttctgggatgttagaacaggcagcatttcttttggcggacttgatatcagaaagattccactggaagaatacagtcggctgatcgcctatgtttctcaggacaattttctctttaatgatagtattttagagaatattcgtttgggcaagccatctgccagtgatgaagaggtttaccaagttgctaaagattgcggttgttatgattttatcatgaatcttgaaaatggctttgcaacgcaggttggtagttctggcagcagcctgtctggcggtgaacgccaaagaatagccattgccagagccatgctaaaggatgcccctgtggttattttggatgaagcgactgcttataccgatcctgaaaatgaagctctggtacaatcaagcattgcacaattagtgaaagataaaaccttgattgtgattgcccatcgcctctcaaccattgctgatgcagatcagattattttagtaaatgagggacatatagaagcaattggcaagcaagaagacttactcaagtcaagcgacctctatcaaaagatgtggcaggcacatttgtcggtcaaagatgcagaccgtgatgaaaagataggaggcctggctcatgcttag

SEQ ID NO: 34478 - protein, 590 aa, Streptococcus mutans UA159
MKKKSTMAWISEFIAPYRFHYIASVLLAFASVICGFLPYFYIGRIIRDLFNGLKNGQLYLQACLWMAVFWLAYAICHALSTALSHRATFIVLADIRFRLTEKLAKIPLGSVFAQSSGSYKNIIVERVDEAETTLAHIIPEFTASLFGPLIVLIYMIRLDWRLTLLSLLTLPIGILFYVNMLRKSKGDFENTVVKTKALNDTAVEYINGIEVIKVFGKEKFSYQKFVTAAKEGADCFIDWMRKCQFDMAAVIVIMPSILAILLPVGAYFVYSGSLSQDNFILLMILSMGLLTPLITLGTYMDDIRKVGTIFGEITEILEHPDLQRPQELEQPLQGNDILLEKVSFAYEEDKDVLHDISLTIKSGTVNALVGPSGSGKSTLAKLIASFWDVRTGSISFGGLDIRKIPLEEYSRLIAYVSQDNFLFNDSILENIRLGKPSASDEEVYQVAKDCGCYDFIMNLENGFATQVGSSGSSLSGGERQRIAIARAMLKDAPVVILDEATAYTDPENEALVQSSIAQLVKDKTLIVIAHRLSTIADADQIILVNEGHIEAIGKQEDLLKSSDLYQKMWQAHLSVKDADRDEKIGGLAHA

SEQ ID NO: 34479 - DNA, 1740 bp, Streptococcus agalactiae NEM316
  CDS (1)..(1740)
atgaagtctaatcaatggcaagtctttaagagattaatctcctatttacgcccttataaatggtttacagtattagctctatctctcttattgttgacgactgttgttaaaaatattattcctttaattgcttcacattttattgatcactatctgacaaatgttaatcaaacagcagttcttattttagtgggatattattcaatgtatgtcttgcagaccttaattcaatattttgggaatctcttttttgcgcgtgtttcttatagtattgttagagatattcgtagagatgcttttgctaatatggaaaggctaggcatgtcttattttgataggacaccggcaggatctattgtgtcacgtattactaatgatactgaagcaatatctgatatgttttcgggtattttatcaagttttatctcggcgatatttatttttacagttactctgtacactatgttgatgctagacattaaactaacaggactcgtcgctcttttgttacctgttatctttatattagtgaatgtctatcggaaaaaatcagtcactgtcattgctaaaacgagaagtttacttagtgatatcaacagtaaattatcagaaagtattgaaggaattcgcattgtacaggcttttggtcaagaagagcgcttgaagactgaatttgaggaaattaacaaagagcatgttgtgtatgccaatcgttctatggctcttgatagtctcttcttaagaccggcgatgtctcttttaaaactcctagcatatgctgttcttatgtcttattttggatttacaggagttaaaggaggtcttacggcaggattaatgtatgcttttattcagtacgttaatcgtctatttgaccctttaattgaagtaacgcaaaatttttcaaccttacaaacatcaatggtatcagcagggcgtgtgtttgatctgattgatgaaacaggttttgaaccaagccaaaaaaatacagaagcttttgtgagagaaggaaatatcgaatttaaaaatgtatcattctcatatgatggaaaaaaacaaatccttgataatgtttcttttagtgttaaaaaaggtgaaactattgcttttgtaggagcgacaggttctggaaaatcatctattattaatgtctttatgaggttttacgaatttcaatctggacaagttttattagatgggaaggatattagggattactcacaagaacaattgcgaaagaatattggactcgtcttacaagacccctttttatatcatggcactattaaatctaatatcaaaatgtaccaagacatcaccgatcaagaggtacaggacgcagcagagtttgttgatgctgatcaatttattcagaagttgccagataagtacgattcagctgtttcagaacgtgggtcaagtttttcaactggacaacgccaactattagcgtttgccagaactgtggctagtaaacctaaaattttaatcttagatgaggcgacagcaaatattgattcggaaacagagcagattgtacaagattcgttagcaaaaatgcgtcaaggtcgaacaacaattgccattgctcaccgcttatcaaccattcaagatgctaattgtatctatgttcttgatagaggaaagataattgaaagtgggaatcacgagtctttattagaccaaaaagggacttattatcgtatgtaccaattacaagccggcatgatggaggtctag

SEQ ID NO: 34480 - protein, 579 aa, Streptococcus agalactiae NEM316
MKSNQWQVFKRLISYLRPYKWFTVLALSLLLLTTVVKNIIPLIASHFIDHYLTNVNQTAVLILVGYYSMYVLQTLIQYFGNLFFARVSYSIVRDIRRDAFANMERLGMSYFDRTPAGSIVSRITNDTEAISDMFSGILSSFISAIFIFTVTLYTMLMLDIKLTGLVALLLPVIFILVNVYRKKSVTVIAKTRSLLSDINSKLSESIEGIRIVQAFGQEERLKTEFEEINKEHVVYANRSMALDSLFLRPAMSLLKLLAYAVLMSYFGFTGVKGGLTAGLMYAFIQYVNRLFDPLIEVTQNFSTLQTSMVSAGRVFDLIDETGFEPSQKNTEAFVREGNIEFKNVSFSYDGKKQILDNVSFSVKKGETIAFVGATGSGKSSIINVFMRFYEFQSGQVLLDGKDIRDYSQEQLRKNIGLVLQDPFLYHGTIKSNIKMYQDITDQEVQDAAEFVDADQFIQKLPDKYDSAVSERGSSFSTGQRQLLAFARTVASKPKILILDEATANIDSETEQIVQDSLAKMRQGRTTIAIAHRLSTIQDANCIYVLDRGKIIESGNHESLLDQKGTYYRMYQLQAGMMEV

SEQ ID NO: 34481 - DNA, 1833 bp, Pseudomonas putida KT2440
  CDS (1)..(1833)
gtgcttgatgtaccagggtcacccgacccggtaccgggcaagccatacactgcgggcgatcgactgagctgggcggaaatccgccgcctggccttgcatcacaagaaaaacctctggtccgccaacctcattgcgttactggcggcgtgttgcagtgtgcccattccgctgctgctgccgctgttggtggacgaagttctgctcggccatggcgatgctgcgctgaagtggatgaaccatctgctgccgtccagctggcaggtggcagccggctacatcggcctgatgctggcgctcaccctgtgcctgcgcctggctgcactggcgttcaacgttatccagtccaagctgttcgccgggctggccaaggacatcgtctaccgcctgcgcatccgcctgatcgagcgcctcaagcgtatttcgctgaaagagtacgaaagcctgggcagcggcacggtgaccacccacctggtcaccgacctggacaccctcgacaagttcgttggcgaaaccctcagccgcttcctggtggccatgctgacactgaccggcacggcggccatcctgatctggatgcactggcagctggccttgctgatcttgctgttcaacccgctggtgatctacttcaccgtgcagttgggcaagcgcgtcaagcacctgaaaaagctcgaaaacgacagcaccgcgcgctttacccaggcgctagcggaaaccctcgatgccatccaggaaatccgcgccggcaaccgccagggctacttccttggccgcctgggcttgcgtgcccgcgaggtgcgcgattacgccgtggactcgcaatggaaaagcgatgccagtggccgtgccagtggcctgctgttccagttcggcatcgacatcttccgcgcggcggccatgctgaccgtgctgttttccgacctgtcgatcggccagatgctggcggtgttcagctacctgtggttcatgatcggtccggtggagcaactgcttaatctgcaatatgcctactacgccgcaggcggtgcgctgagccgcctcaacgagctgctggcgcgtgccgacgagccgcaatacccggccgccagcgacccgttcgccgggcgcgaaacggtgggcattgaagtgcgcgacctgcgctttgcctatgccgacgagccggtgctcgagcacctcgacctgtccatcgctgcgggtgagaaggtggcgattgtcggtgccagcggcggcggcaagagcacgctggtgcagctactgctgggcctttacagcgcccaggccgggaccatccgctttggcggggccagcctgcaggaaatcggcctggaaaccctgcgcgagaacgtcgcggtggtgttgcagcacccgtcgctgttcaacgacagcgtgcgggccaacctgaccatgggccgcgactgcagcgatgatgcgtgctggcaggcgctgcgcatcgcccagctggatgccaccatcgccgccttgccgcagggcctggacagcgtggtagggcgttcaggcgtgcgcttgtccggtggccagcgccagcgcctggccattgcccgcatggtactggctgagcccaaggtggtgatcctcgacgaggccacctcagccctggatgccgccaccgagtacaacctgcatcaggccttggcgtgcttcctcagcggccgcaccacgctgatcatcgcccaccgcttgtcggcggtgaaacaggccgaccgggtgctggtgttcgatggcgggcacgtggccgaagacggcgaccatcagcagctgattgccgagggtgggttatacgccaagctgtatgggcatctgcagcagagctga

SEQ ID NO: 34482 - protein, 610 aa, Pseudomonas putida KT2440
MLDVPGSPDPVPGKPYTAGDRLSWAEIRRLALHHKKNLWSANLIALLAACCSVPIPLLLPLLVDEVLLGHGDAALKWMNHLLPSSWQVAAGYIGLMLALTLCLRLAALAFNVIQSKLFAGLAKDIVYRLRIRLIERLKRISLKEYESLGSGTVTTHLVTDLDTLDKFVGETLSRFLVAMLTLTGTAAILIWMHWQLALLILLFNPLVIYFTVQLGKRVKHLKKLENDSTARFTQALAETLDAIQEIRAGNRQGYFLGRLGLRAREVRDYAVDSQWKSDASGRASGLLFQFGIDIFRAAAMLTVLFSDLSIGQMLAVFSYLWFMIGPVEQLLNLQYAYYAAGGALSRLNELLARADEPQYPAASDPFAGRETVGIEVRDLRFAYADEPVLEHLDLSIAAGEKVAIVGASGGGKSTLVQLLLGLYSAQAGTIRFGGASLQEIGLETLRENVAVVLQHPSLFNDSVRANLTMGRDCSDDACWQALRIAQLDATIAALPQGLDSVVGRSGVRLSGGQRQRLAIARMVLAEPKVVILDEATSALDAATEYNLHQALACFLSGRTTLIIAHRLSAVKQADRVLVFDGGHVAEDGDHQQLIAEGGLYAKLYGHLQQS

SEQ ID NO: 34483 - DNA, 1764 bp, Pseudomonas putida KT2440
  CDS (1)..(1764)
atgcccgaatcggtttccctgcgccaacgccgtgccttgcgcctggcctggcagttcgttcgcccttatcgccgccaggtgctgctggcattgctggcgctggtggtcaccgctgccatcaccctgtcgatgggccaaggtatccgcctgctggtggatcaaggcttcatgacccgctccgcgcaccagctcaatcagaccatcgggctgttcctgctgctggtgctggcgctggcggtgggtaccttcagccgtttctatctggtgtcgtggattggcgagcgttgtgtggccgatatccgtcgtgcggtcttcgatcacctgatcggcctgcacccaggttttttcgaggacaaccgcagctccgagatccagtctcggctgactgcggacaccaccttgctgcaatcagtgatcggttcatcgctgtcgatgttcctgcgcaacgcgctgatggtcattggcggtgtggtattgctgttcatcaccaaccccaagctcaccagcatcgtggtggtaacgctgccgctggtgttggcaccgatcctgttgttcggccgtcgggtgcgcagcctgtcgcggcagagccaggacagagtcgccgatgtgggcagctacgtggctgagacgctggggcagatcaagaccgtgcaggcctacaaccaccaggcgcacgaccgcgaactgttcgccgatacggtcgaagcagcgtttactgttgcccgcaagcggattacacagcgtgcctggctgattaccctggtgatcgtgctggtgttgggggcggtgggggtgatgctgtgggtcggcggcatggatgtgatcgccgggcgtatatccgcaggcgagctggcagcattcgtgttctacagcctgatcgtcggcagcgccttcggtaccctcagtgaggtgatcggcgagctgcaacgggccgcgggtgcagccgagcgcattgccgaactgttggccgcgcgcagtgccatcctgccccccgacgtggcgcaggtgctgccgcagccgcgggccagcggtcatatcgagctgcaacaggtcgtgttcgcttacccttcacggcccacggtggcagctgtcgacggcctgagcctgaccatcgaacccgggcagaccgtcgccctggtaggcccttccggggcaggcaagtcgaccctgttcgatctgttgctgcgcttttacgacccacagcaagggcgcatcctgctcgatggtcagccggttaccgactttgatcccgaccagctacgccggcagttcgctttggtggcacaaaacccctcgctgttccgtggcacggtggaggccaacattcgttatggccggcccgaggcgaccttggctgaagtcgaagcagcagcccgcggcgcccatgccgacgaattcatccggcaattgccccaaggctaccagaccccgctgggggagggcggcatcggcctttccggcgggcaacgccagcgcctggcgattgcccgggccttgctggtcgatgcgccgatcctgttgctggacgaagccaccagtgcccttgatgcacaaagtgaatacttgatccagcaagcgctgcccagcctgatggccggccgtaccacgctggtgatcgcccatcgcctggccacggtacagcatgccgagcgcatcgcggtcatcgaccagggccggctggtggcggtgggcacccaccgtcagttgattgaggacagcccgttgtatgcgcggctggcagcgctgcaattcaccacgggctag

SEQ ID NO: 34484 - protein, 587 aa, Pseudomonas putida KT2440
MPESVSLRQRRALRLAWQFVRPYRRQVLLALLALVVTAAITLSMGQGIRLLVDQGFMTRSAHQLNQTIGLFLLLVLALAVGTFSRFYLVSWIGERCVADIRRAVFDHLIGLHPGFFEDNRSSEIQSRLTADTTLLQSVIGSSLSMFLRNALMVIGGVVLLFITNPKLTSIVVVTLPLVLAPILLFGRRVRSLSRQSQDRVADVGSYVAETLGQIKTVQAYNHQAHDRELFADTVEAAFTVARKRITQRAWLITLVIVLVLGAVGVMLWVGGMDVIAGRISAGELAAFVFYSLIVGSAFGTLSEVIGELQRAAGAAERIAELLAARSAILPPDVAQVLPQPRASGHIELQQVVFAYPSRPTVAAVDGLSLTIEPGQTVALVGPSGAGKSTLFDLLLRFYDPQQGRILLDGQPVTDFDPDQLRRQFALVAQNPSLFRGTVEANIRYGRPEATLAEVEAAARGAHADEFIRQLPQGYQTPLGEGGIGLSGGQRQRLAIARALLVDAPILLLDEATSALDAQSEYLIQQALPSLMAGRTTLVIAHRLATVQHAERIAVIDQGRLVAVGTHRQLIEDSPLYARLAALQFTTG

SEQ ID NO: 34485 - DNA, 1659 bp, Pseudomonas putida KT2440
  CDS (1)..(1659)
atgaccagtaaaccacgtggcgccgtcagcgaactgttcggcctgctcaaacccttctggcccctggtgacggtttcgatcatcctgggcatggtcggtggcctcagtgtcaccgccctgctggcgaccatcaactcggccctgcacagcgacaccggcctgactcaaggcgtggtcctgggttttgccgggctgtgcctgctggcgctgttcagctcgatctgctcggacatgggcaccaactgggtcggccagcacatcatcgcgcgcctgcgccgtgagctgggcgagaaggtgctggcagcgccgatcgaccagatcgaacgctaccgcagccatcgcctcatccccgtgctgacccatgacgtcgacaccatcagcgacttcgccttcgtcttcgcgcccctggccgtttcgctcaccgtcaccgtgggctgcctgggctatctggcgcacctgtcgataccgatgttcctggtgatcctggtggccatcggcatcggctcggtcatgcagttcgttgcccgctcgtggggtgtgcgcggcttcgaaagcgcccgagaagccgaggatgaactgcaaaagcattacagcgcgatcgccgaaggtgccaaggaactgcgcattcaccgcccacgccgcaaacgcatgttccagcacggcatccaggacaccgccaaccgtatttgcgccacccaggtacgctcgatcaacaccttcgtaatcgccaagaccctgggctcgatgctgttcttcgtggtcatcgccgtggccctggccatgcagtcgctgtggcccacaggcgacaagagcgtcaccagcggtttcgtgctggtgctgctgtacatgaaaggcccgctggaacacctgatcagcaccctgccgatcatcagcaaggcccagatcgccttccgccgcatcgccgaactgtcacgccagttctcatcgcccgagccgcacttgctgctggatgacacccgcgccgccgacaaggccctgcacaccctgcagctgcaggacgtcagctacaccttcccccgcgtggaaggcagtgagccgtttcatctgggtccggtgaacctgagcatcaagcaaggcgacatcgtgttcatcgtcggcgaaaacggttgcggcaagaccacccttatcaagctgctgctcggcctatacgcacctcagcaaggcacgatcagcctcgacggcaagccggtgacggccgaaaaccgtgacgactaccggcagctgttcaccaccatcttcgccgactactacctgttcgacgatgtcatccagggtgaccggccagtacctgccgacgccagtcgctacctggagcgcctggagatcgctcacaaggtcagcatccgtgacggcgtgttcagcaccaccgacctgtccactggccaacgcaagcgcctggcgctagtgagcgcctggctggaggagcgcccggtgctggtgttcgacgaatgggccgccgaccaggatccgacgttccggcgaattttctacacagagctgctgccggacctcaagcgcctgggcaagaccatcatcgtgataagccacgacgaccgctacttcgacgtcgccgaccagctcatccacatggcggcaggcaaggtccaacaggagaaccgcgtcgcagattgcatttaa

SEQ ID NO: 34486 - protein, 552 aa, Pseudomonas putida KT2440
MTSKPRGAVSELFGLLKPFWPLVTVSIILGMVGGLSVTALLATINSALHSDTGLTQGVVLGFAGLCLLALFSSICSDMGTNWVGQHIIARLRRELGEKVLAAPIDQIERYRSHRLIPVLTHDVDTISDFAFVFAPLAVSLTVTVGCLGYLAHLSIPMFLVILVAIGIGSVMQFVARSWGVRGFESAREAEDELQKHYSAIAEGAKELRIHRPRRKRMFQHGIQDTANRICATQVRSINTFVIAKTLGSMLFFVVIAVALAMQSLWPTGDKSVTSGFVLVLLYMKGPLEHLISTLPIISKAQIAFRRIAELSRQFSSPEPHLLLDDTRAADKALHTLQLQDVSYTFPRVEGSEPFHLGPVNLSIKQGDIVFIVGENGCGKTTLIKLLLGLYAPQQGTISLDGKPVTAENRDDYRQLFTTIFADYYLFDDVIQGDRPVPADASRYLERLEIAHKVSIRDGVFSTTDLSTGQRKRLALVSAWLEERPVLVFDEWAADQDPTFRRIFYTELLPDLKRLGKTIIVISHDDRYFDVADQLIHMAAGKVQQENRVADCI

SEQ ID NO: 34487 - DNA, 1896 bp, Escherichia coli CFT073
  CDS (1)..(1896)
gtggcaatcatgatgagctggcgcaacaaagtggctggtatcgcgatatgtatcgctatcaacaactggaggcggcgctcgacgacgctccggaaattcgcgaggaggccatcgatgcgtagttttagccaactgtggccgactctcaagcgcctgttagcgtacggttcgccgtggcgtaaaccgttggggattgcggtcctgatgatgtgggttgcggcggcggcagaagtcagtgggccgctgcttatcagctattttatcgacaatatggtagcgaaaaataacctgccgttgaaagtggttgcagggctggctgcggcgtatgttgggctgcaactgtttgccgccgggctacattacgcgcagtcgctgctgtttaatcgggcggcagtaggcgtagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgtagcgccgcactggtgggcgcgatgctggtggcgatgttcagcctcgactggcgaatggcgctggtggcgataatgattttcccggtggtgctggtggtaatggtgatatatcagcgttacagcacgccgattgtccgtcgtgtgcgcgcttatctggcggatatcaacgacggctttaacgaaatcatcaatggcatgagcgttatccagcagttccgtcagcaggcgcgatttggcgaacgtatgggtgaggccagtcgttcacactatatggcgaggatgcaaaccctgcgcctcgacggttttctgctgcgtccgctgctgagtctgttttcatcgctcattctttgtggcttgttgatgctgtttggtttctccgccagcggcaccattgaagtgggcgtgttgtatgcgttcatcagttatttggggcgacttaacgaacccttaatcgaactgaccacgcagcaggcgatgctgcaacaggctgttgttgctggtgagcgcgtttttgagctgatggacggaccgcgccagcaatatggcaatgatgatcgcccgttgcagagcggcaccatcgaagtcgataacgtgtcatttgcttatcgcgatgacaatctggtgctaaagaacattaatctctctgtgccttcgcgcaactttgtggcgctggtcgggcataccggcagtggcaaaagcaccctcgccagtttattgatgggctattacccgctaacggaaggtgagattcgccttgatggtcgtccattaagttcgctaagtcacagcgcgctgcgccagggcgtggcaatggtgcagcaagatccggtggtgctggcggataccttcctcgccaacgtgacgctggggcgtgatatctccgaagaacgcgtctggcaggcgctggaaaccgtgcaactggcggagctggcgcgtagcatgagcgacggtatttacacgccgcttggcgagcaggggaataatctctcagtcgggcaaaagcaactgctggcactggcacgcgtgttggtggagacgccgcaaatcctgatccttgatgaggcaacagccagcattgactccggtactgaacaggcgattcaacatgctctggcggcggtgcgtgaacatactacgcttgtggtgattgctcaccgcttatcaactattgttgatgccgacaccattctggtgcttcatcgtgggcaagctgtggagcagggcactcaccagcaactgctggcggcccagggacgctactggcagatgtatcaactgcaacttgcgggcgaagagctggcagccagcgtgcgtgaagaggaatcattgagcgcctga

SEQ ID NO: 34488 - protein, 631 aa, Escherichia coli CFT073
MAIMMSWRNKVAGIAICIAINNWRRRSTTLRKFARRPSMRSFSQLWPTLKRLLAYGSPWRKPLGIAVLMMWVAAAAEVSGPLLISYFIDNMVAKNNLPLKVVAGLAAAYVGLQLFAAGLHYAQSLLFNRAAVGVVQQLRTDVMDAALRQPLSEFDTQPVGQVISRVTNDTEVIRDLYVTVVATVLRSAALVGAMLVAMFSLDWRMALVAIMIFPVVLVVMVIYQRYSTPIVRRVRAYLADINDGFNEIINGMSVIQQFRQQARFGERMGEASRSHYMARMQTLRLDGFLLRPLLSLFSSLILCGLLMLFGFSASGTIEVGVLYAFISYLGRLNEPLIELTTQQAMLQQAVVAGERVFELMDGPRQQYGNDDRPLQSGTIEVDNVSFAYRDDNLVLKNINLSVPSRNFVALVGHTGSGKSTLASLLMGYYPLTEGEIRLDGRPLSSLSHSALRQGVAMVQQDPVVLADTFLANVTLGRDISEERVWQALETVQLAELARSMSDGIYTPLGEQGNNLSVGQKQLLALARVLVETPQILILDEATASIDSGTEQAIQHALAAVREHTTLVVIAHRLSTIVDADTILVLHRGQAVEQGTHQQLLAAQGRYWQMYQLQLAGEELAASVREEESLSA

SEQ ID NO: 34489 - DNA, 1794 bp, Mycoplasma penetrans HF-2
  CDS (1)..(1794)
atgaaacaacatattggatatataagtgtatttaaaagactaatattgatgttgagtaaaaacaaaaaagctttttatggtgcaatctttttgtcattattgaaaactactttttctgttgctacttcaattggtttaggaattgtgattcaaaactttttctatgatttaaatagcaattcaccagcttctgcatttattaacttctcaattggttgtgctttaatcatgataggttatactttatacttttttgcatatattatcagtcaaaaactaatcttaaaattgacctatcatattggttattctattagagaattattctttaataagattagaagaatgccttttaaaattgttgaaaaagcagcaaggggagatttaattagtagaggtacaactgatactaatgcacttgcaattaatttatctgtttgtattggggaaatctttacagcaccacttgtagtaattggtgtgtttattggattacttattatttcaccaatcttaactgctatcacattaggtttttatttagtgttagttacagtgtcatttattatctctttaaaagcaggaccaaaatacatgagaatgcaaaatgaagttggtaaattaaatggagttgttgaagaatatgtttctggaagaaaagcaattaaatctttttgttatgaagaaaaagcatttaatttatttaaagaaataaatcataatcaagctaaagaatctagaggggctgaaatgattttaaatttcatttgaccttgaaatgattttattgaaacagtgatgtatgcttttatttatgtgttaggaattatcttttttgtaaacaatattaatagtggaagtatcttttttccaagttatgaaataggattattaacttcttttgttttattggcaagaattgcaactggtgaaacaagtaattcattaagacttgctggaactttacaaaaaacaacagtagcatcaaaaagagtgtttgcagtgttggatgaaatcaatgaagtggatcaaggaaaacttgaacctacagttcaaggaaaaattgaatttaaaaatgttaatttttcatatgttgaagatagaccaattttaaaaaatgttagtttcacaatcaaccctaatgaaacagttgcaattgttgggccaacaggaagtggtaaaaccacaatggcatctttgatttcaagattttatgaaattgattcaggagagattttgattgatggaactaatattaaagatattagtaaacaaagtttatttaaaaacatttcaattgttttacaagatcctttcttattttcagaaagtattgaaaaaaatatttgatatggaaacactaatgcaacagctgaacaagttatagatgtttgtaaaaaatctaatgttgattactttattaaaaaattaccagatgggtatgagactatcatgtctgaaaaaatgagtgatttgtcacttggtcaaattcagttaatttcaattgcaagagcatttatgtcagaagctaaaatattagtattagatgaagcaacttcatctgttgacacaaagactgaaattgatattcaaaatgctttaatgaaaattactaataacaaaactgtaattgttattgcacaccgtttatctactgttgtcaaagcagataaaattattgttttaaaagatggtgaaattcaagaaattggtaatcataaacaactattaaaaaataaagggttttactatagtttatataaagcaaatgctgtcatggaagaccatgaataa

SEQ ID NO: 34490 - protein, 597 aa, Mycoplasma penetrans HF-2
MKQHIGYISVFKRLILMLSKNKKAFYGAIFLSLLKTTFSVATSIGLGIVIQNFFYDLNSNSPASAFINFSIGCALIMIGYTLYFFAYIISQKLILKLTYHIGYSIRELFFNKIRRMPFKIVEKAARGDLISRGTTDTNALAINLSVCIGEIFTAPLVVIGVFIGLLIISPILTAITLGFYLVLVTVSFIISLKAGPKYMRMQNEVGKLNGVVEEYVSGRKAIKSFCYEEKAFNLFKEINHNQAKESRGAEMILNFIWPWNDFIETVMYAFIYVLGIIFFVNNINSGSIFFPSYEIGLLTSFVLLARIATGETSNSLRLAGTLQKTTVASKRVFAVLDEINEVDQGKLEPTVQGKIEFKNVNFSYVEDRPILKNVSFTINPNETVAIVGPTGSGKTTMASLISRFYEIDSGEILIDGTNIKDISKQSLFKNISIVLQDPFLFSESIEKNIWYGNTNATAEQVIDVCKKSNVDYFIKKLPDGYETIMSEKMSDLSLGQIQLISIARAFMSEAKILVLDEATSSVDTKTEIDIQNALMKITNNKTVIVIAHRLSTVVKADKIIVLKDGEIQEIGNHKQLLKNKGFYYSLYKANAVMEDHE

SEQ ID NO: 34491 - DNA, 1776 bp, Vibrio vulnificus CMCP6
  CDS (1)..(1776)
atgaaaaagaccacgttgaaacgtttatttgcttatccattggcgcaaccaaaacccatgataacgggtttagtctttttgttgattgcggctgtcagcaatgcgggtggcccttggctcatccaacactttattgacgagcacattaccaaagacgattacactcaacagacacttatcttacttgctagtggctatattggcctgctgctttgctcagctttgtttcaatatctccaaggtttgcaatttaacattgtcgcgacaggcatcattaaaaccattcgcaagcaggcatttaatcgtgtgatcaagcaacctttgtcggctttcgattacacccctactggcaagctggtctcaagactcaccaacgacacggaatctctgcagcagttctacgagcttcttattgcgtcggtggttaagaatcttgtgatgattttagtcatgctgggagtgatgttgatcttaagctggcaactgaccttagttgtactgattctcttgcctgtggtggtggcttttatggccttgttccaaaagttgagcactcacgcctatcgcgttatgcgtgatttgctcactgacatcaatggcaatatgagcgaatcgatccaagggatgagcgtgatccaactgatgcgccaagaaaaacgcttcaaccagcagtttaatcaactgactgagcagcatttcaaagcgggtcgtaaagtcatcaagctgaatggtattttacttcgacccttgatggatttattggcgggcatcgctttactcaccctcgttgccatttttggtttcagtggtaccgagctcattggtgttggtgtactgtacgcgtttatcagctaccttggccgtattaccgaaccattaattgaaatgacgcaacagctagcgctactgcaacaagctttagtggccagcgagcgtatttttgaaatgatggatgcaccggagcaaagctatggtcatgatcagcagccacttaaaagtggttccatcgccatagagcaactgagctttagctacgatggtaagcagcaggtattgaaaaagatcgacattgacgtggaacaccagcagttcgtcgctttggtcggccacacgggtagcggaaaaagtaccctcgcttcgctattgatgggcttttacccagtaagccaaggcaaactgaaactggatggacgccctattgcttcattggcaaaatcggtgctgcgaaaagacgtggcgatggttcaacaagatccacatattctgccaacctcggtcagagaaaatattgccttgggaagagaagtctcagacgacatcatttggcaatctttagaacaagtaggtttggctgagcagatcaaacgctaccctcaattgctggacacccaactgggccaaggagaaaccaacctctctgctggacaaaaacagttgttggccatggcccgagtgcttatcgctaagccgaaaattttaatcctcgacgaagcgacggcaaacatcgattcagggactgaggcgctgatacagcgcagtttgaatgccctacgccatgatatgacgctagtggtgattgcacaccgcctttccaccattatggaggccgacaaaattgtggttttacaccacggagatttggttgaaatgggcagtcacaaacaactgcttgcccagcaagggcgctacgcacagatgtaccagttgcaacaagcaggccagcatatcaaggaaattgaacagcaggaggagcaagaactggaacaagccagctaa

SEQ ID NO: 34492 - protein, 591 aa, Vibrio vulnificus CMCP6
MKKTTLKRLFAYPLAQPKPMITGLVFLLIAAVSNAGGPWLIQHFIDEHITKDDYTQQTLILLASGYIGLLLCSALFQYLQGLQFNIVATGIIKTIRKQAFNRVIKQPLSAFDYTPTGKLVSRLTNDTESLQQFYELLIASVVKNLVMILVMLGVMLILSWQLTLVVLILLPVVVAFMALFQKLSTHAYRVMRDLLTDINGNMSESIQGMSVIQLMRQEKRFNQQFNQLTEQHFKAGRKVIKLNGILLRPLMDLLAGIALLTLVAIFGFSGTELIGVGVLYAFISYLGRITEPLIEMTQQLALLQQALVASERIFEMMDAPEQSYGHDQQPLKSGSIAIEQLSFSYDGKQQVLKKIDIDVEHQQFVALVGHTGSGKSTLASLLMGFYPVSQGKLKLDGRPIASLAKSVLRKDVAMVQQDPHILPTSVRENIALGREVSDDIIWQSLEQVGLAEQIKRYPQLLDTQLGQGETNLSAGQKQLLAMARVLIAKPKILILDEATANIDSGTEALIQRSLNALRHDMTLVVIAHRLSTIMEADKIVVLHHGDLVEMGSHKQLLAQQGRYAQMYQLQQAGQHIKEIEQQEEQELEQAS

SEQ ID NO: 34493 - DNA, 1800 bp, Vibrio vulnificus CMCP6
  CDS (1)..(1800)
atgttatcgacatccgacactattagccgctcctggcttttaacacaagcaaaaaaacacaaatctaagcttgtgtttgcgaacctcattgccattgttgccactttggttagcgtccctattcctctactcatgccactcatggttgacgaagtgttacttgatcaacctggtaaaggattagcagccatgaataccctattgcctcaagcctggcaaacaccgacagggtatatcttcttgactttgttactggtgattctgatgcgtatcaccagccaagcattaaacattttacagagccgccagttcaccttggtctcaaaaaccattacttatcaaatgcgcgctaagatgatcgataaactcggtcgcatcagtattcgtcaatatgagactcgaggtagcggaggcatcaacgcacacctcatcacagacatcgagaccattgaccaattcatcggcagcaccttagcgaagttcgtgattagcttgcttaccgtcatcggcactgcaggtgttctcctatggctggaatggcgacttggcttgtttatcctcttagtcaaccctatcgttatttacttctctagaaaactaggcagcaaagttaaacatctcaaaaagcgtgaaaaccaagcatttgagcagtttcaaaatcgcctagttgaaacccttgatggcatttatcaattgagagcagccaataaggaacgagagtttctctctgagctcaaacagcaagctgatcaagtccgactcaacgcagacaaatatgcttggcaatccgaagccgcgggtagagtctcctttttgctctttttacttggttttgagctgtttcgtgccgttgcgatgctcatggtgctctttagtgatctcacgattggccaaatttttgctgtttttggttatctttggttcatgctgactccggttcaagaactgctaggtatccagttttcttggtatagcgcgaaagcggcgcttgctcgcatcaacgcgcttttggaactggaggaagagtatagacctgagtcgaaagtcaatcctttcactgatggcaaagaaattgatgtttcggtcgaaaatgtcagcttctcttacaacagtgaaaccactgtattaaatcagttgaatttacgaatcccagcgggaaagaaagtcgctctcgttggcgcaagtggtggtggaaagtccacattaattcagctgcttattggtgtctaccggcaagacagcggagtcattcgttacaataatgagtccagcgatgatattggttttgagttaattcgtgaaaaaattgctgttgtattacaacaacctatactatttaatgacagcctaaggcataatctgacccttggtggcgactatgacgaaagcgcgctgtggcaagcgttggaaatcgctcaactgcaagacgttatttcgcagttaactgctgggttggatacgcaagtgggccgaaatgggatacgtttatccggaggccaaagacagcgtttagctattgctcgcatggtattgagtgatcctcaatttgtgattttggatgaagcaacctcagcgttagataccgcaaccgaagcggcgctccatagagcgcttaatgaatatttgaaaggaaagacaacgcttatcgtggcacaccgattgtctgcggtaaaacaagcggatttgatctatgtattggaagatggacaagttacacaaagcgggacacatactgagctggttgagcaagatggcttgtatcaaacactttatggcagtgtccaatcgcatgccagctag

SEQ ID NO: 34494 - protein, 599 aa, Vibrio vulnificus CMCP6
MLSTSDTISRSWLLTQAKKHKSKLVFANLIAIVATLVSVPIPLLMPLMVDEVLLDQPGKGLAAMNTLLPQAWQTPTGYIFLTLLLVILMRITSQALNILQSRQFTLVSKTITYQMRAKMIDKLGRISIRQYETRGSGGINAHLITDIETIDQFIGSTLAKFVISLLTVIGTAGVLLWLEWRLGLFILLVNPIVIYFSRKLGSKVKHLKKRENQAFEQFQNRLVETLDGIYQLRAANKEREFLSELKQQADQVRLNADKYAWQSEAAGRVSFLLFLLGFELFRAVAMLMVLFSDLTIGQIFAVFGYLWFMLTPVQELLGIQFSWYSAKAALARINALLELEEEYRPESKVNPFTDGKEIDVSVENVSFSYNSETTVLNQLNLRIPAGKKVALVGASGGGKSTLIQLLIGVYRQDSGVIRYNNESSDDIGFELIREKIAVVLQQPILFNDSLRHNLTLGGDYDESALWQALEIAQLQDVISQLTAGLDTQVGRNGIRLSGGQRQRLAIARMVLSDPQFVILDEATSALDTATEAALHRALNEYLKGKTTLIVAHRLSAVKQADLIYVLEDGQVTQSGTHTELVEQDGLYQTLYGSVQSHAS

SEQ ID NO: 34495 - DNA, 1659 bp, Vibrio vulnificus CMCP6
  CDS (1)..(1659)
atgctactggcgtttttaacgctgttcgcttctattggcctactcactttgtcaggctggtttctttctgccgcagccattgccggattgaccattgctcgtgaaacattcaactacatgctgcctggggcatttgtgcgtggttttgcgatgggacgaacagcgggacgttggggcgaaagagtggtcagccataacgcgaccttcaagctcttgactgacctgcgtattttctttttctctaagttagcgccgctgatcccaggacgagtctccaatcttcgtgacgccgatttgcttaaccgcttggtagcagacattgacgcaatggatcatgtttatttgcgtttgatcagccctatggtcgtcggcacacttggcatactgggcttaacggccgtgctgtgttggtttgatatgacattgggcctaacactgggggcaattctgactctgctactgctactctggcctgtccttttctacaagctagggaaaagcaatggacaagcgctaacccacaataaagcagagctgcgtgttgcaactttggactggttgcaaggttacagtgaactgacactctttggtgccgaatcacgctaccaccacgctattttgcatgtacaagagaaattactgaaaaaccaatactttaacgcccatttttctggtttggcacaagcgttattgatgctcgcaaacggttggaccttggtattgatgctttggcttgccgcagatggcgtcggtggtaacgcacccgatcctatgattgcactagtggccttcgccaccatggcaagcgtagaactgctcatgccaattgcgggcgctttccagcaccttggtcaaaccttaacgtccgcccgtcgcctcaatgaagttattctggctgaacctgaagtccgttttgccaaagaggatgtggctcactctggtgaatactctattgactatcaggccgtatcgttcaaatacccggatagccaaagtatggccctgagcaatgtcagcttgacgattccagcccagcacaaagtggccattgtcggccaaacgggctcaggaaaatcaaccttgctgcaactgctcaatcgttattgggatgttaatcaaggctctatcttgcttgcaggcaaaccgatcaccgagtggagtgaaagccagctacgccgctccatcagtgttgtaagtcaacgtgtagatatcttaaacggatcgttacgagacaatttattgatggcctcccctagcgcaaccgacgaacaattgtctgacatgctcaccaaagtcgggctagaaaaactgcttgacgataacgggctatccgcatggcttggcgaaggtggtcgccagttatccggtggtgaaaaacgccgtatcggtattgcaagagccttgctacacaatgcaccaatcttactgcttgatgaaccgacagagggcttagataagcagacggaacagcagatcatgcagttacttgaagcgcactttgacgggaaaaccgtactcttcattacacaccgtttggtcaacctcgacaaaatggacagcatttgcctaatcgaacaaggtaagattgtcgaatatggtcaccatcaagcgcttttagccgctcgtggtcgctattttgaactcaaccaaacgctgtaa

SEQ ID NO: 34496 - protein, 552 aa, Vibrio vulnificus CMCP6
MLLAFLTLFASIGLLTLSGWFLSAAAIAGLTIARETFNYMLPGAFVRGFAMGRTAGRWGERVVSHNATFKLLTDLRIFFFSKLAPLIPGRVSNLRDADLLNRLVADIDAMDHVYLRLISPMVVGTLGILGLTAVLCWFDMTLGLTLGAILTLLLLLWPVLFYKLGKSNGQALTHNKAELRVATLDWLQGYSELTLFGAESRYHHAILHVQEKLLKNQYFNAHFSGLAQALLMLANGWTLVLMLWLAADGVGGNAPDPMIALVAFATMASVELLMPIAGAFQHLGQTLTSARRLNEVILAEPEVRFAKEDVAHSGEYSIDYQAVSFKYPDSQSMALSNVSLTIPAQHKVAIVGQTGSGKSTLLQLLNRYWDVNQGSILLAGKPITEWSESQLRRSISVVSQRVDILNGSLRDNLLMASPSATDEQLSDMLTKVGLEKLLDDNGLSAWLGEGGRQLSGGEKRRIGIARALLHNAPILLLDEPTEGLDKQTEQQIMQLLEAHFDGKTVLFITHRLVNLDKMDSICLIEQGKIVEYGHHQALLAARGRYFELNQTL

SEQ ID NO: 34497 - DNA, 1761 bp, Vibrio vulnificus CMCP6
  CDS (1)..(1761)
atgagcagcaaaaacaataaaaacctcggtattcttcttaaactcagtacctttgtttcaccttatagatggcgggttgctgccgctttggtggcgcttgtggccacggcgagccttaccctttctgttgggtatggggtacgtatgcttatcgaccaagggtttgcccagcaatcgttgcatgagctcaccaatgcgattcagtttattgttggcgtgactctgtgcattgcgattggcaccttctttcgcttttatttggtctcatcggttggggagcgtgtcagcgccgacattcgccttgcggtgtttaaccatgtgataaccttgcacccgagctacttcgagaccaacagcagcggcgatattatgtcgcggctcaccacagacaccaccttgctgcaaagcattattggctcgtcgttttccatggcgatgcgtagcgcgctaatgtgcgtcggggcgatcatcatgttgtttgccaccaactttaaactcacgctgattgtgctggcttccgtgccatttgtgttggtgccaattttggtttatggccgacgcgtgcgtgccctctctcgccaaagccaagattcaatggccgatgtgggcagctacgccggagaagcaatagaacacattaaaaccgtgcaaagctttagttctgagcaacatgaaaaagccgccttcgcggttgaagttgaaaaggcgtacgaaatcggcagacagcgtgtaaaacagcgggcgattttaatctctggcgtgatcgtaattgtctttggtgccattgcaggcatgctttgggttggtggtagtgatgtgatccacggaaagatgtcggcaggcgatctcggcgcttttgtcttttatgccattatggtcgcctcttccaccgccaccatttctgaagtgctgggcgagctgcaaagagcggcgggcgcaaccgaaagactgattgaaattctgcaagtggaaagcgacattaaagcgcctagccatcagcaatccatccccgcagacatccctgccgaagtaagcttcgattcggtgaacttcaactacccatctcgccccaatcagcctgcgatcaaaggcttaaatctcaccgcggaacaaggcaaagtgttggccttggtcggcccatcgggcgcgggaaaaaccacgttgtttgaactactgcaacgcttttacgacccgcaacaagggcatgtgctgttgggtggtatcgatattcgccagtttgatcctaacgagctgcgccaacaaatggcgctcgtgccgcagcaaccagcgttatttagccacgatgtgttccataacattcgctacggcaacccagacgcgactgacgagcaagtgattgaggcggcgaaaaaagcgcacgcgcacgaatttattgaaaagctgccagaaggttatcacagctttttgggtgagcgcggggtcaggctctctggcgggcaaaaacagcgcattgccattgctcgcgcgattttgaaagatcccaaaattcttttgttggatgaagccaccagcgcactggacagcgagagtgaacaccacgttcagcaagcacttgaagcgttaatgaaaggccgcacaacgttgatcatcgcgcatcgcctttccaccattcaacacgccgataaaatcgccgtgctggacaatggcgagttggtcgatatcggtaatcatcacgccttgatgcaaagctgtgagctataccagcgcttggtcgcattgcagtttaagcatctgaattaa

SEQ ID NO: 34498 - protein, 586 aa, Vibrio vulnificus CMCP6
MSSKNNKNLGILLKLSTFVSPYRWRVAAALVALVATASLTLSVGYGVRMLIDQGFAQQSLHELTNAIQFIVGVTLCIAIGTFFRFYLVSSVGERVSADIRLAVFNHVITLHPSYFETNSSGDIMSRLTTDTTLLQSIIGSSFSMAMRSALMCVGAIIMLFATNFKLTLIVLASVPFVLVPILVYGRRVRALSRQSQDSMADVGSYAGEAIEHIKTVQSFSSEQHEKAAFAVEVEKAYEIGRQRVKQRAILISGVIVIVFGAIAGMLWVGGSDVIHGKMSAGDLGAFVFYAIMVASSTATISEVLGELQRAAGATERLIEILQVESDIKAPSHQQSIPADIPAEVSFDSVNFNYPSRPNQPAIKGLNLTAEQGKVLALVGPSGAGKTTLFELLQRFYDPQQGHVLLGGIDIRQFDPNELRQQMALVPQQPALFSHDVFHNIRYGNPDATDEQVIEAAKKAHAHEFIEKLPEGYHSFLGERGVRLSGGQKQRIAIARAILKDPKILLLDEATSALDSESEHHVQQALEALMKGRTTLIIAHRLSTIQHADKIAVLDNGELVDIGNHHALMQSCELYQRLVALQFKHLN

SEQ ID NO: 34499 - DNA, 1743 bp, Clostridium tetani E88
  CDS (1)..(1743)
atgataaataggagactaataaatttagttggagattcaaaagtatggatttttctaacagtgttaatgaagtggattagtttattgtttaatataataaatataatgtttatagcaaattatctagaattcacatatttatatggagtagattctagaaaaggtcttataacattaggcatatttataataagcatattaattagagctatttgtaactatatgtccgtaaaattctcgtctaaatgctctcaaaatgcaaggataacccttagaaatacaatatatgaaaagttgattaatctaggtataaattataatgaaaaagtttcaacatcagaaactatacaggttgctattgatggagtagaacagttggaaatatattttggtagatatttaccacaatttttttatagtgttttagcacctttaactttatttgttacgctgggctttattagcataaaggtagttttaattttattaatatgtgtgcctttaataccaatttccattgccttaataatgaaaattgctaaaaaaatatttgctaagtactggggtatttatgttaacctaggagatacatttttagaaaatcttcaagggcttactacattaaaaatatataatatggatgaagatagaaatacaaaaatgaatgaagaggcagaaaactttagaaaaataactatgaaagttttatccatgcagttaaattctataagtgttatggatttaattgcttttgggggaagtgctataggtatgatactaactttaaaagaattagcacagggtagaataagtatggcaggtgcttttactattatactgctttcctcagaattttttataccattaagacttttaggttcttttttccatgtagctatgaatggaatatcagcatcacaaaagatatttaacataatagatacacctttagagcaatataaaacaaaagaaattaaagattttaatagtttatctgtggaattcaaaaatgtgaacttttcctatgaagaagatagaaaaattttaaatagtataaatttaaatataaatagtggtaaaataacagcactggtaggaccttctggctgcggtaaaagcactatatctagcttaataatgggatttaataaaaactatcaagggaagatattgataaatggaaatgaattaagagaaattgatgaagaacaacttaaaagaaaaataaatatagttacacataatagttatatatttacaggaaccattgaagaaaatttaaaaatgggaagagaaagtgcctctatagaagagatgtacgaagctctacgaaaggtaaatttatatgactttgttatgtctttagataataaacttaaatcagagataaaggaaggaggagccaatctgtcaggaggtcaaagacaaaggcttgcacttgcaagagcactgctatatgatagtgagatttatatatttgatgaagctacatctaatattgatgtggagagtgaaaatgaaattatggatgttatatatgaaattggaaaagaaaagaccatacttttaatttcacacaggctttataatgtgaagaatgcagattgtatatatgtattatctcaaggagaaattaaggaatgtggaaatcataaagaacttatgaataagaaaggaatatattttacattagttgaagaacaaaatgaattagaaaagttaggagctgattattgtgcgtag

SEQ ID NO: 34500 - protein, 580 aa, Clostridium tetani E88
MINRRLINLVGDSKVWIFLTVLMKWISLLFNIINIMFIANYLEFTYLYGVDSRKGLITLGIFIISILIRAICNYMSVKFSSKCSQNARITLRNTIYEKLINLGINYNEKVSTSETIQVAIDGVEQLEIYFGRYLPQFFYSVLAPLTLFVTLGFISIKVVLILLICVPLIPISIALIMKIAKKIFAKYWGIYVNLGDTFLENLQGLTTLKIYNMDEDRNTKMNEEAENFRKITMKVLSMQLNSISVMDLIAFGGSAIGMILTLKELAQGRISMAGAFTIILLSSEFFIPLRLLGSFFHVAMNGISASQKIFNIIDTPLEQYKTKEIKDFNSLSVEFKNVNFSYEEDRKILNSINLNINSGKITALVGPSGCGKSTISSLIMGFNKNYQGKILINGNELREIDEEQLKRKINIVTHNSYIFTGTIEENLKMGRESASIEEMYEALRKVNLYDFVMSLDNKLKSEIKEGGANLSGGQRQRLALARALLYDSEIYIFDEATSNIDVESENEIMDVIYEIGKEKTILLISHRLYNVKNADCIYVLSQGEIKECGNHKELMNKKGIYFTLVEEQNELEKLGADYCA

SEQ ID NO: 34501 - DNA, 1890 bp, Lactobacillus plantarum WCFS1
  CDS (1)..(1890)
atgagcgaaaagaatacgagttctactaagcctgcacgtcctgctggcggtcatggccccggtggtcatgctggactagttgaaaagcctaagagtttttggaaaacggcgattcgattgatgcgctacatgtcagaccggtgggtcggtttggcagtggtcatgatttttgccattgcttccgtgattttccagattcgaacacctaagattttaggtaaagcaacgaccgaactttataagggaattatgaagggggccgcgcaacagaaggctggtatcagtcaatccggttacccaatcaactttgaaaaaatcggtcagattattatgatcgttttgatcatgtacttggcctcagcactgttcaactttattcaacagtacattatgacgcggatttcccaacggaccgtgtataagttgcggcgttcatttaagggtaagatgcaaaaggtgccgatttcatattatgatacccattcgaatggggacattatgagtcgggccgtcaatgatatggataatattgccaacacgttgcagcaaaacctaacccaagcggtgacaagtaccgtcacctttgttggaaccttatggatgatgctgacgattagttggaagctgaccttgattgcactcgttaccattccactgagtgtcgtggtggttggtgtgattgcgccgaaatcacagaaattcttcggaacacagcaaaagagcttggggttgttgaataaccaagttgaagaaaactatgctggacacgtggtcatcaagagctttaacaaggaacaagatgccatcgatgattttgaaatccaaaacaataattattatcaatcagcctggaaagcgcaatttatttcaggtattatcatgccactgatgatgttcttaaataatattggctacgtctttgttgccatcattggtgggattgatgtggctaacgggaacgtttcgttaggtaacattcaagcgttcttacaatacacgcaacaattttcacaaccgatttcacaaatggcgaacttgttgaacacgattcaatcgaccgtggcttccgctgaacgggtctttgaagtgcttgatgaagaagaaatgaaacagacgaaatccaacttaccagccgaaccagatagtgataacttgattagtctgcaacacgttcaatttggttatgcggataacgacctgttaatgaaggattataatctggacgttaaacgtgggcaacaagtggccatcgttgggccaactggtgctggtaagacgaccatcattaatttgttggaacgtttttatgacatcaaaggtggttctattaaattgaaagggaccgatacacgggacctggatcgtgaagacttgcggtcacactttgcgatggtgcttcaagatacctggctctttactgggacgatttttgacaacttgaagtacggccgtgaagatgcgtcagatgaagagatttatgctgcggctaaagcggcccatgttgatagctttgttcgcaaattgccagatggttatcagacggttctgaacgaagaagcttcaaatatttcacagggacaacgccaattattgacgattgcccgggcgtttgtggctaatccagaaattctgattttggatgaagcaacgagttcggttgatacgcggactgaagtgcatattcagcatgccatggaacgactcctgaagaaccggaccagttttgtggttgcgcaccggttatcaacgattcagggtgcggacaacattattgtgatgaaccatgggtcagtggttgaaactgggacgcatgaacagttgatggctcaaaatgggttctatgcggatctatataacagtcaatttactggcaatattagtctcgactaa

SEQ ID NO: 34502 - protein, 629 aa, Lactobacillus plantarum WCFS1
MSEKNTSSTKPARPAGGHGPGGHAGLVEKPKSFWKTAIRLMRYMSDRWVGLAVVMIFAIASVIFQIRTPKILGKATTELYKGIMKGAAQQKAGISQSGYPINFEKIGQIIMIVLIMYLASALFNFIQQYIMTRISQRTVYKLRRSFKGKMQKVPISYYDTHSNGDIMSRAVNDMDNIANTLQQNLTQAVTSTVTFVGTLWMMLTISWKLTLIALVTIPLSVVVVGVIAPKSQKFFGTQQKSLGLLNNQVEENYAGHVVIKSFNKEQDAIDDFEIQNNNYYQSAWKAQFISGIIMPLMMFLNNIGYVFVAIIGGIDVANGNVSLGNIQAFLQYTQQFSQPISQMANLLNTIQSTVASAERVFEVLDEEEMKQTKSNLPAEPDSDNLISLQHVQFGYADNDLLMKDYNLDVKRGQQVAIVGPTGAGKTTIINLLERFYDIKGGSIKLKGTDTRDLDREDLRSHFAMVLQDTWLFTGTIFDNLKYGREDASDEEIYAAAKAAHVDSFVRKLPDGYQTVLNEEASNISQGQRQLLTIARAFVANPEILILDEATSSVDTRTEVHIQHAMERLLKNRTSFVVAHRLSTIQGADNIIVMNHGSVVETGTHEQLMAQNGFYADLYNSQFTGNISLD

SEQ ID NO: 34503 - DNA, 1764 bp, Lactobacillus plantarum WCFS1
  CDS (1)..(1764)
atggaaacgcatatcacgtcatcggctaaacaaccacatgccaagtatgggacccgtgatttattgagattgatcatgacccatgctcacccgaagaagggactctttgtgattggaatcctgttgtcgtttgtcgcaacgatttgtagtcttggcattacgttgatgttgaaggagtttatcgacgcctttaaccatggtacttcgggtcaactgttgcttcggttaggcgctgtgattgtcgtgcagctatttgcaagtgttgcgtcgagttttctacttagttatacgggggtcgacgccgtttcgacgttgcggagcgcgttatggcaacatatcgtggacttgccgattccatattttgaccataaccggacgggggaactgtctagtcgggtagttaacgatacatcgacgatttttgaattgatttcaagtcagttttcgaatgccattaatgggatcatctcaattgtgggttccttgacgttaatgttgttattaaacttccgcttaacgattattattttaattgtggttccattgatggccgtgatcattgtgccaatgggtcaagtgttagcgcggatctccaaagcgattcaaaaagaaacggccaacttaaatagtgcagcagtacaaatgattggtcaaaatcggttagtgaaagcaatggttgctgaaaaggcactgaaaaaacagggaaaagatcaagttgatcggatcaaaggcttcagtgtccgtcaaatcaagctgatctcggtgcttaatccagtgctaaacatcatgttactggccgcaattttcattatcattgtttatggtgggatcttggtacaaacgaacgcgttgacaattggaagtttagtagctttcttaatgtatgccgttcaaatgatttcaccactgagtagcgtaactggcttagtgactgccttgcaacaaacggtcggggcaactgagcgaatcgacaacattttagatagtccggaagaagataagcggttgtcaggcgaaacgctgtcaacaatcgatacggtcgactttgatcacgtcgattttggctacgaaagtgataaaccggtgcttaaggacattgatttgacaattcatcgcggtgagcggattgccttgattggtgagagtggtagcgggaaaacgaccttagtttcgctcttagaggcttactatacgccaactcgtggtgagctggacgtgaatggcgagacaatggccagttatacgattccctcgattcgtaatcagatcggctacgtgagtcaagaagtagacttgatgcccgggacgattcgcgataatctcctgttaggttcgacggaaccggtctctgatgaacaattgagtgcgttgttgacacaagtcggcttagcggactggctagctgaactgtcagctggtcttgatacggacgtcggtgaacggggcttgaatgtttctggtggacagcggcaacgtttggccatcgtccgggcactcgtccgccacccgtcgttattgattttagacgaagcgacggctagtcttgataatcagaaccaagaacgggtgacccagctcttggcgacgttaccagctgacctgacgactattacgattgtccatcggttaaaccagatcgaagcttatccgcgaattctcttcatggaggatggtcagattacgggtgatggcaatcatgagtccttattagcaacccatgaacgttatcgtgacttttatcggctgcagtatcaacacggttaa

SEQ ID NO: 34504 - protein, 587 aa, Lactobacillus plantarum WCFS1
METHITSSAKQPHAKYGTRDLLRLIMTHAHPKKGLFVIGILLSFVATICSLGITLMLKEFIDAFNHGTSGQLLLRLGAVIVVQLFASVASSFLLSYTGVDAVSTLRSALWQHIVDLPIPYFDHNRTGELSSRVVNDTSTIFELISSQFSNAINGIISIVGSLTLMLLLNFRLTIIILIVVPLMAVIIVPMGQVLARISKAIQKETANLNSAAVQMIGQNRLVKAMVAEKALKKQGKDQVDRIKGFSVRQIKLISVLNPVLNIMLLAAIFIIIVYGGILVQTNALTIGSLVAFLMYAVQMISPLSSVTGLVTALQQTVGATERIDNILDSPEEDKRLSGETLSTIDTVDFDHVDFGYESDKPVLKDIDLTIHRGERIALIGESGSGKTTLVSLLEAYYTPTRGELDVNGETMASYTIPSIRNQIGYVSQEVDLMPGTIRDNLLLGSTEPVSDEQLSALLTQVGLADWLAELSAGLDTDVGERGLNVSGGQRQRLAIVRALVRHPSLLILDEATASLDNQNQERVTQLLATLPADLTTITIVHRLNQIEAYPRILFMEDGQITGDGNHESLLATHERYRDFYRLQYQHG

SEQ ID NO: 34505 - DNA, 1788 bp, Lactobacillus plantarum WCFS1
  CDS (1)..(1788)
atggcagcacgtcagtcggtatgggcacgttccatgcctgttaaggaacaactcacggttattcggcgactattgccgtatgcgaaaccgttcaaatggttttttattgcggccatcgttttttccggtctgattagtgtggttaatatctatctgccgcgtgtattacagacctttattgatcattatctcaaaacaggacacgccacggtaccggtcatgtggtactttgcgggcctgtatttcttcggcatggttgtgcgcgcgttgatgcagttcgtacagaacttcagtagtacgatgggggcagaatatatgcttgaaaatgtccgccgacaaatgttcgccaagttgcatcggatgggcatgcgctactttgatcaagtccctggtggctcaattttgtcacgcctgactaacgatacgatgtcgttttccaatttttgggcgttgtttaatacattatttaccgccttttttgcggtgatttcgtcgtttgtcgcgatgtatctcaccgatgcgcagattgccttgtggttattggttttcatgccttttttggctgtaacgatttggtattatcaacggtatagctcacgggtttaccggcgaatgcgggaacggctcagtgagttgaataccaagttgagtgaagcaattactggaattagtgttattcagcaatttcgacaagaacaccgtatcaatggtgaatttgatcataccaatgatgcctattttaagacccgccaagcgatgatccggacgaactcattattattaagtccactgatcgacttgttttatgcgttagggacggtcatggttctgggaatcttcggggttcgtggactcaatggttatgtggctgccggggtcgtttatgcgttcatcacgtacctgaataacttctataatccgatgacgtcgatgatggataatttgtcagactttcaagatggcgtcgtcgccggatcacgggttttacgggtcatggatgatccaacgattgccccggcccaacacgccgatcctacggctaagattacgcgcggtaagattgaatttcggcacgtcacctttgcctatgacggccagcatccggtcttaaaagacgtttcattcgtggctgaaccaggccaaacggtggcactagttggtcagacggggagtggaaaaacgtcgacgattaatgttttgatgcggttttatgagtttcagtcaggagaagttttaattgatgatcgcgacattcgtgagtatccggctgaggaattgcgacagaagatggggttggtcttgcaagaaccgtttatgttttatggtgatattaattccaacatccgaatgtttaacgatcagatttcagatgaacaagttcaagcagcggcacggtttgtaaaggccgatgacttcatcaacgatttacctgagaattatcagtcacgcgtcattgagcgcggggccagttattcttcaggacagcggcaattgatttcatttgcgcggacgattgtgactgaccctaagattttaatcttggacgaagccacggcgaacgtcgatactgagaccgaagagatgattcagactggtttggatcggattcaggagaaccgcacgacgattgcgattgcccaccgcttgtccacgattcaaaatgctgatttgatcctggtcttaaatcaggggcaaatcgttgaacgcgggtccaacgacgagctattgcaacagcatggttactactatgatatgattcagttgcaaaattccgctcacgtcgattaa

SEQ ID NO: 34506 - protein, 595 aa, Lactobacillus plantarum WCFS1
MAARQSVWARSMPVKEQLTVIRRLLPYAKPFKWFFIAAIVFSGLISVVNIYLPRVLQTFIDHYLKTGHATVPVMWYFAGLYFFGMVVRALMQFVQNFSSTMGAEYMLENVRRQMFAKLHRMGMRYFDQVPGGSILSRLTNDTMSFSNFWALFNTLFTAFFAVISSFVAMYLTDAQIALWLLVFMPFLAVTIWYYQRYSSRVYRRMRERLSELNTKLSEAITGISVIQQFRQEHRINGEFDHTNDAYFKTRQAMIRTNSLLLSPLIDLFYALGTVMVLGIFGVRGLNGYVAAGVVYAFITYLNNFYNPMTSMMDNLSDFQDGVVAGSRVLRVMDDPTIAPAQHADPTAKITRGKIEFRHVTFAYDGQHPVLKDVSFVAEPGQTVALVGQTGSGKTSTINVLMRFYEFQSGEVLIDDRDIREYPAEELRQKMGLVLQEPFMFYGDINSNIRMFNDQISDEQVQAAARFVKADDFINDLPENYQSRVIERGASYSSGQRQLISFARTIVTDPKILILDEATANVDTETEEMIQTGLDRIQENRTTIAIAHRLSTIQNADLILVLNQGQIVERGSNDELLQQHGYYYDMIQLQNSAHVD

SEQ ID NO: 34507 - DNA, 1827 bp, Pseudomonas syringae pv. tomato str. DC3000
  CDS (1)..(1827)
gtgcgtgatgatttgcccgaaggtgctcacccatcgtcagtcggccatcgcgatacgctgagctgggccgagatccgtcgtcttgcgctgcgccataaaaaagccctgtggctggccaatggcgtcgcagttctggcgaccctgtgcagcgtgccgatcccgttgctgttgccgttgctggtcgacgaagtattgctggggcgcggcgacgctgccctcaacgtcatgaaccacctgctgcctgacagcttgcaaaaagctgtgggttacatcggcctgatgctcttgctgacgctggtgctgcgggtcggggcgctggtgttcaatgtgttgcaggcgcggctgtttgccgggctggccaaggatattgtctatcgcatccggctgcgtctgatcgagcgcctcaagcggatttccctgcgcgaatacgaaagcctgggcagcggcacagtcaccacgcatctggtgaccgacctggacacgctggacaagttcgtcggcgagaccctcagtcgcctgctggtgtctacgctgaccctggccggcacggcgggcatcctgatgtggatgcactggaagctggccctgctgatcatgctcttcaacccgttggtgattctgctcacggtgaagctgggcaagcgggtcaaacacctcaagaaactggaaaacgacagtacctcgcggttcactcaggcgctgagcgaaaccctggatgcgattcaggaggtcagggcaggcaaccggcagggctttttcctcgggcgtctgggcgcaaaagcgcaggaagttcgcgattacgcgatcaattcacagtggaaaagcgacgcttccgggcgggccagcgggctgctgttccagttcggcatcgacatctttcgcgcggcggcaatgctcaccgtgctgttctcggacctgtccatcgggcagatgctcgcggtcttcagttacctgtggttcatgatgacgccggttgagcaactgctgaacctgcaatacgcctattacgcggcgggcggggctctgacgcgcatcaacgaactgctcgcgcgtgccgacgagccgcactacgcgggcggcgcggaccctttcaaggggcgcgaaacggtcagtgtcgaggtgcgcggtctgagtttcggctatggcgaggatctggtgctggaccaactgaacctgagcattgcaccgggcgagaaggtcgccattgtcggtgccagtggtggcggcaagagcaccctggtgcagttgctgctgggcctgtacacggcccgtaccggagtcatccgctttggtggcgtcagtcagcaggatatcggtctggacacagtgcgtgagaacgtcgccgtggtcctgcagcacccggcactgttcaacgacactgtgcgcgccaacctgaccatgggccgtgactgcagcgacgaagcctgctggagggcgctggaggttgcgcaactggaatcggccattcgcgacctgccgcaaggcctgggcagcgtgctggggcgttccggtgtgcgcctgtctggcgggcagcgccagcgcctggccatcgcgcgcatggtgttgtccgatccgaaagtggtcatcctcgacgaagcgacctcggcgctggacgccgccaccgagttcaacctgcaccaggccctggcgcggtttctgcgcagccgcacaacgctgatcatcgcccatcgtctgtcagccgttaagcaggcggaccgggtgctggtgttcgacggcgggcgaatcgtcgaagacggcgaccatcagcaactgattgccgatggaggtctttacgccaagctgtacggacatctgcaacaaatctga

SEQ ID NO: 34508 - protein, 608 aa, Pseudomonas syringae pv. tomato str. DC3000
MRDDLPEGAHPSSVGHRDTLSWAEIRRLALRHKKALWLANGVAVLATLCSVPIPLLLPLLVDEVLLGRGDAALNVMNHLLPDSLQKAVGYIGLMLLLTLVLRVGALVFNVLQARLFAGLAKDIVYRIRLRLIERLKRISLREYESLGSGTVTTHLVTDLDTLDKFVGETLSRLLVSTLTLAGTAGILMWMHWKLALLIMLFNPLVILLTVKLGKRVKHLKKLENDSTSRFTQALSETLDAIQEVRAGNRQGFFLGRLGAKAQEVRDYAINSQWKSDASGRASGLLFQFGIDIFRAAAMLTVLFSDLSIGQMLAVFSYLWFMMTPVEQLLNLQYAYYAAGGALTRINELLARADEPHYAGGADPFKGRETVSVEVRGLSFGYGEDLVLDQLNLSIAPGEKVAIVGASGGGKSTLVQLLLGLYTARTGVIRFGGVSQQDIGLDTVRENVAVVLQHPALFNDTVRANLTMGRDCSDEACWRALEVAQLESAIRDLPQGLGSVLGRSGVRLSGGQRQRLAIARMVLSDPKVVILDEATSALDAATEFNLHQALARFLRSRTTLIIAHRLSAVKQADRVLVFDGGRIVEDGDHQQLIADGGLYAKLYGHLQQI

SEQ ID NO: 34509 - DNA, 1770 bp, Pseudomonas syringae pv. tomato str. DC3000
  CDS (1)..(1770)
atgatttcactggtttccaggcgtcaacgccaggcgattcgtctggccgcaagttttatcgcaccttaccgctggcaggcgcttggcgcattgttggcactggtcgttactgcgggcatcacgctgtcgatcgggcagggcatcaagttgatgatcgatcagggtttcatgacccgttcgccgcaattgctcgaacgctcgatcgggttcttcatgctgctgacggtgggcctggccataggcactttcagtcgcttttatctggtgtcgtggatcggcgagcgtgtggtggcggatctgcgcaagaaggtctttgaccacttgatcgaactgcatccggggttttatgaaaacaaccgtagttcggaaatccagtcgcgcctgaccgccgacaccacgctgttgcagtcggtcatcggctcgtcgctgtcgatgttcctgcgcaatgctttgatggtcgtcggcgggatcgtactgctgttcatcaccaaccccaagctcaccagcatcgtggtggtggccttgccgttgatcatcgcgccgattctcatgttcggtcggcgagtgcgcactctgtcgcgcgagagccaggaccgcgtcgccaatgtcggcagctatgtggccgaggcgttggggcagatcaagacggtgcaagcctataaccatcagcaacaggacaaacagcgttttgcccacaccgtcgaacaggcgttcgataccgcgcgcaagcgaatcctgcaacgctcctggctgatcacgctggttatcgttctggtgctgggggcggtggcggtgatgttgtgggtgggcggcatggatgtgatcagcggccgcatttccagtggtgaactggcggccttcgtgttttacgcgctggtggtcggtatggcgttcggcacgttgagcgaggtgatcggcgagctgcagcgcgccgccggtgcggccgagaggatcggcgagttgctgcaggcgcgcagcgagatcagcgcgccaaccaccggtctgcagaccctgccgcaacgtatcagcggcgggcttgcactggagggcgtcagtttcgcctatccgtcgcgccccgagcgtaatgcggtcgatgacctgaccctgaccgtagagcccggcgaaaccctggctttggtagggccgtccggcgcgggcaagtcaacgatcttcgacctgctgctgcgtttttacgacccaggctgtggacgcattctgatcgagggcgtgccggccgtgcagctcgatccccatgacctgcgtcgctgctttgcaatggtgtcgcaaacgcctggtttgttttttggcagcgtcgaggacaacattcgttacggcaacgtcaacgcaagctttgaacaggtgcaggcagcggcacgtatcgcccatgcccacgagttcattctggaaatggctgacggttaccgcactcatctgggcgagggcgggctggggttgtcgggtgggcagcgccagcgtctggcgattgctcgtgccttgctggtcgatgcgccgattttactgctggacgaggctaccagcgcgctggatgcgcaaagcgaacacctgattcaacaagccttgcccagcttgatgaaaggccgtaccacgctggtcatcgctcaccgtctggcgacggtgcagaatgctgaccgcatcgcggtgatggatcaagggcaactggtggcggtaggcactcatcagcaactgattgccagcaacccgctgtatgcacggctggcggcgttgcagttcaatgccggtgtcgaataa

SEQ ID NO: 34510 - protein, 589 aa, Pseudomonas syringae pv. tomato str. DC3000
MISLVSRRQRQAIRLAASFIAPYRWQALGALLALVVTAGITLSIGQGIKLMIDQGFMTRSPQLLERSIGFFMLLTVGLAIGTFSRFYLVSWIGERVVADLRKKVFDHLIELHPGFYENNRSSEIQSRLTADTTLLQSVIGSSLSMFLRNALMVVGGIVLLFITNPKLTSIVVVALPLIIAPILMFGRRVRTLSRESQDRVANVGSYVAEALGQIKTVQAYNHQQQDKQRFAHTVEQAFDTARKRILQRSWLITLVIVLVLGAVAVMLWVGGMDVISGRISSGELAAFVFYALVVGMAFGTLSEVIGELQRAAGAAERIGELLQARSEISAPTTGLQTLPQRISGGLALEGVSFAYPSRPERNAVDDLTLTVEPGETLALVGPSGAGKSTIFDLLLRFYDPGCGRILIEGVPAVQLDPHDLRRCFAMVSQTPGLFFGSVEDNIRYGNVNASFEQVQAAARIAHAHEFILEMADGYRTHLGEGGLGLSGGQRQRLAIARALLVDAPILLLDEATSALDAQSEHLIQQALPSLMKGRTTLVIAHRLATVQNADRIAVMDQGQLVAVGTHQQLIASNPLYARLAALQFNAGVE

SEQ ID NO: 34511 - DNA, 1665 bp, Pseudomonas syringae pv. tomato str. DC3000
  CDS (1)..(1665)
atgacccgcaaaactgaaagcctcgcccgggaaaccctgaggatcctcaagccgttctggtggctggtggcgctgtcgactgtgctgggcatcgtcagtggcctgagcgtcaccggcctgctggccaccatcaacaatgcgctgaacatgcccggcgggccagacacccacaccgcgctgctgttcgccgggctgtgtgtactgacgctggcctgcgcgacactgtccaatctgtcgaccaactacgtcggccagcgcgtggtcgccaatctgcgtcgcgagctggccgccaaggtgctggtcgcgcccatcgagcaactggagcgctaccgctcccaccgtttgattccggtgctgctcaacgacgtcaacaccctcagcaccttcgccctgtcggtcgcgccgatggtgatttcgttcactgtcacgctcggctgcctgacttatctggcgttgttgtcgtggcagattctggccctgaccgtgctcaccgtggtgctcggcacgggcgcgcagtacctggcccatgcgttcggcatgcgcagcattctggcggcgcgcaacagtgaagacgaactgcagaagcactatcaggcgctgtccgcaggtgccaaggaactgcgcattcagcgcaagcgtcgtcagcacatgctcgatgagaagattcacggtgccaccgaaaacatctgccgctcgaacattcgcgccgccaacatcttcgtcagcgcggaaaccttcggttcgatgctgttctttgccgtgatcggcatggccatcgccttccaggccatgtggccgaccactgaaaagaccgtgctgggcggcttcgtgctggtgatgctgtacatgaaaggcccgctggaaaggctgattaccgccctgcccggtatcagtcgcgcgcagatcgccatgcgccgtattgccgagctgtcgtggaagttttcaagccccgaaccacacctgctggtcagcgaccgccctaactcgctggcgaatatgcagaccctggaactgcacaacctgcgctatgactacccgccggtcgaaggcagcgacgcctttcatctcgggccggtcgacttgagcatcaaacagggcgatatcgtgttcatcgtcggcgagaacggctgcggcaagaccacgctgatcaagctgctgctgggcctgtacacgccgcagcaaggcgaaatccacctgaatggccaagccgtaaccccggaaaatctcgacgattaccgccaactgttcaccacgatcttcgccgattactacctgttcgatgagcccctgcagggtgaggccgcgttgccgcaagacgccggcaaatacctggagcgcctggacatcgcgcacaaggtcagcatccaggacggcgcgtttaccaccaccgacctgtccaccggacagcgcaagcgtctggcgctgatcaatgcgtggctggacgaacgtcaggtgctggtgttcgacgagtgggccgccgaccaggacccggcgttccggcgcgtgttctacaccgaactgctaccggaactgaagcagcaaggcaagaccatcatcgtcatctctcacgacgaccgctatttctacatcgccgaccaactggtgcgcatgcaggcgggccggatcgaggtcgagcaggcgcagagccaggccgctcaagcctga

SEQ ID NO: 34512 - protein, 554 aa, Pseudomonas syringae pv. tomato str. DC3000
MTRKTESLARETLRILKPFWWLVALSTVLGIVSGLSVTGLLATINNALNMPGGPDTHTALLFAGLCVLTLACATLSNLSTNYVGQRVVANLRRELAAKVLVAPIEQLERYRSHRLIPVLLNDVNTLSTFALSVAPMVISFTVTLGCLTYLALLSWQILALTVLTVVLGTGAQYLAHAFGMRSILAARNSEDELQKHYQALSAGAKELRIQRKRRQHMLDEKIHGATENICRSNIRAANIFVSAETFGSMLFFAVIGMAIAFQAMWPTTEKTVLGGFVLVMLYMKGPLERLITALPGISRAQIAMRRIAELSWKFSSPEPHLLVSDRPNSLANMQTLELHNLRYDYPPVEGSDAFHLGPVDLSIKQGDIVFIVGENGCGKTTLIKLLLGLYTPQQGEIHLNGQAVTPENLDDYRQLFTTIFADYYLFDEPLQGEAALPQDAGKYLERLDIAHKVSIQDGAFTTTDLSTGQRKRLALINAWLDERQVLVFDEWAADQDPAFRRVFYTELLPELKQQGKTIIVISHDDRYFYIADQLVRMQAGRIEVEQAQSQAAQA

SEQ ID NO: 34513 - DNA, 1833 bp, Pseudomonas syringae pv. tomato str. DC3000
  CDS (1)..(1833)
atgctttatcgtcgttttgaacaactgatcgatatcttcaaagacgcccctaccgcttccccgcccaacaccgtttttgcgttctacctgtactacctgcgtcaggtatggccgacgtttctcgcgctgttggtcgtgggcctgatcggtgcgctgatcgaggtgtcgctgttcaactacctgagccgcatcattgacctggcgcaaaccacgccgccgaaggattttttcagccttcacggcccggaactgatctggatggtagtggtggccctgctgctgcgtccgatcttcgtcggtctgcacgacctgctggtgcaccagaccatcagccccggcatgactaacctgatccgctggcaaaaccacagctacgtgctcaaacagagcgtcaactttttccagaacgattttgccgggcgcattgcccagcgcatcatgcagaccggcaactcgctgcgcgactcggccgtgcagtcggtggacgcgctgtggcatgtgttgatctacgcgatcagcgccatggtgctgttcgccgaggctgactggcgactgatgatcccgctgggtacctggatcctggcgttcatcctctcgctgatgtatttcgtccccagggtcaaacagcgctcggtggattcgtccgacgcgcgctcaaagctcatgggccggatagttgatggctacaccaacatcaccaccctgaaactgttcgcccacaccaatcacgaacagcaatacgcgcgtgaagcgatgcgtgaccagaccgaaaaaagccagctggccggccgggtcgtgacgtcgatggacaccaccatcaccaccatgaacggcgtgctgattgttaccacgaccgggctggcgctctggctgtggacccagtcaatgatctcggtgggcgccattgcgctggccacaggcctggtgattcgtatcgtcaacatgtccggctggatcatgtgggtggtcaacggtattttcgagaacatcggcaccgtgcaggacggcctggaaagtatttcgcagcctgtcacggtcaatgaccagcccggcgctaaaccgttgaagatcgagaacggtggcgtcaggttcgacggggttgatttccattatggcaatggcaacgggatcattcacaacctcaacctggacataaaacccggcgagaagatcggtttgatcgggccatccggcgctggtaaatcgacgttggtgaatctgttgctgcgcatgtatgacgtgcagggcggcaggattctgatcgacggccaggatatttcccggataacccaggaaagcctgcgtgcgcagatcggcatgatcactcaggatacttcgctgttgcaccgctcgattcgcgaaaacctgctgtatggcaatcctgacgcgaccgatgaacagctctgggagtcgatccacaaggcccgcgccgatgagtttattccgctgttatcggactccgaaggccgtaccggtttcgatgcgcatgtcggtgagcgcggcgtcaagctgtccggtggtcagcgccagcgtatcgcgatcacccgcgtgctgctcaaggacgcgccgattctgatcatggacgaagccacctcggcactcgactcggaagtcgaagcggcgattcaggagagcctggaaacgttgatgcaaggcaaaaccgtgatcgccatcgctcaccgcctgtcgaccatcgcccgcatggatcgcctggtcgtcctggaaaaaggccagatcgccgaaaccggcacccatgccgaactgctggcccgcggcgggttatatgcgcgattgtggcaacatcagaccggcgggtttgtgggggtggattga

SEQ ID NO: 34514 - protein, 610 aa, Pseudomonas syringae pv. tomato str. DC3000
MLYRRFEQLIDIFKDAPTASPPNTVFAFYLYYLRQVWPTFLALLVVGLIGALIEVSLFNYLSRIIDLAQTTPPKDFFSLHGPELIWMVVVALLLRPIFVGLHDLLVHQTISPGMTNLIRWQNHSYVLKQSVNFFQNDFAGRIAQRIMQTGNSLRDSAVQSVDALWHVLIYAISAMVLFAEADWRLMIPLGTWILAFILSLMYFVPRVKQRSVDSSDARSKLMGRIVDGYTNITTLKLFAHTNHEQQYAREAMRDQTEKSQLAGRVVTSMDTTITTMNGVLIVTTTGLALWLWTQSMISVGAIALATGLVIRIVNMSGWIMWVVNGIFENIGTVQDGLESISQPVTVNDQPGAKPLKIENGGVRFDGVDFHYGNGNGIIHNLNLDIKPGEKIGLIGPSGAGKSTLVNLLLRMYDVQGGRILIDGQDISRITQESLRAQIGMITQDTSLLHRSIRENLLYGNPDATDEQLWESIHKARADEFIPLLSDSEGRTGFDAHVGERGVKLSGGQRQRIAITRVLLKDAPILIMDEATSALDSEVEAAIQESLETLMQGKTVIAIAHRLSTIARMDRLVVLEKGQIAETGTHAELLARGGLYARLWQHQTGGFVGVD

SEQ ID NO: 34515 - DNA, 1851 bp, Vibrio parahaemolyticus RIMD 2210633
  CDS (1)..(1851)
atgtttaaacgatttgaaggcttcacagagccgtttcccaaatctacgcccgatcagcccccttcagggatttttgcctttctacgccattacacccgagggtatgaaaagccactgatcatcatgtcactgatgtcgacgattgttgccatcgttgaagtcatgctgtttggtgcaatgggccaactggtggactggctttccaccagcaatccagaaacctttttgcaagataaccgagcggatctgattttttacggcgtcttacttctggttgtaatgccacttttggttgttatctactctttgctggtgcatcaaaccttgttgggtaactacccaatgtccattcgctggcttgctcaccggtatctgctcaatcagagtctgaacttctatcaagatgattttgcagggcgtgttgcgaccaaagtgatgcaaacctctctcgcagtacgagaaacggtcatgaagagcatggacgtatttgtctacgtgacggtttacttcaccagtatggtcgtgatgttagcagctgcagattggcgtttaatgattccaatgattgtctggcttttggtttacatcgcgattcagatttactttgtaccgaaactgaaagatgtggcctctgagcaagccgatgcgcgctcaaccatgacaggccgtattgttgacagctacaccaacatccaaaccgtgaagctgttttcacatagccaacgagaaacccaatatgccgagcaaggcatgaaaggatttctcaacacggtttatcgtcaaatgcgcttggttacgggctttgacgtggcggttgaaatctcgaactacatcttggtgttttccgtcgcggctttgtcgatttatctgtggttggacagcgcgattagcgtcggtgccattgctattgcggtcagcctagcgctgcgcgttaacggcatgtcgatgtggatcatgtgggaagtaggagccctgtttgaaaacatgggtactgtcgtggatggcatgaaaacactgtccaaacctatcgatatccaagacaaaccgaatgcgaaagacttggtcgtatctcaaggtggcatccagttcgataacgtcagctttcattacggtgaaaacaaaggcgtcatcaaccatctgaatctcgacatcaaacctggcgaaaaagtcggcttggttgggcgctctggcgcaggcaaatccacgttggtgaacttgctgttacgcttccatgatgtggaagaaggcagcattaagattgacggtcaaaacattgctgacgtcacgcaagattcgttgcgctcgaaaattggtatggtgacacaggatacgtctcttttgcaccgttcaataagagataacatcttgtacggcaacccaaccgcctcagaagaggaactgcttaaagcgacgaaacaagcgcacgctcacgagttcatcgaaacactgacagacccatttggcaatgtcggctacgatgcacaagttggcgaacgaggcgtgaagttgtctggtggtcagcgtcaacgtatcgcgatttctcgtgtgttattgaaagacgcgccgctgttggtactggatgaagcgacttcagctctggactcagaagtcgaagcagctatccaagaaagcttgaacgagctcatgcaaggcaaaaccgtgattgcaatagcacaccgattgtcgaccatcgcccagatggatcgcttaatcgttctcgacaaaggtaacgtcgtagagcaaggctcgcaccaagagctgatcgctcataacggcatctacgcacagctttgggcacaccaaactggcggttttcttggtgaagaactagacaatcagcaagcttcttaa

SEQ ID NO: 34516 - protein, 616 aa, Vibrio parahaemolyticus RIMD 2210633
MFKRFEGFTEPFPKSTPDQPPSGIFAFLRHYTRGYEKPLIIMSLMSTIVAIVEVMLFGAMGQLVDWLSTSNPETFLQDNRADLIFYGVLLLVVMPLLVVIYSLLVHQTLLGNYPMSIRWLAHRYLLNQSLNFYQDDFAGRVATKVMQTSLAVRETVMKSMDVFVYVTVYFTSMVVMLAAADWRLMIPMIVWLLVYIAIQIYFVPKLKDVASEQADARSTMTGRIVDSYTNIQTVKLFSHSQRETQYAEQGMKGFLNTVYRQMRLVTGFDVAVEISNYILVFSVAALSIYLWLDSAISVGAIAIAVSLALRVNGMSMWIMWEVGALFENMGTVVDGMKTLSKPIDIQDKPNAKDLVVSQGGIQFDNVSFHYGENKGVINHLNLDIKPGEKVGLVGRSGAGKSTLVNLLLRFHDVEEGSIKIDGQNIADVTQDSLRSKIGMVTQDTSLLHRSIRDNILYGNPTASEEELLKATKQAHAHEFIETLTDPFGNVGYDAQVGERGVKLSGGQRQRIAISRVLLKDAPLLVLDEATSALDSEVEAAIQESLNELMQGKTVIAIAHRLSTIAQMDRLIVLDKGNVVEQGSHQELIAHNGIYAQLWAHQTGGFLGEELDNQQAS

SEQ ID NO: 34517 - DNA, 1644 bp, Salmonella enterica subsp. enterica serovar Typhi Ty2
  CDS (1)..(1644)
atggaacttcttattcttgtctggcggcagtaccgctggccatttattagcgtgatggcgctgagcctcgccagcgcggcgctggggattggcctgatcgcgtttatcaatcagcgcctgattgaaacggtggacaccaccgtcatggtgctgccggaatttctcggtctgctcctgttgctaatggttgtcacattaggttcccaactggcgctcaccgctctgggacaccatttcgtttaccgcctgcgcagcgaatttatcaagcgcattctggatacgcacgttgaacgcattgagcaactgggcagcgcctctttactggccggtctgaccagcgatattcgcaatattactatcgcctttgtgcgtctgcctgagctggtgcagggcattgtcctcaccgtcggctcggcggcgtatctggcgatgctatcgacaaaaatgctgctggttacggctatctggatggcggtcactatctggggcggattcgtgctggtggcgcgggtttaccagcatatggcgaccctgcgcgagaccgaagataagctgtacaacgactatcagacggtgctggagggacgcaaagagctgacgctaaaccgcgagcgtgcggagcagatttttcagcaatgctataccccggacgccaaagagtaccgtcatcacattatccgtgccgatacttttcacctgagcgccgtcaactggtcgaatatcatgatgctgggggcgataggcctggtcttctggatggcgaatagtctcggctgggcggataccaacgtcgcggcgacctattcactgacgttgctgttcctgcgcacgccgctgctgtctgcggtgggggcgttgccaacgctactgaccgcccaggtggcgtttaataaactgaataaattcgcgctcgccccgtataagcctgattttccacagccgaaagcctttcccgactggaagacgctggagctgcgcaacgtggtttttcactatcaggataacgcgttttccgtggggcccatcaacctgacgattcaccgcggcgaactgctgtttttaattggcggcaacggtagcgggaaatcgacgctggccatgttattgaccggtttataccagccgcaatcgggaacgattttacttgacggtcaacctgttgccgccgggcagccggaagattatcgcaaactgttttctgcggtgttcaccgatgtgtggttattcgaccgcctgctggggccgcaggggaaacccgccaatcccgcgctggtcgaaaagtggcttgagcacctgaaaatgacgcacaagctggagctaaacgatgggtgcatcttgaatcttaaactgtcgaaagggcaaaaaaagcgcattgcgctgctgctggcgctggcggaagagcgcgatattattttgctggatgagtgggccgccgatcaggacccgcatttccgccgggaattttatcaggtactgttgccgttaatgcaggaaatgggcaaaaccattttcgccatcagccatgatgatcactattttattcacgccgatcgcctgcttgaaatgcgtaacgggcagttaaccgaactcaccggcgacgaacgtgacgccgcttcgcgtgatgcggttgcgcgtactgcgtaa

SEQ ID NO: 34518 - protein, 547 aa, Salmonella enterica subsp. enterica serovar Typhi Ty2
MELLILVWRQYRWPFISVMALSLASAALGIGLIAFINQRLIETVDTTVMVLPEFLGLLLLLMVVTLGSQLALTALGHHFVYRLRSEFIKRILDTHVERIEQLGSASLLAGLTSDIRNITIAFVRLPELVQGIVLTVGSAAYLAMLSTKMLLVTAIWMAVTIWGGFVLVARVYQHMATLRETEDKLYNDYQTVLEGRKELTLNRERAEQIFQQCYTPDAKEYRHHIIRADTFHLSAVNWSNIMMLGAIGLVFWMANSLGWADTNVAATYSLTLLFLRTPLLSAVGALPTLLTAQVAFNKLNKFALAPYKPDFPQPKAFPDWKTLELRNVVFHYQDNAFSVGPINLTIHRGELLFLIGGNGSGKSTLAMLLTGLYQPQSGTILLDGQPVAAGQPEDYRKLFSAVFTDVWLFDRLLGPQGKPANPALVEKWLEHLKMTHKLELNDGCILNLKLSKGQKKRIALLLALAEERDIILLDEWAADQDPHFRREFYQVLLPLMQEMGKTIFAISHDDHYFIHADRLLEMRNGQLTELTGDERDAASRDAVARTA

SEQ ID NO: 34519 - DNA, 1731 bp, Bacteroides thetaiotaomicron VPI-5482
  CDS (1)..(1731)
atgaatgcaatcaagaatattacggtaggacataccgaacgtctgcgtaaacctgtcggttacacgatgcttgccaatctggtgaatatcgttccgttctgtctttctatcgaagccataaatgtgattttccgtacgtttgacggtagtggtacaccgctggatacgaatcgtctttggatgatttttgctatattggtcgtgtatatggtggtgatggcttttgccgaacgcgccgcctatcgtgccaactttcgcggtgcttatgagatgagtgccgaagggcgtattaatttagccgagcatctgcgtaaattatccttgggattcctgtcccgcagagatccgggggatctttcttccatgctgatcactgactttaccatggcggaaacgggaatatcccatcacttgccccaattgatgggagcgttggtaatgccggtttttgccttccttggcttgctttggattgactggcgcatggcggtggccatgttcgtagctttaccgcttgcggttgctgtcctgttgcttagcaatatcgcccagcgtaagctgagtgtgcgacagattgaagccaagattaatgccggaaaccgcttggaagaatatctgcaaggcatacgggtgatgaaagcatataatttgctgggaggcaagttcgaacgcctgaaaatggcttttagtgatctccgtcgtgcctgtatccggcaggaggcgcttctcggtccatttatcttattctcggtcacattgattcgtgccggattgacattcatgatactttgcggtacgtacctgttgataggaggcgaactttcactgctcacgtttgtcatgtttctggtggtcggttcccgtgttttcgatccgctgacatctgccttgactaactttgccgagtttcgctacttctccatcgcaggaggacgtatccttacgttgatgaacgaaccggaaatgaagggagatcgtgatgtgcccgaaagcggagatattacttttgatcatgtatctttcggttatcaggaaaaggaaatactgcatgatatttccgtgactcttagaaaagggacgctcactgctttggtcggtccttccggaagcggaaagagtacgatgctgaaactttgcgcacgcttctatgatccgcgtaaaggctcggttcgttttaacggaatggatatgaaagaactggagccggagtcattaatgaaacattgttccatggtttttcaggatgtctatctgtttcaggatacgctgaagaataatatccgtttcggcaggacagatgctacggatgaagagatcgtagcggcagcgaaaaaggcttgttgtcacgaattcatcatgcgtctgcccaaaggatacgatacgatggtaggagaaggtggctgcactctttcgggaggagaaaaacaacggatctccattgcccgtgccatgctgaaagaagctccggtcgtgctgctggatgaggctactgcctctctcgatccggagaatgaagtagaagtgcagcaggctatcaataccttgattgcgggacggacggtaatcgttatcgctcaccgcctcaaaacgatccgaaatgccgaccggattattgtgctggaagaaggacgaattgcggaacaaggcactcatgatgaacttttgagccggccggggctgtacgccaaactttggaatatacaggaacagacatcgggatggaaactataa

SEQ ID NO: 34520 - protein, 576 aa, Bacteroides thetaiotaomicron VPI-5482
MNAIKNITVGHTERLRKPVGYTMLANLVNIVPFCLSIEAINVIFRTFDGSGTPLDTNRLWMIFAILVVYMVVMAFAERAAYRANFRGAYEMSAEGRINLAEHLRKLSLGFLSRRDPGDLSSMLITDFTMAETGISHHLPQLMGALVMPVFAFLGLLWIDWRMAVAMFVALPLAVAVLLLSNIAQRKLSVRQIEAKINAGNRLEEYLQGIRVMKAYNLLGGKFERLKMAFSDLRRACIRQEALLGPFILFSVTLIRAGLTFMILCGTYLLIGGELSLLTFVMFLVVGSRVFDPLTSALTNFAEFRYFSIAGGRILTLMNEPEMKGDRDVPESGDITFDHVSFGYQEKEILHDISVTLRKGTLTALVGPSGSGKSTMLKLCARFYDPRKGSVRFNGMDMKELEPESLMKHCSMVFQDVYLFQDTLKNNIRFGRTDATDEEIVAAAKKACCHEFIMRLPKGYDTMVGEGGCTLSGGEKQRISIARAMLKEAPVVLLDEATASLDPENEVEVQQAINTLIAGRTVIVIAHRLKTIRNADRIIVLEEGRIAEQGTHDELLSRPGLYAKLWNIQEQTSGWKL

SEQ ID NO: 34521 - DNA, 1767 bp, Enterococcus faecalis V583
  CDS (1)..(1767)
atgcaaactaaaaaaattcattttggtgccttctcacgttttaagccgtatttactacgctatccaaaagaaattattggcgccttaatcctaggaattctcagtggtttttcgactgtcctcatgacttattatataggtaaatccgttgatacaatggtgggtaaaggacaagtcaatgctgcgcaactcatcaaaattttaggtttattagcagggattttactcgtaaccgttctaagtcaatggctgattcaacgtctcggtaatcgcgtgtcttatttatcgaccacacagctgagaaaagatgcctttgcccatttaaatcaattaccgttaagttattatgaccaaacgtcacacggaaatatcgtcagtcgctttaccaacgatattgacaatatttcaatggcttgctcggctgtcttcaaccaattattttctggcatggccaccgtcgttgttgctttgctctttatgattcggctaagtcccctgctcacattagtggttcttatcagtacgccgattatttttattgtaaactggcttgttgcaaaagcttcacaaaaaaactttgctgcacaacaaacgattgttggtgaaatttccggtttcgtttcagaaatggttggcaaccaaaaaattgttaaagcctttcaacaagaacaagctacgcaagaaacatttgaagcattgaatcaaacgttgtatgaaaaaggacagaaggctcagttttcttcctccttaaccaacccactttctcgatttatcgaccatttatcttatttatcgattggattagtcggtggcttgttagttttaagtggcaatcctttagtcacagttggtgttatttccagtttcaccatttactctagtcaattttctaaaccttttattgaactctcaggaatcaccaaccaaatccaagccgccttagctggattggaacgtacctttgatatgatggatcaaccagttgaacgtcctgatgcctcgaacgcaattgttttgaaagaagcgcgaggccgtgttgaatttaaagacgttgatttttcttacacgccgacgcgacctttaatcgaaaactttaatttaattgctgaaccaggagaaacaattgccattgttgggcgaactggtgcgggtaaatcaacattagtgaatttgttaatgcgcttttacgaggtcgaccgtggccaaattacggttgatactcacgacattactcaaattactcgggacagcttgcgaaaaagttttggtatggttctccaagatacttggctattcgatagctccattcgggaaaatttaacgtacggaaatcctgaagcctctgacgaagaaattatagaagccatgaaaaaagcccatatttttgatttcgtcatgcgtttacctcaaggactagataccgagattggttcccaaggcgttaaaatttctgaaggacaacgacaattaatgactattgcacgcacgatgattagtaatccgccgatgcttattttagatgaagcgaccagttcagttgatacattgaccgagcaaaaaattcaggatgcttttttacaaatgatgactggccggaccagttttgttattgcccatcgcttagcaacaatcaaaagtgctgaaaaaattctagttatggataatggtcaagtggttgaaattggcacccatgacgaattattgcaaaaagaacagggttattatcgtgacctttacgaagcacagtttaatcaaaaagcacaataa

SEQ ID NO: 34522 - protein, 588 aa, Enterococcus faecalis V583
MQTKKIHFGAFSRFKPYLLRYPKEIIGALILGILSGFSTVLMTYYIGKSVDTMVGKGQVNAAQLIKILGLLAGILLVTVLSQWLIQRLGNRVSYLSTTQLRKDAFAHLNQLPLSYYDQTSHGNIVSRFTNDIDNISMACSAVFNQLFSGMATVVVALLFMIRLSPLLTLVVLISTPIIFIVNWLVAKASQKNFAAQQTIVGEISGFVSEMVGNQKIVKAFQQEQATQETFEALNQTLYEKGQKAQFSSSLTNPLSRFIDHLSYLSIGLVGGLLVLSGNPLVTVGVISSFTIYSSQFSKPFIELSGITNQIQAALAGLERTFDMMDQPVERPDASNAIVLKEARGRVEFKDVDFSYTPTRPLIENFNLIAEPGETIAIVGRTGAGKSTLVNLLMRFYEVDRGQITVDTHDITQITRDSLRKSFGMVLQDTWLFDSSIRENLTYGNPEASDEEIIEAMKKAHIFDFVMRLPQGLDTEIGSQGVKISEGQRQLMTIARTMISNPPMLILDEATSSVDTLTEQKIQDAFLQMMTGRTSFVIAHRLATIKSAEKILVMDNGQVVEIGTHDELLQKEQGYYRDLYEAQFNQKAQ

SEQ ID NO: 34523 - DNA, 1869 bp, Enterococcus faecalis V583
  CDS (1)..(1869)
atgagtagtcgaccaaaaggcggaccaatgggcggtggaccaggacgcaacattggcgcaaaagggccaaaaccaaaaaatttctggaaaacagtgaaacgtttatttcgatacatgtctaaacgaatgctgtcaattattgctgtcttagtattagcaattgcagccgtcgttttccaaattcaaacaccaaaagtattaggacaggcaacaactgaaatttttaaaggcgtcatgaaaggcgctgctgaaatgaaacaaggcttaaaaataacatcttttccaattgattttgacaaaattggtcaaattttattaattgttattgccatgtaccttatttctgctgtctttaatttcttgcagcaagtaattatgacacgtgtttcacagcgaacagtttatgaattacgtcaagaattagaagcgaaaatgaacaaagttccaatttcctattatgatactcatagtaatggggacattatgtcacgggcaattaacgacatggataatattgcgagtactttacagcaaaacttaacccaattaattaccagtatcgtgacatttgtgggtgtactttggatgatgctgaccattagctggcagttaacactaattgccttagcaacagtgccattaagtttaattgttgtgatggttgtggcgcctcgctcgcaaaaacattttgcggctcaacaaaaaagcttaggattattgaataaccaagtcgaagaaacctacggtggtcacgtagtagtaaaaagtttcaaccacgaagaaagtgatcaagaagtatttgaaaaagaaaatgaaaaattatatcatgctggtcgcaaagcacaatttatttcagcgatcattatgcctttaatgaactttatcaaaaatctaggctacgtgtttgttgcagtccttggtggcgtaaaagtagcgaatggtatgatggatttaggggatgtccaagcatttcttcaatataccaatcaattttcacaaccgattactcaaatcgctaatttaatgaatacaatccaagctacggtggcttcggcagaacgtgtctttgaagtattagatgaagaagaaatggtggatgaaccttctggcataccagtggaaacagatagtccttatcgtgtttcttttgaacatgttgcttttggctattcaccagagaaattattaatgaaagatttcaatttaaatgttaaacctggggaaatggtcgcaatcgtgggcccaacaggtgctgggaaaacaaccctaattaacttattggaacgcttctatgatattagtagcggcagcatcaaatatgatggcgtagatacgcgcgatttatctcgcgaagagttgcgagcacacttttcaatggttcttcaagatacttggttgttcactggaagtatctatgacaatattcattatggtaatgagcaagcgagcgaagaagaagtgatccgtgcggcgaaagcagcccatgtggatgattttgtcagaaaattaccagaaggctatcaaacgattctaaatgaagaagccagcaatatttctcaaggtcaacgacaattaattacaattgctcgagcattcttagcaaatccagacgttttaattttggatgaagccacctcaagtgtggacactcgaacagaaatactgattcaagcagcaatgaatcgtttattggaaaatcggaccagctttgtagtcgctcatcgcttgtcgactatccgtgatgccgatacgattatcgttatggcagaaggttcaattgtagaaacaggaacccacgatgaattaatggcgaaaaacggtttttatgctgacttatataacagtcagttttcagaagaagtagcctaa

SEQ ID NO: 34524 - protein, 622 aa, Enterococcus faecalis V583
MSSRPKGGPMGGGPGRNIGAKGPKPKNFWKTVKRLFRYMSKRMLSIIAVLVLAIAAVVFQIQTPKVLGQATTEIFKGVMKGAAEMKQGLKITSFPIDFDKIGQILLIVIAMYLISAVFNFLQQVIMTRVSQRTVYELRQELEAKMNKVPISYYDTHSNGDIMSRAINDMDNIASTLQQNLTQLITSIVTFVGVLWMMLTISWQLTLIALATVPLSLIVVMVVAPRSQKHFAAQQKSLGLLNNQVEETYGGHVVVKSFNHEESDQEVFEKENEKLYHAGRKAQFISAIIMPLMNFIKNLGYVFVAVLGGVKVANGMMDLGDVQAFLQYTNQFSQPITQIANLMNTIQATVASAERVFEVLDEEEMVDEPSGIPVETDSPYRVSFEHVAFGYSPEKLLMKDFNLNVKPGEMVAIVGPTGAGKTTLINLLERFYDISSGSIKYDGVDTRDLSREELRAHFSMVLQDTWLFTGSIYDNIHYGNEQASEEEVIRAAKAAHVDDFVRKLPEGYQTILNEEASNISQGQRQLITIARAFLANPDVLILDEATSSVDTRTEILIQAAMNRLLENRTSFVVAHRLSTIRDADTIIVMAEGSIVETGTHDELMAKNGFYADLYNSQFSEEVA

SEQ ID NO: 34525 - DNA, 1782 bp, Streptomyces avermitilis MA-4680
  CDS (1)..(1782)
atgatcggcgtggcgccaccggcgtacgacccggccgccccgacaacggcgaacaccctgccggtcggcgcccccgcgaccgtacgcgcctacgtggccgaactgttccgacggcaccgccgtgcctttctgatcctcatcgcggtcaacacggtggccgtcgtcgcctcgatggccggtccctacctgctgggcgcggtcgtcgagcgggtctcggaccacacgcgcgaactccacctggagcgcaccgccgcactgttcgttctcgcgctcgtcgtgcaggccgtgttcgtacgggaggtgcggctgcggggggccatgctcggcgagcggatgctggccgatctgcgcgaggacttcctcgtacggtcggtcgggcttccccccggcgtgctcgaacgggccggcacgggtgatctgctgtcccgcatcaccacggacatcgaccgcctcgccaacgcgatgcgcgaggccgtgccgcagctgaccatcggcgtcgtgtgggtcgcgctgctgctcggcggcctcgccgtcacggcaccgccgctggcgcccgccgtgctgctcgccgtgccgctgctggtgatcggctgccgctggtacttcaagcgcgcgccgtccgcctaccggtcggaggccgcgggatacgccgccgtcgccgccgtcctcgccgagaccgtcgacgccggtcgcaccgtggaggcccaccgcctcggcggccggcgcatcgacctgtcggaccggcgggtcaaggagtggacggcctgggagcggtacaccctgtggctgcggacggtgctcttcccggtcgtcaacctcacccacgtcaccgtgctgtgctcggtcctgatgatcggcggggtgttcgtcctgcaaggctggatcgacgtcggccagctgaccaccggcgcgctcatcgcgcagatgctcgtcgaccccatcggcatgatcctgcgctggtacgacgagcttcaggtcgcccaggtctcgctggcgcgcctggtcggcgtccgggacgtcgagccggtcgcgggcgacgagtcgctcgccccggacggccgcgacgtgcacgccgaccgggtccacttcggctaccgcgccggagtcgacgtcctgcgcaaggtgtccctggaggtcgcgcccggcacccggctggccctggtcggcccgtccggcgcgggcaagtcgaccctgggcaggctgctcgccggcatctacgcgccccgcgacggccgcatcaccctgggcggcgccgagctgtcccggatgccggccgagcgggtccgctcccacgtggccctggtcaaccaggagcaccacgtcttcgtgggctccctgcgcgacaacctgctcctcgcgcgcaccggcgccggcgacgccgagctgtgggcggcgctgggcgcggtcgacgcagacggctgggcgcaggcgctggacgacggcctcgacaccgaggtcggctcgggcggactcgcgctcaccccggcccaggcccagcagatcgcgctggcccggctggtcctggccgatccgcacacgctggtcctggacgaggcgacctcgctcctcgacccgcgcgcggcccgccatctggagcggtccctggcccgcgtcctcgacggccgcaccgtcgtcgccatcgcccaccggctgcacaccgcccacgacgccgacgtcatcgccgtcgtcgagaacgggcagatcagcgagctgggcagccacgaccagctggtcgcggccgacggagcgtacgcggcgctgtggaggtcctggcacgggtga

SEQ ID NO: 34526 - protein, 593 aa, Streptomyces avermitilis MA-4680
MIGVAPPAYDPAAPTTANTLPVGAPATVRAYVAELFRRHRRAFLILIAVNTVAVVASMAGPYLLGAVVERVSDHTRELHLERTAALFVLALVVQAVFVREVRLRGAMLGERMLADLREDFLVRSVGLPPGVLERAGTGDLLSRITTDIDRLANAMREAVPQLTIGVVWVALLLGGLAVTAPPLAPAVLLAVPLLVIGCRWYFKRAPSAYRSEAAGYAAVAAVLAETVDAGRTVEAHRLGGRRIDLSDRRVKEWTAWERYTLWLRTVLFPVVNLTHVTVLCSVLMIGGVFVLQGWIDVGQLTTGALIAQMLVDPIGMILRWYDELQVAQVSLARLVGVRDVEPVAGDESLAPDGRDVHADRVHFGYRAGVDVLRKVSLEVAPGTRLALVGPSGAGKSTLGRLLAGIYAPRDGRITLGGAELSRMPAERVRSHVALVNQEHHVFVGSLRDNLLLARTGAGDAELWAALGAVDADGWAQALDDGLDTEVGSGGLALTPAQAQQIALARLVLADPHTLVLDEATSLLDPRAARHLERSLARVLDGRTVVAIAHRLHTAHDADVIAVVENGQISELGSHDQLVAADGAYAALWRSWHG

SEQ ID NO: 34527 - DNA, 1767 bp, Streptomyces avermitilis MA-4680
  CDS (1)..(1767)
atgacgaccggaacttctggacacctgcccgtcgcggaaccggccggtgtgcggcgggccgccgtccgtctggtccgggccgacgggcgcgccttcgccgccgtgctggtcctgaacgcgctggccgcgggcgccgggctggccgggccgtggctgctcgggcgcatcgtcgacggggtcggggccggaggcggggtgcgggccgtggaccggctggcgctgggcatcctgctgtgctccctcgcgcagctgctgctggcccgctgggcccggtacgtggggcaccgcttcggggagcggacgctcgcccgggtgcgcgaggagttcgtcgaccggacgctggcgctgcccgcgtcggtcgtggagcgggcgggcaccggcgatctgacggcccgtggcaccgccgacgtggccgccgtcggcaccaccttgcgcgatgtcggacccgatctgctcatccacaccctcgaggcgctgttcctcctcggtgcggtgttcgtcctcgccccgctgctgggcgccttcggcgtgctcggtctgaccggcatctggtgcgcgctgcgctggtatctgcggcgggcccgggacggctatctcgccgagggcgcggccacctcggaggtcgccgagatcctcgcggcgacggcgtcgggggcccgtaccgtcgaggcgttcgggcttcaggagcggcggatcggcgcgagccgggaggcgctggagacgtcccggcgcacccggctgtacacgctgtatctgcgcaccgtgttcttcccggtggtggaggtgtcgtacatcgtgcccgtggccggggtgctgctgatcggcggtgcgctgcacgcgcggggtgtgatgagcctgggtgcggtggtggcggcggcgctgtatctgcgccagctcggcgaaccgctcgaccagatcctgatgcgggtcgagcagttgcagagcagcggcgcctccttcgcccgggtggagggcctggcccgggcgccgcggagcggtccggccgactcggccgcgccggcggacgaccggatcgacgtgaccggggtgcgctacgcgtacgagcgtgggggcgaggtgctgcgcggcgtcgacctgaccgtgcgtcccggggagcggctggccgtcgtcggcccgtccggcgccggcaagaccacactgagcaggctgctcgcgggcgtcgacgcgccgagcgcgggcacggtgacggtgggcggggtgccggtcgtcggcctcgagccggagcggctgcgccggcaggtcgtcctcgtcacccaggagcaccatgtcttcctcggcacggtccgcgacaacctgctgatcgccgagccctcggccacggacgacgcgttgtgggcggctctcgccgcggtcggcgccgacggctgggtgcgcgagctgccggacggcctcggcaccgtcctggggtccggtggttgtgccacggacggctcacaggctcagcaactggcgctggcccgggtggtgctggcggatccgcacacgctgatcctcgacgaggccaccgcgctgctggatccgacgaccgcccgccacaccgagcgcgcgctggcggccgtactcgaagggcggaccgtcatcgccatcgcccaccggctgcacacggcgcacgacgcggaccgggtggccgtgatggaggacggccggctgaccgaactcggcacccacgaggccctggtggcggcggggggcgcgtacgcggcgctgtggcattcgtggcacggcgacgagccgtccccgtcctga

SEQ ID NO: 34528 - protein, 588 aa, Streptomyces avermitilis MA-4680
MTTGTSGHLPVAEPAGVRRAAVRLVRADGRAFAAVLVLNALAAGAGLAGPWLLGRIVDGVGAGGGVRAVDRLALGILLCSLAQLLLARWARYVGHRFGERTLARVREEFVDRTLALPASVVERAGTGDLTARGTADVAAVGTTLRDVGPDLLIHTLEALFLLGAVFVLAPLLGAFGVLGLTGIWCALRWYLRRARDGYLAEGAATSEVAEILAATASGARTVEAFGLQERRIGASREALETSRRTRLYTLYLRTVFFPVVEVSYIVPVAGVLLIGGALHARGVMSLGAVVAAALYLRQLGEPLDQILMRVEQLQSSGASFARVEGLARAPRSGPADSAAPADDRIDVTGVRYAYERGGEVLRGVDLTVRPGERLAVVGPSGAGKTTLSRLLAGVDAPSAGTVTVGGVPVVGLEPERLRRQVVLVTQEHHVFLGTVRDNLLIAEPSATDDALWAALAAVGADGWVRELPDGLGTVLGSGGCATDGSQAQQLALARVVLADPHTLILDEATALLDPTTARHTERALAAVLEGRTVIAIAHRLHTAHDADRVAVMEDGRLTELGTHEALVAAGGAYAALWHSWHGDEPSPS

SEQ ID NO: 34529 - DNA, 1626 bp, Bacillus cereus ATCC 14579
  CDS (1)..(1626)
gtgtataaagcgaaagcattaacgaaagaagaagtgtttgcattttataaaccagaaataaaccgtctattattacttggtggtggctatttcgctttattagtagtcgtgtcattatttgcatacggaaagcagttcttcttgcagaaggcagcgaacaaaattattcaaattatgagggaagatgttttttctcatattcaaacgttgccaattcggtactttgatcatttaccggcggggaaaattgtttcgcgtgtgacgaatgatacagaggccattcgtgatttatatgtaacggtgctggcaacattcgtttctagtatcatctatattattgggatattcgctgcgttatttttattagatgtgaagctcgcttcattatgtttattaattatcccaattttaattgtttgggcgattctttatagaaaatatgcgtctgtatacaatcataaaatgcgctctcgcttatctgatattaacggaacagtgaatgaatccattcaagggatgccaattattcaagcgtttcgtcaagagcgtgaaacgaaaaaagaatttgaagaattaaatggcgattattttaagtatcaaaataaaattttaaatttaaatgcagcaacttcgcataacttagtagccgtattaagaaatatcgctttcacaggagtaatttggtatttcggcggtgcgtcattaagtgctacaggtattatttcacttggggtactgtatgcgttcgtcgattatttaacacgattattctcgccaattacgaatatggtgaaccagcttgcaaacttagagcaagcgcgcgttgcatcagaacgtgtctttgaattgttagaggaaaaaggggaaccggtagaagaagaacgtatgcctcgtttaaaaggaaatgtaaaatttgataatgtatcattttcttataatggaaaagatgaagtgttaaaaaatatttcttttgaagcgaaacaaggcgagacagtggcacttgtcggtcatactggatcaggaaaaagttctatcatgaatgtactctttcaattttatgagtttgaaaaaggaaagcttacgattgatggtcacgatgtaaaagagatgccgaaacaagcaacccgtgaacatatgggaatcgtactgcaagacccgtttctttttagcgggacggtcgcttccaatgtaagcttagaaaatgaaaaaatttcaaaagagcgtatcataaaagcattgcatgatgttggtgctgaaagatttgcgaataatataaatgaagaaattacagaaaagggaagtacgctttccactggagaacgtcagcttatttcatttgctagggcgcttgcttttgatccagctatcttaattttagatgaagcaacgtctagtattgatacagaaacagaggcgatgattcaacaagcactagaagttgtaaaaaaaggaagaacgacatttattatcgctcaccgcctttcaacgattaaaagcgcagatcaaattattgtgctcgatagaggaaccattttagaaaaaggctctcatgatgaactcatgaaaaagcgggggcgttattacgatatgtataaaacgcaaatggaaggcaatcagagtgcttaa

SEQ ID NO: 34530 - protein, 541 aa, Bacillus cereus ATCC 14579
MYKAKALTKEEVFAFYKPEINRLLLLGGGYFALLVVVSLFAYGKQFFLQKAANKIIQIMREDVFSHIQTLPIRYFDHLPAGKIVSRVTNDTEAIRDLYVTVLATFVSSIIYIIGIFAALFLLDVKLASLCLLIIPILIVWAILYRKYASVYNHKMRSRLSDINGTVNESIQGMPIIQAFRQERETKKEFEELNGDYFKYQNKILNLNAATSHNLVAVLRNIAFTGVIWYFGGASLSATGIISLGVLYAFVDYLTRLFSPITNMVNQLANLEQARVASERVFELLEEKGEPVEEERMPRLKGNVKFDNVSFSYNGKDEVLKNISFEAKQGETVALVGHTGSGKSSIMNVLFQFYEFEKGKLTIDGHDVKEMPKQATREHMGIVLQDPFLFSGTVASNVSLENEKISKERIIKALHDVGAERFANNINEEITEKGSTLSTGERQLISFARALAFDPAILILDEATSSIDTETEAMIQQALEVVKKGRTTFIIAHRLSTIKSADQIIVLDRGTILEKGSHDELMKKRGRYYDMYKTQMEGNQSA

SEQ ID NO: 34531 - DNA, 1680 bp, Bacillus cereus ATCC 14579
  CDS (1)..(1680)
atgactttaactattttccttggtcttcttggagttagttcaggagcgatgttactttttatttcaggttatttgatctcaaaatctgcccttagaccagaaaatgtaatggctgtatatgttcctattgttgcaacaagagcgtttagtatagggcaagctgtatttcattatatagagcgcctagtcggacatgatgtcgtactacgtatattagaaaaaatgagaacgaggctatatagaatagtagaaccacaggcgttatttttccgttctcgatttcaaacgggtgatatgttaggagtgttatccgaagatatagagcatttgcaaaacctatatttacgtacaatatttcctagcatattagcgctagttgtttatagtatcttcgtacttgttatcggtgcatttgattttgtttttgcacttattgtaggttgtatgttagctattatcgtttttcttcttccgtttgtatcattacttttgatgaagaaacatcatgttactttaaagcaaggaagaaaccgtttgtatcaacaactgacagatgctgtttttggattatctgattggcaagcaagtggtcgtaaagatgaatttattaatgagtatgtaaaacaaaatgatcagttgttaaaaatcgaaaagagagtgaaacgctggtatcatattcgggacagtatcattcaattagtagtaggtattgtagttatttcgatgatcatatggactgggaatgaagcggcaagtgaacaaattgctcctacagttatcgcagctttcgtattaatgactttatctgtaacaaacgcgcttattcctattgcagatgccatcgatcgaataccgtcgtacgtagaatctacccatcgtcttaatggcgtagaaagtgatagtgttttacatgatgaaacggatttgcatggagagaaagattatattgaaccaaaacatgtagatattgaactgaatcacgtatcgtatagttatccagatagtaatgagattgtattaaaagatgtatcattacaaataaaagcagggaagaaaattgctattttaggaagaagtgggacagggaaatctactttactaaaattgttaacaggggcgttaagcccagtaaatggccaagttgtattgaatggtgaacgagctcatacgaatcttttatctaaatatatttctgtattaaatcaaaagccgcatttgtttgatacgacaattggaaataatgtacgaattggcaaaccggaggcgacggatgaagagatatggaaagctttagagaaagcacaattagcttcacatgttacttctcttccagacggattacaaacaaaaatgcatgaaatgggaaagcggttttctggtggggaaagacaaagggttgcttttgctagaactcttatgcaagaaacatcaattattgtacttgatgaaccgactatcggtttagatccaaaaacagaattgtctttaatcgaaacaatgttttctgcaacggaagacaagacggttatttggattacgcaccatcttgtaggaatagaacatgtagacgaagttatattccttgatcgtggccaaattgtcatgcaaggtagtcataaacaacttctgaaagaaaatgaaaagtatcgtaaactttatgagttagataaaggaatatga

SEQ ID NO: 34532 - protein, 559 aa, Bacillus cereus ATCC 14579
MTLTIFLGLLGVSSGAMLLFISGYLISKSALRPENVMAVYVPIVATRAFSIGQAVFHYIERLVGHDVVLRILEKMRTRLYRIVEPQALFFRSRFQTGDMLGVLSEDIEHLQNLYLRTIFPSILALVVYSIFVLVIGAFDFVFALIVGCMLAIIVFLLPFVSLLLMKKHHVTLKQGRNRLYQQLTDAVFGLSDWQASGRKDEFINEYVKQNDQLLKIEKRVKRWYHIRDSIIQLVVGIVVISMIIWTGNEAASEQIAPTVIAAFVLMTLSVTNALIPIADAIDRIPSYVESTHRLNGVESDSVLHDETDLHGEKDYIEPKHVDIELNHVSYSYPDSNEIVLKDVSLQIKAGKKIAILGRSGTGKSTLLKLLTGALSPVNGQVVLNGERAHTNLLSKYISVLNQKPHLFDTTIGNNVRIGKPEATDEEIWKALEKAQLASHVTSLPDGLQTKMHEMGKRFSGGERQRVAFARTLMQETSIIVLDEPTIGLDPKTELSLIETMFSATEDKTVIWITHHLVGIEHVDEVIFLDRGQIVMQGSHKQLLKENEKYRKLYELDKGI

SEQ ID NO: 34533 - DNA, 1797 bp, Bacillus cereus ATCC 14579
  CDS (1)..(1797)
atgcgtaattttcaagggcaatttgctaataaaggtggacgaaacaaaccaaagatggggaaagctaaaaatgctcaaggaactgtaatgcggatatggaactatatgggctaccaaaaagctgctcttatgtttgttatatttctagtcgttgttactactttacttggattattaggtccctattttatgggggtcattattgatcaatatattgtaccgaaagatttaagtggtacagcaagaatgtgtatgttacttatcgcaatttacggtgtaactgtacttttaacatggttacaaacatttgtcatgattaacgttgcattaaaaacaattcaaaaaatacgacaagatatttttgagaaaatccaaacgctttctttacggttctttgatgtgcgttcccaaggtgatttaatgagccgtgtgacaaatgatatagataatttgaatcaagctttgacacaaagtgttgtacaaattatttcatcagcgttaacttttataggtgtaacgattgcgatgttcgctttaaattggattttagcaattgtaactttaattacagtacctattatgttttacgttacaaaaaaactagttgcatatagtggtaaaaactttgcgaagcgtcaaaaagatttaggtgaattaaatggatttattgaggaagcaattacaggtgcggatgttacaacgttgtacggaaaagaaaaagaaactgtacaaaatttcaataaaattaatgaacagctaagagtttcagctacgaaggctgatacattttcagcttttatttttccaagtatgaactttattaataatttaggtatgggccttgtcattgggactggatcagttatggtcttaaacggaatgacaacagtaggagttattgcggcttttattaattattctcgtcaattctcaagaccgctaagtcaatttgcgactttaatgaatacaattcaagcggcagttgctggtggagaacgtgtttttgaaattatggatgaggtaccagaaattcaaaataaaaaagacgcattcgttgtacaaaatttacaagggcatgttgcacttgagaatgtttcatttggctacgcagaaaataaaacgattttaaaagaagtgagtcttaaagcgcagccaggagagacaattgctttagttggtccgactggatcagggaaaacaacaatcattaatttattaactcgcttttacgatatacagcaaggacaaattcatattgatggaaaagatataaaagattatgatattaattctttacgaagtaaaataggagtagttttacaggatacgtatttatttgctggttcgattatggataatatccgttatggacgcttagatgctactgatgaagaagttatcactgcagctaaggcagcatctgcacattcttttattaagcatttgccaaatcaatatgaaacagaaattgcttcagaaggatcgaatttaagtcaaggacaaaaacaacttctagcgattgcacgagcaattttagcagatgcagatatattaattctcgatgaagcgacatcaaatattgatacaagaacagaattacaaatacaagcaggactaaataatttaatgagaggtcgcacaagttttgtgatcgctcatcgacttaaaacaattgaaaaagcagatcaaattcttgttataaaagatggaaatattttagaaagagggaatcatgaatctctcatggaagatagagggttttattttgatttgtatacgagccagtttaaaatatag

SEQ ID NO: 34534 - protein, 598 aa, Bacillus cereus ATCC 14579
MRNFQGQFANKGGRNKPKMGKAKNAQGTVMRIWNYMGYQKAALMFVIFLVVVTTLLGLLGPYFMGVIIDQYIVPKDLSGTARMCMLLIAIYGVTVLLTWLQTFVMINVALKTIQKIRQDIFEKIQTLSLRFFDVRSQGDLMSRVTNDIDNLNQALTQSVVQIISSALTFIGVTIAMFALNWILAIVTLITVPIMFYVTKKLVAYSGKNFAKRQKDLGELNGFIEEAITGADVTTLYGKEKETVQNFNKINEQLRVSATKADTFSAFIFPSMNFINNLGMGLVIGTGSVMVLNGMTTVGVIAAFINYSRQFSRPLSQFATLMNTIQAAVAGGERVFEIMDEVPEIQNKKDAFVVQNLQGHVALENVSFGYAENKTILKEVSLKAQPGETIALVGPTGSGKTTIINLLTRFYDIQQGQIHIDGKDIKDYDINSLRSKIGVVLQDTYLFAGSIMDNIRYGRLDATDEEVITAAKAASAHSFIKHLPNQYETEIASEGSNLSQGQKQLLAIARAILADADILILDEATSNIDTRTELQIQAGLNNLMRGRTSFVIAHRLKTIEKADQILVIKDGNILERGNHESLMEDRGFYFDLYTSQFKI

SEQ ID NO: 34535 - DNA, 1782 bp, Shigella flexneri 2a str. 2457T
  CDS (1)..(1782)
atgcgtagttttagccaactgtggccgactctcaagcgcctgttagcgtatggttcgccgtggcgtaaaccgctggggattgcggtcctgatgatgtgggttgcggcggcggcagaagtcagtgggccgctgcttatcagctattttatcgacaatatggtagcgaaaaataacctgccgttgaaagtggttgcagggctggctgcggcgtatgttgggctacaactgtttgccgccgggctacattacgcgcagtcgctgctgtttaatcgggcggcagtaggcgcagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgcagtgccgcactggtgggcgcgatgctggtggcgatgttcagcctcgactggcgaatggcgctggtggcgataatgattttcccggtggtgctggtggtaatggtgatataccagcgttacagcacgccgattgtccgccgtgtgcgcgcctatctggcggatatcaacgacggctttaacgaaatcatcaatggcatgagcgttatccagcagtttcgtcagcaggcgcgatttggcgaacgtatgggggaggccagtcgttcacactatatggctaggatgcaaaccctgcgcctcgacggttttctgctgcgtccgctgctgagtctgttttcatcgctcattctttgtggcttattgatgctgtttggcttctccgccagcggcaccattgaagtgggcgtgttgtatgcgtttatcagctatcttgggcgacttaacgaacccttaatcgaactgaccacgcaacaggcgatgctgcaacaggctgttgttgctggtgagcgcgtgtttgaactgatggacggaccgcgccagcaatatggcaatgatgattacccgttacagagtggcaccatcgaagtcgataacgtgtcatttgcttatcgcgatgacaatctggtgctaaagaacattaatctctctgtgccttcgcgtaactttgtggcgctggtcgggcataccggcagtggtaaaagtaccctcgccagtttattgatgggctattacccgctaacggaaggtgagattcaccttgatggtcgtccattaagttcgctaagtcatagcgcgctgcgccagggcgtggcaatggtgcagcaagatccggtggtgctggcggataccttcctcgctaatgtgacgctggggcgggatatctccgaagaacgcgtctggcaggcgctggaaaccgtgcaactggcggagctggcgcgcagcatgagtgattgtatttatacgccgctgggcgagcagggaaataatctctcagtcgggcaaaagcaactgctggcactggcgcgcgtgctggtggagacgccgcaaatcctgatccttgatgaggcaaccgccagcattgactccggtactgaacaggcgattcaacatgctctggcggcggtgcgtgaacataccacgctggtggtgattgctcaccgcttatcaactattattgatgccgacaccattctggtgcttcatcgtgggcaagccgtggagcagggcactcaccagcaactgctggcggcccagggacgctactggcagatgtatcaactgcaacttgcgggcgaagagctggcagccagcgtgcgtgaagaggaatcattgagcgcctga

SEQ ID NO: 34536 - protein, 593 aa, Shigella flexneri 2a str. 2457T
MRSFSQLWPTLKRLLAYGSPWRKPLGIAVLMMWVAAAAEVSGPLLISYFIDNMVAKNNLPLKVVAGLAAAYVGLQLFAAGLHYAQSLLFNRAAVGAVQQLRTDVMDAALRQPLSEFDTQPVGQVISRVTNDTEVIRDLYVTVVATVLRSAALVGAMLVAMFSLDWRMALVAIMIFPVVLVVMVIYQRYSTPIVRRVRAYLADINDGFNEIINGMSVIQQFRQQARFGERMGEASRSHYMARMQTLRLDGFLLRPLLSLFSSLILCGLLMLFGFSASGTIEVGVLYAFISYLGRLNEPLIELTTQQAMLQQAVVAGERVFELMDGPRQQYGNDDYPLQSGTIEVDNVSFAYRDDNLVLKNINLSVPSRNFVALVGHTGSGKSTLASLLMGYYPLTEGEIHLDGRPLSSLSHSALRQGVAMVQQDPVVLADTFLANVTLGRDISEERVWQALETVQLAELARSMSDCIYTPLGEQGNNLSVGQKQLLALARVLVETPQILILDEATASIDSGTEQAIQHALAAVREHTTLVVIAHRLSTIIDADTILVLHRGQAVEQGTHQQLLAAQGRYWQMYQLQLAGEELAASVREEESLSA

SEQ ID NO: 34537 - DNA, 1749 bp, Nitrosomonas europaea ATCC 19718
  CDS (1)..(1749)
atgacgagcaatcgctggcaggctgttttgaaaacggctgctttcctcaaaccttataaactatcgttaagttttagtctggcagcgttattcctgactgccggaattaccttatcgctagggcaagggatacggctgatggtggatcgtggattcgctacacagtcgcctgatctgctgacccggtatgtgttggtttttctgttgttggtggtactgcttgcgataggtacgtttacacgttactactgggtgacctggctgggggagcgggtgatcgcagatatacggcgcaaagttttcgcacatctgatcgagctgcatcctggatttttcgaagccaaccgtagccttgagatccagtctcgcttgactgcggatatgactttgctgcaatccgtagtgggttcttccatttcggtagcgttacgtaacctgattatgctggccggtggcatcgtctggttgtttattaccaatgtcaagctgacggtgatcgttatgctgagtattccattggtcatagttcccatcttgctgtttggccgacgcgtgcgtgtgctgtcgcgacaaagccaggatcgggtagcggccgttggcgcttatgttggggaaatgcttgggcagatcaagacagtgcaggcctataaccatcaggcaatggataaaatgcatttcgatcagtatgttgaggatgcgtttcatatcgcccgccagcggacattacaacgtgcctggttgatcgcggtggtaattgttctggtattcggtgcgatcggtatgatgctctgggtcggtggcatggatgtgatcgaaggtaaaatcagtgggggagaactggcggcattcgttttttacagcatcatcattggctcggcggtagggtcgatatcagaggtactgggggaattgcagcgtgctgcgggggctgcggagcgaaccatggagctgttggaggagcccagccagatcagttcgcctgtcgatcctcgtcaattgccggcagtgacaggcaatatcgtgttccagcgagtatgttttgcttatccatcacggcctgaaatacaagtgatcaatgatttttcattggcggtacgcccgggtgaaacgttggcgctggttggtctctcgggcgcaggcaaatcaactttattcgatttgctgctgcgtttctatgatgtgcggtcgggctgcatcagtctggaaggtgtgaatatccgcgatctggatttgtctgatctcaggcgcagttttgcattggtatctcagaatcctgtgctgtttcatggcagtatcgagcagaatctgcgttatgcgtgcccggatgcttcggatgcggaaatcgaaatggcggctaaagctgcttttatacatgatttcattgtttctctaccacaaggttaccagaccagcctgggtgataccggactggggttgtcgggtggccagaaacagcggctggcaattacccgggctattctggcagatgctccggttttattactggatgaagctaccagtgcactggacagtcagagtgagcactgggtgcaacaggcaattaccagattgagtacaggcaggacaaccattgtcattgcccatcgcctgagtaccatcctgacttctgatcgcattgctcttattcatcatggccgtctggaagcactgggtacacacgtggaattgatggaatctagtgaactgtatgcgcgtctggcgatagcgcagtttcaaatccccggctga

SEQ ID NO: 34538 - protein, 582 aa, Nitrosomonas europaea ATCC 19718
MTSNRWQAVLKTAAFLKPYKLSLSFSLAALFLTAGITLSLGQGIRLMVDRGFATQSPDLLTRYVLVFLLLVVLLAIGTFTRYYWVTWLGERVIADIRRKVFAHLIELHPGFFEANRSLEIQSRLTADMTLLQSVVGSSISVALRNLIMLAGGIVWLFITNVKLTVIVMLSIPLVIVPILLFGRRVRVLSRQSQDRVAAVGAYVGEMLGQIKTVQAYNHQAMDKMHFDQYVEDAFHIARQRTLQRAWLIAVVIVLVFGAIGMMLWVGGMDVIEGKISGGELAAFVFYSIIIGSAVGSISEVLGELQRAAGAAERTMELLEEPSQISSPVDPRQLPAVTGNIVFQRVCFAYPSRPEIQVINDFSLAVRPGETLALVGLSGAGKSTLFDLLLRFYDVRSGCISLEGVNIRDLDLSDLRRSFALVSQNPVLFHGSIEQNLRYACPDASDAEIEMAAKAAFIHDFIVSLPQGYQTSLGDTGLGLSGGQKQRLAITRAILADAPVLLLDEATSALDSQSEHWVQQAITRLSTGRTTIVIAHRLSTILTSDRIALIHHGRLEALGTHVELMESSELYARLAIAQFQIPG

SEQ ID NO: 34539 - DNA, 2094 bp, Enterococcus faecalis
  CDS (1)..(2094)
atgattttaaagcattataatacagaaatacccattcacaagttacgtgagttgtctggaacagatttagagggaacttccgcttttggtctaaaaagaactttagaaaaaattggttttgattctcctgctattcaagctgataatgaagtatggaaagaaaaagaattaccgttacctttaattgcgcatgtcttaattgacaataaatacatgcactatgtcgtggtttatggaataaaaggagataccttattaattgctgatccagatccaacagtaggaaaagtaaaaaaatcaatggaagaattttccaaagaatggacaggcgttttactgttacctacacctaaagagtcttatactcctaccaaagaaaaagtcgctggattgagctcttttttacccattatttggcgtcaaaaaggcttagtttttcacattattttagcgtctctttttattacgctatttgggattgggagctcctactattttcaaggaattttagattactttattcctaatcaagcacgttctactttaaacattgtttcgattggcttgattgctgtctatctgttccgtgtcctgtttgaatacagtcggagttatctcttagttatcctaggacaacgcatgagcatggccgtaatgcttcaatactttaaacatgttcttactttacctatgaacttttttgctacccgtaaatcaggggagatcatttctcgttttctagacgcaaataaaatcattgatgccctcgccagtgcaaccttatccgtctttttagacattgggatggtcttcttagtagggattaccttagccattcaaaatggtacattattcttaattaccttagcttcgttaccgttttattttgtggccattctagcctttgtcaaaagttatgaaaaagccaatcaagaagaaatggcggctggcgctaccttaaattcaagtattatcgagagcctaaaaggaatcgagacgatcaaggcctacagtggagaagaaaaagtctataatcgcgtggatcgagaatttattcgattaatgaaaaagtccttccggactgttacgctagataatgtgcaacaagggattaaacatgctattcagttaatcagtagtgcccttattttgtggctaggttctttctatgtcatggatggtacgattagccttggccaattgattacttacaatgccttgttggtgtttttcacggatcctttacagaatattattaatctacaagtcaaaatgcaaacagcgcaagtggccaacaaacgcttaaacgagatttttgccattgaaccagaacaaacaaacgattcttcggaacgcgaaattccaaatcaaacgttccaacaagaaataagactagaaaatgtctccttctcctataacatgaaagcacctaccttaaacaatatttcttgcaccattgcaccgaaaagtaaaatcgccttggttggggtaagtggttcagggaaatcaacattagcaaaattattagtgaacttttatgcgccttcagaaggaaccattcgctacggaaaaatgaatcatttagatattccgtttcaacaattacgtgaacacgtcacctatgtgccgcaagagtcttttttctttagcgggacaattgtagaaaacctaacgtttggcttacagaacatgcctagttttgaacggattattgaagtgtgtgaagccgttcaactaaacacattcattgaacaacagcctttacgctatgacatggtactagaagaaggaggggcgaatctttcaggaggacaacggcaacgattggcgattgctcgtgctcttttgaaagacgcggatgttttaatcttagacgaagcaactagcggattagacacactattagaacatgcgattcttgattatttactaacgttagaagagaaaacattgctttttattgcgcaccatttgcccattgctaaagcgtgcgatcacattctagttcttcatgaagggcaactggttgaacaaggggctcatgacgacctccgttataatcagggggtttatcaacagttatgggatatttag

SEQ ID NO: 34540 - protein, 697 aa, Enterococcus faecalis
MILKHYNTEIPIHKLRELSGTDLEGTSAFGLKRTLEKIGFDSPAIQADNEVWKEKELPLPLIAHVLIDNKYMHYVVVYGIKGDTLLIADPDPTVGKVKKSMEEFSKEWTGVLLLPTPKESYTPTKEKVAGLSSFLPIIWRQKGLVFHIILASLFITLFGIGSSYYFQGILDYFIPNQARSTLNIVSIGLIAVYLFRVLFEYSRSYLLVILGQRMSMAVMLQYFKHVLTLPMNFFATRKSGEIISRFLDANKIIDALASATLSVFLDIGMVFLVGITLAIQNGTLFLITLASLPFYFVAILAFVKSYEKANQEEMAAGATLNSSIIESLKGIETIKAYSGEEKVYNRVDREFIRLMKKSFRTVTLDNVQQGIKHAIQLISSALILWLGSFYVMDGTISLGQLITYNALLVFFTDPLQNIINLQVKMQTAQVANKRLNEIFAIEPEQTNDSSEREIPNQTFQQEIRLENVSFSYNMKAPTLNNISCTIAPKSKIALVGVSGSGKSTLAKLLVNFYAPSEGTIRYGKMNHLDIPFQQLREHVTYVPQESFFFSGTIVENLTFGLQNMPSFERIIEVCEAVQLNTFIEQQPLRYDMVLEEGGANLSGGQRQRLAIARALLKDADVLILDEATSGLDTLLEHAILDYLLTLEEKTLLFIAHHLPIAKACDHILVLHEGQLVEQGAHDDLRYNQGVYQQLWDI

SEQ ID NO: 34541 - DNA, 1644 bp, Rhodopirellula baltica SH 1
  CDS (1)..(1644)
atgaaactgcttctgatcctgcttcgatcatcctggatttctggtctggtttccggacttttgggagcgttcagcggtgtggcaaatctcggcttgatcatgctgatccaccacgctttgacgggggatccgtccgaggcgggttcgttgccgtatttgtttgccggtgcgtgcgtgttggtcctggtcacgcaagtgacggccaagtgcttgcttgtgcaattgtctcaggcaaccgcggcacgactgcgatacgagctgtgcaccaagatcatttcggctcccttgccgaccttggaatccgttggctcgcatcggttgttggctgcattgatcaacgacgtcaacgcaatcacatcggccttgtccgcatttcctggggcatgtgccaacgcgatggtgttggtttgtggattggtgtatttggcgacactgtccgttccattggcgggcgggacgattgtgatggcgggcatcggtgtgttcacgttcatgacggggctgaggtttgccaaccggcatcttcgacaggcccgagaagaccaagacgaagtggtcaagcaattgcgtgccatgatcgatggcatcaaagagctcaaaggcaacaacatgcgttgtctggactttgtctatgacgtgttgttgccagccgacaccaagatgcgtcacagcctgatcatcggttcaaacatacaggggtttgcgcacagttggggacggttgttcctgttcatcggcatcgggctgttgctgtttgcttggccgcaaatcgcgacggtgtcgacggcgacgttgaccggatacgttctgacgattttgtatctgacttatcccttggatgggatcttgggttggttgccggcgatgaatggtgcctcgattgcggtggccaagattgagaagctgggtttgatgatcgatcagcctgaacagcagacctcccacgttgcgccgaccaagtttgattcgcttgagatgcgaaacgtgacttatcggtacgattccacggacgatgagtgctttgcactgggccccgtcgatttaacgctctcgcccggtgagattttgttcatcgcgggtggcaacggcagtgggaaaacaacgctcgcgaaattgttgacgggactttacgttcccgacaccggtcagttgtgctggaacggtcgagatgtgaccagcaaggttcgagcagattaccgtcaactgttttcgacggtctttgtggaaggccatctgttcgatcgtttgttgggagttgatgtcacgcccggcaagttggagcattggatctctctgctggggatggaagaaaaggtcgatgtgcaaaccggtcgactgttgacccaggaactctctcggggccagcacaaacgtttggcgttgttggttgcggcgctcgacgatcgcccgatctttgttttcgatgaatgggccgccgaacaagacccaggattcaaggacatcttctaccaacagatcctgccagagcttcgacggatcgggaaaaccgtcgtcgcgatcacgcatgatgaccgctatttctccgttgccacgcgagtgttgatggtcgtcgatggtcggttgactgatgcgacccagaaagcggctgattcgttgcacgtcattcacagggacgcagcgtga

SEQ ID NO: 34542 - protein, 547 aa, Rhodopirellula baltica SH 1
MKLLLILLRSSWISGLVSGLLGAFSGVANLGLIMLIHHALTGDPSEAGSLPYLFAGACVLVLVTQVTAKCLLVQLSQATAARLRYELCTKIISAPLPTLESVGSHRLLAALINDVNAITSALSAFPGACANAMVLVCGLVYLATLSVPLAGGTIVMAGIGVFTFMTGLRFANRHLRQAREDQDEVVKQLRAMIDGIKELKGNNMRCLDFVYDVLLPADTKMRHSLIIGSNIQGFAHSWGRLFLFIGIGLLLFAWPQIATVSTATLTGYVLTILYLTYPLDGILGWLPAMNGASIAVAKIEKLGLMIDQPEQQTSHVAPTKFDSLEMRNVTYRYDSTDDECFALGPVDLTLSPGEILFIAGGNGSGKTTLAKLLTGLYVPDTGQLCWNGRDVTSKVRADYRQLFSTVFVEGHLFDRLLGVDVTPGKLEHWISLLGMEEKVDVQTGRLLTQELSRGQHKRLALLVAALDDRPIFVFDEWAAEQDPGFKDIFYQQILPELRRIGKTVVAITHDDRYFSVATRVLMVVDGRLTDATQKAADSLHVIHRDAA

SEQ ID NO: 34543 - DNA, 1752 bp, Candidatus Blochmannia floridanus
  CDS (1)..(1752)
atgcattactgcaataatggtaatatatcaaattggaaagtctttcggcgtctttggcctataattaatccctttaaaataggattaattatagcgtctattactttaattataaatgcagtaagtgattctttaatgttagcgttgttgaaaccgttgcttgatgaaggtttcgggaaagctaataggtcgatttttatgtggatgcctttggtattgatgggtttaatgattatgcgcgggatgagtgggtttgcgtcaacttattgtatatcatgggtatctggaaaagtggtaatgcatattagaagacttttgtttaatcatataatgaacatgccggtttctttttttattgaacaatctactgctactttaatgtctcgtattacttatgatgcagatcaagttgcatcatcatcttctggagctttaattactatcattcgagaaggagcatctgttgttgggttatgtattatgatgttttattacagttggcaattatcgttagttttaattttgattatgccgataatatccataattattaagttagtatccaataaatttaaagatattggaaaaaagatacagaattctatgagtcaacttgtaaatagtgtagagcaaatgctaaaaggtcataaagaagtgttaatatttggaggtcaacatcttgagcaaaatagatttaattatttaagtaatcgtatgagacaatatactatgaaaatggttcaaacgtcttctgtatttgaaccattaattcagtttgttgcttcattagcattggcttgtgtattatatatagcaagtattcctagtgttatagaaatgcttagtgctggaacaattactgttattttttcatccatgatagcattaatgaaaccattaaagtctttaactaatgttagtgcgcaatttcagcgtggaatggtagcttgtcaaactttgtttactattttagatttaaaaactgaaaaaaatataggtaaatttagcgttaaaagagttaaaggacatattatttttgataatgttacttttttttaccctgaaacaaatactccatctttatgtaatatcaattttaatattgaatctggaaaaactatagcattagtcggaagatctggatctggaaaatctactattgtaaatttattaactcgtttttatgatgtgtatcagggtcgtatattgcttgatggattaaatttaaatgattatacacttacttctttgagagaacaagtatctgtagttacacaaaatgtatatttatttaatgatactattgcaaataatattgcatatgcacgtacaagattttattctagggcttctattgaagaagcagctaaaatggcgtatgctatggggtttatttctaaaatgaagaatgggtttgatactattgttggagaaaatggtatattgttatctaatggtcaacgtcaacgtattgcaattgctcgggctttattaagaaattgtcctattttaattttagatgaagctacttcatctttggatactgaatctgaatgtattatttataaatctattaatatattaaagaaaaatagaacatcattaattattgcacatcgtttatctactatagaaaatgcggatgaaattttagtagttgaacgaggatctattgtggaaagaggaatacatgtggatttattaaatcataaaggtgtttattctcagttatataaatttcaattttcctga

SEQ ID NO: 34544 - protein, 583 aa, Candidatus Blochmannia floridanus
MHYCNNGNISNWKVFRRLWPIINPFKIGLIIASITLIINAVSDSLMLALLKPLLDEGFGKANRSIFMWMPLVLMGLMIMRGMSGFASTYCISWVSGKVVMHIRRLLFNHIMNMPVSFFIEQSTATLMSRITYDADQVASSSSGALITIIREGASVVGLCIMMFYYSWQLSLVLILIMPIISIIIKLVSNKFKDIGKKIQNSMSQLVNSVEQMLKGHKEVLIFGGQHLEQNRFNYLSNRMRQYTMKMVQTSSVFEPLIQFVASLALACVLYIASIPSVIEMLSAGTITVIFSSMIALMKPLKSLTNVSAQFQRGMVACQTLFTILDLKTEKNIGKFSVKRVKGHIIFDNVTFFYPETNTPSLCNINFNIESGKTIALVGRSGSGKSTIVNLLTRFYDVYQGRILLDGLNLNDYTLTSLREQVSVVTQNVYLFNDTIANNIAYARTRFYSRASIEEAAKMAYAMGFISKMKNGFDTIVGENGILLSNGQRQRIAIARALLRNCPILILDEATSSLDTESECIIYKSINILKKNRTSLIIAHRLSTIENADEILVVERGSIVERGIHVDLLNHKGVYSQLYKFQFS

SEQ ID NO: 34545 - DNA, 1803 bp, Prochlorococcus marinus str. MIT 9313
  CDS (1)..(1803)
atggattctcgcgttcggcgcactgcaagtcccctgagaaggctgctcagcagccttaagcctcatcggcgcctgattcttgcggcaaccacttgctccattctcaacaaactgtttgatctcgccccgccggtactcatcggtttggccattgacgtcgtcgtacacgaacagacttcctggttagcgaatcttggctttagcactgtccctagccaattgggatttcttgcgttgctctcctttctgatctggagtgctgaatccttctttgaatatctttatggcgtgttgtggcgcaatctcgcccagacaactcaacacaatcttcgcctgaaggcctataaccacctccagaatttggagatggcgtttttcgaggcagatagcagtgggcggctgatggctgttcttaatgacgacatcaaccaattagaacgatttctcgactacggggctaatcagatcttgcagttgattacaactgtgctgttggtaggtggggcgatggtcttcgtcgctccaggtgttgccttgttcgcctttttgcctatcccagtgatcttatggggatcaattcaatttcagcggcggttggctccgcgctaccgcgaggtcagagataaagctggtgagctggctgctcatctcagcaacaacctcggcgggatgttcacaatcaagagtttcgctacagaagcctgggaactagagcaaattcgctatcgcagtgaggcctatcgcagcagcaataagcaggcaatcaagctttcagcagccttcattcctctgattcgctttgccattttgtttgcttttttggccatcttggtgatcggaggccttcaggcatggaaggggcaaatggctgttgggctttacagcgtgcttgtttttattacacaacgcttgctgtggcctcttacaacccttggccgcacacttgatgaatatcagcgttcaatggcctccaccaatcgtgtgctggatttgatcgatactccgattaccatcgttgaaggatcacagccgttgataacagcacgagtgcggggcgctttgtgctttgaggatgtgggcttccattaccaaggccgcgctcctcttctaactcacttcaatcttgatattcccgctggctgcacgatcggaattgtgggagctacagggtcaggaaaaagcaccctggtgaaacttttgctgaggctttatccactcagctctggacggattcttctggatggacagccgattgacatgctcaagttaagggatctacgtcgttcaatcgcactggtcagtcaagaagtttatttatttcatggaacagtctctgaaaacattgcttatggcagtcctgagacaactcagaaaaaaattgatgatgcggcagatttggctgaagcctcagagtttattaaagccctcccgcgtggtttcaatacgttggtgggtgaacgtgggcaacgtctttctggtggtcagcgtcaacgaattgccctggctagggcaattctcaagcaggcaccgattctgatcttggatgaggccaccgctgccgttgataatgagacagaagcagcgattcaacgttctttgatgcatatcaccaaaaaccgaaccactgttgtgattgctcatcgtctcagtactgtgaggcatgcagatcagattattgttatggatcaaggtaatattgtcgagcaaggtactcacgattcacttttgaagcaatcaggtatctatagggatctctggcgagttcaggctggtttgcgtgctgacgaattgctgttggcctga

SEQ ID NO: 34546 - protein, 600 aa, Prochlorococcus marinus str. MIT 9313
MDSRVRRTASPLRRLLSSLKPHRRLILAATTCSILNKLFDLAPPVLIGLAIDVVVHEQTSWLANLGFSTVPSQLGFLALLSFLIWSAESFFEYLYGVLWRNLAQTTQHNLRLKAYNHLQNLEMAFFEADSSGRLMAVLNDDINQLERFLDYGANQILQLITTVLLVGGAMVFVAPGVALFAFLPIPVILWGSIQFQRRLAPRYREVRDKAGELAAHLSNNLGGMFTIKSFATEAWELEQIRYRSEAYRSSNKQAIKLSAAFIPLIRFAILFAFLAILVIGGLQAWKGQMAVGLYSVLVFITQRLLWPLTTLGRTLDEYQRSMASTNRVLDLIDTPITIVEGSQPLITARVRGALCFEDVGFHYQGRAPLLTHFNLDIPAGCTIGIVGATGSGKSTLVKLLLRLYPLSSGRILLDGQPIDMLKLRDLRRSIALVSQEVYLFHGTVSENIAYGSPETTQKKIDDAADLAEASEFIKALPRGFNTLVGERGQRLSGGQRQRIALARAILKQAPILILDEATAAVDNETEAAIQRSLMHITKNRTTVVIAHRLSTVRHADQIIVMDQGNIVEQGTHDSLLKQSGIYRDLWRVQAGLRADELLLA

SEQ ID NO: 34547 - DNA, 1797 bp, Prochlorococcus marinus str. MIT 9313
  CDS (1)..(1797)
atggctgttactgattttcagcgggttcggcgtctagggcgctatctccgtgaggaccgccggcgtctatggatggtgcttgtcctcttggtgccggtagctcttgctggtgcgattcaacccttcttggttggccaggcaatcagtgttttgaagcaagagtcaaccttcccttggctcagtgatctgccagtgagctcagcaataagagttttggtggggattctgctgatttctgtgcttctgcgcttgggtctgcagggctttcagtctttcaatatcgaggccttagggcaacggctaacggcgcgtattcgtaacgatctgtttggccacgccatggccctttcgctgcgctttcacgatcgaatgcctgtgggcaagttgttgactcggctgaccagtgatgtgaatgcactatcggaggtttttggtagtggggcagtaggagttttgggggatctcgtcagccttgtggtgattgcagtcaccatgattttgattgattggcgcctgggggggttgctgctggtgacgcaggtaccagtcaccttggtgatcctttggttgcaacgccgataccggaaagccaattaccgcgtgagggaggaactctctcagctcaatgccgattttcaggaaaaccttcaggggcttgaggttgtccagatgtttcgtcgagaaacgtttaatgggcagctatttgatcgcactggctcggcctacaggcaagccgtgaatggaacgatcttttatgacagcagcatttcagcttttatcgaatgggtggccctggcagccgtggctgtggtgttggcgcttgggggatggatggtaactgccgagacaatgggccttggcaccttgacaacattcatcctttattcccagcgtttgtttgatcccctgcgtcaacttgctgatcgcttcactcagattcaggggggcctgactgctgttgaacggattggcgagttgctggagcagccactggacattgtcgatgcaaagcctgttaaagacgaacccagctttgttaggccctcggcttctgctgcttgcggtgaggtggtgtttgagggggtgagctttgcctatcggccagacgagccgattctccaggaccttagttttcgcatttctgctggtgaacatgttgccctggtaggaccaaccggttcaggcaagacgaccctgatccgcttgctttgtcgtctttacgagcctcaagtcgggcggatcatgcttgatggtgttgacatcaaaacaatccctctttggcggctacgcaaacaactgggggttgtgcttcaggacacctttctatttagcggcaatgtggcagataacctccgattggattcctcgattgaggatgaccgtttgcggacgatctgtagagatcttggccttgatcctttgctcaatcggctacccaacggcttggagactgagctcagggagcgtggcggcaatttgtcatcgggagagagacagctcttagcagttgcaagggtggccattcgcaaccccactgtgctggtaatggatgaggcgaccgctttcatggacccttctacggaagcgacattgcaaagggatctagatcgcttgcttgaacgtcgtaccgcggttgttattgcccatcgcttggccactgtggaagcagccgatcgaattatggtgcttcggcggggcaagctgattgagcagggaacccaccttgagcttcgtgccaagggaggcctttattctcagttagcggaactacaggaaaggggactggcgaaactttga

SEQ ID NO: 34548 - protein, 598 aa, Prochlorococcus marinus str. MIT 9313
MAVTDFQRVRRLGRYLREDRRRLWMVLVLLVPVALAGAIQPFLVGQAISVLKQESTFPWLSDLPVSSAIRVLVGILLISVLLRLGLQGFQSFNIEALGQRLTARIRNDLFGHAMALSLRFHDRMPVGKLLTRLTSDVNALSEVFGSGAVGVLGDLVSLVVIAVTMILIDWRLGGLLLVTQVPVTLVILWLQRRYRKANYRVREELSQLNADFQENLQGLEVVQMFRRETFNGQLFDRTGSAYRQAVNGTIFYDSSISAFIEWVALAAVAVVLALGGWMVTAETMGLGTLTTFILYSQRLFDPLRQLADRFTQIQGGLTAVERIGELLEQPLDIVDAKPVKDEPSFVRPSASAACGEVVFEGVSFAYRPDEPILQDLSFRISAGEHVALVGPTGSGKTTLIRLLCRLYEPQVGRIMLDGVDIKTIPLWRLRKQLGVVLQDTFLFSGNVADNLRLDSSIEDDRLRTICRDLGLDPLLNRLPNGLETELRERGGNLSSGERQLLAVARVAIRNPTVLVMDEATAFMDPSTEATLQRDLDRLLERRTAVVIAHRLATVEAADRIMVLRRGKLIEQGTHLELRAKGGLYSQLAELQERGLAKL

SEQ ID NO: 34549 - DNA, 1779 bp, Synechococcus sp. WH 8102
  CDS (1)..(1779)
atgagcgtcatcagtgattggaaacgagtgcgtcggctgggccgttatctcgttcatgaccgccgccgtctgctgctgaccctggtgctgctcgtgccgttagcggtggcgggagcgattcagcccctgttggtgggccaggccatcagtgtgttgcgcaacgaacccagccttccctggctggagggtctgacgaccggggccgccatccgcctgatcgtgtcgctgctgctcgtgtcggtgctgttgcgtctagcgctgcagggggttcagctgttcaacatccaggctgtgggtcagcgacttaccgcacggatccgggatgatctgtttcgtcatgccctgtcgctgtcgctgcggttccacgacggcatgcctgtgggcaagttgctcacacggctcaccagtgatgtcgatgccttgtcggaggtcttcggcagcggagccgttggtgttcttggcgatctggtgagcctggtggtgatcgccagctcgatgctgctgatcgaatggcggcttggcctgttgctgctttgcacacagatccccgtgaccttgatggtgatctggttgcagggccgttaccgcaaggcgaattaccgagttcgagaggagctctcccagctcaatgctgattttcaggagaacctgcagggcctggaggtggtccagatgtttcggcgcgagcaggtcaacggcgagcgcttccagcgcaccggttccgcttacaggcgcgctgtgaatggaacgattttcttcgacagcagcatctctgccttcctcgaatgggtgtccctcggagctgttgccctggtgttggctcttgggggatggatggtgacatcaggttccatgggccttggaatcctcaccaccttcatcctctattcccagcgtctgtttgatccgctgcgtcagctggcggaacggttcacccagattcagggtggtctgacggccgtggagcgcatcggtgagctgatggagcagcccctggagatcgtggaggatcccaacgccactccgctgcgttcggccggcctgggggaggtgattttcgagaacgtcagcttcagctatcggccggatgagccgatcctgcgcaacctctccttccgcattgctcctggcgagcacgtggccctggtgggaccgacggggtctggaaaaaccaccgtcatccggctgctctgccggctgtatgaacctcagcagggccggattcttctggatggtcgtgacattcgttcgatttcgatcgccgatctgcgacgtcagctgggggtggtgttgcaggacaccttcctgttcagcggcaacgtggccgataaccttcggctcaatgccgagatcagcgatcaggagctggctggaatctgccgtgatctgggcctgaacgacctgttgcaacggctgcctaatgggttggagacagagttgcgggagcgtggcggcaatctctcgtccggtgaacgtcagctgctggcggtggcacgggttgcgatccgtaaccccacggtgctggtgatggacgaggccaccgccttcatggatccctccacagaggccaccctgcaacgcgacctggatcggttgctgcagaaacgcacggctgtggtgatcgcccatcgcctggccacggtggaagcctcggatcggattctggtgctgcgccgcggtgagttgatcgaacagggcacgcacctggagttgcgagcccggggtgggctctacgcccagctggcggagctgcaggaaaaggggttggctcgtttgtga

SEQ ID NO: 34550 - protein, 592 aa, Synechococcus sp. WH 8102
MSVISDWKRVRRLGRYLVHDRRRLLLTLVLLVPLAVAGAIQPLLVGQAISVLRNEPSLPWLEGLTTGAAIRLIVSLLLVSVLLRLALQGVQLFNIQAVGQRLTARIRDDLFRHALSLSLRFHDGMPVGKLLTRLTSDVDALSEVFGSGAVGVLGDLVSLVVIASSMLLIEWRLGLLLLCTQIPVTLMVIWLQGRYRKANYRVREELSQLNADFQENLQGLEVVQMFRREQVNGERFQRTGSAYRRAVNGTIFFDSSISAFLEWVSLGAVALVLALGGWMVTSGSMGLGILTTFILYSQRLFDPLRQLAERFTQIQGGLTAVERIGELMEQPLEIVEDPNATPLRSAGLGEVIFENVSFSYRPDEPILRNLSFRIAPGEHVALVGPTGSGKTTVIRLLCRLYEPQQGRILLDGRDIRSISIADLRRQLGVVLQDTFLFSGNVADNLRLNAEISDQELAGICRDLGLNDLLQRLPNGLETELRERGGNLSSGERQLLAVARVAIRNPTVLVMDEATAFMDPSTEATLQRDLDRLLQKRTAVVIAHRLATVEASDRILVLRRGELIEQGTHLELRARGGLYAQLAELQEKGLARL

SEQ ID NO: 34551 - DNA, 1863 bp, Chromobacterium violaceum ATCC 12472
  CDS (1)..(1863)
atgttttcctggttcgaacgccggatatccccctatccggacgcgccagccgcccagcctccgagcggcttcttttccttcgtctggttctgtacccgaggcatgcgcggcctgattctgtgcatgaccctgctcaccgcgctgatcggcgccttcgaggccttgctgttctcgatgatgggctcggtggtggactggctggccaaggtgccggccgatcagctgtggcagcgcgagcgtggccatctgctgatgctggccggcattctgctcggcagcgtattgttggtgtcgctgcaggcgatgagcaagtatcagggcctgttctccaatttcccgatgcggctgcgctggaacttccaccgccatttgctgggccagagcctgagcttctatcaggacgagttcgccggcagggtgtcggccaaggtgatgcagaccgcgctggcggtgcgcgacaccgtgttgatcgtcaccgacatcctggtgttcgtcgtcatctacttcgtcaccatgatcgcggtgctgggccatttcgacaccatgctgttgctgcctttcctggcctggctggcgctttacgtcgcgaccttgtggttcttcgtgcccaggctcggcaaggcggccagcctgcaggccgacgcgcgcagcctgatgacaggccgcatcaccgacgcctacaccaatatcgccaccgtcaagctgttctcccacggccagcgcgaagcgcgcttcgccaagggcgcgatgcaggagttcctgtccaccgcttaccgccagatgcggctggtcagcggcttcgaagtcgtcaaccagctgaccagcatgctgctgatcggcgtcaccaccggttccgcgctgtggttgtggagccaaggccaggtcagcatcggcgcggtggcggcgtccaccgcgatggcgttgcggctgaacggcatttcgcactggatcatgtgggaaatgtccagcctgttcgagaacatcggcacagtgcaggacggcatctccacgctgtcgcgcacggtagcggtggtggacaggccggatgcggccaggctggaggtgccgcgcggcgaaatccgcttcgacaatgtcgatttcgcctatggcggcgccaaaaaagtgatcagcgggctgaatctgacgatacggccgggcgagaagatcggcctggtcggccgttccggcgccggcaaatccaccatcgtcaacctgttgctgcgcttctacgacctggacggcggccgcatcctgatagacggccaggacatcgccggcgtcactcaggacagcctgcgcgccaaggtgggcatggtgacccaggacacctcgctgctgcaccgctcggtgcgcgacaatctgctgtacggccggccggccgccagcgacgagcagatgattgaggccgcgcgcagggccgaagccgatgatttcatccgcgcgctgaccgatcccaaggggcgcgtcggctacgaggcgcatgtcggcgagcgcggcgtcaagctgtcgggcggccagcggcagcgcgtcgccatcgcgcgggtgatgctgaaggacgcgccgattctgttgctggacgaagcgaccagcgcgctggactccgaggtggaggcggtcatccagggcagcctgtatcggctgatggagggcaagaccgtggtggccatcgcgcaccgcctgtccaccatcgcggcgatggaccgcctgatcgtgctggatcgcggccagatcgtagaggagggctcgcaccagcagttgctggctcagggcggcctctatgcccggctgtgggcgcatcagagcggcggttttctcggcgaggaggacggcgacgaggagtcgagcctgtccctgatgggctga

SEQ ID NO: 34552 - protein, 620 aa, Chromobacterium violaceum ATCC 12472
MFSWFERRISPYPDAPAAQPPSGFFSFVWFCTRGMRGLILCMTLLTALIGAFEALLFSMMGSVVDWLAKVPADQLWQRERGHLLMLAGILLGSVLLVSLQAMSKYQGLFSNFPMRLRWNFHRHLLGQSLSFYQDEFAGRVSAKVMQTALAVRDTVLIVTDILVFVVIYFVTMIAVLGHFDTMLLLPFLAWLALYVATLWFFVPRLGKAASLQADARSLMTGRITDAYTNIATVKLFSHGQREARFAKGAMQEFLSTAYRQMRLVSGFEVVNQLTSMLLIGVTTGSALWLWSQGQVSIGAVAASTAMALRLNGISHWIMWEMSSLFENIGTVQDGISTLSRTVAVVDRPDAARLEVPRGEIRFDNVDFAYGGAKKVISGLNLTIRPGEKIGLVGRSGAGKSTIVNLLLRFYDLDGGRILIDGQDIAGVTQDSLRAKVGMVTQDTSLLHRSVRDNLLYGRPAASDEQMIEAARRAEADDFIRALTDPKGRVGYEAHVGERGVKLSGGQRQRVAIARVMLKDAPILLLDEATSALDSEVEAVIQGSLYRLMEGKTVVAIAHRLSTIAAMDRLIVLDRGQIVEEGSHQQLLAQGGLYARLWAHQSGGFLGEEDGDEESSLSLMG

SEQ ID NO: 34553 - DNA, 1707 bp, Porphyromonas gingivalis W83
  CDS (1)..(1707)
atgatacgatatttccaacaccgattcgctctctctcgtaagggtgcgcaggatcttgccaaaggcattgcatggactacggttttgaatgtcggatttatgttgcctgccatattcacttttcttttcctcgaagactatctgcaaggatccgccacacatggtatttggtattatatagccatgggagcggcttttatggcggtgctcttcgttatagctctcttccaatacacaagcctgtacaccaagatatatacagagagtgccaaccgccgcatcgccttggctgaaaaactacgcaaactcccattggctttcttcggagagaagaatctgtccgatctgacttccacgatgatggaggatagtacggtgatggagactgtcttctctcacagtataccccagctctttgcatcgttggtcagtctctttttgatcggtatagggctcttctgctataattggcagctttcgttggcactcttttgggttgtgcctgtagcagccttagcaattgtcttttccaaaaagatgttgaacaaatcattccactcgaactaccatgtcaaacgagaggtcaccgagcatatacaggaaggaatcgaagagatacaggagataaaatcatataatggcgaagaagaatttgccgagcgcttcgatgccaaactccatgcctatgagaagagccttattcgatgtgaacttgttgtcggtgccgtccttaatgcttcacatataatcctcaaactgggacttgcctctgtaatcataatgggagcttatctcttgtcagaaggaacaattgatctattcacttatttagtctttctgcttatcggatcgagcatatataatcccataagtgaagtattcagcaatttgctactcttgcagtacctcgatgtacgtatcgatcgggtgagagagatggatgctatgccgatacaggaaggtaaaacggactattctgtccggaacttcgatattatattccaaaacgtaaatttctcctacgaaaaggggaagcaagtactgcgcaatgtatcgttcacggccaaacaaggagaagtcacagccctcgtcggtccgtcgggtggaggaaagagcacatcggccaagttggctgcacgcttttgggatatagatggaggaaagatctttttgggaggggaagacatttcgcaaatcgaacccgaaaccctgctacgtcattatgccatcgtcttccaagatgtactgctcttcaatgcatcggtggccgataatatccgcataggtaaacctgatgctacagatgaagagctcaaacgtgtagctcggttggcaagatgcgacgaatttgtagatcgtctgccgaatggatatgacactttgatcggtgaaaatggtgagaacctttcaggaggtgaacgtcagcgcatttctatagccagagctttactcaaggatgctccgattgtgctgctggatgaagctacggcaagtctcgatgttgagaatgagacactgatacaggccggtatatccgaactgatcaaaaacaagacagtcctcattatcgctcatcgtatgcgcactgtagccaatgcccataagattgttgtactcaaagaagggactgtagccgaatgtggcagtccggccgaattgatggccatgaacggtgtgtttgctcgaatggtggcggcgcagaagtaa

SEQ ID NO: 34554 - protein, 568 aa, Porphyromonas gingivalis W83
MIRYFQHRFALSRKGAQDLAKGIAWTTVLNVGFMLPAIFTFLFLEDYLQGSATHGIWYYIAMGAAFMAVLFVIALFQYTSLYTKIYTESANRRIALAEKLRKLPLAFFGEKNLSDLTSTMMEDSTVMETVFSHSIPQLFASLVSLFLIGIGLFCYNWQLSLALFWVVPVAALAIVFSKKMLNKSFHSNYHVKREVTEHIQEGIEEIQEIKSYNGEEEFAERFDAKLHAYEKSLIRCELVVGAVLNASHIILKLGLASVIIMGAYLLSEGTIDLFTYLVFLLIGSSIYNPISEVFSNLLLLQYLDVRIDRVREMDAMPIQEGKTDYSVRNFDIIFQNVNFSYEKGKQVLRNVSFTAKQGEVTALVGPSGGGKSTSAKLAARFWDIDGGKIFLGGEDISQIEPETLLRHYAIVFQDVLLFNASVADNIRIGKPDATDEELKRVARLARCDEFVDRLPNGYDTLIGENGENLSGGERQRISIARALLKDAPIVLLDEATASLDVENETLIQAGISELIKNKTVLIIAHRMRTVANAHKIVVLKEGTVAECGSPAELMAMNGVFARMVAAQK

SEQ ID NO: 34555 - DNA, 1692 bp, Wolinella succinogenes DSM 1740
  CDS (1)..(1692)
atgctggccaaactccgcactcttctcaccgccaaagacaaagagttcatcttcgtcttgcttctcttctccatcatcatctctatcatcgagatgatcggcatctccgctatcatgcccttcatctcggtggcaagtgattttgagaccattgaggccaaacgctacttttccgtcccttatcactattttggcttcacctccccgcagggcttcgtgatcgcctttggagtcattctccttttcttttaccttttccgcagtcttatcaatctcttttaccaatatcttctcgctcgattctcctttgggcgctaccacctcatcgcctttcgactctttcagaactacatggggatgagctataaagatttcatcaccaaaaacagctcctctctcaccaaggccatcatcaacgaggccaacaacctcaccatcgttatcgctgccgtgctctttatgatctctgagctctttgtggtgattctcatctatggaatgctgctagtggtcgactatcagatcaccctcacactcacactccttttggcgctcaaagcatggattttaggggtgaccgtctccaaaaaaatcaaagatgagggggatagacgcgaggagttccaaaagagcttctatgagattatcggctctagctttggcaacttcaagctcatcaaacttcagagcaacgaaaaacctatcatggacaaattcgccaatgcctcttggggatacgccacctctaacatcatcaatcagaccctctcccatgtccctaggctctttttagaggccattggattctctttgatggtcgccatcatcctctttttggtctactccaaggagggtgacatcagcgatgccctacccctcctctctatgtatgtgctcgctctctatcgcctcttgccctccgtgaatcgaatcttggacagttacaaccgaatcctcttcaatcacaaatcgcttgatattgtctatgacgacctctcttatagccttgattctttgggcgattcccccgtggaatttgaacgtgagattcgactccagaatgtcacttttgaatacgagaatcacaaacccgtttttgaaaatctcaacctcaccctcaaaaaagggcaaaaggttgctttcatcggcgagagcggaagcggcaaaagcaccctagtggatattttgattggactctacaagcccaaaagtggtgaaatctttattgatgagacgcgcctaagtctagaaaacctcaaaaactggcgccgcaaagtgggctatatcccccaaagcgtctatctttttgatggcaccgttgccgagaatgtggtctttgggcgagagtataatgagagcaaaatcaaagaggtgctaaaactagccaatgtctatgactttttgcaaaaaaaagagggtctcttcaccaaagtgggcgagggaggagtgatgctaagcggagggcaaaaacagcgaattgctatcgctagagccctttatggtgaccctgaaattttggtgcttgatgaagccactagcgcgttagataacgaaacggagagcaaaatcatggaagagatttacgaggtaagccaggacaaaacgcttatcatcatcgctcaccgcttaagcaccatagagcactgtgaacgaatcttccgcatcaaagagggaggagtgcatgaagagtga

SEQ ID NO: 34556 - protein, 563 aa, Wolinella succinogenes DSM 1740
MLAKLRTLLTAKDKEFIFVLLLFSIIISIIEMIGISAIMPFISVASDFETIEAKRYFSVPYHYFGFTSPQGFVIAFGVILLFFYLFRSLINLFYQYLLARFSFGRYHLIAFRLFQNYMGMSYKDFITKNSSSLTKAIINEANNLTIVIAAVLFMISELFVVILIYGMLLVVDYQITLTLTLLLALKAWILGVTVSKKIKDEGDRREEFQKSFYEIIGSSFGNFKLIKLQSNEKPIMDKFANASWGYATSNIINQTLSHVPRLFLEAIGFSLMVAIILFLVYSKEGDISDALPLLSMYVLALYRLLPSVNRILDSYNRILFNHKSLDIVYDDLSYSLDSLGDSPVEFEREIRLQNVTFEYENHKPVFENLNLTLKKGQKVAFIGESGSGKSTLVDILIGLYKPKSGEIFIDETRLSLENLKNWRRKVGYIPQSVYLFDGTVAENVVFGREYNESKIKEVLKLANVYDFLQKKEGLFTKVGEGGVMLSGGQKQRIAIARALYGDPEILVLDEATSALDNETESKIMEEIYEVSQDKTLIIIAHRLSTIEHCERIFRIKEGGVHEE

SEQ ID NO: 34557 - DNA, 1707 bp, Wolinella succinogenes DSM 1740
  CDS (1)..(1707)
atgcccaactctcttgatataaaaactcttctctcgctcctaaggccccatcgccgctcaattttggcgggctatttggtggctctgcttgcgcttgcgctctccattcccacgcccctttttgtccccctcttggtggatgaggtgattttgggacaaaaaggatggcttacaaatcttctctctccactctacgccgatgcgccgattctcttttatgtggggatggtgcttttgatcgtcacctttttgcgccttgcctatttcggtcttcatatttggcaatacaagatcttcacccacctctccaaagaggtgaccttaaagcttcgagaaaaagtgctagagaagctccagagaagctctatttttgagtttgagcgccttggaggagggaatatctcctcgcgcctcattaatgacctagagacgattgatagcttcattgctatcactagcggtcgattcctgctcgcgctactctctctcttgggtattggcgtggtgctcctttttattcatgtttggctggggctctttatcctgctccttaaccccctagtggtgctggcgagtcgacgcatcgggcagagggtggggctcatcaaaaaagaagagaatcgcgccatcgagtcatttcaggcacagattgaagaggtattcctcctgctcgcccctattcgcgtgaacaacctgagtgagcgattctttggaaagatcaaagaggaggcgcatcgagttcgccaagtcggagaggagtatgcatggaagagcgaagcggcggctcgattctcaggaacggtctttttagtggggtatgagatttttcgtgcggctagcattctcatggttgcctactccgacctctctatcggccttatgttggccgtctttggctatctttggtttatgatgacccccatccaagagctcatctccacccaatacgcctactacaacgccaaagcctcgctgggaagaatcaacgagcttttggatctccccgaagagagcacgcgcttggaggctaaagcctccttccccctctcgcccctccatctggaggtgaagaatctctcctttgcctttcccgactcacctctcctctttgaggggctgagcatggagattaaacccaaagagaaggtcgctcttattggagcttctggttcaggcaagagcacactggctcatcttttggtggggctctgctcaccgcttaagggtgagattctctacaatggcaagaacactcaagagcttggttttgaggccattagagagcgggtctttttgctgcttcaagagcctaggctttttaatgacaccctacacttcaatctcactctaggcaaggagtgcccccaagaggagatccaaaaggcgatcgaaatcgcccagctttccccttttatcgcctctctcaaagagggactagagacgcctttaggtaggcttggagcgaggctctcaggcggtcagcgccaaagagtgatgattgcgcgaatgattctggctaagcctcagtttgtcatctttgatgaatcaacttcagcgcttgatctagagactgaagagcgcctgcacgatctgctcttagaacaccttcgtgacaccacggcactcatcatcgcccaccgacccactacgatcaaaaaagcgaatcgaatctaccagctcaaagaggggagtctgcgggaattttga

SEQ ID NO: 34558 - protein, 568 aa, Wolinella succinogenes DSM 1740
MPNSLDIKTLLSLLRPHRRSILAGYLVALLALALSIPTPLFVPLLVDEVILGQKGWLTNLLSPLYADAPILFYVGMVLLIVTFLRLAYFGLHIWQYKIFTHLSKEVTLKLREKVLEKLQRSSIFEFERLGGGNISSRLINDLETIDSFIAITSGRFLLALLSLLGIGVVLLFIHVWLGLFILLLNPLVVLASRRIGQRVGLIKKEENRAIESFQAQIEEVFLLLAPIRVNNLSERFFGKIKEEAHRVRQVGEEYAWKSEAAARFSGTVFLVGYEIFRAASILMVAYSDLSIGLMLAVFGYLWFMMTPIQELISTQYAYYNAKASLGRINELLDLPEESTRLEAKASFPLSPLHLEVKNLSFAFPDSPLLFEGLSMEIKPKEKVALIGASGSGKSTLAHLLVGLCSPLKGEILYNGKNTQELGFEAIRERVFLLLQEPRLFNDTLHFNLTLGKECPQEEIQKAIEIAQLSPFIASLKEGLETPLGRLGARLSGGQRQRVMIARMILAKPQFVIFDESTSALDLETEERLHDLLLEHLRDTTALIIAHRPTTIKKANRIYQLKEGSLREF

SEQ ID NO: 34559 - DNA, 1752 bp, Gloeobacter violaceus PCC 7421
  CDS (1)..(1752)
atggcctggttaccagaaaactatcgccgcctgataccctatgttgcgccgcaccggcgcgtgattttcgcggcgctggcctcgatgatcgggtttgtttcgacgatgccgctgttggcctacatggttgggcggctgaccaaatttttgggtgagggcaatctctcggcgattacggagcttgcctggatcacctttggggtgttcgtggtgcgcggtatttttcagtacggccaggacactctgatggccaaagccgctctgcaggcgatcaccgacttgcgcgcgcgcgtctacgcccacttgcagtcgctggatctggcgagttttgcttcccagcgcacgggggatttgaccgtgcgtttgaccagcgacatcgacaaacttggcgaaattttgcggcgcttctttaaccagttcatcccctgtgtgctcacgattatcgcggtggtgagctatctcatctacctcaactggcagttgaccctggtgacgctggtggtctccccgctcatcggctggcttttcgggtggttcggcaacaagctggctgatttgtcgcgcaccagccaggagcagatcgccgatttgtcctcgcgactttatgaaattttcagtgccatccgcatcatccgggcttttgccgccgaagattacgagcagcgccgttttggcgaattgtccgatgaaaaccggctggcgcgctttcgcaccgaacagatcaaagccatccagtatccggtcatcggtttgatgcaggctctgggggtgctgttggttttctgggtaggcgcctggcagattagcgccggcaacctgccggctttcgaatttgcctcttttgccaccggcatcggcctactccttgatccggtgcggatgatcaccgagaaccttaacgagttacgccaggccggtgcttctgctgaccgggtcttcgaattatttgatttgaagccgaccgtgttgcaggcgccggatgccgttcccctcagtccggtcaaaggacgcatcgagtttagcaatatcgatttttcctacgccgacgatcgcccggtgctcaacaatgtcaacttgcgtgtcgagccgggagaggtggttgccctagtcggtccttccgggtccggcaagtcttcgctggtgaatctgctgccccgcttctacgacccacagcagggcaccgtgcgcatcgatggaacggacgtgcgcgcggtgaccttcaagagcctgcgccgtcagatcggtattgtgcctcaagaaacgctgttgttctccggcaccatcgcccagaacattgcctacggctgcgacgaggccgacatcaagggcatgctggacagaattgtccgggcggccaagattgccaacgcccacgagtttattcaggacttgcccgggggctacgacgcgaaggtgagcgaggggggacggggtttatccggcggtcagcgccagcgcatcgctatcgcccgcgccgtgctgttggatccgaagattttgatcctcgatgaagcaaccagcgcccttgacaacgaatcggaggcgctggtgcaagaagcgctcaaccgtctaatgcaagatcgcaccgtgatcatcgtcgcccatcgcctgtccaccatccgcgacgccgatcgcatcctggtgcttgagcgcggccggattatcgaggctgggaatcatctcagcctgatcgacagcggcggcgtttacgcggcgctctacaaccgccagttcgaacgcgcctcggtttga

SEQ ID NO: 34560 - protein, 583 aa, Gloeobacter violaceus PCC 7421
MAWLPENYRRLIPYVAPHRRVIFAALASMIGFVSTMPLLAYMVGRLTKFLGEGNLSAITELAWITFGVFVVRGIFQYGQDTLMAKAALQAITDLRARVYAHLQSLDLASFASQRTGDLTVRLTSDIDKLGEILRRFFNQFIPCVLTIIAVVSYLIYLNWQLTLVTLVVSPLIGWLFGWFGNKLADLSRTSQEQIADLSSRLYEIFSAIRIIRAFAAEDYEQRRFGELSDENRLARFRTEQIKAIQYPVIGLMQALGVLLVFWVGAWQISAGNLPAFEFASFATGIGLLLDPVRMITENLNELRQAGASADRVFELFDLKPTVLQAPDAVPLSPVKGRIEFSNIDFSYADDRPVLNNVNLRVEPGEVVALVGPSGSGKSSLVNLLPRFYDPQQGTVRIDGTDVRAVTFKSLRRQIGIVPQETLLFSGTIAQNIAYGCDEADIKGMLDRIVRAAKIANAHEFIQDLPGGYDAKVSEGGRGLSGGQRQRIAIARAVLLDPKILILDEATSALDNESEALVQEALNRLMQDRTVIIVAHRLSTIRDADRILVLERGRIIEAGNHLSLIDSGGVYAALYNRQFERASV

SEQ ID NO: 34561 - DNA, 1767 bp, Gloeobacter violaceus PCC 7421
  CDS (1)..(1767)
atgtccgaagccgtcgagccgcagccgggtgagcgccgcaactgggaactgctcaagcgcgtctggccttttgcccgtcggcaggtgcgcctttttatactggccttggtcctgctgccgcccctggccaccgcgagcgccatcggcccgattctcatccagcgggccatcgacggaccggccaagaccggcgacatggggcttctgcattggctggcgtttttgttcgcccttacggtgctggtgcggttgggtctacaggcctggcagggctatttgctgcagcaggcgggccagcggatgaccgccgacatccgctcagcactttttgaccacgtcacccgcctatcgagcagctacttcagccgcacgccggtgggcaagctgatcacccgcctcaccagcgacgtcgaagcgttgggcgaagtcttttccaccggcggcgtgggtatcctcagcgatgccgtctcgattgtgatcgtggccgccttcatgttcacgctgcgctgggatctggccctggtggtagtaatcttactcttcccgatcaccgccatcgtcatctggtttcagaacacctaccgggcggccaattcccgcgtgcgcgaggcgctttccaacctcaacgccatcttgcaggaaaatctaatcggcgtgaacgtcgtgcagatgttccgccgcgaggggcgcaacgccgagcagttcgaccgggtcaaccgcgggtacatcaagtcggtggacgagacgatcctctacgattcggccctctcggcggtgatggagtggatttcgctggtggccattgccggggtgctctggttcggcggcggccaggtgctccaaaatgccattacttttgggacgctggtggcctttatccagtacgcccagcgcctgtttgatccgattcgccagttgggcgagcgcttcacgtcgatccagtcgggctttacgtccctggagcggatcaccgacatcctcgatgaacccatcgagatcaaagaccaggacaaaccgttgcaactgcccgcggacggtaccggagaagtcacgtttcaaaacgtctggtttgcctacaaagcggacgaatacgtgctcaaaaatgtcagcttcacgatcaaacccggccagaccgtggccctggtcggtcccaccggctccggcaagagcacgattatccggctgttgtgccgcctgtacgaacccacccaggggcgcatcctcatcgacggcgtcgatatccaactgattgcccaggaagagttgcgccgccgcatcggggtcattttgcaggaggggttcctcttctccggcgatatcaactcgaacatcgcccttggtgaacccttcagcgaagaagagattcaacaagccgcgcgggcgatgaacgtcgatcgcttcatccgcgagttaccgaacggctacaagacccaggtgcgcgagcgcggcaacaacctttccggcggccaaaagcagctgttggccttcgcccgcgccgccgtgcgcaacccacgcatcctgatccttgacgaggccaccgcttcgctcgatgtaggcaccgagtcgctcatccaacaagatctgggtcgtctgctcgaagggcgcacctgtatcatgatcgcccaccggctatccaccatccgcgacgtcgatcgcattttggtgttgcgcaaaggtgaactgatcgaagacggcagtcacgaacagctattggcccagcacgggctttacgagagcctctacaagctacaggctctggcctcttga

SEQ ID NO: 34562 - protein, 588 aa, Gloeobacter violaceus PCC 7421
MSEAVEPQPGERRNWELLKRVWPFARRQVRLFILALVLLPPLATASAIGPILIQRAIDGPAKTGDMGLLHWLAFLFALTVLVRLGLQAWQGYLLQQAGQRMTADIRSALFDHVTRLSSSYFSRTPVGKLITRLTSDVEALGEVFSTGGVGILSDAVSIVIVAAFMFTLRWDLALVVVILLFPITAIVIWFQNTYRAANSRVREALSNLNAILQENLIGVNVVQMFRREGRNAEQFDRVNRGYIKSVDETILYDSALSAVMEWISLVAIAGVLWFGGGQVLQNAITFGTLVAFIQYAQRLFDPIRQLGERFTSIQSGFTSLERITDILDEPIEIKDQDKPLQLPADGTGEVTFQNVWFAYKADEYVLKNVSFTIKPGQTVALVGPTGSGKSTIIRLLCRLYEPTQGRILIDGVDIQLIAQEELRRRIGVILQEGFLFSGDINSNIALGEPFSEEEIQQAARAMNVDRFIRELPNGYKTQVRERGNNLSGGQKQLLAFARAAVRNPRILILDEATASLDVGTESLIQQDLGRLLEGRTCIMIAHRLSTIRDVDRILVLRKGELIEDGSHEQLLAQHGLYESLYKLQALAS

SEQ ID NO: 34563 - DNA, 1803 bp, Photorhabdus luminescens subsp. laumondii TTO1
  CDS (1)..(1803)
ctgcttggcggggagaaaaaaccgggacaggagcaaattatcatggggctatttaatcgtctccagcaacatctatcaccaaaactacaaagagtttggtttaagggattgttatataaacagtttgataccgttgcgattatggctcaactggctattgctgcctgggctattacccatctaggggaaagtgacaatcctatgttgccgcttatcactttgggattactggttattttattgttgctgcgatttacttttatggctcgcgcattacgtaaactcaccattgccgcctatggtttaggcatagaaattcgtcgctctctgctacaacgccttgtcagtatgtctgtcgccactattcggggattgagcgctggaaaaatagcgttgacgttatctgaagatgtgcaatggcaggaaaatcagtcagcctataccacaccgcaaatcgcttgtcaggtgatgatgctgactctcatctacttagctttattctggttcgattgggtggttgccggtagtgcattattagtgctgatggttggaatgttcatcttgggagctatccgtaaaaaactgaatgaaatattgcgcttgcgtgccactatgatggctgaggtatccgaagctatcgttgagtacgcccaaggtatgtcctttattcgtgctgcggcagcaaccacgacggtagaacagcgttttgaccgcgaaatcgaccaattacgtgtcgcattccgccgcggggtattcagaagtattccgctactgagcctgttttacatcatcattgataccagcgtggtcgttggcattctggctggtgctctgcgttttaattcaccagaagcattaacactttcagaaatacttatcactattctgttgttgtttgccacgattacccctctacgtgggatcatccccttactcaatattacggccttaacgcaagtaggtgaaacccatattgcagagatagaagccgttgcaacgcaagcttccgggccactagctgcgccagacaaatatgatgttgaagttaatgacatttcgtttagctatccaggtaccaatcaacccgctatccaaaatgtgtcgttttatgcgccgcaaggcagtatgaccgctattgtcggacccagtggcagtgggaaatccacactggcttatctattactctctttctatcaactggataagggagaaatccgtctgggtggaaatgatatccatcattaccaaacccaagcattgtatgacaccgtgactatggtatttcaggaaaccgcactatttcaggataccgtcgctaacaatctccggttgggtgatcccaatgcaacccaattagaactggaacaagcagctcgtcttgccaatattcacgatacgattttggcattaccacaaggatacgatactccgctaggcgtggatggcggtacgctgtctggtggcgagcgtcagcgccttgccattgcccgtgccattttaaagcaatctccggttttattccttgacgaagcgacggcttctctcgatcccgaaaacgaacagttgatacaacaggcgtttgattctcttacccggaataaaacagtttttgttatcgctcatcggctgagcacgataacccgcgctgaccagatattggtgatggatcatggaaccctttgtgatagcggcactcatgacgaattgttagcgcgttgttcactttatcaatctctttgggaaaaccatctcggctcagaagagcactggcatctatatccaaataagccaaataaggtgtaa

SEQ ID NO: 34564 - protein, 600 aa, Photorhabdus luminescens subsp. laumondii TTO1
MLGGEKKPGQEQIIMGLFNRLQQHLSPKLQRVWFKGLLYKQFDTVAIMAQLAIAAWAITHLGESDNPMLPLITLGLLVILLLLRFTFMARALRKLTIAAYGLGIEIRRSLLQRLVSMSVATIRGLSAGKIALTLSEDVQWQENQSAYTTPQIACQVMMLTLIYLALFWFDWVVAGSALLVLMVGMFILGAIRKKLNEILRLRATMMAEVSEAIVEYAQGMSFIRAAAATTTVEQRFDREIDQLRVAFRRGVFRSIPLLSLFYIIIDTSVVVGILAGALRFNSPEALTLSEILITILLLFATITPLRGIIPLLNITALTQVGETHIAEIEAVATQASGPLAAPDKYDVEVNDISFSYPGTNQPAIQNVSFYAPQGSMTAIVGPSGSGKSTLAYLLLSFYQLDKGEIRLGGNDIHHYQTQALYDTVTMVFQETALFQDTVANNLRLGDPNATQLELEQAARLANIHDTILALPQGYDTPLGVDGGTLSGGERQRLAIARAILKQSPVLFLDEATASLDPENEQLIQQAFDSLTRNKTVFVIAHRLSTITRADQILVMDHGTLCDSGTHDELLARCSLYQSLWENHLGSEEHWHLYPNKPNKV

SEQ ID NO: 34565 - DNA, 1677 bp, Photorhabdus luminescens subsp. laumondii TTO1
  CDS (1)..(1677)
atgatctctgatttggttaaagccaatcggttaaaaattatttttaatagtattgttggtgcttttagtgctttctttagtatttggttaatttccttgattaccgatgatgcattagaacagattagcgctgacttagtatcatggacagttaaattcttcatcgggcttgcctgcttgtttgttgtgagttcttttgctaattacttaatgacaaagttaagcgtcaaaattatttttgaagttcgtagtaccttagtgaaacgtatcttgaataccccttatgctattttggaacggattggcgggcataaagtccaggccagtttaacatctgatgtgagtgatatttccagagctatttctaccatgccgcagtttatttatcatgtgattacagtgattgcatgtttaggttttctggcattcaaatcgattgagctgtttatggtcacgttggtcactctcccgttagggcttttggtttcgcgttattttattagtaaagccgaagcttatgatgaggtatatcgtgatgattatgatagccttcatgaacagtttaaaagtctggtagatggagttaaagagcttaataataatgaaaagcgcaaacattcattttttaatcgaggtgttttaccatcattagaaaagattaatgactctgatcttaaatcagaaattttctggaaattgaatgaaaactgggggcaaatattattatttctggtgcttggatctattttattttctcacgttatgtgggagataggagaaagcaatgatattcttacctttatctttattatgacctttttgctgggccctgttgattttattttgtcctcacaggaaaccatagtaaaggcactcatatctctacgtaagattgatcgcttaaggttttctgaaaacttatcaatggagccaacattaaccaacacaggagagtttaaagaatggtctcgaatttccctgcgttccataagctttaaatatgccggtgaagggaattgtttttctgttgggccgattaatctggatattcagcgtggcgaaattatcattattaaaggcggtaatggcagtggtaaatcaacttttgctaaattgttgattggtctattgaataaatctgaaggtgatattttcatagatgataaggtggttaatgaagataatcgagagaattatctgaatatgtacagtgttattcattcagatttttatctatttgatacagtaattaatcgaaaaggtgaacttgccgatgatgaattaactcgtcaatatctgaaaaaattggatttagcagaaaaagtcacggttaaagatggtagattatccacaactaagctttctcatggtcaacgtaaacgcttagctctggttatctcttatatggaagatgcgcctatttatttgtttgatgaatgggcagccgatcaagatcctaattatagaagatttttctatcatgaattactttctgaaatgaagcgcaatggaaaaaccgtcatcgttattagccatgacgataaatattttcatatcgccgacagagttatcactatggataatggtttggtggataatattgaaataaacgtacaccccgataaagtagaaaatgctgctttagagtccgctatttctactatgtatacccaatag

SEQ ID NO: 34566 - protein, 558 aa, Photorhabdus luminescens subsp. laumondii TTO1
MISDLVKANRLKIIFNSIVGAFSAFFSIWLISLITDDALEQISADLVSWTVKFFIGLACLFVVSSFANYLMTKLSVKIIFEVRSTLVKRILNTPYAILERIGGHKVQASLTSDVSDISRAISTMPQFIYHVITVIACLGFLAFKSIELFMVTLVTLPLGLLVSRYFISKAEAYDEVYRDDYDSLHEQFKSLVDGVKELNNNEKRKHSFFNRGVLPSLEKINDSDLKSEIFWKLNENWGQILLFLVLGSILFSHVMWEIGESNDILTFIFIMTFLLGPVDFILSSQETIVKALISLRKIDRLRFSENLSMEPTLTNTGEFKEWSRISLRSISFKYAGEGNCFSVGPINLDIQRGEIIIIKGGNGSGKSTFAKLLIGLLNKSEGDIFIDDKVVNEDNRENYLNMYSVIHSDFYLFDTVINRKGELADDELTRQYLKKLDLAEKVTVKDGRLSTTKLSHGQRKRLALVISYMEDAPIYLFDEWAADQDPNYRRFFYHELLSEMKRNGKTVIVISHDDKYFHIADRVITMDNGLVDNIEINVHPDKVENAALESAISTMYTQ

SEQ ID NO: 34567 - DNA, 1785 bp, Photorhabdus luminescens subsp. laumondii TTO1
  CDS (1)..(1785)
atgactaaagttcgtcaattgtggccgtctctgaagcgtctgttggtttatggaaaaaattatcgtaagccgttggggctggctgtactcatgttatggggggctgcaattgcggaagtcagtggtccggttctcattagttattttatcgataatatggttgcaacgggtaatatgcctactagagtggttatcgggctagctataacttttattgttctgcaactgattacggcggcgttacactattttcaggctttattgttcaatcaagtgtcagttgatgtggttcagcagcttcgtactgatgtgatgaatgcagcattgcgccagcctctgagtgcttttgataatcaaccggtagggcagttgatttcccgtgtaacgaatgacaccgaagtcattaaagatctttatgttaatgtagttccatcggtatttcgcagcatggcattgattggtacgatgctgattgctatgtttatgttggaatggcgtatggcattgattgcaattcttatttttcctgtcgtattgattgttatggcaatatatcagcattttagtacacccattgtccgccgggtacgtagttatttggctgatattaatgatgagtttaatgaagtcattaatggaatgagtgttattcagcagttccggcagcaggcgcgttttggtgaacgtatgttgttaaccaatcgggcccattatcaggcgagaatgcaagcgttgagattagatgggcttttgttacgcccattattgagtttgctatctgctatggtactgtgcggtcttatcgtgttgtttggaattagtgggccaggggcgattggtatcggggtattgtatgcttttattaattatttggggcggttgaatgaacctcttattgagctgacatctcagcaatcgattttgcaacaagctgtcgtttctggcgagagaatatttgaattaatggatagccctcaacaaggttatggtatggatggtcagccactatccagtggtcgaattgatatagaaaatgtcagtttttcctaccggcatggaaaaatagttttgcaagatattaacttacaggttccggctcatggttttgttgctttggttggtcatactggtagtggtaaaagtacgctggcaaatttgctgatgggatattacccgtggcagaaaggggaaatttatctcgatggcaggcctgtatcatctctgtctcattcggtattacgcaatggtgtggcaatagttcagcaggacccggttgttcttgcggactctttctttgacaatattacgcttggtcggaatatttcagaagagaaggtttggcaagtactggaaacggttcaattagctgagttagtacgtacattgcctgatggacttcatactatcttgggagagcagggtaatacgttgtcagccggtcaaaaacaattgcttgctatggcgagagtgttagtgcaaacgccacaaattttgatccttgatgaagcgactgcaaatattgattctggtacggaacaggcggtacaacaggctttgagattgattcgtcaacaaacaacattgatcgtgattgctcatcgtctgtctaccattgtggaggctgatactattctggtgctgcatcgtggtgcagttgttgaacagggatgccatcaacaattatttgtgagtcgtggacgttattatcagatgtatcagttgcaacaagtaggtgagacattaaatgaatgtggcacaatctctgagaaagaggtgttaatttaa

SEQ ID NO: 34568 - protein, 594 aa, Photorhabdus luminescens subsp. laumondii TTO1
MTKVRQLWPSLKRLLVYGKNYRKPLGLAVLMLWGAAIAEVSGPVLISYFIDNMVATGNMPTRVVIGLAITFIVLQLITAALHYFQALLFNQVSVDVVQQLRTDVMNAALRQPLSAFDNQPVGQLISRVTNDTEVIKDLYVNVVPSVFRSMALIGTMLIAMFMLEWRMALIAILIFPVVLIVMAIYQHFSTPIVRRVRSYLADINDEFNEVINGMSVIQQFRQQARFGERMLLTNRAHYQARMQALRLDGLLLRPLLSLLSAMVLCGLIVLFGISGPGAIGIGVLYAFINYLGRLNEPLIELTSQQSILQQAVVSGERIFELMDSPQQGYGMDGQPLSSGRIDIENVSFSYRHGKIVLQDINLQVPAHGFVALVGHTGSGKSTLANLLMGYYPWQKGEIYLDGRPVSSLSHSVLRNGVAIVQQDPVVLADSFFDNITLGRNISEEKVWQVLETVQLAELVRTLPDGLHTILGEQGNTLSAGQKQLLAMARVLVQTPQILILDEATANIDSGTEQAVQQALRLIRQQTTLIVIAHRLSTIVEADTILVLHRGAVVEQGCHQQLFVSRGRYYQMYQLQQVGETLNECGTISEKEVLI

SEQ ID NO: 34569 - DNA, 1839 bp, Vibrio vulnificus YJ016
  CDS (1)..(1839)
gtgctggtgacatcgttcaagcaggcagttatgacgaacttgctcatcaagaaggcttgttccaagaaatgttattggctaaccaagccctcaagcaacttgataaggggaatcttgatgcgtgatttaattcccttcctaaaactgtataagaaacactggtttggtctctctctagggatgctactggcatttttaacgctgttcgcttctattggcctgctgactttgtcaggctggtttctttctgccgcagccattgccggattgaccattgctcgtgaaacgttcaactacatgctgcctggggcatttgtgcgtggttttgcgatgggacgaacagcgggacgttggggtgaaagagtggtcagccataacgcgaccttcaaactcttgactgatctgcgtattttctttttctctaagttagcgccgctgatcccaggacgagtctccaatcttcgtgacgccgatttgcttaaccgcttggtagcagacattgacgcaatggatcatgtttatttgcgtttgatcagccctatggtcgtcggcacacttggcatactgggcttaacggccgtgctgtgttggtttgatatgacattgggcctaacactgggggcaattctgactctgctactgctactctggcctgtccttttctacaagctagggaaaagcaatggacaagcgctaacccacaataaagcagagctgcgtgttgcaactttggactggttgcaaggttacagtgaactgacactctttggtgccgaatcacgctaccaccacgctattttgcatgtacaagagaaattactgaaaaaccaatactttaacgcccatttttctggtttggcacaagcgttattgatgctcgcaaacggttggaccttggtattgatgctttggcttgccgcagatggcgtcggtggtaacgcacccgatcctatgattgcactagtggccttcgccaccatggcaagcgtagaactgctcatgccaattgcgggcgctttccagcaccttggtcaaaccttaacgtccgcccgtcgcctcaatgaagttattctggctgaacctgaagtccgttttgccaaagaggatgtggctcactctggtgaatactctattgactatcaggccgtatcgttcaaatacccggatagccaaagtatggccctgagcaatgtcagcttgacgattccagcccagcacaaagtggccattgtcggccaaacgggctcaggaaaatcaaccttgctgcaactgctcaatcgttattgggatgttaatcaaggctctatcttgcttgcaggcaaaccgatcaccgagtggagtgaaagccagctgcgccgctccatcagtgttgtaagtcaacgtgtagatatcttaaacggatcgttacgagacaatttattgatggcctcccctagcgcaaccgacgaacaattgtctgacatgctcaccaaagtcgggctagaaaaactgctcgacgataacgggctatccgcatggcttggcgaaggtggtcgccagttatcaggtggtgaaaaacgccgtatcggcattgcaagagccttgctacacaatgcaccaatcttactgcttgatgaaccgacagagggcttagataagcagacggaacagcagatcatgcagttacttgaagcgcactttgacggaaaaaccgtgctcttcattacacaccgcttggtaaacctcgacaaaatggacagcatttgcctaatcgaacaaggtgagattgtcgaatatggtcaccatcaagcacttttagccgctcgtggtcgctattttgaactcaaccaaacgctgtaa

SEQ ID NO: 34570 - protein, 612 aa, Vibrio vulnificus YJ016
MLVTSFKQAVMTNLLIKKACSKKCYWLTKPSSNLIRGILMRDLIPFLKLYKKHWFGLSLGMLLAFLTLFASIGLLTLSGWFLSAAAIAGLTIARETFNYMLPGAFVRGFAMGRTAGRWGERVVSHNATFKLLTDLRIFFFSKLAPLIPGRVSNLRDADLLNRLVADIDAMDHVYLRLISPMVVGTLGILGLTAVLCWFDMTLGLTLGAILTLLLLLWPVLFYKLGKSNGQALTHNKAELRVATLDWLQGYSELTLFGAESRYHHAILHVQEKLLKNQYFNAHFSGLAQALLMLANGWTLVLMLWLAADGVGGNAPDPMIALVAFATMASVELLMPIAGAFQHLGQTLTSARRLNEVILAEPEVRFAKEDVAHSGEYSIDYQAVSFKYPDSQSMALSNVSLTIPAQHKVAIVGQTGSGKSTLLQLLNRYWDVNQGSILLAGKPITEWSESQLRRSISVVSQRVDILNGSLRDNLLMASPSATDEQLSDMLTKVGLEKLLDDNGLSAWLGEGGRQLSGGEKRRIGIARALLHNAPILLLDEPTEGLDKQTEQQIMQLLEAHFDGKTVLFITHRLVNLDKMDSICLIEQGEIVEYGHHQALLAARGRYFELNQTL

SEQ ID NO: 34571 - DNA, 1800 bp, Vibrio vulnificus YJ016
  CDS (1)..(1800)
atgttatcgacatccgacactattagccgctcctggcttttaacacaagcaaaaaaacacaaatctaagcttgtgtttgcaaacctcattgccattgttgccactttggttagcgtccctattcctctactcatgccactcatggttgacgaagtgttacttgatcaacctggcaaaggattagcagccatgaataccctattgcctcaagcctggcaaacaccgacagggtatatcttcttgactttgttactggtgatcctgatgcgtatcaccagccaagcattaaacattttacagagccgccagttcaccttggtctcaaaaaccattacttatcaaatgcgcgctaagatgatcgataaactcggtcgcatcagtattcgtcaatatgagactcgaggtagcggaggcatcaacgcacacctcatcacagacatcgagaccattgaccaattcatcggcagcaccttagcgaagttcgtgattagcttgcttaccgtcgtcggcactgcaggtgttctcctatggctggaatggcgacttggcctgtttatcctcttagtcaaccctatcgttatttacttctctagaaaactaggcagcaaagttaaacatctcaaaaagcgtgaaaaccaagcatttgagcagtttcaaaatcgcttagttgaaacccttgatggcatttatcaattgagagcagccaataaggaacgagagtttctctctgagctcaaacagcaagctgatcaagtccgactcaacgcagacaaatatgcctggcaatccgaagccgcgggtagagtctcctttttgctctttttacttggttttgagctgtttcgcgccgttgcgatgctcatggtgctctttagtgatctcacgattggccaaatttttgctgtttttggttatctttggttcatgctgactccggttcaagaactgctaggtatccagttttcttggtatagcgcgaaagcggcgcttacccgcatcaacgcgcttttggaactggaggaagagtatagacctgagtcgaaagtcaatcctttcactgatggcaaagaaattgatgtttcggtcgaaaatgtcagcttctcttacaacagtgaaaccactgtattaaatcagttgaatttacgaatccctgcgggaaagaaagtcgctctcgttggtgcaagtggtggtggaaagtccacattaattcagctgcttattggtgtgtaccgacaagacagcggagtcattcgttacaataatgagtccagcgatgatattggttttgagttaattcgtgaaaaaattgctgttgtattacaacaacctatactatttaatgacagcctaaggcataatctgacccttggtggcgactatgacgaaagcgcgctgtggcaagcgttagaagtcgctcaactgcaagatgttatttcgcagttgactgccgggttggatacgcaagtgggccgaaatgggatacgtttatccggaggccaaagacagcgtttagctattgctcgcatggtattgagtgatcctcaatttgtgattttggatgaagcaacctcagcgttagataccgcaaccgaagcggcgctccatagagcgcttaatgaatatttgaaaggaaagacaacgcttatcgtggcacaccgattgtctgcggtaaaacaagcggatttgatctatgtattggaagatggacaagttacacaaagcgggacacatactgagctggttgagcaagatggcttgtatcaaacactttatggtagtgtccaatcgcatgccagctag

SEQ ID NO: 34572 - protein, 599 aa, Vibrio vulnificus YJ016
MLSTSDTISRSWLLTQAKKHKSKLVFANLIAIVATLVSVPIPLLMPLMVDEVLLDQPGKGLAAMNTLLPQAWQTPTGYIFLTLLLVILMRITSQALNILQSRQFTLVSKTITYQMRAKMIDKLGRISIRQYETRGSGGINAHLITDIETIDQFIGSTLAKFVISLLTVVGTAGVLLWLEWRLGLFILLVNPIVIYFSRKLGSKVKHLKKRENQAFEQFQNRLVETLDGIYQLRAANKEREFLSELKQQADQVRLNADKYAWQSEAAGRVSFLLFLLGFELFRAVAMLMVLFSDLTIGQIFAVFGYLWFMLTPVQELLGIQFSWYSAKAALTRINALLELEEEYRPESKVNPFTDGKEIDVSVENVSFSYNSETTVLNQLNLRIPAGKKVALVGASGGGKSTLIQLLIGVYRQDSGVIRYNNESSDDIGFELIREKIAVVLQQPILFNDSLRHNLTLGGDYDESALWQALEVAQLQDVISQLTAGLDTQVGRNGIRLSGGQRQRLAIARMVLSDPQFVILDEATSALDTATEAALHRALNEYLKGKTTLIVAHRLSAVKQADLIYVLEDGQVTQSGTHTELVEQDGLYQTLYGSVQSHAS

SEQ ID NO: 34573 - DNA, 1776 bp, Vibrio vulnificus YJ016
  CDS (1)..(1776)
atgaaaaagaccacgttgaaacgtttatttgcttatccattggcgcagccaaaacccatgatgacgggtttagtctttttgttgattgcggccgtcagcaatgcgggtggcccttggctcatccaacactttattgacgagcacattaccaaagacgattacactcaacagacacttatcttacttgctagtggctatattggcctgctgctttgctcagctttatttcaatatcttcaaggtttgcaatttaacattgtcgcgacaggcatcattaaaaccattcgcaagcaggcttttaatcatgtgatcaagcaacctttgtcggctttcgattacacccctactggcaaactggtctcaagactcaccaacgacacggaatctctgcagcagttctacgagctgttgatcgcctccgtggtgaagaacctagtgatgatcttagtgatgctgggcgttatgctgattttgagctggcagctaacgttggtggtcttggttttgctgcccgttgtggttggttttatggtgctatttcaaaagctcagcacccatgcataccgagtgatgcgtgacttgcttaccgacatcaatggcaatatgagcgaatcgatccaaggaatgagcgtgatccaactgatgcgccaagaaaaacgcttcaacctgcagtttaatcaactgaccgagcagcatttcaatgcgggtcgtaaagtcatcaagctgaatggtattttacttcgacccttgatggatttattggcgggcatcgctttgctcaccctcgttgctattttcggtttcagtggtaccgagctcattggtgttggcgtactgtacgcgtttatcagctaccttggccgtattactgaaccgttaattgaaatgacgcaacagctagcgctactgcaacaagctttagtggccagcgaacgcatttttgaaatgatggatgctccagaacaaagctatggtcatgatcagcagccacttaaaagtggttctatcgccatagagcagctgagctttagctacgatggtaagcagcaggtattgaaacagatcgacattgacgtggaacaccagcaattcgtcgctttggtcggccacacgggtagcggaaaaagtaccctcgcgtcgctattgatgggcttttacccagtaagccaaggcaagctgaaactggatggtcgccctattgcctcattggcaaaatcggtgctgcgaaaagacgtggcgatggttcaacaagatccacatattctgccaacctcggtcagagaaaatattgccttgggaagagaagtctcagacgacatcatctggcaatctttagaacaagttggtttggctgagcagatcaaacgttaccctcaattgctggacacccaactgggccaaggagaaaccaacctctctgctggacaaaaacagttgttggccatggcccgagtgcttatcgctaagccgaaaattttaatcctcgacgaagcgacggcaaacatcgattcagggactgaggcgctgatacagcgcagtttgaatgccctacgccatgatatgacgctagtggtgattgcacaccgcctttccaccatcatggaggccgacaaaattgtggttttacaccacggagatttggttgaaatgggcagtcacaaacaactgcttgcccagcaagggcgctacgcacagatgtaccagttgcaacaagcaggccagcatatcaaggaaattgaacagcaggaggagcaagaactggaacaagccagctaa

SEQ ID NO: 34574 - protein, 591 aa, Vibrio vulnificus YJ016
MKKTTLKRLFAYPLAQPKPMMTGLVFLLIAAVSNAGGPWLIQHFIDEHITKDDYTQQTLILLASGYIGLLLCSALFQYLQGLQFNIVATGIIKTIRKQAFNHVIKQPLSAFDYTPTGKLVSRLTNDTESLQQFYELLIASVVKNLVMILVMLGVMLILSWQLTLVVLVLLPVVVGFMVLFQKLSTHAYRVMRDLLTDINGNMSESIQGMSVIQLMRQEKRFNLQFNQLTEQHFNAGRKVIKLNGILLRPLMDLLAGIALLTLVAIFGFSGTELIGVGVLYAFISYLGRITEPLIEMTQQLALLQQALVASERIFEMMDAPEQSYGHDQQPLKSGSIAIEQLSFSYDGKQQVLKQIDIDVEHQQFVALVGHTGSGKSTLASLLMGFYPVSQGKLKLDGRPIASLAKSVLRKDVAMVQQDPHILPTSVRENIALGREVSDDIIWQSLEQVGLAEQIKRYPQLLDTQLGQGETNLSAGQKQLLAMARVLIAKPKILILDEATANIDSGTEALIQRSLNALRHDMTLVVIAHRLSTIMEADKIVVLHHGDLVEMGSHKQLLAQQGRYAQMYQLQQAGQHIKEIEQQEEQELEQAS

SEQ ID NO: 34575 - DNA, 1890 bp, Vibrio vulnificus YJ016
  CDS (1)..(1890)
gtgtgggcgttgttatttttaggaagcgttatgtttaaacgatttgaaagctttaccaatccgtttccggccggaacgccggaacaaccacctgaagggttactggctttttgccgccactacactcgtgggtttgaaaaaccgctgattttgatgtcattgctgtctaccatcgtcgcgattgtcgaggtgtcgttgtttggtgccatgggacaacttgtcgactggctgagcaacagcgatccacaaaccttccttgagcaaaaccaaagtgagctgatttattacggcgtgatacttttagtggtgatgccaaccctgatcgttggctactcactgctggtgcatcaaagtctgctgggcaactacccgatgtcgatccgctggttggcgcaccgctatttgcttaatcaaagcttgaacttctatcaagatgattttgccgggcgtgtcgccaccaaagtgatgcaaacctcgttggcggtgcgtgaatcggtgatgaaaaccatggacgtgtttgtttacgtgtccgtctatttcaccagcatcattgtgatgctcgcggcggccgactggcgtttgatggtgccgatggtgatttggctgctgatctacatcggcattcaagtttactttgtccctaagctcaaagatgtcgcttcagcgcaagcagacgcccgctctaccatgaccggtcgcattgtcgacagctacaccaatatccaaacggtgaaactgttttcgcacagcaaacgcgagactgagtatgccgaaagcggcatgcgcgagttcttagacacggttcatcgccaaatgcgcttggtgacaggcttcaatatcgcggtgcaggtaaccaactatgtgctggtgttttcgattggtgcgctctccatccacctttggttaggcggtgcgatcagcattggcgcgattgccattgccgtgagtttagcgttgcgtatcaacgggatgtcgatgtggatcatgtgggaagtgggctcactatttgaaaacatgggcacggtggttgatggcatgaaaacgctgtccaagccgattgatattcaagacaaaccacaggccactgagctagtagtgaaacaaggcggcattgagtttgacgacgtgagtttccactacggtgaaaacaaaggcgtgattaaccatctcaatttgcacatcaaaccgggtgagaaaattggcctagtggggcgctctggcgcgggcaaatcaacgctggttaacctgctgctgcgtttccacgatgtggagagcggcaagatcaagatcgacggccaaaccatctctgaagtgacgcaagattcgctgcgtgcgcaaattggtatggtgacgcaagacacctcactgctgcaccgctcgattcgcgagaacattctttatggtaatccggatgccagtgaagaagagctgttgcgcgccaccaagcaagcgcacgcgcatgagtttatcgaaaccctcaccgacccgtttggcaacgtcggctacgatgcgcaagtgggtgagcgaggggtgaaactctcaggtggtcaacgtcagcgcatcgcgatttctcgcgtgctgctcaaagacgcaccacttttggtgctggatgaagccacctcagccctcgactcggaagtggaagcggccatccaagaaagcttgaacgagctgatgcaaggcaaaaccgtaattgcgattgctcaccgcttgtcgaccattgcacagatggatcgcctgatcgtgctggataagggcaatattgtcgagcaaggttcgcaccaagagctgctgcaaaacaacggtatttatgcgcagttgtgggcacaccaaaccggcggctttcttgccgacgactgcccagaagtggaagagagccaaatcgcttaa

SEQ ID NO: 34576 - protein, 629 aa, Vibrio vulnificus YJ016
MWALLFLGSVMFKRFESFTNPFPAGTPEQPPEGLLAFCRHYTRGFEKPLILMSLLSTIVAIVEVSLFGAMGQLVDWLSNSDPQTFLEQNQSELIYYGVILLVVMPTLIVGYSLLVHQSLLGNYPMSIRWLAHRYLLNQSLNFYQDDFAGRVATKVMQTSLAVRESVMKTMDVFVYVSVYFTSIIVMLAAADWRLMVPMVIWLLIYIGIQVYFVPKLKDVASAQADARSTMTGRIVDSYTNIQTVKLFSHSKRETEYAESGMREFLDTVHRQMRLVTGFNIAVQVTNYVLVFSIGALSIHLWLGGAISIGAIAIAVSLALRINGMSMWIMWEVGSLFENMGTVVDGMKTLSKPIDIQDKPQATELVVKQGGIEFDDVSFHYGENKGVINHLNLHIKPGEKIGLVGRSGAGKSTLVNLLLRFHDVESGKIKIDGQTISEVTQDSLRAQIGMVTQDTSLLHRSIRENILYGNPDASEEELLRATKQAHAHEFIETLTDPFGNVGYDAQVGERGVKLSGGQRQRIAISRVLLKDAPLLVLDEATSALDSEVEAAIQESLNELMQGKTVIAIAHRLSTIAQMDRLIVLDKGNIVEQGSHQELLQNNGIYAQLWAHQTGGFLADDCPEVEESQIA

SEQ ID NO: 34577 - DNA, 1716 bp, Geobacter sulfurreducens PCA
  CDS (1)..(1716)
atggataccttcaagcgcattctgcattacagcaagccctactggtggcggatcgtcatctccatggcggcgtcactctgcgtcggcggcaccgatgcggccatcgcctggatggtggagccgctgctgaagaagatcttttccgaaagggacatgacgattttcatcctcgtccctgtggccctgattatcgtcttcctgttccgcggggtggcacggttcctccagggctactatgtccagaccgcaggtcagctggccatccaggacatccgcaacgaggtgtaccgcaagcagatagggctgcccctgcgctacttcaccgataatcccaccgggaccctcatgtcccggatcatgagcgacgtggggcagatgcagcagggggtggcaaatatcgtcacgagcctgttgcgagacggcgtgaccgccatcggcctgctgggcgtcatcttctaccgcaactggcagctggcgctcatcacgtttatcgtgctcccccttacggccgttccggcccagaaaatcggcaagaggatcaagaatctggcaaaacagtccctgggccagatgggtgagatcacgagcattctccaggagacgttctccggcatcaaggtggtcaaggcattccgtcaggagaagagcgttgtggatcggttcagccggaccaacctcggcctgtaccgctacctgcgcaagagcattaaatacgaatcgcttcacacgcccatcatggagatcatcacttcgttcggagtggcgggggtgatctggttcggcggcagccaggtcatggacggcaagatgacggcgcccgaattcttctcctttctgaccgccatggtgatgctctacggcccgatcaagaaggtcctcagcgcctacaatacggttcagcaggccatgggggcggccgaacgggttttcgaggtcatcgatcatccagcggacatccaggacccgcccgatccggtggagccgggaatggttcgcggctccgtagaactgcgcaatgtctcgttccgctatgacgatgaggaggtgctgcgtgacgtatcgttcacggccgggcggggcgaggtggtggctctggttgggccatcgggcgccgggaagacgacggtcatgtcgctcattccccggttttacgatgtgaccggcggtgcggtgctcatcgacgggatcgacgtacggcgcttgcggctggatgacctcctttgccagatcgccctggtggatcaggaaacgatcctgttcaacgaaaccattgccaacaacatcaggctcggcaaccccgatgctaccctggaggaagtggagcgcgcggcccggtctgcctttgcccacgacttcatcatggagatgccagaggggtatgacacaaacatcggcgaccggggggtgcgcctctccggtggtcagcggcagcggctctgcatcgcccgggccattctcaagaatgccccgattctcctcctggatgaggcaaccagcgccctggatacggaaagcgagcacatggtccagcaggccctgaccaatctgatgaagaaccggaccaccctggtgattgcccaccggctctccactgttctccatgcggaccggatcgtggtcattgacaagggtgaggtggttgaggtcgggaccaacgacgagttgttggcgcgcgacgggctctaccgcaagctctacgacatgcagttcaagtga

SEQ ID NO: 34578 - protein, 571 aa, Geobacter sulfurreducens PCA
MDTFKRILHYSKPYWWRIVISMAASLCVGGTDAAIAWMVEPLLKKIFSERDMTIFILVPVALIIVFLFRGVARFLQGYYVQTAGQLAIQDIRNEVYRKQIGLPLRYFTDNPTGTLMSRIMSDVGQMQQGVANIVTSLLRDGVTAIGLLGVIFYRNWQLALITFIVLPLTAVPAQKIGKRIKNLAKQSLGQMGEITSILQETFSGIKVVKAFRQEKSVVDRFSRTNLGLYRYLRKSIKYESLHTPIMEIITSFGVAGVIWFGGSQVMDGKMTAPEFFSFLTAMVMLYGPIKKVLSAYNTVQQAMGAAERVFEVIDHPADIQDPPDPVEPGMVRGSVELRNVSFRYDDEEVLRDVSFTAGRGEVVALVGPSGAGKTTVMSLIPRFYDVTGGAVLIDGIDVRRLRLDDLLCQIALVDQETILFNETIANNIRLGNPDATLEEVERAARSAFAHDFIMEMPEGYDTNIGDRGVRLSGGQRQRLCIARAILKNAPILLLDEATSALDTESEHMVQQALTNLMKNRTTLVIAHRLSTVLHADRIVVIDKGEVVEVGTNDELLARDGLYRKLYDMQFK

SEQ ID NO: 34579 - DNA, 1569 bp, Lactobacillus johnsonii NCC 533
  CDS (1)..(1569)
atgaagaaatttatcaacaaaaaatattttaccttaagtatcttgcttgcatgcttaagtggcttagagttacccttcggaacttggtcatattcagagattttcgctctaattaccgaaaaaaatattcctaatactatcaagatgataacaattattactgctgctcaagttcttttggttgttatcaaatatttaaatacaaggatgctcaatagaaatattgcttgttttaatcaaaatgtgcgtgaatatctaatgaaaagtaactttattgaaattagtgaaaataatgtgtcaaaacaaatttcttttttatcaaatgatcttaatttaatagaagaaaattattttaagcagctttttcaattgatttctatgattgtaacaattatcggaactttaataattgcaatcggcaatagttttctattaactttagtttttatttcatttgctattttttcaagtattattcctaagtttttcagcaaaaaaacagcccaacaatcaaataattggagtacttctactggaacttacataacatttatgtctgattttctaaaaaacattagaacagttttaaattataatgccttagatacatttattaaaaaaggacaaaaaattattactcaatctactgaaaataaaagattacgtgataatacaattgccaaaagtaatttttgggttaatatattcgtttattcttttagctttttacctattggagtaggaataattatggtcatcaaagggatgctcactctagcctcatttgtggcagttcaatattccagtacttggattattaacagtttttacagtattaatagctgccgtaatcaaatgtcttcggcaaaacccatgatagataagctgaactcctttaaaccagaaaaatttaatacagatgtttctaattctaacctagatacactaatacttaacaatattagttttggatataaggcagaagaattagttttagacaaagtcaatttagaaattaaaaaaggcgataagctattacttaccggtaaatctggtcagggaaagtctactctccttaatcttttaactggtcgactaaaacctactaacggaaatattcttatcaatggattatctaataaaagttttacatttagtgaggtacaacagacttctcaaatatttaatgatactttgcttttcaacctaactttaggtaaaaagtttagtgattccaaaattgcagaagctatcaaaaaggccggattattgccatatgttaagcggtatggattaaatgcaattatagaagaaaatgggaagaacttatctggtggtgaaaagaaaagaatagagttagcacgagcttttttatatgaaagagattttttaatcgttgatgaaggaacagcttcgcttgatcccactacagccaatcagatacatgaaatgtttttgaattctccactaactgtggttgaaattgatcatcacattccacccaaaatcatgcacctctttaatcaccattatgaattacacaaccaacaattagaacgtatattttaa

SEQ ID NO: 34580 - protein, 522 aa, Lactobacillus johnsonii NCC 533
MKKFINKKYFTLSILLACLSGLELPFGTWSYSEIFALITEKNIPNTIKMITIITAAQVLLVVIKYLNTRMLNRNIACFNQNVREYLMKSNFIEISENNVSKQISFLSNDLNLIEENYFKQLFQLISMIVTIIGTLIIAIGNSFLLTLVFISFAIFSSIIPKFFSKKTAQQSNNWSTSTGTYITFMSDFLKNIRTVLNYNALDTFIKKGQKIITQSTENKRLRDNTIAKSNFWVNIFVYSFSFLPIGVGIIMVIKGMLTLASFVAVQYSSTWIINSFYSINSCRNQMSSAKPMIDKLNSFKPEKFNTDVSNSNLDTLILNNISFGYKAEELVLDKVNLEIKKGDKLLLTGKSGQGKSTLLNLLTGRLKPTNGNILINGLSNKSFTFSEVQQTSQIFNDTLLFNLTLGKKFSDSKIAEAIKKAGLLPYVKRYGLNAIIEENGKNLSGGEKKRIELARAFLYERDFLIVDEGTASLDPTTANQIHEMFLNSPLTVVEIDHHIPPKIMHLFNHHYELHNQQLERIF

SEQ ID NO: 34581 - DNA, 1812 bp, Treponema denticola ATCC 35405
  CDS (1)..(1812)
atgttaaaaagattttttgctttatctgatgcgggaatgcgtaatttgcgttcgtcgattacgctcggtgtcattatcaatttatttttgatggtaccgctgggactttcgctgtatgtgctgcagtattttttggcgcgcatcatgcagcaaggttttcaagtaccgaatgtgtgggcggtgtctgcagccgctcttgcgattattgttgtactgttcatcctcgaaaaactgaagtacggcaggatgtacaacggtgcatatgaagaagcggcgaatgtgcgtatttcgcttgcagaatcgcttagaaagctcccgctgtcctacttcggcaggcaggatttgtcgtatttaacctcgacgcttttgaacgatgttacgacgattgaagaagcgctttccaatgtcgtgccggagatgttcagcggtattatttcgattttgattgcagccggtcttcttgcccttttggattggcggatgaccattgcgttgtttgtttgtgcctttgcaggattttttatcgtcgtcggctgccgcaggctttcggaaaaaaagatgaaaagcgtcatagtccgcaaagattcgatatacgattccctccagcagatgatcgagaacgtcaaagtattgaagtcttccgataaaaaagcggagtatgtacagaagctcaaaaccgatattaccgaagcgacaggagctgcgctcaaatcggaagcgtcgatcggagcgcttatgttcggtgtagcgatgtttatccgcttcggctttccgctggttatttcctatggggcgtttttgctggcgcaggggcaaattgaactgttgacatatatcgtctttttgctggtctcctgccgtatcttcgatccgctgacaacggtgtttatgctgctcgccgagttcttttatacgctgattgccgttgaacggaaacaggcgattgttaattatccggcccagacgggaagcgaaacattcaatccgaacggttacgacatttcctatgataatgtttcattctcgtataatgaatcgaccagcaaaggtgcaggcggcataggcgggagctccgacgataattcaatggcagatagtacagcaaacaataccgaagaagatacggtcagaggaataagctttaccgcaaagcagggcgaaattaccgcccttgtcgggcactcaggttgcggaaagtccacgattgcacgcttggctgcacgcttttgggatgcctcatcgggcacggtcagcataggcggtgtcgatgtttccacggtggaacctgaaactctgctcggagctttttcaattgtgtttcaagatgtcgtactcttcaatgacacggtatacaacaatattttaatcggcaatcgaaacgctacaagagaacaagtgcttgctgccgcaaaagccgcacagtgcgattcgttcatcgaaaaactaccgcaaggctatgacacggaaatcggcgaaaacggttacaccctttcaggcggagagcgccagcggctttccatcgcccgtgcacttttaaaggacgcgccaatcatcctcttggatgaagcaactgccgccctcgatcccgaaaacgaaacgctcattcagcatgccatcagcacactgataaaaaataaaaccgttatcgtcatcgctcacagactgcgaacggtagaaactgccgacaagattatagtgcttaacaagggaaccattgccgaaacaggtacccactccgagttgatggagaaggacggtatttatcgggagatgtatcggctgcagagagaaagcgatcaatggtcggcataa

SEQ ID NO: 34582 - protein, 603 aa, Treponema denticola ATCC 35405
MLKRFFALSDAGMRNLRSSITLGVIINLFLMVPLGLSLYVLQYFLARIMQQGFQVPNVWAVSAAALAIIVVLFILEKLKYGRMYNGAYEEAANVRISLAESLRKLPLSYFGRQDLSYLTSTLLNDVTTIEEALSNVVPEMFSGIISILIAAGLLALLDWRMTIALFVCAFAGFFIVVGCRRLSEKKMKSVIVRKDSIYDSLQQMIENVKVLKSSDKKAEYVQKLKTDITEATGAALKSEASIGALMFGVAMFIRFGFPLVISYGAFLLAQGQIELLTYIVFLLVSCRIFDPLTTVFMLLAEFFYTLIAVERKQAIVNYPAQTGSETFNPNGYDISYDNVSFSYNESTSKGAGGIGGSSDDNSMADSTANNTEEDTVRGISFTAKQGEITALVGHSGCGKSTIARLAARFWDASSGTVSIGGVDVSTVEPETLLGAFSIVFQDVVLFNDTVYNNILIGNRNATREQVLAAAKAAQCDSFIEKLPQGYDTEIGENGYTLSGGERQRLSIARALLKDAPIILLDEATAALDPENETLIQHAISTLIKNKTVIVIAHRLRTVETADKIIVLNKGTIAETGTHSELMEKDGIYREMYRLQRESDQWSA

SEQ ID NO: 34583 - DNA, 1743 bp, Treponema denticola ATCC 35405
  CDS (1)..(1743)
atggatatcttaaaaaaacatatcggcgcaatcatcgttccggtggttttcgcaattatcggtgttgcctgcggcattgttccatactttgctgttgcatctattgtgacacagctgataaacggtgtcacggattaccgcgttttcttgccttatgccggacttatccttgccggatttgcaggggcgcttatcgggcattctatatcgacaatcggttcccacaatcttgcgttcagtgtcatcgaagatacgcggaaaaaggttgtggaaaaactaagccgcctttcgatgggcacaatagaagaaaaaagcagcggcaagtggtctcaatttgtggtagaaacacttgataagatggaaaaacctattgcacatgtaatccctgaagtattggcgaatgtgctcattccggttgtcattgtcgttatcatttttatattaaattggaagatcggtcttgcaaaccttgtaacactgccgctcggtatacttttttcgatgctgatgatgaaagattacgaagcaaagtccaagcggtacattgaagcgtcaaaaaaaatgaatgctgccgccgtcgaatatattcagggcatcaaagttatcaaggcttttaataagtctgcttcatcctatgataaatttcaaaaagcagtggaggacaatcgggactctatgctcgactggtatttaagcgtatgttttgccatgatagctgcgatggaggttctgccgtctacgctccttatcgtattaccggtagggctttacctctttatgaccggagggattacaattcctacgctgattatgtgcattttgctttcgtatgcgtcgtacaaaccgcttttaaaagcgatggcctatacggatgcgatggcaaatgtgcgtgtcgtattcggtgaaataaaatcggtactggatttaccggaactggtacggaacgatacggctcccgatccgcaaggctttgatgtgcgctttgaaaatgtggtattcggctacggcggaacactgtgcgaaacggacggtgcagctgccaagaacggtacaaatgtgttcgatggattgaactttacggcaaaggaaggcgagctcaccgcgattgtcggatcttccggcagcggcaagtctaccatcgcaaaactgctggcaggcttttggaatatcgacagcggacacatcagcatcggaggcgctgacatcggcagcatgagtttggaacggaacatgcagctggttacatatgtgtcgcaggagaattttttattcaacaagagcattcgggagaacctaaagatggcaaaagagaatgcaacggatgaggaaatcgaaacagcctgtacaaaagcaagcatccatgattttatcaaaagcctgcctaacgggtatgacaccaatgcgggaaacgcaggcagtaagttttcaggcggtgaacggcagcggcttaccattgcccgtgcgcttctcaaggatagtcccattgtcgtactcgacgaggcaaccgcctattccgatcctgaaaacgaagccgttattcaacagtccatcgacaacctcgtcaaagataaaaccgttattatgattgcacacaggctttccactattgtcaacgccgataaaatcatcgtgctggataagggccggattgctgcagagggaacgcacaccgaactgttacaagattcgccgctctaccaaaaaatgtggcagtcccatatcagcggcagggataacggataa

SEQ ID NO: 34584 - protein, 580 aa, Treponema denticola ATCC 35405
MDILKKHIGAIIVPVVFAIIGVACGIVPYFAVASIVTQLINGVTDYRVFLPYAGLILAGFAGALIGHSISTIGSHNLAFSVIEDTRKKVVEKLSRLSMGTIEEKSSGKWSQFVVETLDKMEKPIAHVIPEVLANVLIPVVIVVIIFILNWKIGLANLVTLPLGILFSMLMMKDYEAKSKRYIEASKKMNAAAVEYIQGIKVIKAFNKSASSYDKFQKAVEDNRDSMLDWYLSVCFAMIAAMEVLPSTLLIVLPVGLYLFMTGGITIPTLIMCILLSYASYKPLLKAMAYTDAMANVRVVFGEIKSVLDLPELVRNDTAPDPQGFDVRFENVVFGYGGTLCETDGAAAKNGTNVFDGLNFTAKEGELTAIVGSSGSGKSTIAKLLAGFWNIDSGHISIGGADIGSMSLERNMQLVTYVSQENFLFNKSIRENLKMAKENATDEEIETACTKASIHDFIKSLPNGYDTNAGNAGSKFSGGERQRLTIARALLKDSPIVVLDEATAYSDPENEAVIQQSIDNLVKDKTVIMIAHRLSTIVNADKIIVLDKGRIAAEGTHTELLQDSPLYQKMWQSHISGRDNG

SEQ ID NO: 34585 - DNA, 1668 bp, Treponema denticola ATCC 35405
  CDS (1)..(1668)
atgtttaaagaaaaatataaaccgcttattaaaatgtctaaatacataagcttttataaaaaagaatttatcatttcgattatttacggaatatttaacagtgtttttgctttgctcaccgttttaacgggtgcatatatagcttcagcggctctgtttaaaatgagcacaggaaaaatactttatctttttataccgctgattatttttattatcggcaaaggactttttgcttttttggaaatgtacgaatgtcatttggtttcatacggtgtaatcgaaaaaataagaaaccttttatatgattcgatttccaaaacagcaccgcaatccacaggcaaaaaaagaagcggaagtattacctccgtgtttgtcgaagatgttgaagccactgaagttttttatgctcataccgcaggatcttacataattgcagttgtctgcactgttctttatcttactgcattaagttttctttcatttaaaataagtgcagccgtttttgccgcctgtattcttgtcgcagccgttccgtatttttttaatcctattacaaaaaaaatcggagaagagatacgcgacggtttggctgaggtaaatgccgaagctgtagatacggttcaaggtttacgtgagattttaattttcggcaaagaaaaaaaatacattgaaaaagttactgccgataccttacgcttaaataaaaaagaaatacgggatgggagatttaagggcttacacagtttagtaataaacttaattacctccgcagttttaatttcaacaatattactcgctcattcggaagtaattgcaggctcgttaaaacctgaaatggtttcggttgttataatattttctctttttgcctttgtgcctataatgagcgtttcggttacggcaggagctatgaatatttcaaatggagcggcaaaaagaattttggatatattagaagaagaaccggccgttaaagacagggttccatatattccgcaaaacaaatcttcagttaagggaaacatagaatttaaggacgtaaaattttcttacgaaaaaggtaccgaagttttacacggagttaattttacggttaaggccggtgaaagcattgcccttacgggtgaatcgggagcgggaaaatctacaatagcaaatttacttatgcgcttttacgaacctgacagcggagcaatttatattgacggaaaaaacataaaagatatacaccaaaattccctgagggatataatcgcctatgtaccgcaggatgtttatctctttaacaaaaccataaaagaaaacatttcccttgcctgtcccgatgcaagcgatgaagaaattaaacaagctgctaaggttgcgatggctgatggctttattaaaaggttggaacaaggctacgataccaatgtcggtgagcggggtgttcagctctcaggcggagaaaaacaaagaattgctatagcgcgcgccgtcttaaaaaattctcccatattgctgatggacgaagccgtttccaatttggatagtgaaagcgaagcactcttccggcaagccctaaataatatccgcaaaaataaaaccataataacgattgcacatcgtccttctacaataaaagaggcagacagggttgtaaaaatcgaaaacggaaaaatagtttaa

SEQ ID NO: 34586 - protein, 555 aa, Treponema denticola ATCC 35405
MFKEKYKPLIKMSKYISFYKKEFIISIIYGIFNSVFALLTVLTGAYIASAALFKMSTGKILYLFIPLIIFIIGKGLFAFLEMYECHLVSYGVIEKIRNLLYDSISKTAPQSTGKKRSGSITSVFVEDVEATEVFYAHTAGSYIIAVVCTVLYLTALSFLSFKISAAVFAACILVAAVPYFFNPITKKIGEEIRDGLAEVNAEAVDTVQGLREILIFGKEKKYIEKVTADTLRLNKKEIRDGRFKGLHSLVINLITSAVLISTILLAHSEVIAGSLKPEMVSVVIIFSLFAFVPIMSVSVTAGAMNISNGAAKRILDILEEEPAVKDRVPYIPQNKSSVKGNIEFKDVKFSYEKGTEVLHGVNFTVKAGESIALTGESGAGKSTIANLLMRFYEPDSGAIYIDGKNIKDIHQNSLRDIIAYVPQDVYLFNKTIKENISLACPDASDEEIKQAAKVAMADGFIKRLEQGYDTNVGERGVQLSGGEKQRIAIARAVLKNSPILLMDEAVSNLDSESEALFRQALNNIRKNKTIITIAHRPSTIKEADRVVKIENGKIV

SEQ ID NO: 34587 - DNA, 1746 bp, Treponema denticola ATCC 35405
  CDS (1)..(1746)
atgaaggaaaaagaaaaaagtccttcgcctatcgcgtgggcgttgggacaaacaggggaacacaaggggcaatatgttctgagtgttatcctcgcagtcatcggtgtggccttttccatcgcaccgtattttgttgttgccggcatcgtacacggtttgatgagcggaaacaaagacctttcgtattatatgatacgttgtctgattattgcagcgttttggttttgccgtgtactgtttcatgcgcttagcacatcgacaagtcatagagcaacgtttgcagtgctcggggaaatccgaaaacgatgcacggaaaaactgacaagaatgcctctgggtgcggtgttggagcaaagttccggagcgctcaaaaatatactcatcgaacgtatcgacagcattgaaacaacactggcgcatatcgttccggagttcaccgcaaatttactgatccccgtcatcattttgatctatatttttaccattgactggcgtatggggctggcttctcttgcaacgataccggtgggctttttctgttacggtcttatgatgaagggcagtcctcaattctatcaacgcacggttacagccacaaaggcgctcaatgatacggcggttgaatatatcggcggtattcaagtcatcaaggttttcgggaatacaaaaagttcctacgaccgcttcgtgcatgacgcctatgaagccgctcacagctatatcgattggatgcgctcctgtattctcacctttacattcgccacggtaatcatgcccgctacaatggtttccgtgctccccatcggcggtcttttggtaaagggaggatatctttctccgcagaatctcgtaacaattattattctgtccgtcggcatcatcacaccgcttataaccttgatgagttattcggacgactttcgaaccatgggaaccatcttcggtgaagttcaaagtattctgtatgctcccgaaatggagcgcccgttagacggagctattccaaaagaaaacacattgaagctgcaggatgttcgtttttcgtataaggaaaaggaagtgcttcatggcatttctatggaaatcccggagggcagctttattgcgctggtcggtccttccggcagcggaaagagtaccattgcgcgccttatcgcttcgctctgggatgtgagcagcgggaaaattttgctggaggatacggacattcgtgaaattccgcaagaggcctattcggataagatcgcctttgtctcgcaggataattatctattcaatatgacggtcagagaaaatatccgcattgggcgagcggatgcaacggatgcggaagtggaggaagcggcaagacaaagcggttgccatgaattcattttggaactggagcacggttacgataccgtggtaggcacttccggcgggcatctttccggcggtgagcggcagcgtatctccattgcaagagcaatgctgaaagcggcacctattatcattttggatgaggcaaccgcctacaccgatcctgaaaacgaagcggttattcagcgctctatctctaagctgacggaggggaagacgctcatcgtgattgcgcaccggctttcgacggtctcctctgcggattgtatttatgtcattaaagacggcaccgttgcagacagcggaacccatgatgagcttctttctcatcacggcttatatgaaacgatgtggaatgcacatatggaggtgaaagatcatgcttaa

SEQ ID NO: 34588 - protein, 581 aa, Treponema denticola ATCC 35405
MKEKEKSPSPIAWALGQTGEHKGQYVLSVILAVIGVAFSIAPYFVVAGIVHGLMSGNKDLSYYMIRCLIIAAFWFCRVLFHALSTSTSHRATFAVLGEIRKRCTEKLTRMPLGAVLEQSSGALKNILIERIDSIETTLAHIVPEFTANLLIPVIILIYIFTIDWRMGLASLATIPVGFFCYGLMMKGSPQFYQRTVTATKALNDTAVEYIGGIQVIKVFGNTKSSYDRFVHDAYEAAHSYIDWMRSCILTFTFATVIMPATMVSVLPIGGLLVKGGYLSPQNLVTIIILSVGIITPLITLMSYSDDFRTMGTIFGEVQSILYAPEMERPLDGAIPKENTLKLQDVRFSYKEKEVLHGISMEIPEGSFIALVGPSGSGKSTIARLIASLWDVSSGKILLEDTDIREIPQEAYSDKIAFVSQDNYLFNMTVRENIRIGRADATDAEVEEAARQSGCHEFILELEHGYDTVVGTSGGHLSGGERQRISIARAMLKAAPIIILDEATAYTDPENEAVIQRSISKLTEGKTLIVIAHRLSTVSSADCIYVIKDGTVADSGTHDELLSHHGLYETMWNAHMEVKDHA

SEQ ID NO: 34589 - DNA, 2001 bp, Bacillus cereus ATCC 10987
  CDS (1)..(2001)
atgagcgtttcaaaacgattgtttcaatatgcgatgaaggtaaaagggacgatttttgcagcgatgctaatgttatttattttcgtcatcgcagagcttgcgggtcctttcgtcgcgaaaacgatgattgacgatcatatcgttggaatagagaagccttggtatgaaacagaaaagagtgaagaggctgtttcgtataatggcgccttttataagcgaagcgatcgcttccaggaaggtgagaaaaaaggaaaagaagtacgtgtgatgcaagtcggttttcaatattactttgtaccgaataaagtaaatctggaagggtcacggactgtaaaaggtgatatgattaccgttcaaaacggtaaggcggtgcaagtgtataaagcgaaagcattgacgaaagaagaagtgtttgcgttttataaaccagaaataaaccgtctattattacttggtggtggatacttcgctttattagtagtcgtatccttgtttgcatacggaaagcagtttttcttacagaaggcggcgaacaaaattattcaaattatgagggaagatgtcttttctcatattcaaacgttgccgattcgttattttgatcatttaccagcagggaaaattgtatcgcgtgtaacgaatgatacggaagccattcgtgatttatatgtaacggtacttgcgacattcgtctctagtatcatttatattatcgggatatttgcggctttatttttactcgatgtaaaattagcaacgatatgtttacttattatcccgatattaatcgtttgggcaattctttatagaaagtatgcgtctgtatacaatcataaaatgcgttcacgtttatctgatattaacggaacagtgaatgaatccattcaagggatgccaattattcaagcgttccgtcaagagcgcgaaacgaaaaaagagtttgatgaattaaatggagattattttaagtatcaaaataaaattttgaatttaaatgcagcaacttcgcataacttagtaggtgtattaagaaatatcgctttcacaggtgtaatctggtatttcggtggtgcttcattaagtgcttcaggcatcatttctctagggatactgtatgcgttcgttgattatttaacacgattgttctcaccgattacaaatatggtgaatcagcttgctaacttggaacaatcgcgtgttgcatcagagcgtgtttttgaattgttagaggaaaaaggagaaacagtagaagaagaacgtatgcctcgcttacaaggaaatgtgaagtttgataatgtgtcgttttcttataatggaaaagatgaagtgttaaaaaatatttcttttgaagcgaaacaaggcgagacagtcgcgcttgtcggtcatactggatcaggaaaaagttccattatgaatgtactttttcagttttacgagtttgaaaaaggaaagcttacgattgatggtcatgatgtaaaagagatgccgaaacaagcaactcgtgaacatatgggaattgtactgcaagatccgtttttatttagcggaacagtagcatctaatgtaagtttagaaaatgaaaacatttcaaaagagcgcattgtaaaagcgttgcgtgatgttggtgcggaaagatttgcgaacaatataaatgaagaaattacggagaaaggaagtaccctttcaaccggagaacgtcagcttatatcgtttgctagagcacttgcatttgatccagccattttaattttagatgaagcgacgtctagtattgatacagagacggaagctatgattcaacaagcattagaagttgtgaaaaaaggaagaacgacatttattatcgctcaccgactttcaacgattaaaagcgcagatcaaattatcgtgcttgatagagggacgattttagaaaaaggctctcatgatgaactaatgaaaaagcgcgggcgttattacgatatgtacaaaacgcaaatggaagggaaccagagcgcttaa

SEQ ID NO: 34590 - protein, 666 aa, Bacillus cereus ATCC 10987
MSVSKRLFQYAMKVKGTIFAAMLMLFIFVIAELAGPFVAKTMIDDHIVGIEKPWYETEKSEEAVSYNGAFYKRSDRFQEGEKKGKEVRVMQVGFQYYFVPNKVNLEGSRTVKGDMITVQNGKAVQVYKAKALTKEEVFAFYKPEINRLLLLGGGYFALLVVVSLFAYGKQFFLQKAANKIIQIMREDVFSHIQTLPIRYFDHLPAGKIVSRVTNDTEAIRDLYVTVLATFVSSIIYIIGIFAALFLLDVKLATICLLIIPILIVWAILYRKYASVYNHKMRSRLSDINGTVNESIQGMPIIQAFRQERETKKEFDELNGDYFKYQNKILNLNAATSHNLVGVLRNIAFTGVIWYFGGASLSASGIISLGILYAFVDYLTRLFSPITNMVNQLANLEQSRVASERVFELLEEKGETVEEERMPRLQGNVKFDNVSFSYNGKDEVLKNISFEAKQGETVALVGHTGSGKSSIMNVLFQFYEFEKGKLTIDGHDVKEMPKQATREHMGIVLQDPFLFSGTVASNVSLENENISKERIVKALRDVGAERFANNINEEITEKGSTLSTGERQLISFARALAFDPAILILDEATSSIDTETEAMIQQALEVVKKGRTTFIIAHRLSTIKSADQIIVLDRGTILEKGSHDELMKKRGRYYDMYKTQMEGNQSA

SEQ ID NO: 34591 - DNA, 1755 bp, Bacillus cereus ATCC 10987
  CDS (1)..(1755)
atgaaatcatttcgcaaattattacagtatttaaaaccatacatgttcttcgctattattggaccgctatttatggtacttgaggttgcgatggacttaattcaaccgactattatgcaacatattattgatgttgggatagcaaatcgggatatgaattatgtaataaaaatgggacttcttatgataggagctgcagcactcggtttagttggaggacttgggtgtatgatgtattctacaaaagcagctgttaatttcgctactgacatacgaaaagatgtgtttgcgaaaatagaaacattttctagtgaaaatcgtgattcgtttggaacgggaaagttattaacaattgttacaaatgatattacttctattcaatcggcgatgacgatgacattacgtgttcttgttcgtggtcctttgttatttatcggaagtataataattgtttttatgacagcgcgtgagttatttcctatattactcgtagtcgttccaattttattacttgcgattatattcattgcgagtaaagcaagcgggacgttcagaaaagtgcaagaagcattagataaagtgaatacaaagttacaagaaaatttatctggagtacgtgtgattaaagcgtatgtaagacaaaaatatgaaattaatcagtttggaaatgttaatacaaatttaacgaagataaatattcgagcggtgcagcttatttccttaatgatgccaatcattatgttagttgtaagtggcggaattgtcgcaacgttatgggttggtggagagaaagtatttaatggaacccttcaagtaggggctatattagcatttataaactatttgaatattattttaatgtcacttatgtctataagtatggtatttatgcaaatcgcgcgagcatttccgtcagcggatcgtgtacagcaagttttaaatactgacgttgatattatgaccccaaaaaatgcgcttgcacctaagcaaattgagggacaaattgaatttaaaaatgttagttatagttacatgaaaaataatgaatatgttttaaaagatatttcatttcgcataagtaaaggtgaaaaaatcgggattattggttctacagggagtggtaaatctactttagcaaaattattaccgcgcttatacgatgttgatcaaggggaaatatgcattgatggaataaatgttaaggcgtatgatttacaaaaacttcgtgcgtcaatcgggtttgtacctcaaaaggcattgttgttttctggtagcatagaagagaatttacgttacggtaaagaagatgcatcaaatgacgaattggaagtagcagcttcatcagcttgtgcgactgagtttattaacaagctggaagattcatatcaatatcatttaacacaaggtgcgacgaatttgtcaggtggccaaaaacaacgtgtatcaattgcaagggcgcttgtgagaaagccatccattcttatattagatgattctacatcagcagtggatgcaaaatcagaatctaacattcaatcggcattaagaacagaatataaaggaacaacaacattattaatcgcttctaaaatctcatctataatagatgcggataaaattctcgttttagataatggtgaattagttggtgatggtacacatgaagaattgttagaacaatgtgaggtatataaagaaatctatctttcccaaggtggtaatttatataaaaaaggtgggaaagaacatgcgtaa

SEQ ID NO: 34592 - protein, 584 aa, Bacillus cereus ATCC 10987
MKSFRKLLQYLKPYMFFAIIGPLFMVLEVAMDLIQPTIMQHIIDVGIANRDMNYVIKMGLLMIGAAALGLVGGLGCMMYSTKAAVNFATDIRKDVFAKIETFSSENRDSFGTGKLLTIVTNDITSIQSAMTMTLRVLVRGPLLFIGSIIIVFMTARELFPILLVVVPILLLAIIFIASKASGTFRKVQEALDKVNTKLQENLSGVRVIKAYVRQKYEINQFGNVNTNLTKINIRAVQLISLMMPIIMLVVSGGIVATLWVGGEKVFNGTLQVGAILAFINYLNIILMSLMSISMVFMQIARAFPSADRVQQVLNTDVDIMTPKNALAPKQIEGQIEFKNVSYSYMKNNEYVLKDISFRISKGEKIGIIGSTGSGKSTLAKLLPRLYDVDQGEICIDGINVKAYDLQKLRASIGFVPQKALLFSGSIEENLRYGKEDASNDELEVAASSACATEFINKLEDSYQYHLTQGATNLSGGQKQRVSIARALVRKPSILILDDSTSAVDAKSESNIQSALRTEYKGTTTLLIASKISSIIDADKILVLDNGELVGDGTHEELLEQCEVYKEIYLSQGGNLYKKGGKEHA

SEQ ID NO: 34593 - DNA, 1797 bp, Bacillus cereus ATCC 10987
  CDS (1)..(1797)
atgcgtaattttcaaggacaatttgctaataaaggtgggcgtaacgcaccaaagatggggaaggctaaaaatacgaaaggaactgtgatgagagtatggaactatatgggctaccaaaaggctgcccttacgttcgttatattcttagtgtttgttacgacgttacttgggttattaggtccgtatttaatgggagtaattatcgatcaatatattgtaccgaaagatttaagcggtacggcgagaatgtgtttggtacttatcgcgatttatggtgtaacagtattattaacttggttacaaacatttgtaatggttaatgttgcattaaaaacgatacaaaaaatacgacaagatatttttgagaaaatccaaacgctttctttacggttctttgatgtacgttctcaaggggatttaatgagtcgtgtaacaaatgatatagataatttgaatcaagcgttgacacaaagtgttgtacaaattatttcatcagcgctaacttttataggtgtgacgattgcgatgttcgcattagattggattttagcgattgttactttaattacagtacctattatgtttttcgttacaaaaaaactagttacttatagtggtaaaaactttgcaaagcgtcaaaaagatttaggagagttaaatggatttattgaggaagctataacaggtgcggatgttacaacgttatatgggaaagaaaaagaaaccgtacaaaatttcaataaaattaatgaacagctaagagtttctgcaacgaaggcggatacattttcagcttttatttttccgagtatgaactttattaacaacttaggtatgggacttgtaattgggactgggtcagtaatggttttaaatggaatgacaacagtaggtgtcattgcagcatttattaattattctcgtcaattctcaagaccactcagtcaattcgcaactttaatgaatacgattcaagcggcagtggctggtggggaacgtgtctttgaaattatggatgaagtaccggaaatcaaaaataaaaaagatgcattcgttgtacaaaatttacaaggacatgttgcactcgagaatgtttcatttgggtatgaggaaaataaaacgattttaaaagaagtgagtcttaaagcgcggccaggggagacaattgctttagtaggtccaactggatcgggcaaaacaacaatcattaatttgctaacgcgcttttacgatatacagcaagggcaaattcatattgatggaaaaaacataaaagaatatgatatgaattcgttgcgaagtaaaataggagtagttttacaagatacgtatttatttgctgggacgattatggataatatacgttatggtcgattagatgctagtgatgaagaggtaatcaatgcagctaaggcagcatctgcacattcttttataaaacatttaccgaatcaatatgaaacgaaaattgcttcagaaggatcgaatttaagtcaaggacaaaaacaacttcttgcgattgcacgggcaattttagcagatgcagatatattaattctcgacgaagcaacatctaatattgatacgagaacagaattacaaatacaagaaggactaaacaatttaatgagaggtcgaacaagtttcgtaatcgctcatcgactgaaaacgattgaaaaagcagatcaaatccttgttataaaagatggaagtattttggaaaaagggaaccatgaatctctcatggaagatagaggattttactttaatctgtatacgagtcagtttaaaatttaa

SEQ ID NO: 34594 - protein, 598 aa, Bacillus cereus ATCC 10987
MRNFQGQFANKGGRNAPKMGKAKNTKGTVMRVWNYMGYQKAALTFVIFLVFVTTLLGLLGPYLMGVIIDQYIVPKDLSGTARMCLVLIAIYGVTVLLTWLQTFVMVNVALKTIQKIRQDIFEKIQTLSLRFFDVRSQGDLMSRVTNDIDNLNQALTQSVVQIISSALTFIGVTIAMFALDWILAIVTLITVPIMFFVTKKLVTYSGKNFAKRQKDLGELNGFIEEAITGADVTTLYGKEKETVQNFNKINEQLRVSATKADTFSAFIFPSMNFINNLGMGLVIGTGSVMVLNGMTTVGVIAAFINYSRQFSRPLSQFATLMNTIQAAVAGGERVFEIMDEVPEIKNKKDAFVVQNLQGHVALENVSFGYEENKTILKEVSLKARPGETIALVGPTGSGKTTIINLLTRFYDIQQGQIHIDGKNIKEYDMNSLRSKIGVVLQDTYLFAGTIMDNIRYGRLDASDEEVINAAKAASAHSFIKHLPNQYETKIASEGSNLSQGQKQLLAIARAILADADILILDEATSNIDTRTELQIQEGLNNLMRGRTSFVIAHRLKTIEKADQILVIKDGSILEKGNHESLMEDRGFYFNLYTSQFKI

SEQ ID NO: 34595 - DNA, 1896 bp, Leptospira interrogans serovar Copenhageni str. Fiocruz L1-130
  CDS (1)..(1896)
atgaagtttttttttaggctcttatcttactctgtacattataaatatcgatttacgttaggaatcgtattcgcgttgttaaccgcaattttaaacgcggtttctctgacggcgctcattccgttattcgattctttaggaaacgataaacaaactcggtttcaattacagatgacactgccagaacagagaattattcttaaacaaaaagtgttcggaaaagattccttagatggactagaaaaaaccaaacttctgttaatcgaagtaaaagaatgggtcaacggaagaacaaaaggattagaacccaaagaagtagtttggtccatctgtatcattgtaatgccattatatcttttaaaattgattacgtatctattatcggtgttttgtatcgccactgcaggttataaggcggtgcgtgatattcgacaggaacttttcgaaaaaaaccaacttctccctttaacttacttttttaaggaaaaaaccggtttgatgatgagtagaatcatcaacgacgtagaagtaatcgcagctgtgatttctagtaatttcagagatgctacaatcaattttttttatgtgatcacacacttaatggtattattatatttgaatactgaattgttattaattgcttgtcttacggtccctgtaatcatccttccggtcactttgtttactagaaaaattactaaatctaccgcaagatctcaagagaaaatggcagatctaaacgcgaacattcaggaaatgatttccggaattaaggtaattcgagtttttaattcggaaaaatacgaacaggaaaaattcggcaagatcaatcaaaatgtttatcgtagaaattttaaaggtcagttttatctccagatcgcaccttctcttgtagaattaacttcttctgtcgtggtccttggtttttttgctgcgggtgcaagtttaatttacaacggaagattcacacaaggggagtttatggctttccttttgactcttttatttctacttagacccttaactcaactgtctcaaatggtaggaaaggtgacccagtctatcgcttctggaaaaagaatttttgaaatcatcgatttagaaacggaggaccatagcgaagaaagtaagataaccgcttctcctctatctcaaaatatagaatttaaaaatttattcttctcttatccaggaactggctccgcagttttaaaggatattaatctcaaagtcaaaaagggagaaacgattgcacttataggcgcgagtggttgcggaaaatccactttgatggatttgattccaagattttttgatccaacttccgggtcgatagagtttgacggaatcgacattcgagatttaagcctgggagatcttcgtaaaaaaatcggtatcgtgacccaggacatatttttatttcatggctccgttgcagataatattgcttatggaaaaccaggagcaactcgcaaagacgtaattcgagcagcaagacttgcacacgcccacgactttatcaaaaagatggataatggatacgatagtattttaggagttagaggtttaaatctttcaggtggacaaaggcaaagacttgtaattgcaagagcccttttgagagatccagaaattatgattttggacgaggccacttccgccctcgacgtagaatcggaaagattagtcagtgacgcactccgaagattatatgcaaatagaactacattcgtaattgctcatagactttctacgatcaaggatattcctagaattatagtaatggataacggaaagatcgtggaagaaggagatcataattcactatatgataaaaatggaatatatagaaaattatcagataatcaatttgccaacaacggagtactaccatga

SEQ ID NO: 34596 - protein, 631 aa, Leptospira interrogans serovar Copenhageni str. Fiocruz L1-130
MKFFFRLLSYSVHYKYRFTLGIVFALLTAILNAVSLTALIPLFDSLGNDKQTRFQLQMTLPEQRIILKQKVFGKDSLDGLEKTKLLLIEVKEWVNGRTKGLEPKEVVWSICIIVMPLYLLKLITYLLSVFCIATAGYKAVRDIRQELFEKNQLLPLTYFFKEKTGLMMSRIINDVEVIAAVISSNFRDATINFFYVITHLMVLLYLNTELLLIACLTVPVIILPVTLFTRKITKSTARSQEKMADLNANIQEMISGIKVIRVFNSEKYEQEKFGKINQNVYRRNFKGQFYLQIAPSLVELTSSVVVLGFFAAGASLIYNGRFTQGEFMAFLLTLLFLLRPLTQLSQMVGKVTQSIASGKRIFEIIDLETEDHSEESKITASPLSQNIEFKNLFFSYPGTGSAVLKDINLKVKKGETIALIGASGCGKSTLMDLIPRFFDPTSGSIEFDGIDIRDLSLGDLRKKIGIVTQDIFLFHGSVADNIAYGKPGATRKDVIRAARLAHAHDFIKKMDNGYDSILGVRGLNLSGGQRQRLVIARALLRDPEIMILDEATSALDVESERLVSDALRRLYANRTTFVIAHRLSTIKDIPRIIVMDNGKIVEEGDHNSLYDKNGIYRKLSDNQFANNGVLP

SEQ ID NO: 34597 - DNA, 1806 bp, Desulfovibrio vulgaris subsp. vulgaris str. Hildenborough
  CDS (1)..(1806)
atgggtgaaccttcgacaacgcaaagggcaagcctgcccctgttgcgccgcatcggccgttattttctccctcacaaggtttcgatcgccctttccatgggctgcatggctatcgtttctgccaccactgcgggaaccgcctacctgatcaagcccgctcttgacgacatcttcatcaacaaggatgagcaggcgctcttgcttgtgccggcctttttcatcgtgctcaccgcgctcaagggcttcggcagatatttccagaactacttcatgaactacgctggcttgcgtgtcattgaaagcctgcgggatcagctcttcaccaagatcatccacttgccgatgcgattctacgaggattcgcagatcggcttgctcatgtcgcgcatcatcaacgacgtatccatgatccgcgacagcctgccgtcgaccgtcatgatcgtccggcagatactgaccatggtggggctcatcggcgtggtcttctaccagaacgccgaactggccacatgggcggttctcgtgttgccgctggctctctatccgttcatctacttcgggcgcaagctgcgcaagctgggacgacgcaatcaggagaagctggccgacatttccgtcatccttcaggaggtgttcagcggcatccgggttgtgaaggctttcgccaccgaaaaggaagaagcccatcgcttcgatgccgagaaccagagactcgtgaagctcaccctcaagcagatttgcgtctctgagctttcatctcctgtcatggaactcataggcgctctcggcatcggtctcgtcatcctttacggaggacatgaagtcatatccggcaagaccacgcccggtacgttcttctcgttcatggctgcactggtcatgctctacgaccccatcaaatcgctgagcatggccaaccgcgaggtgcaacgtgcccttgtcggggctgaacgtgtctttgaaatcctcgatgcagaggacctttgcatcgaaacctcgggtgacctgaagttcaaccgcgacttcaaggaagtgtgcatcaaggatgtgagcttcgcctatgccgacgggtcgccagccctgagggacatcaacctgtgcgttcgtgcaggagaacgggtggccatcgtcgggccaagcggcgccggcaagaccacactggtgaacctcatcccccgtttctatgaaccctcatcgggatgcatcgagattgacggggtaccgttgcaggacttcgaccttgccgacctcaggcgttccatatccgtggtgtcgcaagacgcttttctcttcaacctgagcgtctcggacaacatcacctacggcacgccgaatgtcggcgccggacggatagaggccgcagcacatgcggcgttcgctcacgagttcgtacaacaactcgcccaagggtacgataccgtcctcggtgaacggggcgtcaaactctccgggggtcagaagcaacggctcaccatcgcccgggcacttctcaaggacgcaccgctccttatccttgatgaagcgaccagtgcactcgactcgcaagccgagcgtatcgtgcagaaggctctcgacaatctgatggagaacaggacgagcatcgtcatcgcgcaccgtctttccacggtgctcaatgccgaccgcatcgtagtcatggaagacggtcgcgtcgtcgaccagggccctcatgccgagcttctcggccggtgcgagctttatacccgactgtattccattcagttcgggcaggagaaggccgacgcagaccggatagacggaacctccgaagagaagcttgaagcatga

SEQ ID NO: 34598 - protein, 601 aa, Desulfovibrio vulgaris subsp. vulgaris str. Hildenborough
MGEPSTTQRASLPLLRRIGRYFLPHKVSIALSMGCMAIVSATTAGTAYLIKPALDDIFINKDEQALLLVPAFFIVLTALKGFGRYFQNYFMNYAGLRVIESLRDQLFTKIIHLPMRFYEDSQIGLLMSRIINDVSMIRDSLPSTVMIVRQILTMVGLIGVVFYQNAELATWAVLVLPLALYPFIYFGRKLRKLGRRNQEKLADISVILQEVFSGIRVVKAFATEKEEAHRFDAENQRLVKLTLKQICVSELSSPVMELIGALGIGLVILYGGHEVISGKTTPGTFFSFMAALVMLYDPIKSLSMANREVQRALVGAERVFEILDAEDLCIETSGDLKFNRDFKEVCIKDVSFAYADGSPALRDINLCVRAGERVAIVGPSGAGKTTLVNLIPRFYEPSSGCIEIDGVPLQDFDLADLRRSISVVSQDAFLFNLSVSDNITYGTPNVGAGRIEAAAHAAFAHEFVQQLAQGYDTVLGERGVKLSGGQKQRLTIARALLKDAPLLILDEATSALDSQAERIVQKALDNLMENRTSIVIAHRLSTVLNADRIVVMEDGRVVDQGPHAELLGRCELYTRLYSIQFGQEKADADRIDGTSEEKLEA

SEQ ID NO: 34599 - DNA, 1896 bp, Mycoplasma mobile 163K
  CDS (1)..(1896)
atgaaacactacaaacgaaaggagtgctataatatgacttcaaaagaattaaaaaaacaaaaaattaaaaataaagaagaattaactttaatgcaaagtttagctattttatttaaatacattgctttttataaaactaaatttataattgttattgttttaagtgttttatttgctctaattaatgtaggtgcaattgttggaatttattttgttttcaaagtaattggtgaatcattaaaattaccaggatcttcggttgattttgctttagtttcgctttatttaggaattttgttaattgcttatttaattagtttagtattttcaactatacaaaccgtttttatggttaaaattgctcaacaagttggaaatgctattagaagtgatttatttaaaagaattcaagtattgaaactatcttattttgatcaaaactcttcaggtgatattatgtctagattaacaaatgatacaaacaatgttactgtagctttaagtcaaaactttactcaatttattacaattactttacaaattagttcaatgttaatagcaatgtttgtctttagtccttatattgctttagttgtgtttgggctttcacctttaatgctaggagcagtatttattgctgttaaaaaatcacagccttattttaatgaaaatcaacaaagagttggagaattaaacggatttgctgaagaaatgatctcagctcatcgtgtaacaaatacttttaataaaaaatcttacttacaagcaagtttcgatactttgaacaataaaatcattaaagcaaatgctacttctcaaattatttcaggactaacaggtccatggaacttatttatggcttcattcttgcaaattttggcctatgctttagcaattatctttgctttaaacaacattgaatttggtggtgcagtttccactttaaacccaaatggagcaactaatcctggcgaaacaatttctttgatcggaattttcattttatttttaaataattttacaaatccaatttttcaattatttcaattattaaatattattcaaggagcaatttcaggaacaaaaagatttcatgaagttttagttaaaccaagtgaacatctagaagaagaaaatattatagtaaaaaacattaaaggaaaaattgaagttaaaaacttaaatttttcttatgatggtaaaacccctgttttaaaaaatattaattttatagcaaatccaggggaaacaattgctattgttggtccaacaggaagtggaaagacaacttttattaacttattaacaaaattttataatgttgaagatggagatattttaattgataatcaatcaattaaacaaatcacaaaatcttcattaagagaaaatgttagtgttgtgcttcaagatacattcttatttgaagatactgttgctaataatattaaattaagtaaaccaaatgcaactatggaagaaattattaattctgctaaagtagcaaatgcagaccacttcattagaagcttagaacatggttatgacacaatgcttaaacctgaggctgaagatttaagtttaggtcaaaaacaactattagcaattgctagagctgttttaagagatgcaaatattttaattttagatgaggcaacttcgagtattgatacaaaaactgaaaaagatattcaagatgctatgttaaaactaatggaaaataaaacttcatttgtaattgctcaccgtttaagtacaattaaaaatgctgatcaaattttagtgttaagaaatggcgaaattattgaacatggaaaccatcttaaattactagaagataaaggattttattacaaaatgtatacttcagcccgttcaatggaagaatttgaatag

SEQ ID NO: 34600 - protein, 631 aa, Mycoplasma mobile 163K
MKHYKRKECYNMTSKELKKQKIKNKEELTLMQSLAILFKYIAFYKTKFIIVIVLSVLFALINVGAIVGIYFVFKVIGESLKLPGSSVDFALVSLYLGILLIAYLISLVFSTIQTVFMVKIAQQVGNAIRSDLFKRIQVLKLSYFDQNSSGDIMSRLTNDTNNVTVALSQNFTQFITITLQISSMLIAMFVFSPYIALVVFGLSPLMLGAVFIAVKKSQPYFNENQQRVGELNGFAEEMISAHRVTNTFNKKSYLQASFDTLNNKIIKANATSQIISGLTGPWNLFMASFLQILAYALAIIFALNNIEFGGAVSTLNPNGATNPGETISLIGIFILFLNNFTNPIFQLFQLLNIIQGAISGTKRFHEVLVKPSEHLEEENIIVKNIKGKIEVKNLNFSYDGKTPVLKNINFIANPGETIAIVGPTGSGKTTFINLLTKFYNVEDGDILIDNQSIKQITKSSLRENVSVVLQDTFLFEDTVANNIKLSKPNATMEEIINSAKVANADHFIRSLEHGYDTMLKPEAEDLSLGQKQLLAIARAVLRDANILILDEATSSIDTKTEKDIQDAMLKLMENKTSFVIAHRLSTIKNADQILVLRNGEIIEHGNHLKLLEDKGFYYKMYTSARSMEEFE

SEQ ID NO: 34601 - DNA, 1791 bp, Bartonella henselae str. Houston-1
  CDS (1)..(1791)
atgaattttttcaatcattcagaaaaagctaaaaaatttttccatacaaagccttcattctcttcgcttacaacttttagtccttatcttgtgcgctatcgctggttgtttgtctttgcctttattgctttatctgttgctgctctcgtgactcttactttgcctgttgctatccgtcaaatgcttgatcatggcttttctacttcaagtcatggccatattaatttttacttcgctcttttgtttgttttagctttgctgcttgcacttgcttcagcctgccgttattactgtgtcatcactttaggagaacggattgttgccgatttacggcgtgatgtttttgtgcatattatgaaactttctcctgctttttttgatcgttcccattctggtgaacttgtttcacggcttttaacagataccactcaaataaaattggctgttggttcaaccgcttctacggctttgcgtcatctgattgtggtgattggagcgattgttatgatggttatcaccaatgccaaattgtcttcgcttgttttgcttgctatcccttttgttgctattccgttagttgtctttgggcgcaaggttcgtacacgtacacgcgctgcgcaagatcgtattgcagatgccaacgctttagcaactgaacaggtcagcgccattcgcactgtgcaggcctttaccgctgaaaagcttgtttctaaacgtttttctcagttggtagaacgtgcttttcagacagcacgctcttccgtcattctgcgttccttttttactggctttgcaatctttctggttttcggcagtgtggttgctgttttatggattggatcccgggatgttttgaatggcactatgacgggtggggcattaggtcaattcgtgctctatgcggtttttggagcttctacctttgcgcaattatcagaattgggtgcagaattaatccaagcagcaggcgctgctgaacggcttgctgaattgttgcaagaacagcctactattttagctccaaaagctcctgcacctttggcaaaacctgttcaaggtgcccttgtttttgatcaggttgattttacttattcttccagaccacaagagaagattttgcgctctctttccttttctgtcaaaccaggggaaacagttgcttttgttggcgcttcaggtgcaggaaaaagcacacttttttctttgatccttcgtttttatgatccaataagtgggcaaattcgctttgatggcgtggaaatcaagcgcctttctctgcaagatttacgcagttcgatctcgtatgttccacaggatgtcgccatttttgacggtacactgcgcgataatattgtttttggaaccgaaaatatgactgaagagcaaatcattgccgctgctaaagcagcaaacgcacttgagtttattgaagctttaccaaatggtttggatacagaagtgggagaacgcggtattatgctttctggtggacaaaaacaacgcattggtattgctcgggcaattttaagaaatgctcccctgttgctgctggacgaagcaacatcagctttagatgcaaacagtgaaaaattggtgcaagaagccttagaagaactgatgcaaaatcggacaacattggtgatcgctcatcgtttggcaacaattttaaaagctgatcgtattctcgtgatggagaaaggtgctcttgttgaagaaggaacacatgcagaactcgtcgcacaaaacggggtttatgcgtatttagccaaattgcaattttcgcctgagtaa

SEQ ID NO: 34602 - protein, 596 aa, Bartonella henselae str. Houston-1
MNFFNHSEKAKKFFHTKPSFSSLTTFSPYLVRYRWLFVFAFIALSVAALVTLTLPVAIRQMLDHGFSTSSHGHINFYFALLFVLALLLALASACRYYCVITLGERIVADLRRDVFVHIMKLSPAFFDRSHSGELVSRLLTDTTQIKLAVGSTASTALRHLIVVIGAIVMMVITNAKLSSLVLLAIPFVAIPLVVFGRKVRTRTRAAQDRIADANALATEQVSAIRTVQAFTAEKLVSKRFSQLVERAFQTARSSVILRSFFTGFAIFLVFGSVVAVLWIGSRDVLNGTMTGGALGQFVLYAVFGASTFAQLSELGAELIQAAGAAERLAELLQEQPTILAPKAPAPLAKPVQGALVFDQVDFTYSSRPQEKILRSLSFSVKPGETVAFVGASGAGKSTLFSLILRFYDPISGQIRFDGVEIKRLSLQDLRSSISYVPQDVAIFDGTLRDNIVFGTENMTEEQIIAAAKAANALEFIEALPNGLDTEVGERGIMLSGGQKQRIGIARAILRNAPLLLLDEATSALDANSEKLVQEALEELMQNRTTLVIAHRLATILKADRILVMEKGALVEEGTHAELVAQNGVYAYLAKLQFSPE

SEQ ID NO: 34603 - DNA, 1797 bp, Bacillus thuringiensis serovar konkukian str. 97-27
  CDS (1)..(1797)
atgcgtaattttcaaggacaatttgctaataaaggtgggcgtaatgcgccaaagatagataaggctaaaaatacgaaaggtactgtaatgagagtatggaactatatgggctatcaaaaggctgctcttacgttcgttatatttttagtacttgttacgacgttacttgggttattagggccgtatttaatgggagtaattatcgatcaatatattgtaccaaaggatgtaagtggtacagcgagaatgtgtttgttacttatcgcgatttatggtgtaacagtattattaacttggttacaaacatttgtaatggtcaatgttgcattaaaaacgatacaaaaaataagacaagatatttttaagaaaatccaaacgctttctttacggttctttgatgtacgttctcaaggagatttaatgagtcgtgtgacaaatgatatagataatttgaatcaagcgttgacacaaagtgttgtacagattatttcatcagcgctaacttttattggtgtgacaattgcgatgttcgcattagattggattttagcaattgttactttaattacggtacctattatgtttttcgttacaaaaaaactagtggcttatagtggtaaaaactttgcaaagcgtcaaaaagatttaggagaattaaatggatttattgaggaagctataacaggagcggatgttacaacgttatatgggaaagaaaaagaaaccgtacagaaattcaataaaattaatgaacaactaagagtttcagcaacgaaggcggatacattttcagcttttatttttccgagtatgaactttattaacaacttaggtatgggacttgtaattgggactggatcagtaatggttttaaatggaatgacaacagtaggtgtcattgcggcttttattaattattctcgtcagttctcaagaccactcagtcaattcgcaactttaatgaatacgattcaagcggcagttgctggtggggaacgtgtctttgaaattatggatgaagtaccggaaatcaaaaataaaaaagatgcattcgtaatacaaaatttacatggacatgttgcactcgagaatgtttcatttggatatgaggaaaataaaacgattttaaaagaagtgagtcttaaagcgcggccaggggagacaattgctttagtaggtccaactggatcgggcaaaacaacaatcattaatttgctaacgcgcttttacgatgtacagcaagggcaaatttatattgatgaaaaaaatattaaagaatatgatttgaactcgttgcgaagtaaaataggagtagtcttacaagatacgtatttatttgctgggtcaattatggataatatacgttatggtcgattagatgcgagtgatgaagaagtaatcaatgcagctaaggcagcatctgcacattcttttataaaacatttaccgaatcaatatgaaacaaaaatagccacagaaggatcaaatttaagtcaaggacagaaacaacttcttgcaattgcaagggcaattttagcagatacagatatattaattctcgacgaagcaacatctaatatcgatacgagaacagaattacaaatacaagaaggactagacaatttaatgagaggtcgaacaagtttcgtaatcgctcatcgactgaagacgattgaaaaagcagatcaaatccttgttataaaagatggaagcattttagaaaaagggaatcatgaatctctcatggaagatagaggattttactttgacctgtatacgagtcagtttaaaatttaa

SEQ ID NO: 34604 - protein, 598 aa, Bacillus thuringiensis serovar konkukian str. 97-27
MRNFQGQFANKGGRNAPKIDKAKNTKGTVMRVWNYMGYQKAALTFVIFLVLVTTLLGLLGPYLMGVIIDQYIVPKDVSGTARMCLLLIAIYGVTVLLTWLQTFVMVNVALKTIQKIRQDIFKKIQTLSLRFFDVRSQGDLMSRVTNDIDNLNQALTQSVVQIISSALTFIGVTIAMFALDWILAIVTLITVPIMFFVTKKLVAYSGKNFAKRQKDLGELNGFIEEAITGADVTTLYGKEKETVQKFNKINEQLRVSATKADTFSAFIFPSMNFINNLGMGLVIGTGSVMVLNGMTTVGVIAAFINYSRQFSRPLSQFATLMNTIQAAVAGGERVFEIMDEVPEIKNKKDAFVIQNLHGHVALENVSFGYEENKTILKEVSLKARPGETIALVGPTGSGKTTIINLLTRFYDVQQGQIYIDEKNIKEYDLNSLRSKIGVVLQDTYLFAGSIMDNIRYGRLDASDEEVINAAKAASAHSFIKHLPNQYETKIATEGSNLSQGQKQLLAIARAILADTDILILDEATSNIDTRTELQIQEGLDNLMRGRTSFVIAHRLKTIEKADQILVIKDGSILEKGNHESLMEDRGFYFDLYTSQFKI

SEQ ID NO: 34605 - DNA, 1785 bp, Staphylococcus aureus subsp. aureus MRSA252
  CDS (1)..(1785)
ttgaaaggagttacatatacgatgaacaatcagacaaattggataaagatactcagcggatttgcttctgatagtaaatggaaaattatgttatcaattttgttgtctatcatcagtgtcttttctggattagttccatattgggcagtctttaaaattattttaatgatgattaacaatgcatatacgattaattcgattatggtttatatctttattgttttaatcgcttatatttcacaagtgtgttgttttggagcgtcaacgatgctatcacatattacggcatatgaaattttatctgaaattcgtaaaaaattagctcaaaaattaatgcgtctccctttaggcgtagtggaatctaagaaaataggtgaattaaaaaatatatttgtcgataaggttgaaacaatagaattacctttagcacatatgattcctgaagttataggaaacttacttttgtcagctgctatctttttatacataatgctcattgattggcgtatggctagtgccttattagtaacgataccaatttcaattttcgcttttaaaaaagttatgtctggatttaatgagacatatgctgaacaaatgaaatcgaataattatatgaatagcgcgattgtagagtttatcgaaggcattgaagtgattaaaacatttaatcaatctcaaagttcatataaaaaatataaagatgcagtagataattataagattcacactttgaattggtttaaaaatacatgggggtatatgaatttaggagctagtgtattaccttcaacatttttagggattttaccggtcggcatgtatttgatatctattaaccaattaaactatgcggaatttttcctatgcatcgtattatctttaggtgtagtagcaccgattaagaattttactaattatgtaaatcatttaaagtctatacaatacgcattaactgaagtgaatcaaatattaagtctagaagagttagtattgtcaacaaaatttaagaagcctcaacattatgaaattgcttttaataatgttggattttcatataacaaagataaggacgatctggtctttaagcatttatcatttacagtaccagaaaataatttcatagctatcgtcggggcatctggtagcggtaagtcaaccattgccaagcttatatcacgatactgggatgtgacttcaggtgaaattacgattggcggtatagatataaaagatattgaatcgaaacaacttaacgatttagttggttttgttggacaagataactttttattaaatcttacttttaaagaaaatattaaacttggcaatccagaagctacggatgaggcagttgaaaaagctgccaagttagcacaatgtcatgaatttattgaaaagttgccagatggatatgatacgaatgttggtacagtgggagataaattgtctggtggtgaaaaacaacgagtcactattgcaagaatgatattaaaagatgcgcctatcattgtattagatgaagcgactgcttacgttgatccagacaacgaacaaaaaattcaagaagcattaaatgtgttgacgcaggataaaacattgattgttattgcacatcggttatctacgattcaacatgcagatcaaattattgttttaggtaaacaacaaattttagaaaaagggtcacatcacttattgctaaaattaaacggtaattataagaaaatgtgggatacgcacatgcatacaaaagattggggaatcaatactggacataattaa

SEQ ID NO: 34606 - protein, 594 aa, Staphylococcus aureus subsp. aureus MRSA252
MKGVTYTMNNQTNWIKILSGFASDSKWKIMLSILLSIISVFSGLVPYWAVFKIILMMINNAYTINSIMVYIFIVLIAYISQVCCFGASTMLSHITAYEILSEIRKKLAQKLMRLPLGVVESKKIGELKNIFVDKVETIELPLAHMIPEVIGNLLLSAAIFLYIMLIDWRMASALLVTIPISIFAFKKVMSGFNETYAEQMKSNNYMNSAIVEFIEGIEVIKTFNQSQSSYKKYKDAVDNYKIHTLNWFKNTWGYMNLGASVLPSTFLGILPVGMYLISINQLNYAEFFLCIVLSLGVVAPIKNFTNYVNHLKSIQYALTEVNQILSLEELVLSTKFKKPQHYEIAFNNVGFSYNKDKDDLVFKHLSFTVPENNFIAIVGASGSGKSTIAKLISRYWDVTSGEITIGGIDIKDIESKQLNDLVGFVGQDNFLLNLTFKENIKLGNPEATDEAVEKAAKLAQCHEFIEKLPDGYDTNVGTVGDKLSGGEKQRVTIARMILKDAPIIVLDEATAYVDPDNEQKIQEALNVLTQDKTLIVIAHRLSTIQHADQIIVLGKQQILEKGSHHLLLKLNGNYKKMWDTHMHTKDWGINTGHN

SEQ ID NO: 34607 - DNA, 1785 bp, Staphylococcus aureus subsp. aureus MSSA476
  CDS (1)..(1785)
ttgaaaggagttacatatacgatgaacaatcagacaaattggataaagatactcagcggatttgcttctgatagtaaatggaaaattatgttatcaattttgttgtctatcatcagtgtcttttctggattagttccatattgggcagtctttaaaattattttaatgatgattaacaatgcatatacgattaattcgattatggtttatatctttattgctttaatcgcttatatttcacaagtgtgttgttttggagcgtcaacgatgctatcacatattacggcatatgaaattttatctgaaattcgtaaaaaattagctcaaaaattaatgcgtctccctttaggcgtagtggaatctaagaaaataggtgaattaaaaaatatatttgtcgataaggttgaaacaatagaattacctttagcacatatgattcctgaagttataggaaacttacttttgtcagctgctatctttttatacataatgctcattgattggcgtatggctagtgccttattagtaacgataccaatttcaattttcgcttttaaaaaagttatgtctggatttaatgagacatatgctgaacaaatgaaatcgaataattatatgaatagcgcgattgtagagtttatcgaaggcattgaagtgattaaaacatttaatcaatctcaaagttcatataaaaaatataaagatgcagtagataattataagattcacactttgaattggtttaaaaatacatgggggtatatgaatttaggagctagtgtattaccttcaacatttttagggattttaccggtcggcatgtatttgatatctatcaaccaattaaactatgcggaatttttcctatgcatcgtattatctttaggtgtagtagcaccgattaagaattttactaattatgtaaatcatttaaagtctatacaatacgcattaactgaagtgaatcaaatattaagtctagaagagttagtattgtcaacaaaatttaagaagcctcaacattatgaaattgcttttaataatgttggattttcatataacaaagataaggacgatctggtctttaagcatttatcatttacagtaccagaaaataatttcacagctatcgtcggggcatctggtagcggtaagtcaaccattgccaagcttatatcacgatactgggatgtgacttcaggtgaaattacgattggcggtataaatataaaagatattgaatcgaaacaacttaacgatttagttggttttgttggacaagataactttttattaaatcttacttttaaagaaaatattaaacttggcaatccagaagctacggatgaggcagttgaaaaagctgccaagttagcacaatgtcatgaatttattgaaaagttgccagatggatatgatacgaatgttggtacagtgggagataaattgtctggtggtgaaaaacaacgagtcactattgcaagaatgatattaaaagatgcgcctatcattgtattagatgaagcgactgcttacgttgatccagacaacgaacaaaaaattcaagaagcattaaatgtgttgacgcaggataaaacattgattgttattgcacatcggttatctacgattcaacatgcagatcaaattattgttttaggtaaacaacaaattttagaaaaagggtcacatcacttattgctaaaattaaacggtaattataagaaaatgtgggatacgcacatgcatacaaaagattggggaatcaatactggacataattaa

SEQ ID NO: 34608 - protein, 594 aa, Staphylococcus aureus subsp. aureus MSSA476
MKGVTYTMNNQTNWIKILSGFASDSKWKIMLSILLSIISVFSGLVPYWAVFKIILMMINNAYTINSIMVYIFIALIAYISQVCCFGASTMLSHITAYEILSEIRKKLAQKLMRLPLGVVESKKIGELKNIFVDKVETIELPLAHMIPEVIGNLLLSAAIFLYIMLIDWRMASALLVTIPISIFAFKKVMSGFNETYAEQMKSNNYMNSAIVEFIEGIEVIKTFNQSQSSYKKYKDAVDNYKIHTLNWFKNTWGYMNLGASVLPSTFLGILPVGMYLISINQLNYAEFFLCIVLSLGVVAPIKNFTNYVNHLKSIQYALTEVNQILSLEELVLSTKFKKPQHYEIAFNNVGFSYNKDKDDLVFKHLSFTVPENNFTAIVGASGSGKSTIAKLISRYWDVTSGEITIGGINIKDIESKQLNDLVGFVGQDNFLLNLTFKENIKLGNPEATDEAVEKAAKLAQCHEFIEKLPDGYDTNVGTVGDKLSGGEKQRVTIARMILKDAPIIVLDEATAYVDPDNEQKIQEALNVLTQDKTLIVIAHRLSTIQHADQIIVLGKQQILEKGSHHLLLKLNGNYKKMWDTHMHTKDWGINTGHN

SEQ ID NO: 34609 - DNA, 1851 bp, Acinetobacter sp. ADP1
  CDS (1)..(1851)
atgctgctgcgttggtttgaaaaattagtcgatccctatccaaatcatggattaaaacaacctttaccaaccagttttttttcttttatatggaattcaacacgtggcgttcgaccatatctgttggttttgattgcctgtactgcgggtgcagcaacttttgaagcactattgttttcaaaaattggacatcttgtagactggttaagtacaagccagccgagtacatttttagatcatcataaacacaatcttattcttttggcgagtgtactatttgccaatattttctttgtttgtcttcaatccatcgttaaacatcagattttgtatagtagcttcccaatgagattgcgttggcagtttcataacctcttattgcaacaaagtctcgatttttttcataatgattttgcagggcgactctctgcaaaagtcatgcaaactgctcttgctatccgagaattttggatgattctaggtgacatgctggtctatgtcaccatctatttcattacgattagcgtcgtattgggtaatatctccgcattgctactcattcctttaggcatctggttgagtttatttatcttaagtgcctggttttttattccgcgtctttctaaagtttctcaagaacaggcagatgcacgttcaatcatgacaggtcgtgtaacggatgcctacaccaatatccagacagtcaaactatttgcacatgcgggtcgtgaaagtaaatatgccaagcaatctatgattgaatttatggatactgtattcagacaaatgcgtttgggaacattgtttgaaattagtactacaattttaagcgctgttttatttattggcgtaattggtacggctgtgtggttatggatgaacgggcaagcagcacttggtgtaattgcagcaacaacagccatgattttaaaacttaatagcatggccgaattcatgatgtggcaaatgtccatgctttttgaaaatgtcggaaccattcaggatggtatgcgcacacttggtcgcccagtcaccattcaggataagcccgaagcgaaacctttaaatgttcaatctggtgaaattcgttttgaaaatgtcagttttgcctataatgaaaaaaatgtgattaatcatttcaatctcaccattcgcccaggagaaaaaattggtgtcgttggtcgttcaggtgccggtaaatctactctgattcaattactactgcacttttatgatttaaatgaaggtaagattttgattgatggacaaaatattaatgatgtaactcaggatagtttacgcgctaatattgctctggtaactcaagacacttctttattgcatcgcacagttgcagaaaatatcaaatatggtaagccagatgccacagacgatgaaatgagaattgctgtagacaaagctcaggccagcgaatttattccacagctgagcgacctacgtgggcgcaagggttatgaagcctatgtaggagagcgtggtgtaaaactctctggtggtcagcgtcaacgtattgcaatcgcacgtgtatttttaaaagatgcaccaatcctgatattggatgaagcaaccagtgctctggattcagaggtagaagccgcaattcaatctagtctagatgcattgatggatggaaaaacagttattgcgatcgcacatcgtttatctactattgctcagatggatcgattgatcgtgctcgatcagggaaatattgtcgagcaaggtacgcatgatgaactcattgaaaaagatggtttgtatgctcatttatggaaaagacagacgggtggctttttagtcgatgagtttgaaattgaggaaaaacaataa

SEQ ID NO: 34610 - protein, 616 aa, Acinetobacter sp. ADP1
MLLRWFEKLVDPYPNHGLKQPLPTSFFSFIWNSTRGVRPYLLVLIACTAGAATFEALLFSKIGHLVDWLSTSQPSTFLDHHKHNLILLASVLFANIFFVCLQSIVKHQILYSSFPMRLRWQFHNLLLQQSLDFFHNDFAGRLSAKVMQTALAIREFWMILGDMLVYVTIYFITISVVLGNISALLLIPLGIWLSLFILSAWFFIPRLSKVSQEQADARSIMTGRVTDAYTNIQTVKLFAHAGRESKYAKQSMIEFMDTVFRQMRLGTLFEISTTILSAVLFIGVIGTAVWLWMNGQAALGVIAATTAMILKLNSMAEFMMWQMSMLFENVGTIQDGMRTLGRPVTIQDKPEAKPLNVQSGEIRFENVSFAYNEKNVINHFNLTIRPGEKIGVVGRSGAGKSTLIQLLLHFYDLNEGKILIDGQNINDVTQDSLRANIALVTQDTSLLHRTVAENIKYGKPDATDDEMRIAVDKAQASEFIPQLSDLRGRKGYEAYVGERGVKLSGGQRQRIAIARVFLKDAPILILDEATSALDSEVEAAIQSSLDALMDGKTVIAIAHRLSTIAQMDRLIVLDQGNIVEQGTHDELIEKDGLYAHLWKRQTGGFLVDEFEIEEKQ

SEQ ID NO: 34611 - DNA, 1647 bp, Erwinia carotovora subsp. atroseptica SCRI1043
  CDS (1)..(1647)
atggagttgctccgcattgtttaccaacaataccgttggccgtttctcgctgttattattttaagtttactcagtgctgcgttgggcattgggctgattgcctttatcaacctgcaattgattgaaacggtcaatcagtcgttgagcgtcttgccgcagtttctgggcttactgctgcttctgatgggggtgacactggtatctcaactggcgttgaccacgctcgggcaccatttcgtttatcgcctgcgcgggcaatttatcaagcgaattctggatacaaacattgcccgtattgagcagattgggagtgcgcaactgctcgccagcctgtccagcgatatccgcaacatcaccatcgcgtttgtgcgtctacctgagctgattcagggcatcgtgcttaccctcggttcggcggcttatctggcgtggctctctcccaaaatgctagtcgtaacgtccatctggattgtggtgactctctgggtcgggtttatgctggtttcccgtgtgtatcgccatcttacccaggttcgggaagcggaagatcgcctccagaaagattacgaaaccgtgattaacgggcgtaaggagctggcgctcaatcgggaacgcgcgcagaaactgtatgaagaggtttatcaggccaatgcgcgggattaccgacagaatgtgattcgtgccgacaccttccatctcagtgcggtgaactggtcgaacattatgatgctgggcgcgattggcgcggtttttttcatggcaaacaatctcggctgggcggataccaatgtcgcggcgacgtactcacttacgctgctttttttacggacgccgatgcttcaggccgttggtgcgctaccaacactgctgagcgcacaagtcgcatttaataagttgaaacgtttcgatttggtggattatcaggaacctttctcctctgtaatcgcccctgtcgactggcacacgctggaactgcgtgatgtggtgtttcgctatgacgattccagatttgaaattgggccaatcaatctggtgataaagcgtggcgagctggtgtttctcattggcgggaacgggagcggaaaatcgacgttagcgatgctgctgacagggctttataccccggtgtcgggcacgttgctgctggataaccacccgattacgtcggaaacgcgaggggattaccaaaagctattttctgccatttttaccgacttccacctgttcggacagatgatggggccgcagggagcggatcccgatacggcgttggttgatgggtggctggatcgcttgaatatgcgacataagttgacgctggaaaatcatagggtgatgaatttacagctctcacaggggcagcgtaagcgtgtggcgctactattagccgtcgccgaacagcgcgatatcctgctgttagatgaatgggcagccgatcaggatccgcaattccgccgcgtgttctatcttgagttgttaccgcagttgcgtgcattagggaaaacgattgtggcgatcagccatgacgatcactactttgaacatgccgatcgcctacttgaaatgcatcagggtacgctgtcagaactgacgggcgcagcgcgtgaacaggcttctcaggacgctgtggcgcagattagtcgttag

SEQ ID NO: 34612 - protein, 548 aa, Erwinia carotovora subsp. atroseptica SCRI1043
MELLRIVYQQYRWPFLAVIILSLLSAALGIGLIAFINLQLIETVNQSLSVLPQFLGLLLLLMGVTLVSQLALTTLGHHFVYRLRGQFIKRILDTNIARIEQIGSAQLLASLSSDIRNITIAFVRLPELIQGIVLTLGSAAYLAWLSPKMLVVTSIWIVVTLWVGFMLVSRVYRHLTQVREAEDRLQKDYETVINGRKELALNRERAQKLYEEVYQANARDYRQNVIRADTFHLSAVNWSNIMMLGAIGAVFFMANNLGWADTNVAATYSLTLLFLRTPMLQAVGALPTLLSAQVAFNKLKRFDLVDYQEPFSSVIAPVDWHTLELRDVVFRYDDSRFEIGPINLVIKRGELVFLIGGNGSGKSTLAMLLTGLYTPVSGTLLLDNHPITSETRGDYQKLFSAIFTDFHLFGQMMGPQGADPDTALVDGWLDRLNMRHKLTLENHRVMNLQLSQGQRKRVALLLAVAEQRDILLLDEWAADQDPQFRRVFYLELLPQLRALGKTIVAISHDDHYFEHADRLLEMHQGTLSELTGAAREQASQDAVAQISR

SEQ ID NO: 34613 - DNA, 1665 bp, Erwinia carotovora subsp. atroseptica SCRI1043
  CDS (1)..(1665)
atgaatacgtcgacaaccaaaaatccagcgctaaagcttttactctcactcttgtttgattcacggcgggtattgacgattgccacagtagccagtgtcaccaatggcattgccagcgttttattgattaccttaatcaacaaagcgctgctgacgcccaccgatgactatgtgccactcgcctggtattttgccatattgactgtcctggcaatttcctgccgtattctcagcggcgtcattttcgccagattaagccaaggcaccatggcaaaaatgcgcgaactaatttctagccgtgtggctcgcgcgcccttccgtcagatagaagaactgggtgcctcacgtgcgcagtcgatcatcacggatgactcgaccagcgtatcactcttgttcttcaccctgccgaacatcgtgatgcaaggttctatcgtcgtcggctgtctgggataccttgcctggctatcgctccctatcttctttctggcactgacaatcgttgtcattggttcactgggttacagtctgggcggaagcacggcgttcacctccctgaaagcagcaggtcaggcacaagatcgcttatttacccacttcaatgcgctattttccggtgcaaaagagctcaaattgcatgtctcccgtgcgcatgcgtttctcaatcagtcactcggtaaagaaatcgacgccgtacgcaaaaatcgtacccgggccttcggcgtttatgctttcggcgttggctggatcctcttccttttctatagtttccttggtctggtcatcttttccccaaccataataccggggcttgaatcaacagcgctggcgggctatgtcattgtatttttattcatgctgatgccgctggaagggttactgaatagcattccaacgttaaattctgcgcgcgtctcattacgaagaattagcgcgatattatctgagctggacgaacgcgattccatcgatcataccgtctcctcgaatgaatttggcaatgccgacactatcagtctgtctggcgttatccatagctattaccgtgaaaaagaagaccgcgtgtttcaactggggccgattgatatgacgctcaggcgtggggaaattacgtttctgattggcggtaacggaagcggaaaaacaacgctcgccaagctgctagtcggtctatacacgccggaaagcggcaccattaccgtcgacggccacgaggtcgttgacagcaatcgtgccaactatcggcagcttttctccgccgtattctctgattttcatcttttcgaatcactgattgggttgaatgatgccgactcaacgctggattcacgcgctaacgcactactggccaagctgcatctggagaataaggtcacggtggaaaacggctatttttctactcgcaacctctcgcaggggcaacgtaagcgcctcgcgctggtcgtgacctatcttgaggatcgccctttctatctgttcgatgaatgggcagccgatcaggatccgttattcaaacgcgtgttttatcaggaacttctgcctgagttggctgctcgtggtaaagccgtattggctatcacacatgacgatcgttttttccacttggccgatcattgcatcaagctcgaaaacggtcgactcatcgctgatgaaggtaatactgtttag

SEQ ID NO: 34614 - protein, 554 aa, Erwinia carotovora subsp. atroseptica SCRI1043
MNTSTTKNPALKLLLSLLFDSRRVLTIATVASVTNGIASVLLITLINKALLTPTDDYVPLAWYFAILTVLAISCRILSGVIFARLSQGTMAKMRELISSRVARAPFRQIEELGASRAQSIITDDSTSVSLLFFTLPNIVMQGSIVVGCLGYLAWLSLPIFFLALTIVVIGSLGYSLGGSTAFTSLKAAGQAQDRLFTHFNALFSGAKELKLHVSRAHAFLNQSLGKEIDAVRKNRTRAFGVYAFGVGWILFLFYSFLGLVIFSPTIIPGLESTALAGYVIVFLFMLMPLEGLLNSIPTLNSARVSLRRISAILSELDERDSIDHTVSSNEFGNADTISLSGVIHSYYREKEDRVFQLGPIDMTLRRGEITFLIGGNGSGKTTLAKLLVGLYTPESGTITVDGHEVVDSNRANYRQLFSAVFSDFHLFESLIGLNDADSTLDSRANALLAKLHLENKVTVENGYFSTRNLSQGQRKRLALVVTYLEDRPFYLFDEWAADQDPLFKRVFYQELLPELAARGKAVLAITHDDRFFHLADHCIKLENGRLIADEGNTV

SEQ ID NO: 34615 - DNA, 1785 bp, Erwinia carotovora subsp. atroseptica SCRI1043
  CDS (1)..(1785)
atggtcggctatttcttccctattcaggttcactacatgctgaatgataaagatctctccacttggcagacttttcgccgcctatggccgatgatctctccttttaaggcagggcttgctgttgctgcaattgcgctcattattaacgcagctggcgatacactcatgctttcactgcttaaacctttgctggatgaaggatttggtaaggcggatcgctccgtattgctctggatgccgctagttgttattgggttgatgttagtcaggggggcgtcgggctttgtctccagctactgcgtttcttgggtttcaggcaaagtggtgatgaatatgcgccgccgccttttctctcatattatgggtatgccggtcgcattctttgatcaacaatcaacaggaacgctgttatcccgtattacctatgattcagagcaggttgcagcttcgtcatctggcgcgttgattaccgttgtcagagaaggggcctcgattattggcctgttcattttgatgttctactacagctggcagttgtccatcatcctgattgtgattgcgccgattgtgtcgatcgccatgcgcatggtgtccaaacggttccgcagtatcagtaaaaacatgcaggatacgatggggcacgtcaccaccagcacggagcaaatgcttaaaggacataaagaagtgctgatgtttggcggccaggacgtcgagactaaacgcttcgaacaggtcagtaaccggatgcgtcagcagggcatgaagatggtgtctgcttcttcaatttccgaccctatcattcagttgatcgcttctctggccttggcattcgtgctgtatgctgccagcttccctagcgtaatggaaacgctaaccgcggggacgattacggtggtgttctcttccatgattgcgctgatgcgtccgttaaaatcactgactaacgtgaacgcacagtttcagcgcggtatggccgcatgccagacgctgttcgcgattctggacatggaacaggaacgtgacacgggtaaacgagaaatcgaacgtgcgaaaggtgaactcgaattccgtcaggtgaatttcgcttatccggcaagagaaaatctggcgctgaagaacatcaatctgcatatccccgtgggtaaaacggtcgcgttggttggccgctctggttcaggcaaatcgacgattgctagtttgatcacgcgtttttacgatattcagtcgggtgagattctcctcgatggccatgatttacgtgagtatcgcttgtcttccttgcgtaatcaggtggcgctggtttctcaaaacgtccatctgttcaacgacacgatagcaaacaatatcgcttatgcccgcaacgaaaactatagccgtgaagaaattgagcgcgctgcaaaaatggcatatgcaatggacttcatcaataagatggagcacggtttggatacggtcattggtgaaaatggcgtgatgctttctggcgggcaacggcagcgtatcgcgattgcccgtgcgctgctgcgtgatagcccaatcctgatattggatgaggctacgtcggcgctggatacggaatccgaacgcgcgattcaggcagcattagacgaactgcaaaaagatcggaccgcgctggtgattgcacaccgtctttccacgattgagaaagcggatgagattctggtggttgaggatggaagaatcattgagcgaggcaatcatactgcgttactggcgactaacggtgcctatgctcaactacatagaatgcagttcggcgaatga

SEQ ID NO: 34616 - protein, 594 aa, Erwinia carotovora subsp. atroseptica SCRI1043
MVGYFFPIQVHYMLNDKDLSTWQTFRRLWPMISPFKAGLAVAAIALIINAAGDTLMLSLLKPLLDEGFGKADRSVLLWMPLVVIGLMLVRGASGFVSSYCVSWVSGKVVMNMRRRLFSHIMGMPVAFFDQQSTGTLLSRITYDSEQVAASSSGALITVVREGASIIGLFILMFYYSWQLSIILIVIAPIVSIAMRMVSKRFRSISKNMQDTMGHVTTSTEQMLKGHKEVLMFGGQDVETKRFEQVSNRMRQQGMKMVSASSISDPIIQLIASLALAFVLYAASFPSVMETLTAGTITVVFSSMIALMRPLKSLTNVNAQFQRGMAACQTLFAILDMEQERDTGKREIERAKGELEFRQVNFAYPARENLALKNINLHIPVGKTVALVGRSGSGKSTIASLITRFYDIQSGEILLDGHDLREYRLSSLRNQVALVSQNVHLFNDTIANNIAYARNENYSREEIERAAKMAYAMDFINKMEHGLDTVIGENGVMLSGGQRQRIAIARALLRDSPILILDEATSALDTESERAIQAALDELQKDRTALVIAHRLSTIEKADEILVVEDGRIIERGNHTALLATNGAYAQLHRMQFGE

SEQ ID NO: 34617 - DNA, 1893 bp, Symbiobacterium thermophilum IAM 14863
  CDS (1)..(1893)
atgggcatggggcagtaccggacggcacgggagctgcgcaggggggcggccccccggagcgagaacgcggaccgcttctactaccgggaggagcaggtcttcgagaagcccttcgactggaaccagctgaagcggctgggcgccttcctggtcccctacctccgttacgtgatcctcgcgggtatcgccatgctgggcgtgacggtcacccgccttgccgtgccgtggctgatggcgcaggcgatcgacaccgccctggagtccgaggtccggttcacccgctggacgcagtggctggagccgtatgcccgcaccgatcggctcttcatcctggcaggcgcgatgctcgcggtgtacctcgtcaactggctggcgaactacgcgcagatccggctgacgagctgggtggggcagcgggccctgtacgacctgcggacgaagatcttcgcccacgtgcagtcgctgtccatgcgcttcttcgacacccggcccgccgggtcgatcctggtgcgggtgaccaacgacgtcaactcgctgcaggacctgttcaccaacggcatcatcagcgccctgcaggacgtgctgaccctggtcggcatcatcctcatcatgatgtcgatgcacctgaagctctccgtggtcatcttcgccttcctgcccctgatgatggtcaccaccgtgcggctgcggacccgggtgcgccacggctggcagcgggtgcggatccagcgctcccggctcacggcccacctggcggaggcgatccagggcgtgcgggtcacccaggcgttcagccagcaggagcccaacaaggacttcttcgcggacatgaacgtcgaggtgcgcaagacctggatggacaccatccggctcaacgcctggttcaacccgatcgtggagatcatgggggccctgggcaccgcggtggtctactggtacggcacccggatcctgcagggcggcggcatcaccgtgggcgtgctggtcgccttcgtgacgtacgtcggccagttctgggagccgatcctgcggctgacccagctgtacggcaacgtcctggtggccatggcctccagcgagcgcatcttcgagtacctggacacgaagcccaccgtgcccgagaagccggatgcgcagccgctgcccccgatccggggcgaggtggagctggacaacgtgaccttcgcgtacgaggaagggcgcaccgccctgcgcggggtctccctgaaggtgaacccgggcgagacggtggccctggtcggccatacgggcgcgggcaagacgtcgatcatcaacctgctgtcccggttctacgatgtgaacgagggcgcggtgcggatcgacggcgtggacgtccgggacgtgaccctggagtcgctgcgccggcagatcgccgtggtgctgcaggataccttcatcttcagcgggacgatcatggacaacatccgctacggacggctggacgccaccgacgaggaggtcatcgaagcggcggaggcggtgcgggcccacgacttcatcatgcggctgccccacgggtaccagaccgaggtgcgggagcggggttcccggctctccatgggcgagcggcagctgatctcgtttgcccgcgccctgcttgcggatccccggatcctggtgctggacgaggccacggcctccatcgacacccagaccgagctgctgatccaggaggccctggcgcggctgttgcaggggcggacctccttcgtcatcgcccaccggctggcgaccatccgcaacgccgacaagatcgtggtactggaccacgggcagatcgtcgagatgggcacccacgagtcgctcatggcccggcgcggcgcgtactacaacctgattcaggcgcagttcaagttcatcgaggcgagttga

SEQ ID NO: 34618 - protein, 630 aa, Symbiobacterium thermophilum IAM 14863
MGMGQYRTARELRRGAAPRSENADRFYYREEQVFEKPFDWNQLKRLGAFLVPYLRYVILAGIAMLGVTVTRLAVPWLMAQAIDTALESEVRFTRWTQWLEPYARTDRLFILAGAMLAVYLVNWLANYAQIRLTSWVGQRALYDLRTKIFAHVQSLSMRFFDTRPAGSILVRVTNDVNSLQDLFTNGIISALQDVLTLVGIILIMMSMHLKLSVVIFAFLPLMMVTTVRLRTRVRHGWQRVRIQRSRLTAHLAEAIQGVRVTQAFSQQEPNKDFFADMNVEVRKTWMDTIRLNAWFNPIVEIMGALGTAVVYWYGTRILQGGGITVGVLVAFVTYVGQFWEPILRLTQLYGNVLVAMASSERIFEYLDTKPTVPEKPDAQPLPPIRGEVELDNVTFAYEEGRTALRGVSLKVNPGETVALVGHTGAGKTSIINLLSRFYDVNEGAVRIDGVDVRDVTLESLRRQIAVVLQDTFIFSGTIMDNIRYGRLDATDEEVIEAAEAVRAHDFIMRLPHGYQTEVRERGSRLSMGERQLISFARALLADPRILVLDEATASIDTQTELLIQEALARLLQGRTSFVIAHRLATIRNADKIVVLDHGQIVEMGTHESLMARRGAYYNLIQAQFKFIEAS

SEQ ID NO: 34619 - DNA, 1863 bp, Symbiobacterium thermophilum IAM 14863
  CDS (1)..(1863)
atgagcgcccggcacggtccccgacccggtcatggtcccggagccggcccggcgatggcgctggtgggcgagaagccccgcgacttccgcgggaccctgcggcggctgctgcgctacctgcggccgaggctctggcagctgggcgccgtcttcctgctggcggctctcagcacggtcttcagcatcgtgagcccgcgcatcatgggcaaggccaccaccatcctgttcgaagggctgctggcgaagctgagcggcgtccccggcgcggggatcgacttcggccgcatcgcccgcatcctggtcctgctggggctgctctacgtggcgagtgccgccttcggcatcgtccagcagttcgtcatgtccggcgtctcccagcgcacggtctacgacctgcgcaaccaggtgaacgagaagctggcccggctgcccctcagcttctacgaccggaagacccacggcgaggtcctgagccgggtgaccaacgacatcgacaccatcgccgggacgctgcagcagagcctgacccagctgatcaccgccatcgtcacgctggtgggcgtggtggtgatgatgctctccatcagccctgtgctcaccctggtcaccctggtctcgctgccgctgtcgctcctggtcacggtcggcgtcgcccggcggtcacagggctacttcaaggcgcagcagaaggcgctgggcgagctgaacggccacgtcgaggagacctacaccggccaccaggtggtgaaggccttcggccgggaggaggacgtggtggccgagttcgaccgcatcaaccagcggctgtacgaggccggctggaaggcccagttcgtctcgggcatcatcatgccgctgatggcgttcgtcaacaacatcggctacgtgatcgtggccgtggtcggcggcatcttcgtcgcccgccgcgcggtggagatcggcgacatccaggccttcctccagtacgcccggcagttcagccagccgatcacccagacggccaacatcgccaacatcctccagtccaccatcgccgccgccgagcgggtctttgagctcctggacgagccggagatcgtcccggacccggccgagccggtgcggctggagcaggtccggggcgaggtccggttcgagaacgtcagcttccgctacaagccggacgagccgctgatcgaggacctgaacctcacggcccggcccggccaggtgatcgccatcgtcggccacaccggcgccggcaagaccaccctggtcaacctgctgatgcgcttctacgagatcgacggcggccggatcacggtcgacggcgtggacatccgccgcctccgccgcgacgacctgcgcagcctcttcggcatggtgttgcaggacacgtggctcttccatggcacgatccgggagaacatcgcctacggccgggagggggccaccgaggaggagatcgtccgggcggcaaaactcgcccacgccgacggcttcatccgatccctgcccgacggctatgacaccgtgctcaacgaggaggcctcgaacatctcccaggggcagaagcagctgctcaccatcgcgcgggcgttcctggccgacccgccgatgctgatcctggacgaggcgacgtcctccgtggacacccgcacggagctgcagatccagcaggccatgcagaccctcatgaagggcaggacgagcttcgtgatcgcccaccggctctcgaccatccgggaggcagacctgatcctggtcatggaccacggccggatcgtggagcagggcacgcaccgggagctcctggccgcaggcggcccgtacgcggacctgtactacagccagttcgccgccgggcagggcctggccggctga

SEQ ID NO: 34620 - protein, 620 aa, Symbiobacterium thermophilum IAM 14863
MSARHGPRPGHGPGAGPAMALVGEKPRDFRGTLRRLLRYLRPRLWQLGAVFLLAALSTVFSIVSPRIMGKATTILFEGLLAKLSGVPGAGIDFGRIARILVLLGLLYVASAAFGIVQQFVMSGVSQRTVYDLRNQVNEKLARLPLSFYDRKTHGEVLSRVTNDIDTIAGTLQQSLTQLITAIVTLVGVVVMMLSISPVLTLVTLVSLPLSLLVTVGVARRSQGYFKAQQKALGELNGHVEETYTGHQVVKAFGREEDVVAEFDRINQRLYEAGWKAQFVSGIIMPLMAFVNNIGYVIVAVVGGIFVARRAVEIGDIQAFLQYARQFSQPITQTANIANILQSTIAAAERVFELLDEPEIVPDPAEPVRLEQVRGEVRFENVSFRYKPDEPLIEDLNLTARPGQVIAIVGHTGAGKTTLVNLLMRFYEIDGGRITVDGVDIRRLRRDDLRSLFGMVLQDTWLFHGTIRENIAYGREGATEEEIVRAAKLAHADGFIRSLPDGYDTVLNEEASNISQGQKQLLTIARAFLADPPMLILDEATSSVDTRTELQIQQAMQTLMKGRTSFVIAHRLSTIREADLILVMDHGRIVEQGTHRELLAAGGPYADLYYSQFAAGQGLAG

SEQ ID NO: 34621 - DNA, 1800 bp, Symbiobacterium thermophilum IAM 14863
  CDS (1)..(1800)
gtggcgatgcgcggcggccccggcgccttccggctcgacgactacgacgtgaagctgagccaggtggatccccggatctaccggctgctcggcaccctgatccgcccgtacgtgcccaagctggccgcgggcgtcctgctcatggtggccaccgccctcaccgggctggtaggtccgtacctcacgcaggtggcgatcgaccgcttcgtcgccgagcgcgaccccgcgggactcgacctggtggccctggccttcctggcgaccgccctgctcaactggtggtccagttacgggcagacgtacatcgtctcctacgtgggccagtccatcatctacgatctgcgggaccggatgttccgccacctgcagcggctctccttccggttcttcgactccatggccaccggacgcatcatgtcccggctgatgtccgacgtggacgcgatcaaccagctggtctcctcgggcctggtgagcctgttcgccgactctatggtgctggtcaccatcatgggcacgatgctctggatgaactggcggctggccctggtctccttcatcaccatcccgaccctgctgctggtgctgcggcttttccggggctggatgcgggatgccttcatggcccagcgccggcgggcggcggacatgaacgcccacctggcggaggccatcgccggcatccgggtcacgcaggcgtacgtgcgggaggcccgcaaccaggcgcagttcgacggcatcaacgagcggctgcggcaggccaacctgggggccgtgcgggtctgggcgacgatgatgccctcgattgaggtggtgtcggccttcggcgtgacgctggtgctctggtacggcggcatcctgctccggggcggcaccgcggacgtgaccgtgggccaggtcgcggccttcatcctctacctgaaccggttctttcagcccatccgcgacctgtcgcaggtgttcaacgtctttcaggcagcggtggtctcggccgagcgggtcgccgagctgctggatcagcagccggagatcgtggaccggcccggcgcccgcgacctgccccgggtcgccggccgggtggagttccgggacgtggtgttcgggtacgagccgggccaggtggtgctgaaggggatcaatctgcgggcggagccgggggagaccatcgccctggtggggccgaccggcgcagggaagtcgtcggtcatcaacctgctcgcccggttctacgagccgcaggaggggcaggtgctggtggacggggtggatctcagcaccgtgacgcagcggtcctggcggtcgcagctgggcatcgtgctgcaggacaccttcctgttctcgggcacgatccgggacaacatccgctatggccggcctgacgccaccgacgaggaggtggaggccgccgcccgcgcggtgggcgcccacgacttcatcgtgcggctggagaaggggtacgacacggaggtgcacgagcggggggcgaagttgtcggtgggtcagcggcagctgatcgctttcgcccgggccttgtgcgccgacccggcggtgctgatcctggacgaggcgacgtcgaacatcgacacgcacacggaggcggtgatccaggaggccctgcagaccctgctccggggccggacggcgttcgtcatcgctcaccggctgtccacgattcggtccgcggaccggatctactacatcgaggacggacaggtggtggagcaggggcggcacgcggagttgctcgccctgggggggaggtatgcgaggatgtatcgggggcagtgggagggggagtga

SEQ ID NO: 34622 - protein, 599 aa, Symbiobacterium thermophilum IAM 14863
MAMRGGPGAFRLDDYDVKLSQVDPRIYRLLGTLIRPYVPKLAAGVLLMVATALTGLVGPYLTQVAIDRFVAERDPAGLDLVALAFLATALLNWWSSYGQTYIVSYVGQSIIYDLRDRMFRHLQRLSFRFFDSMATGRIMSRLMSDVDAINQLVSSGLVSLFADSMVLVTIMGTMLWMNWRLALVSFITIPTLLLVLRLFRGWMRDAFMAQRRRAADMNAHLAEAIAGIRVTQAYVREARNQAQFDGINERLRQANLGAVRVWATMMPSIEVVSAFGVTLVLWYGGILLRGGTADVTVGQVAAFILYLNRFFQPIRDLSQVFNVFQAAVVSAERVAELLDQQPEIVDRPGARDLPRVAGRVEFRDVVFGYEPGQVVLKGINLRAEPGETIALVGPTGAGKSSVINLLARFYEPQEGQVLVDGVDLSTVTQRSWRSQLGIVLQDTFLFSGTIRDNIRYGRPDATDEEVEAAARAVGAHDFIVRLEKGYDTEVHERGAKLSVGQRQLIAFARALCADPAVLILDEATSNIDTHTEAVIQEALQTLLRGRTAFVIAHRLSTIRSADRIYYIEDGQVVEQGRHAELLALGGRYARMYRGQWEGE

SEQ ID NO: 34623 - DNA, 2001 bp, Bacillus cereus ZK
  CDS (1)..(2001)
atgagcgtttcaaaacgattgtttcaatacgcaatgaaagtaaaagggacgatttttgcagcgatgctaatgttatttattttcgtcattgcagagcttgctggtcctttcgtcgcgaaaacgatgattgacgatcatatcgttggaatagagaaaccttggtatgaaacagaaaagagtgaagaggctgtttcttataatggcaccttttataagcgaagcgatcgcttccaagaaggtgagaaaaaaggaaaagaagtacgcgtgatgcaagtcggttttcaatattattttgtaccgaataaagtgaatgtggaaggatcacgtactgtaaaaggtgatatgattaccgttcaaaatggtaaggcgctgcaagtgtataaagcgaaagcattaacgaaagaagaagtgtttgcgttttataaaccagaaataaaccgactattattacttggtggaggctatttcgctttattagtagttgtttcattatttgcatatggaaagcagtttttcttgcagaaagcagcgaacaaaattattcaaattatgagggaagatgtcttttctcatattcaaacgttgccgattcgttatttcgatcatttaccagcagggaaaattgtatcacgcgtcacgaatgatacggaagccattcgtgatctatacgtaacggtacttgcgacattcgtttctagtatcatctatattattgggatatttgctgcgctatttttactcgatgtaaagttggcgacgttatgtttacttattatcccgattttaatcatttgggccattctttatagaaagtatgcgtctgtatacaatcataaaatgcgctctcgtttatctgatattaacggaacagtgaatgaatccattcaagggatgccaattattcaagcgttccgtcaagagcgtgaaacgaaaaaagagtttgaagaattaaatggtgattattttaagtatcaaaataaaattttaaatttaaatgcagctacttctcataatttagtagccgtattaagaaatattgctttcacaggtgtgatctggtatttcggtggtgcttcattaagtgctacaggcgttatttctctagggatactgtatgcattcgttgattatttgacacgattgttctcaccaattacaaatatggtgaatcagcttgctaacttagaacaatcgcgcgttgcatccgagcgcgttttcgaactgttagaagaaaagggagagacagtagaagaagagcgtatacctcgcttacaaggaaatgtgaagtttgataatgtatcgttttcttataatggaaaagatgaagtgttaaaaaatatttcttttgaagcgaaacaaggcgagacagtcgcgcttgtcggtcatactggctcaggaaaaagttccattatgaatgtactctttcagttttacgagtttgaaaaaggaaagcttacgattgatggtcatgatgtaaaagaggtgccgaaacaagcaactcgtgaacatatgggaatcgtactacaagatccatttttatttagcggaacagttgcgtctaatgttagcttagaaaatgaaaatatttcaaaagagcgtatcgtaaaagcattgcgtgatgttggtgctgaaagatttgcgaacaatataaatgaagaaattacggagaaaggaagtacactttcaaccggagaacgtcagcttatatcgtttgctagggcgctcgcttttgacccagccattttaattttagatgaagcgacatctagtatcgatacagaaacagaagcgatgattcaacaagcgctagaagttgtgaaaaaaggaagaacgacatttattattgcccaccgtctttcaacaattaaaagtgcagatcaaattatcgtgcttgatagagggacgattttagaaaaagggtctcatgatgaattaatgaaaaagcgcgggcgctattacgatatgtacaaaacgcaaatggaagggaatcagagcgcttaa

SEQ ID NO: 34624 - protein, 666 aa, Bacillus cereus ZK
MSVSKRLFQYAMKVKGTIFAAMLMLFIFVIAELAGPFVAKTMIDDHIVGIEKPWYETEKSEEAVSYNGTFYKRSDRFQEGEKKGKEVRVMQVGFQYYFVPNKVNVEGSRTVKGDMITVQNGKALQVYKAKALTKEEVFAFYKPEINRLLLLGGGYFALLVVVSLFAYGKQFFLQKAANKIIQIMREDVFSHIQTLPIRYFDHLPAGKIVSRVTNDTEAIRDLYVTVLATFVSSIIYIIGIFAALFLLDVKLATLCLLIIPILIIWAILYRKYASVYNHKMRSRLSDINGTVNESIQGMPIIQAFRQERETKKEFEELNGDYFKYQNKILNLNAATSHNLVAVLRNIAFTGVIWYFGGASLSATGVISLGILYAFVDYLTRLFSPITNMVNQLANLEQSRVASERVFELLEEKGETVEEERIPRLQGNVKFDNVSFSYNGKDEVLKNISFEAKQGETVALVGHTGSGKSSIMNVLFQFYEFEKGKLTIDGHDVKEVPKQATREHMGIVLQDPFLFSGTVASNVSLENENISKERIVKALRDVGAERFANNINEEITEKGSTLSTGERQLISFARALAFDPAILILDEATSSIDTETEAMIQQALEVVKKGRTTFIIAHRLSTIKSADQIIVLDRGTILEKGSHDELMKKRGRYYDMYKTQMEGNQSA

SEQ ID NO: 34625 - DNA, 1725 bp, Bacillus cereus ZK
  CDS (1)..(1725)
atgagtaactggattaaaccgtatgtacagcaaaataaaggtagaatgactgtaactattttccttggcctgcttggagttagttcaggtgcaatgctacttttcatttcaggttatttaatctctaaatctgctcttagaccagaaaatgtaatggcagtttatgtacctatcgttgcaacacgtgcgtttagtataggacaagcggtatttcattatttagagcgtttagttggtcacgatgtcgtactacgtattttagaaaagatgagaacaaaactatatgggatagtagaaccacaggcgttgtttttccgttcgcgattccaaacgggtgatatgttaggggtattatccgaagatatagagcatttacaaaacctatatttacgtacaatatttcctagcatattagcattagttgtatatagcatattcgtacttgttattggtgcatttgacgtagtgtttgcacttattgcagcatgtatgttggctattatcgtttttcttcttccatttatatcattacttttaatgaagaaacatcatgttactttaaagcaaggaagaaaccgtttgtaccaacaactaacagatgcggtttttggattatctgattggcaagcaagtggtagaaaagatgaattcattgataagtatgtagaacaaaatgatcagttgttaaaaattgagaaaagaatgaagcgctggaatcatattcgggacagtatcattcaattagtagtagggattgtagtcatttcaatgatcatatggactggaaatgaggcggcaagtgaacagattgcacctactgttattgcggctttcatcttaatgacgttatctgtcacaaacgcgcttattcctctttcagatgctatcgatcggataccatcatatgtagaatctgctcatcgtctcaatcaagtagaaggtaatggtgttttacaggatgaaaaggaattacatggagataaggattatgtcgcatcaaaacatatagatattgaattaaaacatgtatcatatagttatccagatagcaatgaatttgtattgaaagatgtatcattacaaataaaagcagggaagaaaatcgccattttaggaagaagcggaacaggaaaatcaactttattaaaactgttaacaggtgcgctaagcccattacatggtgaagttttattgaatagtgaacatgctcacacgaatcttttatcaaaatgtatttctgtattgaatcaaaagccgcatttattcgatacgacaattggaaataatgtgaggataggcaaaccagaggtaacagatgaagagatatggaaagctttagagaaagcacaattagcttcgcatattgcttctcttccagatggattacaaacgaaaatgcatgagatgggaaaaagattttctggcggggaaagacaacgagttgcttttgcaagaacgctaatgcaagaagcaccaatcattgtactagatgaacctacaatcagcttagatccaaagacagaattatctttaatagaaacaatgttttctgcaacggaagaaaagacagtaatttggattacacaccatcttgtaggcattgagcatgttgatgaagtaatattccttgatcgtggtcaaattgtgatgcaaggtagtcatgaacaacttctgaaagaaaatgagaagtatcgacagctttatgaacttgataaaggaatatag

SEQ ID NO: 34626 - protein, 574 aa, Bacillus cereus ZK
MSNWIKPYVQQNKGRMTVTIFLGLLGVSSGAMLLFISGYLISKSALRPENVMAVYVPIVATRAFSIGQAVFHYLERLVGHDVVLRILEKMRTKLYGIVEPQALFFRSRFQTGDMLGVLSEDIEHLQNLYLRTIFPSILALVVYSIFVLVIGAFDVVFALIAACMLAIIVFLLPFISLLLMKKHHVTLKQGRNRLYQQLTDAVFGLSDWQASGRKDEFIDKYVEQNDQLLKIEKRMKRWNHIRDSIIQLVVGIVVISMIIWTGNEAASEQIAPTVIAAFILMTLSVTNALIPLSDAIDRIPSYVESAHRLNQVEGNGVLQDEKELHGDKDYVASKHIDIELKHVSYSYPDSNEFVLKDVSLQIKAGKKIAILGRSGTGKSTLLKLLTGALSPLHGEVLLNSEHAHTNLLSKCISVLNQKPHLFDTTIGNNVRIGKPEVTDEEIWKALEKAQLASHIASLPDGLQTKMHEMGKRFSGGERQRVAFARTLMQEAPIIVLDEPTISLDPKTELSLIETMFSATEEKTVIWITHHLVGIEHVDEVIFLDRGQIVMQGSHEQLLKENEKYRQLYELDKGI

SEQ ID NO: 34627 - DNA, 1851 bp, Agrobacterium tumefaciens
  CDS (1)..(1851)
atgtcaatttcagacacaatctaccgtccgtttgaaaatttgatccggccattagatattccctaccggcctcttccctccacagggcctgtggcggtcctcctgcatttcatatcaatgtttcggggtgtgctgatcctactcgcactttccgcgatggcgatggaagcgatcaatttgtctatcgtctgggggctgtcggttgtcgtggatggcgtcacgcaacagggcgcgtccgcattcctggagaatgaatggccactgctgacctttctcggtctcttgatcttcccggcgatgccaatcgcttcgttcctactcaacacactccagtcacatacgcttggcatcggcatgccggcggcaatccagtggcagggccacaaggcggtggagcggcaggatcttgctttcttccatgagctatttgctgggcaggtcgcctcgcggctacagcaggtatcatccgccgtacagcagcagatcattgccgctttccagaccgtcccgcgctttttgttgcagatggttggttccgttatcctgcttagcgctctgtcctggcagctcgccctgcctgttgtcatatggatcgcgctcaacgtcgcatacaccgtcagaacagttcccacctttgccgagcgctcccgtcgcaccgccaagcagcgtagcttggttgccggtgccattaccgatctctacaccaacatgcagatgatcaagcaatttgccgctgaagatagcgaagcaggcgcgatccgccgtaccatccaaaagtccgtacagacgcagcagagcgaacaacgcatctaccgtacgtccgaactcgccgtggttatcctcaacacgatcctgtggctaagcatgctatcgatcggattttccggcttggttaaggggttcctctccgtcggtcagttcgtcggcgcagtctacatcctgcagcggctttccacccagatctttgttttcctgcaaatgggccagcagatctttcaggcaatagggacaatcaaggacgcgatgccggtgatgaccacgccgcccaccatcattgatcggccgagcgcagccgatcttgtagtggaccgtggcgaaattcggttccaaaatgtcggtttcgcctacaagtccggcaagccggtgatcaataatctttcgctgaccatccggcccggggaaaaggtcggcctggttggactatctggggctggcaagacaacactcgtgagccttctgctgcgcttttacgacattcaagacggagcaatcctgatcgacgggcaggacatctgcgaggtcactcaggggagccttcgccgcaacatcggcgtgatcgcgcaggatgtagcattgctgcaccgctcggtcggcgataatatccggtatggtcggccagaggcgacccagcaagaaatcgaagcggcggcgacgacagcgcgggctgatctgttcatcagggacctgtcggacggtgaaggccgtaaaggttatgaggccttcgtcggcgaccgtggtatcaaactctccggtggtcaacggcaacgtgtggctatcgcgcgggtgttgctgaaggacgcgccgatcctggtgctcgatgaggcgacctccgccctcgacagtgaatcagaggctgctatccaagaaaagctggggctggtcatggcaggaaagacggtcattgctatcgcccatcgcctttcgactattaccatgatggatcggatagtcgtgctcgaccgtggccatatcgtggaagaaggcagacctgaggagttgataaagcggggtggcttgtttgcccgcctttggaaacgtcagacgggtggctttattccagaggatgagtag

SEQ ID NO: 34628 - protein, 616 aa, Agrobacterium tumefaciens
MSISDTIYRPFENLIRPLDIPYRPLPSTGPVAVLLHFISMFRGVLILLALSAMAMEAINLSIVWGLSVVVDGVTQQGASAFLENEWPLLTFLGLLIFPAMPIASFLLNTLQSHTLGIGMPAAIQWQGHKAVERQDLAFFHELFAGQVASRLQQVSSAVQQQIIAAFQTVPRFLLQMVGSVILLSALSWQLALPVVIWIALNVAYTVRTVPTFAERSRRTAKQRSLVAGAITDLYTNMQMIKQFAAEDSEAGAIRRTIQKSVQTQQSEQRIYRTSELAVVILNTILWLSMLSIGFSGLVKGFLSVGQFVGAVYILQRLSTQIFVFLQMGQQIFQAIGTIKDAMPVMTTPPTIIDRPSAADLVVDRGEIRFQNVGFAYKSGKPVINNLSLTIRPGEKVGLVGLSGAGKTTLVSLLLRFYDIQDGAILIDGQDICEVTQGSLRRNIGVIAQDVALLHRSVGDNIRYGRPEATQQEIEAAATTARADLFIRDLSDGEGRKGYEAFVGDRGIKLSGGQRQRVAIARVLLKDAPILVLDEATSALDSESEAAIQEKLGLVMAGKTVIAIAHRLSTITMMDRIVVLDRGHIVEEGRPEELIKRGGLFARLWKRQTGGFIPEDE

SEQ ID NO: 34629 - DNA, 1860 bp, Mannheimia succiniciproducens MBEL55E
  CDS (1)..(1860)
ttggtttcggcagattgtaggcggcgagcgggattgatatttggatcctattacaatataggttacaatgcgccaattatttttttgagaagatatacatttatgcaaaaactgcaagaaaacgatctgtcaacaagccaaacctttaagcgcttatggccgactatcgcgccttttaaaatcggtttaattgcggccgccgccgcgttagtgttaaacgcgttgaccgattcgggcttaatttatctgttaaaacccttacttgatgacggttttggtaaagcggatacctcttttttgaaattgatggcggtgttagtcatcgtctttatttttatccgcggtatcaccagttttatttcaagttattgcttagcctgggtctcgggcaaagtggtgatgaccatgcgtcgccggctattcaaacatttgatgtatatgccggtgagtttttttgatcaaaactccacagggcgcttgctttcccgtatcacttacgacagcgaacaagtggcgaactcatcgtcaaacgcgctggtaaccattgtgcgtgaaggcgcttatattatttcgttgttagcggtaatgattgccacaagctggcagctttccgtagtgcttttcattatcggaccggttatcgcggtgctgattcgtttggtgtctaaaattttccgtcgcttgagtaaaaatatgcagaactcaatgggcgaattaacggcgacggcggaacaaatgctgaaaggacataaagttgtgctttcgttcggcggtcagcaaattgaagaacaacgttttaacgaagtcagtaacgatatgcgccgtaaaggcatgaaaatggtggttgccgatgctatttcggatccgattgtacaaattattgcttcattggcgttatcggcggtgctttatttggctaccatcccaagtattatgagtcaaaatctgagtgccggctcgtttactgttgtgttttcttccatgctggcgatgttgcgcccgttaaaatccctcaccaatgtgaactctcaattccaacgcggtatggcggcctgccaaaccctgtttgatattctggaccttgataccgagaaagataagggtaaatatgaagcggagcgggtgaaaggcgacgtgagctttaaagatgtgagttttacttatcagggtaaagatcaaccggcgctaaaacatctgtcttttgacattcctcacggtaaaacctttgctttagtggggcgttccggttcgggaaaatccactatcgctaatttagtgacccgtttttacgatatcaatcagggcgaaattctacttgatggcgttaacgtgcaggattataccttatctaatttgcgtacccattgttccgtggtttcacaacaggtgcatttattcaacgataccattgccaataacattgcttatgcggcgaaagacaaatacagcagggaacaaattattgcggcggcaaaagcggcgcatgcaatggagtttattgagcctttagaaaacggcttggataccgtaatcggcgaaaacggtgcgagtttatcgggcggtcaacgccagcgtttagctatcgcccgcgccttattgcgcgattcgccggtgctgattcttgacgaagccacatccgcattggatacggaatccgaacgggctattcaggcggcgttggaagaattgcaaaaagaccgcacggtacttgttattgcacatcgcctttctacgattgaaaaagcggatgaaattctggttattgatcacggcgagatctgtgagcgcggtagccatgaagaattactggcattgaacggtgcttataaacagctgcataaaatgcagtttaacggctag

SEQ ID NO: 34630 - protein, 619 aa, Mannheimia succiniciproducens MBEL55E
MVSADCRRRAGLIFGSYYNIGYNAPIIFLRRYTFMQKLQENDLSTSQTFKRLWPTIAPFKIGLIAAAAALVLNALTDSGLIYLLKPLLDDGFGKADTSFLKLMAVLVIVFIFIRGITSFISSYCLAWVSGKVVMTMRRRLFKHLMYMPVSFFDQNSTGRLLSRITYDSEQVANSSSNALVTIVREGAYIISLLAVMIATSWQLSVVLFIIGPVIAVLIRLVSKIFRRLSKNMQNSMGELTATAEQMLKGHKVVLSFGGQQIEEQRFNEVSNDMRRKGMKMVVADAISDPIVQIIASLALSAVLYLATIPSIMSQNLSAGSFTVVFSSMLAMLRPLKSLTNVNSQFQRGMAACQTLFDILDLDTEKDKGKYEAERVKGDVSFKDVSFTYQGKDQPALKHLSFDIPHGKTFALVGRSGSGKSTIANLVTRFYDINQGEILLDGVNVQDYTLSNLRTHCSVVSQQVHLFNDTIANNIAYAAKDKYSREQIIAAAKAAHAMEFIEPLENGLDTVIGENGASLSGGQRQRLAIARALLRDSPVLILDEATSALDTESERAIQAALEELQKDRTVLVIAHRLSTIEKADEILVIDHGEICERGSHEELLALNGAYKQLHKMQFNG

SEQ ID NO: 34631 - DNA, 1680 bp, Mannheimia succiniciproducens MBEL55E
  CDS (1)..(1680)
atgaacatttttatctcaacaataaaaggttatcgctggcatttagtcgccgtgctgattctcacttttattttcagcggattcggtatcggagttttagcttttattaataataaattaatgaaagcgacagaacaaaaagaactgctgatctggactttcatcggcttgctgattctgtttcttatcacatccgttattgcgcaaatcagccttaccgcccttgggcataaatttgtgtatctcatgcgcaaacaattggtaaaacagttattggatacgggaaccgaacagcttaaccaaatcggtaaagcaagactgttagccagcctgtccggcgatattcgcaatatcacctttgccttcgtacgcctgccggaattggtgcaaggttccatacttgtgctatgcgcgggcgcctatatgttttatttgtccgaatctttgttttttgtaaccgcactttggttaagcgtaacggtctgggtaagcaatattgccgtcagacgcgtgtatcaccatttgcgaatcgtgcgggaaacggaagataaactgtataaaaactatcaatccgctattgaagggcataaagaattaagcctgaatcgtgaacgggcaaaattttatttcgaacgtgaattagaagagagcgcaagcacacagcgcgataattccgttcgcgccgacagctatcacgcctttgccaataactggacaaacgtaatggtactcggtgcggtcggtttggttttttatctttctttagccgaaggttggtcgaatctggaaaccgcaaccactatcgcattaaccattttattcctgcgcactccgttaatctctgcggtcggtgcgttgcccatgctgctgaatgccaaagtggcgctggataagttatctaagctgaatttagctccttatacggaagactttgccatttcaaaccccttacctcgagattggaaagaaatccgttttgaaaatgtgacgtacagctatcctacggcggaaggtacaatgagttttgcgttaaaaccggtcaatctcaccattaaacggggcgagctgatctttttaatcggcaaaaacggcagcggtaagtccaccttttcgatgctgctggcggggttgaaccatgcgaccgacggtaaaatctttgtcgataatattgaaatcaccgccgccaatcaacgtgcgttccgggcccagatcagcgccgttttcagtgatttttatctgtttacccaacttttagggcaagcgggctttgcatctctcaaagaagcgggacaatggctggaaaccttgcaattggaaaacaaagtgacggtagaaaaccaccgcttatctaccaccaatctttcgcagggacagcgcaaacgccttggtttgttaatcgccctgctagaacatcgtcccttattaattttagacgaatgggcagcggatcaggacccgacattccgccgcacattctatcaggttttattgcctttactccgcgagaaaggacataccgttttcgctatcagtcatgacgatagctatttccacttggcggatcgcttattgctgatcagccagggcgagcttcgcgaattattcggcgaagaacgggaaacggcaagccatgatgcggtagaaaaattaaataatatcatcaaggaaactaaaatatga

SEQ ID NO: 34632 - protein, 559 aa, Mannheimia succiniciproducens MBEL55E
MNIFISTIKGYRWHLVAVLILTFIFSGFGIGVLAFINNKLMKATEQKELLIWTFIGLLILFLITSVIAQISLTALGHKFVYLMRKQLVKQLLDTGTEQLNQIGKARLLASLSGDIRNITFAFVRLPELVQGSILVLCAGAYMFYLSESLFFVTALWLSVTVWVSNIAVRRVYHHLRIVRETEDKLYKNYQSAIEGHKELSLNRERAKFYFERELEESASTQRDNSVRADSYHAFANNWTNVMVLGAVGLVFYLSLAEGWSNLETATTIALTILFLRTPLISAVGALPMLLNAKVALDKLSKLNLAPYTEDFAISNPLPRDWKEIRFENVTYSYPTAEGTMSFALKPVNLTIKRGELIFLIGKNGSGKSTFSMLLAGLNHATDGKIFVDNIEITAANQRAFRAQISAVFSDFYLFTQLLGQAGFASLKEAGQWLETLQLENKVTVENHRLSTTNLSQGQRKRLGLLIALLEHRPLLILDEWAADQDPTFRRTFYQVLLPLLREKGHTVFAISHDDSYFHLADRLLLISQGELRELFGEERETASHDAVEKLNNIIKETKI

SEQ ID NO: 34633 - DNA, 2019 bp, Bacillus licheniformis DSM 13
  CDS (1)..(2019)
atgacaacaggaaaaaggcttttccaatatgcgcttctttataaaaaaattctcatctgggcgctcgtcatgctgacgatcgccgtcacagccgagctgactgggccgatgatcgccaaaaagatgatcgacgatcatattctcggaattgaaaaaacgtggtatgaaacgacagagaactcgaaatatactgtttcctacaaaggaaaggaatatatcagggaagacaggacagacccttcagctgaaaagctgcaggaagttcacatctttcaagtcggtatgaactactactttgtggggaaaccggtttcctttgacggggagcggacggtttccgggggagagctgagaatgacgagcggagaccggacggaaacctacaaggccgatcgcctgtctttgtctgaagtgtatgctttttacgagcctgaaataggagggctgatctcgctcgtttctatttatttcggccttctcattttctcgatctttttccattacggccaattctacctcttgcagatgagcgcaaaccgcatcattcaaaagatgagacaggatgtattcgccaacattcaaaggcttcctatccgctattttgataatttgccggcaggaaaaatcgttgcaagggtaacgaatgataccgaagcgatccgcgatctgtatgtgaccgttctttcgacgtttgttacaaatatcatttatatggccggaatattcgccgcactgtttttccttgatgtcaggctggccggcgtctgtctgttgattgtgcccctgattgtcatttgggctgctgtttatcgaaaattcgcttcaggctacaatcataaacttaggtcaatcaacagcgagatcaacgccaaaatgaatgaatcgattcaaggcatgacgattattcaggcattccggcgcggacaggacacaaaagaagaatttgaacagctgaatgacagccactttcattaccaaaataaaatgctgaaattaaactcgcttatgtcccacaacttggtcaacattctgagaaatgtgatgttcaccgctctaatatggtatttcgggggagctgccctgaacgcggaaggaatgatttcaatcggcgtactctatgcattcgtcgattacttgaatcgtttatttcagccgattacgggcatcgtcaaccagtttgccaagcttgaattggcgcgcgtatcatcggagcgggttttccgcctgctggatgagccgggcgtcgatgtcaaagagccgagcagcgaaagagcgcgggggcgagtcgtgtttgaggatgtatcatttcgctatcatgacggtgaagatgtgctgaaaaacatctcatttgaagcgaagcaaggggagaccgttgcattggtcggtcatacgggctcaggcaaaagctcaatcatgaatgttcttttccgcttttacgatattgaaaagggcgatgtcaaaatcgacggcagaagcatatatgatatgtcaaggcaggaaatcagaaagcatatgggcatcgttctccaggatccttacttattttccggcacgattgcttcaaatgtcagccttgacaatgctgatattactagagagcaaatagaagacgccttgaaacaggtcggggctcttgaggtgctcgcccgtctgccgaaaggccttgacgagccggtcatcgaaaaaggaagcaccctttcttcaggagaaaggcagctgatctcgtttgcccgtgcgctggcatacgatccggctattcttattttagacgaggcgacggcccatatcgataccgaaacagaagcggtcattcaaaaagcgcttgacgtcgtcaaacaagggcgcacaacctttatcatcgcccacaggctgtcaacgatcaaaaacgccgaccagattctggtgcttgaaaaaggccggattatcgaaaggggaaatcatgaagagctgatgaagcaaaaaggccaatactatcaaatgtatgaactgcaaaaggggaaaggaaccctgatagggtaa

SEQ ID NO: 34634 - protein, 672 aa, Bacillus licheniformis DSM 13
MTTGKRLFQYALLYKKILIWALVMLTIAVTAELTGPMIAKKMIDDHILGIEKTWYETTENSKYTVSYKGKEYIREDRTDPSAEKLQEVHIFQVGMNYYFVGKPVSFDGERTVSGGELRMTSGDRTETYKADRLSLSEVYAFYEPEIGGLISLVSIYFGLLIFSIFFHYGQFYLLQMSANRIIQKMRQDVFANIQRLPIRYFDNLPAGKIVARVTNDTEAIRDLYVTVLSTFVTNIIYMAGIFAALFFLDVRLAGVCLLIVPLIVIWAAVYRKFASGYNHKLRSINSEINAKMNESIQGMTIIQAFRRGQDTKEEFEQLNDSHFHYQNKMLKLNSLMSHNLVNILRNVMFTALIWYFGGAALNAEGMISIGVLYAFVDYLNRLFQPITGIVNQFAKLELARVSSERVFRLLDEPGVDVKEPSSERARGRVVFEDVSFRYHDGEDVLKNISFEAKQGETVALVGHTGSGKSSIMNVLFRFYDIEKGDVKIDGRSIYDMSRQEIRKHMGIVLQDPYLFSGTIASNVSLDNADITREQIEDALKQVGALEVLARLPKGLDEPVIEKGSTLSSGERQLISFARALAYDPAILILDEATAHIDTETEAVIQKALDVVKQGRTTFIIAHRLSTIKNADQILVLEKGRIIERGNHEELMKQKGQYYQMYELQKGKGTLIG

SEQ ID NO: 34635 - DNA, 1836 bp, Bacteroides fragilis YCH46
  CDS (1)..(1836)
atgaaggaattctttcaactcatgcggcggtttgtgtcgccttacaagaaatttctgggatgggctgtattcttaaacttgctgtcggctgtttttaatatattttcgtttactttattgattccgattcttcagattctttttaagatggacaataaagtctatgagtttattccttgggatgctgcgggagagggcttgaaggacatcgctgtgaataatttctattattatgtgactcggatgattgaaataaacggtccttctcttacattgctgtttttgggtttgttcctggcattcatgactttattgaaaacatcgtgctattttgcttcttccgcagtgatgattcctttgcgtacgggagtcgttcgtgatatccgcatcatggtttattctaaagtgatgagtttaccattgggtttcttttcagaagagcgcaagggagacatcattgcccgtatgagtggtgatgtgggtgaggttgaaaactcgattacaagttcattggatatgttgatcaagaatccgattctgattgtcatgtattttggaacgttgattatcaccagttggcaactgactttgtttacattgttagtggttccgggtatgggatggatcatgggtaaagtaggtaaaaaattaaagaggcaatcacttgaggcgcaggctaaatggagtgatacgatgtctcaacttgaagaaactttggggggactccgtattattaaggcttttatcgccgagcaaaaaatgataaatcgttttacggaatgtagtaatgagtttcgtgacgctaccaatagggttgccatgcgtcaggcattagcgcatccgatgagtgaattcttgggcacattgcttattgtggttgtattgtggtttggcggatcactgatattaggaaatcactcttccattgatgctcctacatttatcttttatatggtaattctttatagcgttatcaatcccttgaaggaattttcgaaagccggatataatatccctaagggactggcttctatggagcgtgtcgataagatactgaaagcagaaaataagattgtggagattccgaacccgaaaccgttgaatgggttggaagaacaagttgagttcaaagatatttctttcagttatgatgggaagaaagaagtacttcaacatattaacctgactgtacccaagggtaaaaccgttgctttggttgggcagtccggttcaggaaagtctacgttggtagatttattgccacgctatcacgatgtgcaggaagggacgattactatagacggagtcaatatcaaggatgttcgtatctctgatttgcgcagcctgataggaaatgtcaatcaggaagctattttgttcaatgatacattcttcaataatattgctttcggcgttgagaacgcgactatggagcaggtgattgaggccgccaaaatagccaatgcacacgattttatcatggagaaagaagacggttaccatactaatatcggtgaccggggcagcaagctctccgggggccaacgccagcgtatcagcatagcccgtgccatcttgaagaatcctcccattttgattcttgacgaggctacttccgctttggatactgagtcagagcgtttggtacaggaagcgctggagcgtttgatgaaaacacgtacgacgattgctattgcccaccgcctctctaccatcaaaaatgcagatgaaatttgtgtgctgtacgaaggggaaattgtagaacgcggaaaacacgaagaattattggctaaaaacggatattataaacgactgaatgatatgcagtcactatag

SEQ ID NO: 34636 - protein, 611 aa, Bacteroides fragilis YCH46
MKEFFQLMRRFVSPYKKFLGWAVFLNLLSAVFNIFSFTLLIPILQILFKMDNKVYEFIPWDAAGEGLKDIAVNNFYYYVTRMIEINGPSLTLLFLGLFLAFMTLLKTSCYFASSAVMIPLRTGVVRDIRIMVYSKVMSLPLGFFSEERKGDIIARMSGDVGEVENSITSSLDMLIKNPILIVMYFGTLIITSWQLTLFTLLVVPGMGWIMGKVGKKLKRQSLEAQAKWSDTMSQLEETLGGLRIIKAFIAEQKMINRFTECSNEFRDATNRVAMRQALAHPMSEFLGTLLIVVVLWFGGSLILGNHSSIDAPTFIFYMVILYSVINPLKEFSKAGYNIPKGLASMERVDKILKAENKIVEIPNPKPLNGLEEQVEFKDISFSYDGKKEVLQHINLTVPKGKTVALVGQSGSGKSTLVDLLPRYHDVQEGTITIDGVNIKDVRISDLRSLIGNVNQEAILFNDTFFNNIAFGVENATMEQVIEAAKIANAHDFIMEKEDGYHTNIGDRGSKLSGGQRQRISIARAILKNPPILILDEATSALDTESERLVQEALERLMKTRTTIAIAHRLSTIKNADEICVLYEGEIVERGKHEELLAKNGYYKRLNDMQSL

SEQ ID NO: 34637 - DNA, 1746 bp, Burkholderia pseudomallei K96243
  CDS (1)..(1746)
atgaccgatgccaccgggcgtctcgacgccccgccctcgaccgattcccgccccgccgtgaaacacgcgcggcgcctgatagtcgcgctgctcaagcgctcccgcggcgcgttcgcgatcgcgctcgccgcctgcgtgctgaacggcgcgtcgagcgtgctgctcgtcgcgacgctaagccgcgcgctctccgagccgcaagccgccgacgcgtcgctcgcgtggcgcttcggcctgtgcgcggtgatcgcgctcgtcacccggatcgtcaccggcgtgctgttcgcgcggctgtcgcaggacacgatggcgcaactgcgcgagcacgtcgcgcggcgcgtcgcggcggccgagctgcaggacgtcgagcggatcggcgcggcgcccgtgcagtcggtgctgaccgacgacgcgaccaacgtgtcgatgctgttcttcgcgctgcccaatctcgtgatgcacggctcgatcgtgttcggctgcctcggctatctggcgtggctgtcgtggcccgtgtgcctgctcgcggtcgccgcgatcctcgtcggctcgctcggctatcacgcgggcgacaagcgcgcgatcgcctggctcgaggacgcgggccgctcgcaggacaagctgttcggctatctcggcgcgctcttttccggcgcgaaggagctcaagctgcatcaggcgcgctcgcgccagttcgtcgacggccagctcggcgcggcgatcgccgaggtgcgcgaccaccgccgccgcgcgttcagcgcgtatgcgatcggcgtcggctggatcgtgttcctgttctacgtgttcctgggcgtcgcggcgttctggcccgcgctcggcgtgcgcggcgacgggcccgcgacgtccggctacgtcgtcgtgttcctgttcatgctgctgccgctcgacggcctgctcaacaacgtgccgacgctgaacgcggcgcgcgtgtcgctcgagcgcatcgagaagctgatggcgcagttcggcgcgctgcgcaccgcgccgccgccggacgaaaacgcgtcgcacgagccgttcgacacgctcgcgctgcgcggcgtcacgcattcgtatttccacgaacgcgacgagcggatgttccgcgtcgggccgatcgacctgacgctcaagccgggcgagctcgtgttcatcgtcggcggcaacggcagcggcaagacgacgctcgcgaaggtgctcacgggcctgtacgagcccgagggcggcgtcatcgagctcgacggcaagccgatcggccttgccgagcgcgccgcgtaccgcgagcgcttctcggcggtgttcaacgatttccatctgttcgacgcgctgctcggcatcgtcgatccgaacgacgcggcgcgcgcgcaggccgacgcgcgcgcgaacgcgctcgtcgcgaagctctcgctcgatcacaaggtgcaggtcgtcgacggcgcgttctccacgcgcgcgctgtcgaccgggcagcgcaagcggctcgcgctcgtcgtcgcgtatctggaggaccggccgctctacctgttcgacgaatgggcggccgaccaggaccccgcgttcaaggcggtgttctacgaacagcttctgccggagctgcgcgcgcgcggcaagacggtgatcgtgatcagccacgacgatcgctacttcccgatcgcggaccgggtgctgaagctcgacaacgggatcatcgtcagcgagacgttcggcgcgcggcacgcggcgctcgcgaacggcaccgaggggtga

SEQ ID NO: 34638 - protein, 581 aa, Burkholderia pseudomallei K96243
MTDATGRLDAPPSTDSRPAVKHARRLIVALLKRSRGAFAIALAACVLNGASSVLLVATLSRALSEPQAADASLAWRFGLCAVIALVTRIVTGVLFARLSQDTMAQLREHVARRVAAAELQDVERIGAAPVQSVLTDDATNVSMLFFALPNLVMHGSIVFGCLGYLAWLSWPVCLLAVAAILVGSLGYHAGDKRAIAWLEDAGRSQDKLFGYLGALFSGAKELKLHQARSRQFVDGQLGAAIAEVRDHRRRAFSAYAIGVGWIVFLFYVFLGVAAFWPALGVRGDGPATSGYVVVFLFMLLPLDGLLNNVPTLNAARVSLERIEKLMAQFGALRTAPPPDENASHEPFDTLALRGVTHSYFHERDERMFRVGPIDLTLKPGELVFIVGGNGSGKTTLAKVLTGLYEPEGGVIELDGKPIGLAERAAYRERFSAVFNDFHLFDALLGIVDPNDAARAQADARANALVAKLSLDHKVQVVDGAFSTRALSTGQRKRLALVVAYLEDRPLYLFDEWAADQDPAFKAVFYEQLLPELRARGKTVIVISHDDRYFPIADRVLKLDNGIIVSETFGARHAALANGTEG

SEQ ID NO: 34639 - DNA, 1854 bp, Nocardia farcinica IFM 10152
  CDS (1)..(1854)
gtgacgatgggtggtaccgcagcagagctccgaacggacgaggccacaccgccaccgtcggcatccgcggagtcgaccgcggtgtcccccggtagcgcgctgttccgggtgaccgagccggtccgcggacggctgaccgcgtcgctggccatcgccgcactgggtggcgcggccggggtgaccgggttcgtgggaacggcactggcgctgggggagttgttcgacgccgacacgcggaccggcaccgtggtggccttcctggtgttggccgcggccggattcctcgcccgattcgccctgcgtgcctggtcgttcctgctctcgcatctggcatcgttcgacctcgagcagcgtctgcgcagcgatctggccgcacacctgggccggatgccgttgggggaggcgcagcgccttggctccggcgcggtgaagaagatcgtgcaggacgacgtgcgcggcctgcacatggcggtcgccgacgccgtgccgctggccgggttcaccctggcccagcccgtcgcggcgctggtggcgctgggcctggtggactggcggctgctgctggcggtcgcgctgttcctgccggtggtgttcgtcgggatgcagctcagcctgcgcgactacgtcgagacccgccgccgctacgacgaggccaacgaggccatcaacgcggccacggtggaattcgtgcagggcatgccggtggtgcggaccttcgacgacggcacggtctcgttccggcgcttcgtcgaccgggtgcggcagttcaacttcgcgaccaccaactggcagaacaacaaccgcagcgcgatgatcttcgccaacctgacggtcgcgccgctgccgaccatcgtgatcgtgaccgcggtcggcatctggctcacctcgaccgggtcgatgtcgcccgcgcaactgatcgccgcgatcctcatcggcaccctcccggtggaatcggtggtcccgttgatgaacctgtccaacctgctcaacgactccaaggcaggcgcagcccgcatcgtcgaactgctcgacatcgagccgctgccggagcccgcggacccgcagactccggccgacggatccatcgaattccgttccgtccgtttctcgtacccgggagcggaccggcccgcgctggacggggtggacctgacgatcccgagcggcagtgtgtgcgcgctggtcggctcgtccggctcgggcaaatcgacggtcgcccggctcatcccgcggttctgggacgtcgattccgggcaggtcctcgtcggcggggtggacgtccggcagatcgcgtcgcaggacctgctcgccaccctggcgatggtgttccaggagccgttcctgctctccgacaccgtggccgagaacatccggctggcccggccgtcggccaccgacgccgaggtcgaggccgccgcgcgggccgcccgcgcccacgacttcatcgtctcggaactgccgcgcggctacgacacccaggtcggtgagcggggcgcccggctctccggcgggcagcgccagcgcatcaccatcgcacgtgccctgctcgcggacgcgccgatcgtcgtcctcgacgaggcgacctccttcgccgacccggagaacgaagcggcgatccaggacgcgatcgccgaactcacccgcggccgcaccgtgctggtggtggcgcaccggctgtccacgatcgtcgacgcggaccgcatcgtggtgctggaatccggccgggtcgccgaatccggcacgcacaccgaactgctcgccgccggcgggcgctatgcccggctctgggaacaccacgagcgcgcccgcggatggggtctcggcagctcgaccaaggaggccatgcgccgatga

SEQ ID NO: 34640 - protein, 617 aa, Nocardia farcinica IFM 10152
MTMGGTAAELRTDEATPPPSASAESTAVSPGSALFRVTEPVRGRLTASLAIAALGGAAGVTGFVGTALALGELFDADTRTGTVVAFLVLAAAGFLARFALRAWSFLLSHLASFDLEQRLRSDLAAHLGRMPLGEAQRLGSGAVKKIVQDDVRGLHMAVADAVPLAGFTLAQPVAALVALGLVDWRLLLAVALFLPVVFVGMQLSLRDYVETRRRYDEANEAINAATVEFVQGMPVVRTFDDGTVSFRRFVDRVRQFNFATTNWQNNNRSAMIFANLTVAPLPTIVIVTAVGIWLTSTGSMSPAQLIAAILIGTLPVESVVPLMNLSNLLNDSKAGAARIVELLDIEPLPEPADPQTPADGSIEFRSVRFSYPGADRPALDGVDLTIPSGSVCALVGSSGSGKSTVARLIPRFWDVDSGQVLVGGVDVRQIASQDLLATLAMVFQEPFLLSDTVAENIRLARPSATDAEVEAAARAARAHDFIVSELPRGYDTQVGERGARLSGGQRQRITIARALLADAPIVVLDEATSFADPENEAAIQDAIAELTRGRTVLVVAHRLSTIVDADRIVVLESGRVAESGTHTELLAAGGRYARLWEHHERARGWGLGSSTKEAMRR

SEQ ID NO: 34641 - DNA, 1812 bp, Nocardia farcinica IFM 10152
  CDS (1)..(1812)
atgcaactcctccgatttctcgtatcgatctcctgggcgcgcatcgtcgcggtcgtcgccgcgggcctggtgtgcggtgcggcgaacacctatctggtcaccctgatcaacggggtggtctcgcccgcgccgcatccgcgggtcaccctggcgcagttcgcgctcaccgggctggtggtgctggtcagcggcctgctgtcgcaggtgctgctgatccggttggcgcaggacgccatctaccggctgcgggccgacctgagttcgagcgtggtggccgcgccgctcgagcatctggaacggctcggcacgcaccgcctggtggccaccctcaccgaggacgtgcgggcgctctcccaggcggtgacggcgattccggcgatctgcatcgacgtggcgaccatcatcggctgcttcgtctacctcgcgatggtctccggaccgatcttcgcgatcaccatcgcgggcacgctgctcggggtcgcctgcgtcgagctgttcctcggccgggtgcggcgcatctaccgtgacgccagggagaacgaggacgcgctgctgcgttcgttccagtcggtcaccctggggatcaaggaactcaagctgcaccgcggcaggcgccgcgacttcatggaccggcacctgctcggcgccgcccgcgacctgcgcacgcagaacgtcgacgccggctcgaagttctcggtggcccaggggctcggccagctgctgcaactggcgacgatggcgctgatcctgttcgcggtggccgccgcgatggacctgccgcgcgaggtgatgatcggctacgtactggtgaccacgttcctggcgatgccgatgcagaacttcatgcaccgcatcccggacctgctgcgcggcgacgtggcgctggccaagatccgcgcgatgaacctgtcgctggagaccatgcacgacgaggagcagctgccctacgcgcagcgtcccgccgtcgagtcggcgcggctcgagctcgccggggtggagtacagctaccggcaggacgcgccgccgcagttcccgccgggcccgcccggaccgcatcccggcggcaggccgccgctgccgccgcccggcgccggcgggctgccgccgcagggtccgcccgacgtgaacggtcatcgcacggtcagccacgcgggcgccgacggcagaccggtgccgctcggaccgccgccgcccggcgccgaggacgagtccggcttccggctcggcccggtggatctggtgttcgagccggggcagatcaccttcgtggtcggcggcaacggcagcggcaaatccacgctggccaagctgatcaccggactgtatgtgccgcgcgcgggcacggtgcgactcaacggcgagccgatcgatcaccagaacatcgagtggttccggcagaacacctcggcggtgttcaccgacttccacctcttcgaggagtacctcgggttcgacggccctggtgtcgacgacgaggtgcggcggtacctgcgcgagttgcggctcgacgacaaggtgacggtgcgggacgggaagctctcgaccgtggcgctgtcgcagggtcagcgcaagcggctcgcgctgctgacggcactgctggaggaccggccgatctacgtgttcgacgagtgggcggccgatcaggaaccgaagttccgcgaggtgttctaccgggagatcctcgacgggctcaagcggcgcgggaagacggtcatcgtcatcacccacgacgaccggtacttcgaccgcgccgaccggctggtgaagctggatttcggccgggtggtggatccggtcaccgtgcccggctga

SEQ ID NO: 34642 - protein, 603 aa, Nocardia farcinica IFM 10152
MQLLRFLVSISWARIVAVVAAGLVCGAANTYLVTLINGVVSPAPHPRVTLAQFALTGLVVLVSGLLSQVLLIRLAQDAIYRLRADLSSSVVAAPLEHLERLGTHRLVATLTEDVRALSQAVTAIPAICIDVATIIGCFVYLAMVSGPIFAITIAGTLLGVACVELFLGRVRRIYRDARENEDALLRSFQSVTLGIKELKLHRGRRRDFMDRHLLGAARDLRTQNVDAGSKFSVAQGLGQLLQLATMALILFAVAAAMDLPREVMIGYVLVTTFLAMPMQNFMHRIPDLLRGDVALAKIRAMNLSLETMHDEEQLPYAQRPAVESARLELAGVEYSYRQDAPPQFPPGPPGPHPGGRPPLPPPGAGGLPPQGPPDVNGHRTVSHAGADGRPVPLGPPPPGAEDESGFRLGPVDLVFEPGQITFVVGGNGSGKSTLAKLITGLYVPRAGTVRLNGEPIDHQNIEWFRQNTSAVFTDFHLFEEYLGFDGPGVDDEVRRYLRELRLDDKVTVRDGKLSTVALSQGQRKRLALLTALLEDRPIYVFDEWAADQEPKFREVFYREILDGLKRRGKTVIVITHDDRYFDRADRLVKLDFGRVVDPVTVPG

SEQ ID NO: 34643 - DNA, 1713 bp, Photobacterium profundum SS9
  CDS (1)..(1713)
ttggtggtgatgtctatcttaagcgcgctaattgcgatagcagaagtcaccttgctacgttatatgggtgaacttgtcgatattttaagcactcaagatcgtatcaccttctggcttgatcagggcgatcagataaaaacgatgctatttctggtggctgtcatcatgcctgttttgggcttttttcattcgatgatcatgcatcagactttgcttggtaattacccaatgtctattcgttggtcggtgcaccgctacttgcttaagcaaagtgttggatttttccagcgcgattttgctggtcgtgttgcaacgaaagtgatgcaaagtgcgcttgccgtgcgtgaaactgtcatgaagttgatggatgtattgatatacatttcagtctactttatctcgatgatttggatgatgggtgagtcggacatgttactgatgttaccgattgctatttggcttatttgctatgtatttattcagctgtattttattccgagaatgaaaaaagtcgccatagatcaggcggatgctcgttctatcatgacaggaagaatcgtagatagttacaccaatatcacaacagtgaagctgtttgcgcattctcaacgagagattgattacgcagaaagtagtttgaagcagtttcttaaaaccgtgtatcgccagatgcgcatggtaacttgcttgttattcagtgttgacgctattaactacttactgcttttctccatcgcggccttatctgtcacgctttggttggatgaagcagtgactgtcggtgtgattgccgtagctatcagcattgcgctgagagttcagggcatgtccaaatggattatgtgggaagtgagtgcgttgtttgagaatattggtacggttgtagatggtatgaataccatttctaacgatgttgaaattaaagatgtaccaaatgcagaatcactcgttgttaatgaaggtgcaattcacttcaatcatgttggttttaactacaatgatgacaagcaagtattcgagaaccttaacttagtacttaagccgggtgaaaaagtcggtattgtagggcgttctggtgctggtaagtcgagcttggtgaacttgcttctgcgattctacgatattcaatctggtaccataagcatcgatggtcagaatattgctgaggttagccaagagtctttgcgtaaacaaattggtatgatcactcaggatacttctttgcttcatcgctcaattcgagaaaacattttgtatggcgatccggatgccaacgaacaagcgttgatcaatgctgctcaacaggctcatgcacatgactttatcgcagatctaaaagatgaacagggcaacattggttacgacgttgaagttggagaacgcggcgttaagttatctggtggtcagcgtcaacgtatagccatcgctcgcgtattgttaaaaaatgctcctatcctaatcatggacgaagcaacgtctgcgcttgattcagaagttgaatcagctattcaggaaaaccttgaagcgttaatggaaagcaaaacagtgatcgcgatagcccaccgtttatcaaccatagcggctatggacagattaattgtgatggacaacgggcaagtggtagagcagggaacacaccaagaattacttgaaaaacaaggcatctattcgcagttatgggcgtaccaaacgggtgggtttttagcagagtaa

SEQ ID NO: 34644 - protein, 570 aa, Photobacterium profundum SS9
MVVMSILSALIAIAEVTLLRYMGELVDILSTQDRITFWLDQGDQIKTMLFLVAVIMPVLGFFHSMIMHQTLLGNYPMSIRWSVHRYLLKQSVGFFQRDFAGRVATKVMQSALAVRETVMKLMDVLIYISVYFISMIWMMGESDMLLMLPIAIWLICYVFIQLYFIPRMKKVAIDQADARSIMTGRIVDSYTNITTVKLFAHSQREIDYAESSLKQFLKTVYRQMRMVTCLLFSVDAINYLLLFSIAALSVTLWLDEAVTVGVIAVAISIALRVQGMSKWIMWEVSALFENIGTVVDGMNTISNDVEIKDVPNAESLVVNEGAIHFNHVGFNYNDDKQVFENLNLVLKPGEKVGIVGRSGAGKSSLVNLLLRFYDIQSGTISIDGQNIAEVSQESLRKQIGMITQDTSLLHRSIRENILYGDPDANEQALINAAQQAHAHDFIADLKDEQGNIGYDVEVGERGVKLSGGQRQRIAIARVLLKNAPILIMDEATSALDSEVESAIQENLEALMESKTVIAIAHRLSTIAAMDRLIVMDNGQVVEQGTHQELLEKQGIYSQLWAYQTGGFLAE

SEQ ID NO: 34645 - DNA, 2067 bp, Photobacterium profundum SS9
  CDS (1)..(2067)
atgcaattgcctgctgagttaatcttttataaaacgcgttcttattttccatggcttactccctatatagccgttaatatagctctcccaccaataataggaatcattatcattgtgaaagattctgtaaaccaaacaattaactggtcttggcttctaaagcaagcaaaacgtcaccgcccaagacttgtcgctgcaaatattattgctctcatagcaactctggttagcgtgccaatcccacttctaatgccattaatggttgatgaagtattacttgataaaccggctgatggggtcaaattcttaaatttattactgcctgagtcacttcatgacgcaacgggttacatcttaatggtgttgttccttgttatattgatgcgcgtagcaggtcaagcgcttaatatactgcaaagtcggcagtttaccctcgtcgcaaaagatataacttataacttacgtggtcacctcctcgataaactgggccgcatcagtatgcgtcaatatgaggaaagaggcagtggtggtattacgtcacatctgattacagacgtcgaaaccatcgataaatttataggtgacacattaagccgctttttaatcggtctattaacagtaattggtacagccgttattctgctttggttaaattggcagcttggtttactgattctgcttgttaaccctgtggtggtttacgcttctcggttaatggggaaccgtgtaaaaaacctgaagaagaaagaaaaccaagcatttgaaaagttccaacaacgccttgttgaaacgcttgagggtctataccagttacgcgcatctaaccgtgagcgtgaatttctggcccaattaaaatcgaacgcgaatgacatccgtcacaatgcggataaatacgcttggcaatcagaagccgcgggtcgcgtttcctttctactctttttattaggctttgagttattccgcgctgctgcaatgttgatggtgctgttcagtgatttatctattggtcagatgtttgccgtgtttggttacctatggtttatgttgggtcccgtacaagagttattaggtattcagtttgcttggtacagtgcttcagctgcgatgcaacgtttaaacaacttattggtattagaagaagaagtgcgtccaacaccaaaagtgaaccctttcgtcgacggtgaaacattacagatagaagttaaaaagctacatttcgcctacgatgaagataaggaagtattacacgatctgaatttagttatccctgcagggaaaagagtggcgttagtcggctcttcaggcggcggtaaatcaacgttgattcaattgctattgggtatttatcaaaaaaatactggggatatcttaattaataaccaccctattgaagatgttggttacgacaatcttcgaaacaagatggcggtggtattacagcaccctgtgttatttaatgatacgttaaggcagaatttaacgttaggtgctgattatacagatgaacaattgtggttagcattagatatagcccaattaaccgatgtcactgagcgcctaaccaatggcttagacactgaaattggccgtcaaggtattcgcttatcaggtgggcagcgacaacgtcttgctattgcacgtatggttttgtctgatcctgagtttgtcatacttgatgaggcaacatcagctttagatacagcaacagaagctgcgctacatactgctttgaatgaatttttagttggcaaaacaacactgattgttgcccaccgtttatctgcggttaagcaagctgatttaatatacgtgcttgaagatgggcaagtaagtcagacaggtacgcataaagaacttgttaatgagaaaggcttataccaaactttatatggttcagtgcaatcacctgatgaaaaacatcaatcagtgttggtttcagacatgatcaataacagcaccaatgaaagcggtcaagaaacgcacaactcacaagttattgatcataaaaagcttgatggtaataccagtgaagataacttggcagtagccagaatgaactcaaaataa

SEQ ID NO: 34646 - protein, 688 aa, Photobacterium profundum SS9
MQLPAELIFYKTRSYFPWLTPYIAVNIALPPIIGIIIIVKDSVNQTINWSWLLKQAKRHRPRLVAANIIALIATLVSVPIPLLMPLMVDEVLLDKPADGVKFLNLLLPESLHDATGYILMVLFLVILMRVAGQALNILQSRQFTLVAKDITYNLRGHLLDKLGRISMRQYEERGSGGITSHLITDVETIDKFIGDTLSRFLIGLLTVIGTAVILLWLNWQLGLLILLVNPVVVYASRLMGNRVKNLKKKENQAFEKFQQRLVETLEGLYQLRASNREREFLAQLKSNANDIRHNADKYAWQSEAAGRVSFLLFLLGFELFRAAAMLMVLFSDLSIGQMFAVFGYLWFMLGPVQELLGIQFAWYSASAAMQRLNNLLVLEEEVRPTPKVNPFVDGETLQIEVKKLHFAYDEDKEVLHDLNLVIPAGKRVALVGSSGGGKSTLIQLLLGIYQKNTGDILINNHPIEDVGYDNLRNKMAVVLQHPVLFNDTLRQNLTLGADYTDEQLWLALDIAQLTDVTERLTNGLDTEIGRQGIRLSGGQRQRLAIARMVLSDPEFVILDEATSALDTATEAALHTALNEFLVGKTTLIVAHRLSAVKQADLIYVLEDGQVSQTGTHKELVNEKGLYQTLYGSVQSPDEKHQSVLVSDMINNSTNESGQETHNSQVIDHKKLDGNTSEDNLAVARMNSK

SEQ ID NO: 34647 - DNA, 1854 bp, Photobacterium profundum SS9
  CDS (1)..(1854)
atgtacaaacgctttgaaaaactgacctcagcttttcctaaacaggatcctgatcaaccaccagcaagtctgtttgctttttgccgccactacaccaaagggtttgaactcccactcattgcgatgtcattactcagtgctgttatcgcagtggtagaagtgtctctatttggttttatgggacaactggtcgattggctaacacaacataaccccgacacttttattgccgaagaaggtggaaagctcattgtaatgagtctgattgtgctggttgttgtgccttcactggtttttctacattcattgttactgcatcaagcattattgggtaactacccaatggctattcgttggctagcacaccgttacctgttaaaacaaagcgtgtcattttatcaaaatgattttgctggtcgaattgccactaaagtcatgcaaacgtcattatcggtacgagaaacggtaatgaagttactggatgtattggtctatatttcggtgtatttcaccgcgatggtggtgctgattgctcaatcagattatcgtctaatgataccaatgctgttgtggcttgctgcttatgtcggtattcagctgtatttcgtacccaagctaaagacagtatcaaccgaacaagctgatgcacgttctaccatgacaggacgcattgtcgacagctataccaatattcaaaccgttaagttattttcacattctgatcgtgaaaccgaatacgcagaacaaggaatgaaaggctttcttgacactgtacatcgccaaatgcgcctcgttacagggttaaatattaacgtagagatcatcaattacctgcttgtgttctctattgctggtcttgctatttggctatggacaatctctgccgtcactattggggcaatcgctgtcgcagtaagtttggcattacgtatcaatggcatgtctaaatggattatgtgggaaattggtggtctgtttgaaaatatcggcaccgtcattgacggtatgcgtacgttatctaaacctgttgatattaccgataaaaaagacgcaccaacacttgctgtaaacaatggtggtattcactttgacgatgttaatttccattacggtgaaaaatcaggggtgattgaaaagctgaacctcaatattaaaccgggcgaaaaagtagggttagtcgggcgctctggcgcaggtaaatccactatggttaacctgttaatgcgctttcacgatgtcgaatctggctctatcagtattgatggtcaaaacattgcacacgtgacgcaagattcactccgcgcacaaattggtatggttacgcaagatacatcattgttgcaccgctctattcgtgaaaacattatgtatggtaaccctaatgcaacggaagaacagttgctcgcggcaaccaaacaagcccatgcgcatgagtttattggctcgctatcagacccatacggtaatactgggtatgatgctcaagtcggtgaacgtggtgtgaagctttcaggtggtcaacgccaacgtattgctatctctcgagtactattgaaaaatgcccctatcttactgctagatgaggcaacttcagcattagattcagaagtcgaagcagccattcaagaaagtctgtatgaactgatgcaaggtaaaaccgtgattgccattgcccaccgtttatcaaccattgccgcaatggaccgtcttatagtgctcgataaaggtgaaattgcggagcaaggaacacatcaggaattgattgctcaaaaaggtatttatgctcaattatgggcgcatcaaaccggtggttttattggtgatgaaacttccaatttaaaagcaacaagatag

SEQ ID NO: 34648 - protein, 617 aa, Photobacterium profundum SS9
MYKRFEKLTSAFPKQDPDQPPASLFAFCRHYTKGFELPLIAMSLLSAVIAVVEVSLFGFMGQLVDWLTQHNPDTFIAEEGGKLIVMSLIVLVVVPSLVFLHSLLLHQALLGNYPMAIRWLAHRYLLKQSVSFYQNDFAGRIATKVMQTSLSVRETVMKLLDVLVYISVYFTAMVVLIAQSDYRLMIPMLLWLAAYVGIQLYFVPKLKTVSTEQADARSTMTGRIVDSYTNIQTVKLFSHSDRETEYAEQGMKGFLDTVHRQMRLVTGLNINVEIINYLLVFSIAGLAIWLWTISAVTIGAIAVAVSLALRINGMSKWIMWEIGGLFENIGTVIDGMRTLSKPVDITDKKDAPTLAVNNGGIHFDDVNFHYGEKSGVIEKLNLNIKPGEKVGLVGRSGAGKSTMVNLLMRFHDVESGSISIDGQNIAHVTQDSLRAQIGMVTQDTSLLHRSIRENIMYGNPNATEEQLLAATKQAHAHEFIGSLSDPYGNTGYDAQVGERGVKLSGGQRQRIAISRVLLKNAPILLLDEATSALDSEVEAAIQESLYELMQGKTVIAIAHRLSTIAAMDRLIVLDKGEIAEQGTHQELIAQKGIYAQLWAHQTGGFIGDETSNLKATR

SEQ ID NO: 34649 - DNA, 1746 bp, Lactobacillus gasseri
  CDS (1)..(1746)
atgatgaataaaaaattttcttggaaaaatgaacggtgggtaaagccctacctagcacaatataaatggaattttattctagcaatttttctcggcgttgtgatgttcttttgtggtggagccttgatgttttatgccggctataccatcgataaagccgctacgcgtccagaaaacattttgatgatttatgttcctatagttttaatgagagctgttggtattggacggcctttatttagatatttagaacgtctggtatcccacaactggattttacgcgttactagttctttgagaagacgcctcttttatattgctgaaagaaatacctcggctgttggctcaagttttcaaacaggcagcattttatcactgttgactgatgatattggacacttgcaaaatctttatttaagaactattttcccggcaattttaagttacttagttggctttatcgttgtaattttattgggacttttttcctggcctctagctggagtaatcgcaattttattagttgcggaattagtattggttcccttcttttctcttttaaagcaagctgctgttcgcactaaggaaaaagaagaaaaagcgcagctttacactgaatttactgatcaagttttaggcgctggtgactggaaaatttctggtagacgggatgcttttttcaatcaaactaaaggaactttaaaatctttaggacaatatgaaaagaagtctggaaaatttgattgggctagagactttggtcttgaatttatttttggcttgatggcagttgccctcctttatttcacgaaccaaactcttaccaataatcaagaagcagcaaattatgttggagcagttgtcttagctctctttcctttatcagatgcctttattccagttggacaaggaattgaagaatggcatacatatagtgattctgtaaaacacttaaatgaattaaaagtaccagagaaccgtttacctgcccaacaatattttgatcctgcttttgctggcactttaagagtttcaaatatttcatttacttatcctggagaagactatccaattattcaaaacttttcccttaccctaaaaagaggacaaaaagcggctttaattggtccatcaggtgctggtaaaagtactatcctgcaattaatcttaggtgatttaaagcctcgccaaggaactgttacgctcgaccgctttaatgttcttgaacttcaaaaagagcgttcgaagttattttctgtattaaatcaagagccatttttatttaatacgacgatctatgaaaatttaaaaatggccaatccagacgctagtgctgatcaaatgatgcaaatcttagaaaaagtccaattagccgattttgttaattcactccctaagaaattagataccgaagtagctgaagctggagcacgcttttctggtggtcagaaagagcgtttagcactagcacgtgtacttttgcaagatacgcaaattgtcctcttagacgagccaacagtcggcttagatccactcacagagcaaaagctcttaaatttggtatttgatgtcttaaaaaataagacagtcgtttgggtaacccaccacttacaaggtgtaaaatatatgaacgaagttctcttctttaaagatggaaaagtcacaatgcaaggagatccgcatgaactctttaaacacaatgaacacttccaccaactttatttaatggatcaaggactaatctaa

SEQ ID NO: 34650 - protein, 581 aa, Lactobacillus gasseri
MMNKKFSWKNERWVKPYLAQYKWNFILAIFLGVVMFFCGGALMFYAGYTIDKAATRPENILMIYVPIVLMRAVGIGRPLFRYLERLVSHNWILRVTSSLRRRLFYIAERNTSAVGSSFQTGSILSLLTDDIGHLQNLYLRTIFPAILSYLVGFIVVILLGLFSWPLAGVIAILLVAELVLVPFFSLLKQAAVRTKEKEEKAQLYTEFTDQVLGAGDWKISGRRDAFFNQTKGTLKSLGQYEKKSGKFDWARDFGLEFIFGLMAVALLYFTNQTLTNNQEAANYVGAVVLALFPLSDAFIPVGQGIEEWHTYSDSVKHLNELKVPENRLPAQQYFDPAFAGTLRVSNISFTYPGEDYPIIQNFSLTLKRGQKAALIGPSGAGKSTILQLILGDLKPRQGTVTLDRFNVLELQKERSKLFSVLNQEPFLFNTTIYENLKMANPDASADQMMQILEKVQLADFVNSLPKKLDTEVAEAGARFSGGQKERLALARVLLQDTQIVLLDEPTVGLDPLTEQKLLNLVFDVLKNKTVVWVTHHLQGVKYMNEVLFFKDGKVTMQGDPHELFKHNEHFHQLYLMDQGLI

SEQ ID NO: 34651 - DNA, 1515 bp, Lactobacillus gasseri
  CDS (1)..(1515)
ttgagtggcttagaattgccttttggaacttggtcatattcagaaatattctctttaattactgaaaaaaatattcctaatactatcaggatggtagcagttattactattgcccaaattcttttggtcattattaagtatttgaatacacggatacttaacagaaatatcgcttgttttaatcaaaacgtgcgtgaatttctaatgaaaagcaactttattgaaatcagtgaaaacaatgtatcaaagcaaatttcttttctttcaaatgatcttaacttaatagaagagaactatttgaagcaactttttcaattaatttcaatgattgtaacaattgtcggtacttcaatagttgcagttggcaatagttttttattaactttagtttttatttcattcgctattttttcaagtattatccctaagttttttagcaaaaaaacagctcaacaatcaaataattggagtacttctactggaacttacataacatttatgtccgattttttaaagaatattaggacagttttaaattacaatgcattagatacctttattaaaaaagggcaaaaaattattactcaatctactgaaaataagagattacgtgataatacaattgctaaaagcaatttttgggttaatatattcgtttattcttttgactttttacctattggaataggaataattatggtcatcaaagggatgcttactctagcctcatttgtagctgtccaatactccagtacttggattattaacagtttttacagtattaatagctgccgtaatcaaatgtcatcagccaaacctatgatagataagctactttcttttaaaccagaagaatttgacaaaaatattcctaattctaacctaaataccttaacccttaacaatattagctttggatataagccaggagaattagtactagacaaaatcaacttaaaaattaaaagaggtgataaattattacttactggtaagtctggtcaaggaaagtctactcttcttaatcttttaactggtcaactaaaacctactaaaggaaacgtgctcgtcaatgggatgaccaatcaaaattatacatttagtgaggtacaacagacttctcaaatatttaatgatactttacttttcaacctaacattaggtaaaaagtttgatgatttcaaaattacagaagctatcaaaaaggctggactattgccatatgttaatcggtatggcttaaatacgattatagaagaaaatggaaataacttatctggcggtgaaaagaaacgaatagaattggcacgagcttttctatatgaaagagattttttaattgttgacgaagggacagcttcgcttgatcccatcacagctaatcagattcatgaagtgttcttagattctccattaacagtaattgaaatagatcatcatattccacctaaaattatgcaaatgtttaatcatcattatgatctgcacaataaacgattagaacgtatattttaa

SEQ ID NO: 34652 - protein, 504 aa, Lactobacillus gasseri
MSGLELPFGTWSYSEIFSLITEKNIPNTIRMVAVITIAQILLVIIKYLNTRILNRNIACFNQNVREFLMKSNFIEISENNVSKQISFLSNDLNLIEENYLKQLFQLISMIVTIVGTSIVAVGNSFLLTLVFISFAIFSSIIPKFFSKKTAQQSNNWSTSTGTYITFMSDFLKNIRTVLNYNALDTFIKKGQKIITQSTENKRLRDNTIAKSNFWVNIFVYSFDFLPIGIGIIMVIKGMLTLASFVAVQYSSTWIINSFYSINSCRNQMSSAKPMIDKLLSFKPEEFDKNIPNSNLNTLTLNNISFGYKPGELVLDKINLKIKRGDKLLLTGKSGQGKSTLLNLLTGQLKPTKGNVLVNGMTNQNYTFSEVQQTSQIFNDTLLFNLTLGKKFDDFKITEAIKKAGLLPYVNRYGLNTIIEENGNNLSGGEKKRIELARAFLYERDFLIVDEGTASLDPITANQIHEVFLDSPLTVIEIDHHIPPKIMQMFNHHYDLHNKRLERIF

SEQ ID NO: 34653 - DNA, 1788 bp, Azotobacter vinelandii
  CDS (1)..(1788)
atgcctgaagccaccgatcgcctgggctgggcggagatccgccggctcgccctgcgccaccgcaaggccctgatgctggccaacctggtcgccgtgctagcggccctgaccagcgtgccgattccgctgctgttgccgcttttggtcgacgaagtgctgctccggcaaggggatgcggcgttgcgcctgatggatcgggtgttgcccgccgcctggcagagtgcggtcggctacatcggcctgatgctgctggcgaccctgctgctgcgcagtgcctcgctgctgttcggcgtgctgcaggcccggttgttcgcccggctgtcgaaggatgtcgtctatcgcctgcgcatgcgcctgatcgagcgactcaagcgcatctccctgggcgaatacgaaagcctcggcagcggcaccgtgaccgcccacctggtcaccgacctggacaccctggactccttcgtcggcgacaccctgagccgtttcctggtcgccgtcctgaccctggccggtacttcggcgatcctgatctggatgcactggcaactggccctgctgatcctcctgttcaaccccttggtgatctacgccaccgtgctgctcggcaagcgtgtcaagcacctgaagaagctggaaaacgacagcaccgcgcgcttcacccaggcgctcggcgaaaccctggaggcgatccaggaggtgcgcgccggcaaccgccagggcttcttcctcggccgcctcggcctgcgcgcccgggaagtgcgcgaccgcgccgtcgcctcgcagtggaagaccgatgcctcgacccgcgccagcggcctgctgttccagttcggcatcgacgtgttccgcgccgcggcgatgctcaccgtgttgttctccgacctgtcgatcggccagatgctcgcggtgttcagctacctgtggttcatgatcgccccggtggagcaactgctcggcctgcaatacgccttctacgccgccggcggcgccctggcgcggatcaacgagctgctcgcccgcgccgacgagccgcagtactccggcagcgtcgatccgttcaagggacgcgccacggtcggcatcgaggtgcgcgatctgcatttcgcctaccgcgacgaaccggtgctggacggtctcgacctgtccatcgcgccgggcgagaaggtcgccgtggtcggcgcctcgggcggcggcaagagcaccctggtgcaactgctgctcggcctctacagcccgcagtcggggagcatccggttcggtggttcgaccctggaggagatcggcctggagcgggtgcgcgagcacgtcgcggtggtcctccagcagccggcgctgttcaacgacacggtgcgcgccaacctgaccctgggccgcgagcgcagcgacgaggactgctggcaggcgctggagatcgcccaactggcggcgaccgtgcgcgccctgccgcaggggctggacagcgtggtcggccgctccggcgtacgcctctccggcggccagcggcaacgcctggcgatcgcccgcatggtgctcgccgacccgcaggtggtgatcctcgacgaagccacctcggccctcgatgcggccaccgaatacgccctgcaccaggcgctggcgcgcttcctccacggccgcaccacgctgatcatcgcccaccgcctgtcggcggtgaagcaggccgaccgggtgctggtgttcgacgacgggcgcatcgccgaggagggcgaccaccaccaactgatcgccgggggcggcctgtacgccaagctctacgggcatttgcagcactga

SEQ ID NO: 34654 - protein, 595 aa, Azotobacter vinelandii
MPEATDRLGWAEIRRLALRHRKALMLANLVAVLAALTSVPIPLLLPLLVDEVLLRQGDAALRLMDRVLPAAWQSAVGYIGLMLLATLLLRSASLLFGVLQARLFARLSKDVVYRLRMRLIERLKRISLGEYESLGSGTVTAHLVTDLDTLDSFVGDTLSRFLVAVLTLAGTSAILIWMHWQLALLILLFNPLVIYATVLLGKRVKHLKKLENDSTARFTQALGETLEAIQEVRAGNRQGFFLGRLGLRAREVRDRAVASQWKTDASTRASGLLFQFGIDVFRAAAMLTVLFSDLSIGQMLAVFSYLWFMIAPVEQLLGLQYAFYAAGGALARINELLARADEPQYSGSVDPFKGRATVGIEVRDLHFAYRDEPVLDGLDLSIAPGEKVAVVGASGGGKSTLVQLLLGLYSPQSGSIRFGGSTLEEIGLERVREHVAVVLQQPALFNDTVRANLTLGRERSDEDCWQALEIAQLAATVRALPQGLDSVVGRSGVRLSGGQRQRLAIARMVLADPQVVILDEATSALDAATEYALHQALARFLHGRTTLIIAHRLSAVKQADRVLVFDDGRIAEEGDHHQLIAGGGLYAKLYGHLQH

SEQ ID NO: 34655 - DNA, 1662 bp, Azotobacter vinelandii
  CDS (1)..(1662)
atgcttgcccacctgatcagacagtcccgccgcctgctgaccgccgccaccctggcgagcgtcgccgccggggtgtgcagcgtgctactgctcacccggatcaacgccgcgctggtcgcgagcgacccggcggagcgcacggccctggcctgggggttcgccgtcatcgcgttgctggcgatggtcagtcgcatgctttcctcggtattgttcgagcgccttggccagtatgcgcacgccgaactgcggcgctttgtttccgcgcgggtaatggccaccgatttccgccggctggaggagatcggcgggccgcgggtgctgtcggccctgtccgagcactgcgccagggtggccgacttcttcgtcggctttccggccatcctggtcaatgccatcgtcgtcgtcggctgcctggtctacatggcctggctgtcctggtcgatattcttcgtggccgccgtggtcatcggcctgggctcgctgggctatcacctggcgcacctgtgggcgatccgtcatctcgatgccgcttcccgcgagcaggaccgcctgttcggccatttccgggcgctggtggacggggccaaggagctgcgcctgcacgcctccaagcgggagcgctttgccagggatgtgctgggcgcgtcgatcgaggaggtgcgccgcgagcgtacgcgcggttcgtcgatcttcctcgcctcgtcggcatggggcaacttcctgatctatgccttcatcggcctggtgctgttcgtgctggtgggggaggtgcccgaacgggagcggatcatgaccggtttcgcgctggtcttcgtcttcatggtgtcgccgctggagaacctgctgctcgtcctgccgcgggccaacctggcgaaggtttcggcgcagcgcatcgacgagatcacccgggagctgcagccgggcggggccgaggcgccgacgcggtcgccggccgccttcgcgagcctgagcctggagggcgtgagccatcgttactaccacgaggcagccgacgaagtgttcaccctggggccggtcgacctggatttctcccccgggcagatcagtttcctggtgggcggcaacggcagcggcaagaccactctggccaagctgctggtgggcctttaccggccggaggagggggcgatccgaatcgacggcgaagcggtggaggaggcgggcctcgacggttatcgccagctcttttcggccatcttctcggactttcacctgttcgaccgcctgctggacgtgccctcggccgacctggatgcccggggcaacgtcctgctcgccaagctccatctgcagcacaaggtgcaggtacgcgacggcgccttcaccacgcgcgcgctctcgcagggccagcgcaagcgcctggcgctggtcgtagcctacctcgaggaccgtcccttcctggtcttcgacgagtgggcggccgaccaggacccgctgttcaaggaggtgttctactgcgagctgcttcccgaactgaaggccatgggcaaggccgtgctggtgatttcccatgacgaccgctacttccacctcgccgaccgggtgatccgtatggagaacggccaggtggtggcgattgagaagccggatcggcatcccctggcggaaccgcggtcgctcgaatccagccttccgtcatga

SEQ ID NO: 34656 - protein, 553 aa, Azotobacter vinelandii
MLAHLIRQSRRLLTAATLASVAAGVCSVLLLTRINAALVASDPAERTALAWGFAVIALLAMVSRMLSSVLFERLGQYAHAELRRFVSARVMATDFRRLEEIGGPRVLSALSEHCARVADFFVGFPAILVNAIVVVGCLVYMAWLSWSIFFVAAVVIGLGSLGYHLAHLWAIRHLDAASREQDRLFGHFRALVDGAKELRLHASKRERFARDVLGASIEEVRRERTRGSSIFLASSAWGNFLIYAFIGLVLFVLVGEVPERERIMTGFALVFVFMVSPLENLLLVLPRANLAKVSAQRIDEITRELQPGGAEAPTRSPAAFASLSLEGVSHRYYHEAADEVFTLGPVDLDFSPGQISFLVGGNGSGKTTLAKLLVGLYRPEEGAIRIDGEAVEEAGLDGYRQLFSAIFSDFHLFDRLLDVPSADLDARGNVLLAKLHLQHKVQVRDGAFTTRALSQGQRKRLALVVAYLEDRPFLVFDEWAADQDPLFKEVFYCELLPELKAMGKAVLVISHDDRYFHLADRVIRMENGQVVAIEKPDRHPLAEPRSLESSLPS

SEQ ID NO: 34657 - DNA, 1863 bp, Desulfitobacterium hafniense DCB-2
  CDS (1)..(1863)
atggcaggaggatttcgcactcagcagcccaaagcccccgctcttgtcaaccggccgggagccgggaaccgctttgttccggctgccaaacccaagaataccaaagggaccctggggcggattgtcaaaatctatctgcgctgggccaagagcattttcgccgttattttgctcacagccgcttcctctctggtagcggtggcgattccctattatgtggggcaaaccttcaatacttttcatattgccgaccggagtgtggatacggccaggctggtttccctgctgctgattattttgagcctgtatctcggcaatctgctcctcaatctgctcaacgggaccatgacgctgcggatctcccagaagctggtctatactctgcgccaggagttttttgccaaaatgcagaggcttccactagggttttatgatacccgctcccatggggataccatgagccggatcaccaatgatatggataatatcagctccaccatcgcccagaccaccacccagctcatcgccagcatcctgacccttgccggttccctggcggtcatgctcagtctgaatgtgcctctgaccttggtggtgctgctctgtgtacctttggttttcgtattgaccaaaaccatcgccacccgcagccgggcttattttttggctcagcagggaagcctcggggccctgaacggggtcatcgaagaaaatattctgggtctgaaaatggtcaaagccttcaacaggcaggaggaggtactccgccaattccaggaaatcaaccagggcttgcgtgcaagcagctataaggcccaggtttggtccggctgcatgatgcccctgatgaatgtaatcaataatctggtctttgcagctgtggccatctgcgggggaatcctgaccttaagccaggggctggcggtaggaacggtggtcagctttttaacctattccaagcaatttgcccaccctcttaactccgtagccggtatgtttaataccatccagtcggctctggccggggcggagcgggtttttgaaattctggattatgaggaagagagggcagatgaggagaatgccctggaaatggaacatcctgccggtgccgtaacctttgacgaggtcagcttctcttatgacaagacccagccgattcttaaagaggtgagttttcaggtcaatccaggggaggtcgttgccctggtgggagaaaccggtgccgggaaaacaaccatcgtcaatcttttaacccgcttttatgatgcggacagcggggagatcaggattgacggggtgccggttacccggatcaaacgggccagcctgcgccgctgcttctcagttgtgctgcaggataccagccttttcagcggcacgatcatggacaatattcgttatgggaaagaggacgccaccgaggaagaggtgatcagggcggcgcaaatcgcccatgcccacggctttatcactaagctcccccaaggttatgggacccgggtctccgcagctaatgataatctgagccaggggcaaaagcagctgatctccatcgcccgggcgctgctctgcgacagcccgattctgatcctggatgaagccaccagcagcgtggataccaagacggaaaaagatatccagaaagctctggtcagcctcatgcagaaccggaccagctttctgattgcccaccgtctttccacgatccgggatgcggaccgcatcatggtgatcggggaggggcagatcctggaatccggcaatcaccagagtctgatggaaaagcaaggccgatattatgaaatggtcatgagccagctgggcagtcaaatggctaaatccttttcattaaaagcatag

SEQ ID NO: 34658 - protein, 620 aa, Desulfitobacterium hafniense DCB-2
MAGGFRTQQPKAPALVNRPGAGNRFVPAAKPKNTKGTLGRIVKIYLRWAKSIFAVILLTAASSLVAVAIPYYVGQTFNTFHIADRSVDTARLVSLLLIILSLYLGNLLLNLLNGTMTLRISQKLVYTLRQEFFAKMQRLPLGFYDTRSHGDTMSRITNDMDNISSTIAQTTTQLIASILTLAGSLAVMLSLNVPLTLVVLLCVPLVFVLTKTIATRSRAYFLAQQGSLGALNGVIEENILGLKMVKAFNRQEEVLRQFQEINQGLRASSYKAQVWSGCMMPLMNVINNLVFAAVAICGGILTLSQGLAVGTVVSFLTYSKQFAHPLNSVAGMFNTIQSALAGAERVFEILDYEEERADEENALEMEHPAGAVTFDEVSFSYDKTQPILKEVSFQVNPGEVVALVGETGAGKTTIVNLLTRFYDADSGEIRIDGVPVTRIKRASLRRCFSVVLQDTSLFSGTIMDNIRYGKEDATEEEVIRAAQIAHAHGFITKLPQGYGTRVSAANDNLSQGQKQLISIARALLCDSPILILDEATSSVDTKTEKDIQKALVSLMQNRTSFLIAHRLSTIRDADRIMVIGEGQILESGNHQSLMEKQGRYYEMVMSQLGSQMAKSFSLKA

SEQ ID NO: 34659 - DNA, 1809 bp, Nostoc punctiforme PCC 73102
  CDS (1)..(1809)
atggctactggattaaaatctcatcagatatcaagaaggcgtaaacattcaacgcatcctctccagcgcttgcttgagtatggacatcagtatcgtaaacaaatttggctagcgactacttattctatcctcaataaatttttcgacttggcaccaccaggcttaattggcgtggctgtggatgtagtagtcaagcaacaggattctataattgcccagttaggggtacgcgatgtctttggacaatttttgattatttcttttctcactgtcatcatttggatactagaatctgtttttgaatacgcctacgctcgactttggcggaatttagctcagaatattcagcatgacttgcgtttagatgcctacaaacatttgcaagagttggaattggcttattttgaagaacgcagcactggcggcttaatgtctatcctcagtgatgatattaaccaattagagcgttttttggatggaggagcaaatgatattattcaagtttctgcaactgttctaattattggcgctgctttctttattttggctcctagtgtcgcgtggatggctttgtcaccgatgccatttatcctctggggttcttttgcttaccaacgactgcttgcgcctcgctacgccgatgtccgggaaaaggttggtttcctaaattcgcgtttgtcaaacaatattagtggaataactaccattaaaagtttcactgccgaaacttatgaagcctctcgtttggaattagatagtgaagcttatcgccgcagtaactccaaggcaattactctttctgctgcttttgtaccgttaattcggatgctgattttagtgggtttcacagcattactcttatatggtggcatggcagcagtttctggacaaatgtctgtaggtacttacagtgtattagtgtttttaatccagcgcttgctatggcctttaacaagattaggcgaaacttttgaccaatatcaacgagcaatggcttctactaatcgagtcatgaatttgttagatactcctatcgccattcatacaggaaatgtggcgttacctgtgaatgaagtgcgcggtgaagtgcaatttaaaaatgtttattttgcctataaagatagatttccagtaattaaaaatctgtctttggatattccggctggaaaaaccattgcaattgtcggttcaacaggttctggtaaaagcactttagtcaagcttttgttgcggttatacgaagtgcaaacaggaaacattactctcgatggtattgatttgcaaagtttaaatttgcaagatttacggcgctgtattggtttggtgagtcaagatgtttttctatttcatggcactgtagcagagaatattgcttacggtagctttgagactacagagcaagaaatcatcacggcggcgaagatagccgaggcgcacgaatttattgttgaattgcccgaaggttatgagacaattgtgggggaaagaggacaaaagttatctggtggacaaagacaacggattgcgatcgcccgtgcagtcttaaaaaatccacccattctgattttagacgaagctacctcggcagtggataatgagacagaagctgcaatccagcgatcgctcgaacggattacagtagatagaactacaattgcgatcgctcatcgtctatccaccatccgcaatgccgattgcatttatgtcatggaacatgggaaattagtagagtcaggaacccatgagcaattgctggagaaagacgggatttattccggcctctggcgtgtacagtcaggtttgagataa

SEQ ID NO: 34660 - protein, 602 aa, Nostoc punctiforme PCC 73102
MATGLKSHQISRRRKHSTHPLQRLLEYGHQYRKQIWLATTYSILNKFFDLAPPGLIGVAVDVVVKQQDSIIAQLGVRDVFGQFLIISFLTVIIWILESVFEYAYARLWRNLAQNIQHDLRLDAYKHLQELELAYFEERSTGGLMSILSDDINQLERFLDGGANDIIQVSATVLIIGAAFFILAPSVAWMALSPMPFILWGSFAYQRLLAPRYADVREKVGFLNSRLSNNISGITTIKSFTAETYEASRLELDSEAYRRSNSKAITLSAAFVPLIRMLILVGFTALLLYGGMAAVSGQMSVGTYSVLVFLIQRLLWPLTRLGETFDQYQRAMASTNRVMNLLDTPIAIHTGNVALPVNEVRGEVQFKNVYFAYKDRFPVIKNLSLDIPAGKTIAIVGSTGSGKSTLVKLLLRLYEVQTGNITLDGIDLQSLNLQDLRRCIGLVSQDVFLFHGTVAENIAYGSFETTEQEIITAAKIAEAHEFIVELPEGYETIVGERGQKLSGGQRQRIAIARAVLKNPPILILDEATSAVDNETEAAIQRSLERITVDRTTIAIAHRLSTIRNADCIYVMEHGKLVESGTHEQLLEKDGIYSGLWRVQSGLR

SEQ ID NO: 34661 - DNA, 1656 bp, Nostoc punctiforme PCC 73102
  CDS (1)..(1656)
atgaacctgatccgtcttctattgcgtacttcttctcttcagctctgttttgcaattttagctggtattttcagcggcggcactgctgctggtctaattgccctaattaatacgacattgagtcaaaatcagccatcaaaaactatactaatttggagttttgtcggtctttgtttactgcggttaattgctaatttcgtttctcaagttttattgatacaactttcacaaaaagcaattctcaatttgcgggtacttttaacccgcagtattcttgcctcgcccttacgtcacttagaacaaataggtgctcatggacttttagctgttctcactgaggatattcaaacaatctctaacacagttattactgtcccttttgtgtgcattaatattgccatcgtgattgcctgtctgatttatctgagttggttatctaaaattgttttcctcataggtattagctttatgttcctgggaatattcagctattcactaccaatgatgaaagccatgtcttttttaaaattggctcgtgagcaagaagatagattatttaagcatttccgtagcgtcattcaaggcacaaaagaactcaaactacatcgccgacgacggcaagcatttctctctgaagaactccataccactgcttcatcattccgccgtcataatgttgtgggtatgagtatctttgctgcggctgctagttgggggcaagttctattttttgttgctattgggttacttttattcatcatccctactatcaataaaattccacctgcaattctatctgcttatgccctaactattatctatttgatatcacctctagagtatattatgagtatgatgcctagcataactaaagccttagtagctttaaaaaaagtggagtctctgggtctatcattagcaagttattcaaacgaaatttgtgataatgtttcactggcatcagatcaatattggaactgcttagaactggtaaatataacccatgcttattatcaagaacgggaagaaagcaactttatccttgggcctattaaattaaaatttcatccaggagaacttgtttttattgtaggaggtaacggtagtggtaagtctaccctcgctaagttaattagtgggctttacattcctgaaacaggaaatatttatctagacgatcagctcattgataatcataatttagagtggtatagacagcaattttctgtagtattttccgatttttatctttttgatcgcttcctgggtttggatagtggcgatctggatattcagactcgaaagtaccttattgaattgcaattagaccataaagttaaggtcaataatggagtactttctaccacggacctttctcaaggacagcgcaaacgtctcgctctagttactgcttatttagaagatcgtcccatttatatgtttgatgagtgggcatcagatcaagatcctgtattcaaggaaattttctatactcaacttctggtagagctaaagaagagaggaaaaactgtactagttattagtcacgatgaccaatatttttacctggcagatcggattgtcaagctggaatacggccaagtgaaaactgaatatttaaatattggaaaggagcaaagcaatgtttttgaataa

SEQ ID NO: 34662 - protein, 551 aa, Nostoc punctiforme PCC 73102
MNLIRLLLRTSSLQLCFAILAGIFSGGTAAGLIALINTTLSQNQPSKTILIWSFVGLCLLRLIANFVSQVLLIQLSQKAILNLRVLLTRSILASPLRHLEQIGAHGLLAVLTEDIQTISNTVITVPFVCINIAIVIACLIYLSWLSKIVFLIGISFMFLGIFSYSLPMMKAMSFLKLAREQEDRLFKHFRSVIQGTKELKLHRRRRQAFLSEELHTTASSFRRHNVVGMSIFAAAASWGQVLFFVAIGLLLFIIPTINKIPPAILSAYALTIIYLISPLEYIMSMMPSITKALVALKKVESLGLSLASYSNEICDNVSLASDQYWNCLELVNITHAYYQEREESNFILGPIKLKFHPGELVFIVGGNGSGKSTLAKLISGLYIPETGNIYLDDQLIDNHNLEWYRQQFSVVFSDFYLFDRFLGLDSGDLDIQTRKYLIELQLDHKVKVNNGVLSTTDLSQGQRKRLALVTAYLEDRPIYMFDEWASDQDPVFKEIFYTQLLVELKKRGKTVLVISHDDQYFYLADRIVKLEYGQVKTEYLNIGKEQSNVFE

SEQ ID NO: 34663 - DNA, 1677 bp, Pseudomonas syringae pv. syringae B728a
  CDS (1)..(1677)
atgacccgcacaactgaaagcctcgcccgggaaaccctgagaatcctcaagccgttctggtggctggtggcgctgtcgaccttgctggggattgtcagcggcctgagcgtcaccggcctgctggccaccatcaacaacgcgatgaacaggccaggcgggccggacacgcagaccgcgctgctgttcgccggcctgtgtgtgctgaccctggcgtgttcgaccctgtccaacctgtcgaccaattacgtcggccagcgagtcgtcgccaacctgcgccgcgagctggcggccaaggtgctggtcgcgcccatcgagcagctggaacgctatcgcgcgcaccgcctgatcccggtgctgctcaacgacgtcaacaccatcagcacctttgccctgtcggtcgcgccgatggtgatctcgtttaccgtcaccctcggctgtctggcctatctggccgtgctgtcctggcagattctggcactgacagtgctcaccgtggtgctcggcaccggcgcacaatacctggcgcatgcattcggcatgcgcagcattctggcggcgcgcaacagcgaagacgaattgcagaagcactaccaggcgctgtccgcaggcgccaaggagctgcgcattcagcgcaaacgtcgtcagcacatgctcgacgaaaagattcacggggccactgaacacatctgccgctcgaacattcgcgctgccaacatcttcgtcagcgcggaaaccttcggctcgatgctgttctttgcggtgatcggcatggccatcgccttccaggccatgtggccgaccaccgagaaaaccgtgctgggcggcttcgtgctggtgatgctgtacatgaaaggcccgctggaacgcctgatgactgccctgcccggcatcagccgcgcgcagatcgccatgcgccgcatcgccgagctgtcgtggaaattctccagccccgaaccgcacctgctggtcagtgaccgcccgacgtcgctggccagcatgcacacgctggaactgcacaacctgcgctatgactacccgccggtcgagggcagcgacgcctttcacctcggcccggtcgacctgagcatcaaacagggcgacatcgtgttcatcgtcggcgagaacggctgtggcaagactacgctgatcaagctgctgctgggcctgtacaccccgcaacagggtgagatccgcctgaatggccaggccgttaccgcggaaaacctggatgactaccgccagctgttcaccacgattttcgccgactactacctgttcgacgagccgttgcagggccaggccgcgctgccgcaggacgcgggcaagtacctggagcgcctggacatcgcgcacaaggtcagcatcgagaacggtgtcttcaccaccaccgatctgtcgaccggtcagcgcaagcgtctggcactgatcaatgcgtggctggacgagcgtcaggtgctggtcttcgacgagtgggccgccgatcaggacccggcgttccgtcgcgtgttctacgccgagctgctgccggaattgaagcaacagggcaagaccatcatcgtgatctcccatgacgaccgctatttctacgttgccgatcagttggtgcggatgcagaccgggcagattcaggtcgaacaggttcgcaacgaaacccgcgataaaaccattacggcgtga

SEQ ID NO: 34664 - protein, 558 aa, Pseudomonas syringae pv. syringae B728a
MTRTTESLARETLRILKPFWWLVALSTLLGIVSGLSVTGLLATINNAMNRPGGPDTQTALLFAGLCVLTLACSTLSNLSTNYVGQRVVANLRRELAAKVLVAPIEQLERYRAHRLIPVLLNDVNTISTFALSVAPMVISFTVTLGCLAYLAVLSWQILALTVLTVVLGTGAQYLAHAFGMRSILAARNSEDELQKHYQALSAGAKELRIQRKRRQHMLDEKIHGATEHICRSNIRAANIFVSAETFGSMLFFAVIGMAIAFQAMWPTTEKTVLGGFVLVMLYMKGPLERLMTALPGISRAQIAMRRIAELSWKFSSPEPHLLVSDRPTSLASMHTLELHNLRYDYPPVEGSDAFHLGPVDLSIKQGDIVFIVGENGCGKTTLIKLLLGLYTPQQGEIRLNGQAVTAENLDDYRQLFTTIFADYYLFDEPLQGQAALPQDAGKYLERLDIAHKVSIENGVFTTTDLSTGQRKRLALINAWLDERQVLVFDEWAADQDPAFRRVFYAELLPELKQQGKTIIVISHDDRYFYVADQLVRMQTGQIQVEQVRNETRDKTITA

SEQ ID NO: 34665 - DNA, 1770 bp, Pseudomonas syringae pv. syringae B728a
  CDS (1)..(1770)
atgatttcacggattacccgacgtcatcgccaggccttgcgtctggctgcgagtttcatcgcgccgtatcgctggcaggcgctcggcgcattgctggcactggtcattaccgcgggcatcaccctgtcgatcgggcagggcatcaaactgatggtcgatcagggtttcatgacccgttcaccgcagttgctcgagcgctcgatcgggtttttcatgctgctgacggtcggcctcgccgtcggaaccttcgcccgtttctatctggtgtcatggatcggcgagcgtgtggttgccgacttgcgcaagaaggtgttcgatcacctgatcgagctgcatccgggcttctacgagaacaatcgcagttcggaaatccagtcgcgactgaccgccgacaccacgctgttgcagtcggtgatcggctcgtcactgtcgatgttcctgcgcaatgcgctgatggtcatcggcggcatcgtgctgttgttcatcaccaatcccaaactcaccagcatcgtggtggtggcgttaccgctgatcatcgcgcccattctcatgttcgggcggcgggtacgaaacctgtcgcgcgagagccaggaccgggtcgccaatgtgggcagctacgtggccgaggccctggggcagatcaagacggtgcaggcctacaatcaccagcagcaggacaagcagcgtttctcgcatacggtggagcaggcgttcgagaccgctcgcaaacgcatcctgcagcgttcctggctgatcacgctggtgatcgtcctggtgttgggtgcggtggcggtgatgttgtgggtgggcggcatggacgtgatcagcggccgcatttccagcggtgagctggcagcgttcgtgttctacgcgctgatggtcggcatggcgttcggcacgttgagtgaggtgattggcgatctgcagcgcgccgccggtgccgcagagcggatcggcgagctgcttcaggcgcgcagcgagatcagcgtgcccaccacggacctgcagagcctgccaccgcgcatcagcgggcgtctggcgcttgagaatgtcaccttcgcttacccgtcgcgtcccgagcgcaatgcactggataatttgaccctgagcatcgagcctggtgaaaccctggcgctggtcggaccctccggagcaggcaagtcgaccatcctcgatctgctgttgcgtttttacgacccgattcaagggcgcatcctgatcgagggcgtgccgatcgcgcagctcgatcaccatgacctgcgccgctgcttcgcgctggtttcacaatcgcccgcgctgtttttcggcactgtcgaggacaacattcgttacggtaacgccactgcgagcctcgagcaggtgcaggcggcggcgcgcattgcccatgcgcatgaattcattctcgacatggccgacggttaccgtacgcatctgggtgagggcggggtgggcttgtccggcggacagcggcagcgtctggcgattgcccgagccttgctggtcgatgcgccgattctgttgctggacgaggcgaccagtgcgctggacgcgcagagtgagcacttgattcaacaggctctgccgagcttgatgcaggggcgtaccacgctggtcatcgcccaccggctggccacggtgcagaatgccgaccggattgccgtcatggatcaggggcggttggtcgcggtgggcacccatcagcagttgatcgccagcaacccgctttatgcgcgactggcggcgttgcagttcaatgccggggttgagtag

SEQ ID NO: 34666 - protein, 589 aa, Pseudomonas syringae pv. syringae B728a
MISRITRRHRQALRLAASFIAPYRWQALGALLALVITAGITLSIGQGIKLMVDQGFMTRSPQLLERSIGFFMLLTVGLAVGTFARFYLVSWIGERVVADLRKKVFDHLIELHPGFYENNRSSEIQSRLTADTTLLQSVIGSSLSMFLRNALMVIGGIVLLFITNPKLTSIVVVALPLIIAPILMFGRRVRNLSRESQDRVANVGSYVAEALGQIKTVQAYNHQQQDKQRFSHTVEQAFETARKRILQRSWLITLVIVLVLGAVAVMLWVGGMDVISGRISSGELAAFVFYALMVGMAFGTLSEVIGDLQRAAGAAERIGELLQARSEISVPTTDLQSLPPRISGRLALENVTFAYPSRPERNALDNLTLSIEPGETLALVGPSGAGKSTILDLLLRFYDPIQGRILIEGVPIAQLDHHDLRRCFALVSQSPALFFGTVEDNIRYGNATASLEQVQAAARIAHAHEFILDMADGYRTHLGEGGVGLSGGQRQRLAIARALLVDAPILLLDEATSALDAQSEHLIQQALPSLMQGRTTLVIAHRLATVQNADRIAVMDQGRLVAVGTHQQLIASNPLYARLAALQFNAGVE

SEQ ID NO: 34667 - DNA, 1833 bp, Pseudomonas syringae pv. syringae B728a
  CDS (1)..(1833)
atgctttatcgtcgtttcgaaaaactgatcgatatcttcaaagacgctcctaccgctgccccgcccaataccgtcttcgcgttctacctctactacctgcgtcaggtatggccgacgttcaccgcgctgctggtggtcgggctgatcggtgcgctgatcgaagtgtcgctgttcagctacctgagccgcatcatcgacctggcgcaaaccacgccgccggagaatttcttcagtattcacggttccgagctgatctggatggtggtggtggccctgctgctgcggccgattttcgtcggcctgcatgacctgctggtacaccagacgatcagccccggcatgaccaacctgattcgctggcagaaccacagccacgtactcaaacagagtgtcaatttcttccagaacgacttcgccgggcgtatcgcccagcgcatcatgcagaccggcaactcgttacgtgactcggccgtgcagacggtggatgcgctgtggcatgtgctgatctacgcgatcagcgcgatggtgctgttcgccgaggccgactggcggctgatgattccgctgggcacctggatcgcggcgttcatcctctcgctgatgtatttcgtgccgcgggtcaagcaacgctcggtggattcgtccgatgcgcgctccagactgatgggccgcatcgtcgacggctacaccaacatcaccacgctcaagctgttcgcccacaccaaccacgagcagcagtacgcgcgcgaagcgatgcgcgaccacaccgaaaagagtcagctggctggccgcgtggtcacctcgatggacaccaccatcaccaccatgaacggcatactgatcgtcaccacgaccggtctggccctctggctgtggacccagtccattatctcggtgggtgcgatcgcgctggccaccggtctggtcatccgtatcgtcaacatgtccggctggatcatgtgggtggtcaacggcatcttcgagaacatcggcaccgtgcaagacggcctggaaagtatttcgcagcccgtcacggtcaatgacaaacccggcgccctgccgctgaagatcgaaaacggcggtgtcaggttcgacggcgtggatttccattacggcaatggcaacgggatcattcacaacctcaacctggacatcaaaccgggtgagaagatcggcctgatcgggccttccggcgcgggcaagtcgacgctggtcaacctgctgctgcgcatgtacgacgtgcaaggcgggaggatcctcatcgacggccaggacatttccgaaatcacccaggaaagcctgcgcgcgcagatcggcatgattacccaggacacctcgctgctgcaccgctcgattcgcgagaacctgttgtatggcaatccgcacgcaaccgatgaacagctctgggaatcgatccataaggcccgcgccgacgagttcatcccgctgctgtcagactccgaaggtcgcaccggcttcgacgcccatgtcggtgagcgcggcgtcaagctatccggcgggcaacgccagcgtatcgcgatcacccgcgtgctgctcaaggacgcgccgatcctgatcatggacgaagccacctcggcactcgactcggaagtcgaagcagcgattcaggagagcctggagacgttgatgcagggcaagaccgtgatcgccatcgcgcaccgcctgtcgacgatcgcgcgcatggatcgcctggtggttctggagaaaggccagatcgccgaaaccggcacgcacagcgaactgctggcgcatggcgggctgtatgcgcggttgtggcagcatcagacgggcgggtttgtaggcgtggattga

SEQ ID NO: 34668 - protein, 610 aa, Pseudomonas syringae pv. syringae B728a
MLYRRFEKLIDIFKDAPTAAPPNTVFAFYLYYLRQVWPTFTALLVVGLIGALIEVSLFSYLSRIIDLAQTTPPENFFSIHGSELIWMVVVALLLRPIFVGLHDLLVHQTISPGMTNLIRWQNHSHVLKQSVNFFQNDFAGRIAQRIMQTGNSLRDSAVQTVDALWHVLIYAISAMVLFAEADWRLMIPLGTWIAAFILSLMYFVPRVKQRSVDSSDARSRLMGRIVDGYTNITTLKLFAHTNHEQQYAREAMRDHTEKSQLAGRVVTSMDTTITTMNGILIVTTTGLALWLWTQSIISVGAIALATGLVIRIVNMSGWIMWVVNGIFENIGTVQDGLESISQPVTVNDKPGALPLKIENGGVRFDGVDFHYGNGNGIIHNLNLDIKPGEKIGLIGPSGAGKSTLVNLLLRMYDVQGGRILIDGQDISEITQESLRAQIGMITQDTSLLHRSIRENLLYGNPHATDEQLWESIHKARADEFIPLLSDSEGRTGFDAHVGERGVKLSGGQRQRIAITRVLLKDAPILIMDEATSALDSEVEAAIQESLETLMQGKTVIAIAHRLSTIARMDRLVVLEKGQIAETGTHSELLAHGGLYARLWQHQTGGFVGVD

SEQ ID NO: 34669 - DNA, 1827 bp, Pseudomonas syringae pv. syringae B728a
  CDS (1)..(1827)
atgcatgatgaagtgcctgaggctgcccgacagccgcacgccacacgcagcgacgcattgagctgggccgagatccgtcgtcttgccttgcggcataaaaaatccttgtggctggccaacggtgtcgcggtgctggccacgctgtgcagtgtgcctatcccgttgctgctgccgttgctggtcgacgaggtgttgctgggccgtggcgatgctgcgctcaaggtcatggatcacctgctacctggcaactggcaaaaggcagcgggctacattggcctgatgctgtcgttgacgctggtgctgcgggtcggggcgctggtgttcaatgtgttgcaggcgcggctgttcgccgggctggccaaggacatcgtctatcgtatccggctgcggctgatcgagcggctcaagcgcatttccctgcgtgaatacgaaagcctgggcagcggtacggtgaccacgcatctggtgaccgatctggatacgctggacaagttcgtcggtgaaaccctcagccgcctgctggtggccacgctgaccctggccggcactgcaggcattctgatgtggatgcactggaaactggcgctgctgatcatgctgttcaacccgctggtcatcctgctcacggtgaaactgggcaagcgcgtcaagcacctcaagaagctggagaacgacagtacgtcgcggtttacccaggcactgagcgaaacgctggatgcgattcaggaagtccgggccgggaacagacaaggcttctttctgggacgcctgggcgtacgcgcgcaggaagtgcgtgactacgcaatcaattcacagtggaaaagcgacgcctcgggccgtgccagcgggctgctgttccagttcggtatcgatatctttcgcgccgcggcaatgcttaccgtgctgttctcggacctgtccatcgggcagatgctcgcggtgttcagttacctgtggttcatgatgacgccggttgagcaactgctgaacctgcaatacgcctactacgcggcaggcggggcgctgacgcgcatcaacgagttgctggcgcgcgccgacgagccgcaatatgccggcggcaccgacccgttcgagggcaaggaaaccgtaggggtcgaggtccgtggcctgacctttggctatggcgaagacctggtgctggaccagttgaacctgaacatcgcgccgggagaaaaagtcgccatcgtcggtgccagcgggggtggcaagagcaccttggtgcagttgctgctgggactctatacggcgcgcaccggcgtgatccgttttggcggcgtcagccagcaggatatcggcctggagaccgtgcgcgaaaacgtcgccgtggtactgcagcatccggccctgttcaacgacaccgtacgcgccaacctgaccatgggccgcgactgcagcgatgaagcctgctggcgtgcactggaagttgcgcaactcgattccgcgatccgcgatctgccacagggtctggacagcgtggtcggacgctccggagtcagaatgtcgggtggccagcgccagcgcatggcaatcgcgcgcatggtcctgtccgaccccaaggtggtgatcctcgatgaggccacctcggcgctggacgctgccaccgagtacaacctgcatcaggcactcgcacgttttctgcgcagccgcacgacgttgatcattgcccaccgcctgtcggccgtgaagcaggctgaccgggtactggtatttgatggcgggcgtattgcggaggacggtgaccatcagcagttgattgccgatggaggtctgtacgcaaaactgtacggacatttacaacaaatctga

SEQ ID NO: 34670 - protein, 608 aa, Pseudomonas syringae pv. syringae B728a
MHDEVPEAARQPHATRSDALSWAEIRRLALRHKKSLWLANGVAVLATLCSVPIPLLLPLLVDEVLLGRGDAALKVMDHLLPGNWQKAAGYIGLMLSLTLVLRVGALVFNVLQARLFAGLAKDIVYRIRLRLIERLKRISLREYESLGSGTVTTHLVTDLDTLDKFVGETLSRLLVATLTLAGTAGILMWMHWKLALLIMLFNPLVILLTVKLGKRVKHLKKLENDSTSRFTQALSETLDAIQEVRAGNRQGFFLGRLGVRAQEVRDYAINSQWKSDASGRASGLLFQFGIDIFRAAAMLTVLFSDLSIGQMLAVFSYLWFMMTPVEQLLNLQYAYYAAGGALTRINELLARADEPQYAGGTDPFEGKETVGVEVRGLTFGYGEDLVLDQLNLNIAPGEKVAIVGASGGGKSTLVQLLLGLYTARTGVIRFGGVSQQDIGLETVRENVAVVLQHPALFNDTVRANLTMGRDCSDEACWRALEVAQLDSAIRDLPQGLDSVVGRSGVRMSGGQRQRMAIARMVLSDPKVVILDEATSALDAATEYNLHQALARFLRSRTTLIIAHRLSAVKQADRVLVFDGGRIAEDGDHQQLIADGGLYAKLYGHLQQI

SEQ ID NO: 34671 - DNA, 1845 bp, Actinobacillus pleuropneumoniae serovar 1 str. 4074
  CDS (1)..(1845)
atgttcaacaaaatttttagttggtttgaagcaagagtggaaacttaccccgaagcaccgccgaaaacgcccaaatcgggaataatcccgtttatttttgaagcgactaaaggcatgcgaggctatttagttatgctgaccgtattagtcgctgcagtcgggattatcgaagcggtactgtttcaatttatgggcgaattggttgattgggtcgctcaatattctccggcgcaactttgggcggagaaaagcggtagtattattgcgatgttttgcgccgccttgttagggattttattcgtctttttagcgagtagcatccgtttccagtcgttacaaggtgtgttcccaatgcgtttgcgctggaatttccaccgcttaatgctcggtcagagtatgggcttttatcaagacgaatttgccggacgagtttcagcaaaagtgatgcaaaccgctttagccgtacgtgatgtgattatgacctgtgccgatatgttggtctatgttgcggtttatctaacgacttccagtgttatccttttacagtttgacggttggttatttttaccgtttattctatgggtgattgcattggcggtgacgatccgcattttcgtaccgaaattggcggaagctgcacaagaacaatctgatgcacgcagcttaatgaccggtcgcattaccgatgcttattcaaatatcgccacggtaaaactgttctcgcacggcaatcgtgagtcggcgtatgcgaaagaatcaatgcaggaatttatggttaccgtgcataaacaaatgcgtttggtaacggtcatagaaacccttaccaatgcgatgagtatcggtttaatcgttgcaaccgccggtatcggtttatggctttggggagcagaattagttactgccggtgcgattgctacttcaaccgcattagcgttacgtatcaaaggcttatcacaatggatcatgtgggagtttgcccgtttattcgaaaacttaggcacggtgcaagacggtatgcaaaccttatcaaaaccgcatacggtggtggataaagcggatgcaaaaccgttggaagttagcaaaggtgaaattaaattcgagcacgtcaattttgcttatgatccgaaaaaaccgttgcttaaagattttgaattaaccattaaagccggtgaaaaagtcggtttagtcggacgcagcggtgcaggtaaatccacgctcacgaacttattgctacgtttttacgatattcaaaacggttcaattacgattgatggtcaaaacgtacgagatattacccaagagagccttcgctcacaaatcggtttagtgacgcaagatacttcgttgttacatcgttcagtgcgtgaaaacttactttacgggcgtccgaatgcgactgaggaagaaatgctgaaagcggtagaaaaagcggcagcggcggaatttatcccgaatctacaagatgcgaaaggtagaaccggttttgatgcgcatgtgggtgagcgaggcgtaaaactttccggcggtcagcgccaacgtattgcgattgcacgagtgatgttaaaagatgcgccgattctgttactagacgaagcaaccagtgcgttggattcggaagtggaagcggctattcaagaaaacttaaccgagttaatggacggtaaaaccgtagtagcgatagctcaccgtctttcaaccattatggcgatggatagactgattgtgttggataaaggtgaaattgtggaacaaggcagccatgaagaattattggcacaaaacggcgtttacgctaaactttgggcgcatcaaagcggtggctttttagccgaagatattcattaa

SEQ ID NO: 34672 - protein, 614 aa, Actinobacillus pleuropneumoniae serovar 1 str. 4074
MFNKIFSWFEARVETYPEAPPKTPKSGIIPFIFEATKGMRGYLVMLTVLVAAVGIIEAVLFQFMGELVDWVAQYSPAQLWAEKSGSIIAMFCAALLGILFVFLASSIRFQSLQGVFPMRLRWNFHRLMLGQSMGFYQDEFAGRVSAKVMQTALAVRDVIMTCADMLVYVAVYLTTSSVILLQFDGWLFLPFILWVIALAVTIRIFVPKLAEAAQEQSDARSLMTGRITDAYSNIATVKLFSHGNRESAYAKESMQEFMVTVHKQMRLVTVIETLTNAMSIGLIVATAGIGLWLWGAELVTAGAIATSTALALRIKGLSQWIMWEFARLFENLGTVQDGMQTLSKPHTVVDKADAKPLEVSKGEIKFEHVNFAYDPKKPLLKDFELTIKAGEKVGLVGRSGAGKSTLTNLLLRFYDIQNGSITIDGQNVRDITQESLRSQIGLVTQDTSLLHRSVRENLLYGRPNATEEEMLKAVEKAAAAEFIPNLQDAKGRTGFDAHVGERGVKLSGGQRQRIAIARVMLKDAPILLLDEATSALDSEVEAAIQENLTELMDGKTVVAIAHRLSTIMAMDRLIVLDKGEIVEQGSHEELLAQNGVYAKLWAHQSGGFLAEDIH

SEQ ID NO: 34673 - DNA, 1764 bp, Haemophilus influenzae R2846
  CDS (1)..(1764)
atgcaagagcaaaaattacaagaaaatgatttttcaaccttacaaacttttaaacgtttgtggccaatgattaaaccttttaaagcggggcttattgcttcaggtattgcgttagtttttaatgcattggctgattcaggcttgatttacttgttaaaacctttgttggacgatggttttggcaaggcaaaccattcatttttgaaaataatggcttttgttgttgtgggaatgattattttacgtggcgtgactaactttatttctaattattgcttggcgtgggtatcaggcaaagttgtcatgacaatgcgtcgccgcttatttaaacatttaatgtttatgccagtgagtttctttgacagaaattcaacggggaaattactttctcgtatcacttatgattctgagatgattgcaagttcttcttcaggatctttgattaccattgtgcgagaaggagcatatattatttcgctattggcagtgatgttttatacaagctgggaattaacccttgttttatttgttatcgggccaattattgcagtattgatcactatcgtttcaaaaattttccgtaagttgagtaaaaatttacaagattcaatgggggaattgacggcgacgacggagcaaatgctgaaaggacataaagtcgtgatttcttttggtggtcagtttgtcgaggaagagcgttttaataaagtgagtaacaacatgcgtcgtaaaggtatgaaaatggttactgcagattccatttccgaccctgttgtgcagattattgcttcttttgctttagttgctgtattgtttttagctaccacgccattaattgcggaagataatctaagtgcgggttcttttacggtagttttttcatctatgttggcaatgatgcgcccattaaaatccttaacgaatgtaaactctcaattccaacgtggaatggcagcctgtcaaactttatttgccattttagacttagaaccagaaaaagataacggcacttataaagcagaacctgctaaaggcgagttagaatttaaaaatgtgagttttgcatatcagggaaaagaggaacttgcattaaataatatttcttttagcgtgcctgcaggaaaaaccgttgctttagtgggacgttctggatcgggcaaatcaaccattgctaatttagtgacacgtttttatgatattgagcaaggcgagattttacttgatggcgtaaatatccaagattatcgtttatctaatttacgtgaaaactgcgctgtggtttctcaacaagtccatttatttaacgatactattgcgaataatattgcttatgcagcacaagataagtattctcgcgaagaaattatcgctgcagcaaaagcggcttatgctttagagtttatcgaaaaattaccgcaaggttttgatacggtaattggcgaaaatggcgctagcctatcaggtgggcaacgtcagcgtttagcgattgctcgtgctttattgcgtaattcgccagtattaattttagatgaagctacatctgcactagatacggaatcagaacgagcaatccaatctgcattagaggaattaaagaaagatcgcacggttgttgtgattgcccatcgattatctactattgaaaatgcggatgaaattcttgtgattgatcacggagaaattcgtgagcgtggcaaccataaaacattgcttgaacaaaatggtgcctataaacagttgcatagtatgcagtttactggctaa

SEQ ID NO: 34674 - protein, 587 aa, Haemophilus influenzae R2846
MQEQKLQENDFSTLQTFKRLWPMIKPFKAGLIASGIALVFNALADSGLIYLLKPLLDDGFGKANHSFLKIMAFVVVGMIILRGVTNFISNYCLAWVSGKVVMTMRRRLFKHLMFMPVSFFDRNSTGKLLSRITYDSEMIASSSSGSLITIVREGAYIISLLAVMFYTSWELTLVLFVIGPIIAVLITIVSKIFRKLSKNLQDSMGELTATTEQMLKGHKVVISFGGQFVEEERFNKVSNNMRRKGMKMVTADSISDPVVQIIASFALVAVLFLATTPLIAEDNLSAGSFTVVFSSMLAMMRPLKSLTNVNSQFQRGMAACQTLFAILDLEPEKDNGTYKAEPAKGELEFKNVSFAYQGKEELALNNISFSVPAGKTVALVGRSGSGKSTIANLVTRFYDIEQGEILLDGVNIQDYRLSNLRENCAVVSQQVHLFNDTIANNIAYAAQDKYSREEIIAAAKAAYALEFIEKLPQGFDTVIGENGASLSGGQRQRLAIARALLRNSPVLILDEATSALDTESERAIQSALEELKKDRTVVVIAHRLSTIENADEILVIDHGEIRERGNHKTLLEQNGAYKQLHSMQFTG

SEQ ID NO: 34675 - DNA, 1845 bp, Haemophilus influenzae R2846
  CDS (1)..(1845)
atgtttaacaaaattttttcgtggtttgaaaatcgtttaaatccctatccagaaagcaatccaacaacacctaaaaaaggtttgttccgttttatttggtctagtattacaggaatgaaaggctggatttttttgctcgcaattttaaccgtaggtacaggtgtaatggaagctgtattattccaatttatgggaacgcttgtagattggttaggcacatttacacctgaaagattatggcaagaaaaaggtcatttattaattggaatggctgctctattactcattagtattgtatggggatttttagcttcggccgtgcatttacaaaccttacaaggcgtatttccaatgcgattacgttggaatttccatcgtttaatgcttggacaaagtttaagtttttatcaagacgaatttgcaggtagagtatccgcaaaagtaatgcaaaccgcccttgcagtacgtgacacagtacttacacttgcaaatatgttcgtttatgtattggtatattttattacctctggcgtagtgctagtggcattagattcttggttcttattaccatttattacttggattatactcttcggtttgatcctacgaaccctaattcctaaactatcaaaaaccgcacaacgacaagctgatgctcgttctttaatgacaggatgcattacagatgcttattctaatattgctacagtaaaattattttctcacggctcacgcgaagctacttatgccaagcgttctatgcaagattttatggtaacagtacacgcccaaatgcgcttagcaacatcactagatacactcacttacgctacaaatattctacttacgttaagtactgcaatacttggtattattttatggaaaaatggtcaagttggcgtgggtgcaatagcaacggcaacggcaatggcattacgcgtaaatgggctttctcgctggattatgtgggaatctgcccgtttgtttgagaatatcggcactgtaaacgacggaatgaatactttaaccaaacctcacaccattgtggataaaccacaagcatcaccgttacaagtgaaacaaggggaaattaagtttaacaatattacctttgcttacgatccgacaaaaccattactcaatcatttcaatctcactatcaaaccaggggaaaaggttgggttaatcggtcgttctggtgcaggaaaatctacgattgtgaacttattacttcgcttttatgaagcacaacaaggcgaaattaccattgatggacaaaatgtactcaatgtgcaacaagaaagcttacgtcgccaaatcggtttagtcactcaagacacttcgttgctacatcgttctgtacgtgacaatattatttatggtcgcccgaatgctactgatgaagaaatggttttagctgctgaacgagcgaaagccgctgatttcatcccatttctcagtgattctcaaggtagaaaaggctatgatgcccatgtgggagaacgcggggtaaaactttctggtggtcagcgtcagagaattgccattgctcgtgtaatgttaaaagacgcaccaattctattgttagatgaagccacaagtgcattggattcagaagtggaagtggcaatacaagaaagtctagataagatgatggaaaataaaactgtgattgccattgcccatcgtttatccaccatcgcagcgatggatcgcctgattgtgcttgataaaggacaaattgtcgaacaaggtacgcacgccgaattactagagctcaatggtctgtacgctaaactttggaatcatcaaagtggcggatttttaagcgaaagtgctgaatga

SEQ ID NO: 34676 - protein, 614 aa, Haemophilus influenzae R2846
MFNKIFSWFENRLNPYPESNPTTPKKGLFRFIWSSITGMKGWIFLLAILTVGTGVMEAVLFQFMGTLVDWLGTFTPERLWQEKGHLLIGMAALLLISIVWGFLASAVHLQTLQGVFPMRLRWNFHRLMLGQSLSFYQDEFAGRVSAKVMQTALAVRDTVLTLANMFVYVLVYFITSGVVLVALDSWFLLPFITWIILFGLILRTLIPKLSKTAQRQADARSLMTGCITDAYSNIATVKLFSHGSREATYAKRSMQDFMVTVHAQMRLATSLDTLTYATNILLTLSTAILGIILWKNGQVGVGAIATATAMALRVNGLSRWIMWESARLFENIGTVNDGMNTLTKPHTIVDKPQASPLQVKQGEIKFNNITFAYDPTKPLLNHFNLTIKPGEKVGLIGRSGAGKSTIVNLLLRFYEAQQGEITIDGQNVLNVQQESLRRQIGLVTQDTSLLHRSVRDNIIYGRPNATDEEMVLAAERAKAADFIPFLSDSQGRKGYDAHVGERGVKLSGGQRQRIAIARVMLKDAPILLLDEATSALDSEVEVAIQESLDKMMENKTVIAIAHRLSTIAAMDRLIVLDKGQIVEQGTHAELLELNGLYAKLWNHQSGGFLSESAE

SEQ ID NO: 34677 - DNA, 1764 bp, Haemophilus influenzae R2866
  CDS (1)..(1764)
atgcaagagcaaaaattacaagaaaatgatttttcaaccttacaaacgtttaagcgtttgtggccaatgattaaaccttttaaagcggggcttattgtttctggcgtcgcgttagtttttaatgcattagctgactcaggcttgatttatttgttaaaaccgttgttggacgatggttttggtaaggcaaaccattcatttttgaaaatgatggcttttgtcgtcgttgggatgattattttacgcggcattaccaactttatttctaattattgcttggcgtgggtatcaggcaaagttgtcatgacaatgcgccgccgcttgtttaaacatttaatgtttatgccagtgagtttctttgatcaaaattcaacagggcgtttactttctcggattacttatgattcccaaatgattgcaagttcttcttcaggatctttgattacaattgtgcgagaaggagcatatattatttcgctattcgcagtgatgttttataccagttgggaattaacaattgtgctttttattataggtccaatcattgctgttttaattcgtttggtatcaaaaatttttcgtagattaagtaagaacttacaagattcaatgggtgaacttacgtctgctacagaacagatgttaaaaggtcataaagttgtgctttctttcggagggcaacatgtggaagaagtgcattttaatcatgttagtaatgatatgcgtcgaaaaagcatgaaaatggtgacagcaaattccatttctgatcctgtggtgcaagttattgcatctctcgcattagctacggtgctctatttagctaccactccattaattgcagaagataatttgagtgcaggctcatttacagtggtattttcttcaatgttagctatgatgcgtccgttaaaatcattaactgcggtgaatgcacaatttcaaagtggaatggcagcatgtcaaacgctatttgccattttagatttagagccagaaaaagatgacggggcttataaagcagaacctgcgaaaggcgagttagaatttaaaaatgtgagttttgcatatcaaggaaaagaggagcttgcattaaataatatttcttttagcgttccagctggaaaaaccgtagctctagtgggacgttctggatcgggcaaatcaaccattgctaatttagtgacacgtttttacgatattgagcaaggcgagattttacttgatggcgtaaatatccaagattatcgtttatctaatttacgtgaaaactgcgctgtggtttctcaacaagtccatttatttaacgatactattgcgaataatattgcttatgcagcacaagataagtattctcgcgaagaaattatcgctgcagcaaaagcggcttatgctttagagtttatcgaaaaattaccgcaaggttttgatacggtaattggcgaaaatggcgctagcctatcaggtgggcaacgtcagcgtttagcgattgctcgtgctttattgcgtaattcgccagtattaattttagatgaagctacatctgcactagatacggaatcagaacgagcaatccaatctgcattagaggaattaaagaaagatcgcacggttgttgtgattgcccatcgattatctactattgaaaatgcggatgaaattcttgtgattgatcacggagaaattcgtgagcgtggcaaccataaaacattgcttgaacaaaatggtgcctataaacagttgcatagtatgcagtttactggctaa

SEQ ID NO: 34678 - protein, 587 aa, Haemophilus influenzae R2866
MQEQKLQENDFSTLQTFKRLWPMIKPFKAGLIVSGVALVFNALADSGLIYLLKPLLDDGFGKANHSFLKMMAFVVVGMIILRGITNFISNYCLAWVSGKVVMTMRRRLFKHLMFMPVSFFDQNSTGRLLSRITYDSQMIASSSSGSLITIVREGAYIISLFAVMFYTSWELTIVLFIIGPIIAVLIRLVSKIFRRLSKNLQDSMGELTSATEQMLKGHKVVLSFGGQHVEEVHFNHVSNDMRRKSMKMVTANSISDPVVQVIASLALATVLYLATTPLIAEDNLSAGSFTVVFSSMLAMMRPLKSLTAVNAQFQSGMAACQTLFAILDLEPEKDDGAYKAEPAKGELEFKNVSFAYQGKEELALNNISFSVPAGKTVALVGRSGSGKSTIANLVTRFYDIEQGEILLDGVNIQDYRLSNLRENCAVVSQQVHLFNDTIANNIAYAAQDKYSREEIIAAAKAAYALEFIEKLPQGFDTVIGENGASLSGGQRQRLAIARALLRNSPVLILDEATSALDTESERAIQSALEELKKDRTVVVIAHRLSTIENADEILVIDHGEIRERGNHKTLLEQNGAYKQLHSMQFTG

SEQ ID NO: 34679 - DNA, 1809 bp, Anabaena variabilis ATCC 29413
  CDS (1)..(1809)
atggctatagcatctccatctcaccgggtattacaaaggcgtagacattctgcacatcctttacagcgcctgtttgactatggataccagtatcgtcaacaaatgttgttggcggttggttgttcaattctaaataagctttttgatttagctccaccagctttaattggtatggcggtggatgtggtagttaagcagcaggattctatcattgctcagttgggaataaaagatatctttgggcaatttttaattgtggcgctgctcacagtcatcacttggatactagagtcattttttgaatatcgctatcgcgtgttatggcgtaacctagcacagaatatccagcataacttacgtttggacgcatatagtcacctacaagaattggaattggcttattttgaagaacgtagcacaggtggtttaatgtctatcctcagtgatgatgttaaccaactagaacgttttttggacgtgggcgctaacgacattatccaggtagtcacgactattgtagtcgttggcggcgccttctttattttggctcccagcgtagcttggatggctattttaccaatgccatttattctgtggggttcggtggctttccagaaattgctagcaccacgttacgccgatgtacgggaaaaagtagggttactcaatgggcgtttgtccaataacctgagtggtatcaccacaattaaaagctttacggcggaagagtatgaaaaagggcgtttagaaatagatagttccgcttatcgtcaaagtaacacaagagcgatcgccttgtctgccgcttttattcccctaattcggatgctaattctcgtagggtttacctcattgctgctatttgggggtatggcaaccgttgcggggagaatgtccgtaggcgcttatagttcattagtatttttagtccagctactactttggcctttaactagattgggggaaacttttgatctttatcaaagggctatggcttccactaatagagtgatggagttgttagatactccgattacagcgtatacaggaaatattgctttacctgtagaagaagtacgcggtgccgtggaatttaacaatgttacttttgcctataaagatagattacctgtagttaaacatttatctttgcaaatacccgcaggtaatactattgctattgttggttctactggttctggtaaaagtactttagtaaaactgctgctgcgcttgtatgaagtgcaagctgggaaaataaccttagatgggatcaatatagaagatttaaagttacgcgatttacgccgtagtatgggtttagttagtcaagatgtattcctatttcatggcacggtagctgagaacatagcatacggtactttcgatgcgacagaacaagaaatcatcactgctgccaagatagcagaagcgcacgaatttattagccatctaccccagggttatgaaacaattgtgggagaaagggggcaaaagttatctgggggacaaagacaacgaatagccattgcacgggcggttttgaagaatccaccgattttgattttagatgaagctacctcggcagtggataatgaaacagaggcagcaattcagcgatcgctcgaacgaattaccatcaatagaactacaattgcgatcgctcaccgtctttccacaattcgcaatgctgattgtatatatgtcatggaacatggacaattagtggagtcaggaacccatgaagcattgttagacaaggatggaatatatgctaacctctggcgtgtgcagagtggtttgaaatga

SEQ ID NO: 34680 - protein, 602 aa, Anabaena variabilis ATCC 29413
MAIASPSHRVLQRRRHSAHPLQRLFDYGYQYRQQMLLAVGCSILNKLFDLAPPALIGMAVDVVVKQQDSIIAQLGIKDIFGQFLIVALLTVITWILESFFEYRYRVLWRNLAQNIQHNLRLDAYSHLQELELAYFEERSTGGLMSILSDDVNQLERFLDVGANDIIQVVTTIVVVGGAFFILAPSVAWMAILPMPFILWGSVAFQKLLAPRYADVREKVGLLNGRLSNNLSGITTIKSFTAEEYEKGRLEIDSSAYRQSNTRAIALSAAFIPLIRMLILVGFTSLLLFGGMATVAGRMSVGAYSSLVFLVQLLLWPLTRLGETFDLYQRAMASTNRVMELLDTPITAYTGNIALPVEEVRGAVEFNNVTFAYKDRLPVVKHLSLQIPAGNTIAIVGSTGSGKSTLVKLLLRLYEVQAGKITLDGINIEDLKLRDLRRSMGLVSQDVFLFHGTVAENIAYGTFDATEQEIITAAKIAEAHEFISHLPQGYETIVGERGQKLSGGQRQRIAIARAVLKNPPILILDEATSAVDNETEAAIQRSLERITINRTTIAIAHRLSTIRNADCIYVMEHGQLVESGTHEALLDKDGIYANLWRVQSGLK

SEQ ID NO: 34681 - DNA, 1776 bp, Synechococcus elongatus PCC 7942
  CDS (1)..(1776)
atgccccatccccttgtgcggttgtatcgctacagtgccccccatcaacggcaggtgctgagtgcgatcgcttgttcgatcctcaacaaaatctttgaccttgccccacccgtcctgattggcatggcggtggatgtggttgtccagcggcaggattcttggctggccaagtggggcgtcgtccccgttgaacagcagttagggctgttggtgctgttctcctttgtgatttggagcctcgaatcactgttcgagtatctctacgcttggcaatggcgcaccctcgcgcaaacgctgcaacatgagttgcgtttggatgcctacggccatttgcaagaactggagctgagcttttttgaggagcggagtactggtcagctactcagtgttctcaacgatgacatcaaccagctcgaacgcttcctcgaccacggcgcaaacgagattttgcaggtcacgaccaccgttctggcagtcggtggggcgatggcttatctctctccaaccgtggcagggctggcgattctgccgattcctgtcattctctggggatcgctgcgctttcaacggcgtttagccccgcgctatgcccgcgttcgcgaacaagccggtctgattagtgcacgactggcgaacaatttgggcggcattgccacgattaaaagtttcacggctgaggcatttgaaaaagggcgggtcgctgaggatagtgatgcctatcgccaagcgaatcgtcgggcgatcgcgctcagttccgcttttgttccattgattcgtttcgcgattctgtttgctttcatcgccattctttatgtcggtggaatggaaaccattaacggacggctcgatgtcggcacctatagctttttggtgttcattacccaacgtcttctctggcccttgaccagcttggggcgagtactggatgactaccaacgggcgatggcttcgacccagcgggtgatggatttgctggcgatcccggtgcaaattcccagcggtcgccaatctttgccgatcggccaagtgcaaggtgctgtccagtttgaaggcatcacctttgcttaccgtgatcgcgaacccagtgttatcgatctcaatctgaacatccccgctggtcaaacgattgcgatcgtcggggctactggttctggcaaaagtaccttagtcaaactgctgctgcgtttctatgaacctcaaaccggtcgcatcctactcgatgggattgatttgcgtgacttaaaactgaaggatttgcggcaggcgatcggcttcgttagccaggatgtttttctcttccatggcagtgttgctgagaacattgcctacggtagttttgacgcgactcagactgaaattgagcaagctgccaagctcgctgaagcccacgaattcatcatggatttaccccagggttacgacacagttgtgggcgaacgaggccagaaactgtcgggtggacagcggcagcgtttggcgatcgcgcgagccattctcaaggatccgccaatcctgatcctcgatgaagcaacctcggcagtcgataacgagaccgaagccgccattcagcgatcgctcgaacaaatcacccgcgatcggaccaccttggcgatcgcccaccgcctctcgacgattcgtcatgcggactgcatctatgtgatggatcagggtcgcttggtcgaagccggacaccatgacgaacttcttgccttggatggcctctatgccaacctctggaaagtgcaaaccggcgaacgtctgagcgatcgcgtttag

SEQ ID NO: 34682 - protein, 591 aa, Synechococcus elongatus PCC 7942
MPHPLVRLYRYSAPHQRQVLSAIACSILNKIFDLAPPVLIGMAVDVVVQRQDSWLAKWGVVPVEQQLGLLVLFSFVIWSLESLFEYLYAWQWRTLAQTLQHELRLDAYGHLQELELSFFEERSTGQLLSVLNDDINQLERFLDHGANEILQVTTTVLAVGGAMAYLSPTVAGLAILPIPVILWGSLRFQRRLAPRYARVREQAGLISARLANNLGGIATIKSFTAEAFEKGRVAEDSDAYRQANRRAIALSSAFVPLIRFAILFAFIAILYVGGMETINGRLDVGTYSFLVFITQRLLWPLTSLGRVLDDYQRAMASTQRVMDLLAIPVQIPSGRQSLPIGQVQGAVQFEGITFAYRDREPSVIDLNLNIPAGQTIAIVGATGSGKSTLVKLLLRFYEPQTGRILLDGIDLRDLKLKDLRQAIGFVSQDVFLFHGSVAENIAYGSFDATQTEIEQAAKLAEAHEFIMDLPQGYDTVVGERGQKLSGGQRQRLAIARAILKDPPILILDEATSAVDNETEAAIQRSLEQITRDRTTLAIAHRLSTIRHADCIYVMDQGRLVEAGHHDELLALDGLYANLWKVQTGERLSDRV

SEQ ID NO: 34683 - DNA, 2307 bp, Ralstonia eutropha JMP134
  CDS (1)..(2307)
atgacccagtcttccctgcctgtctctcaaagcctcgccccggatgagccgtggcgtgccgaagccggcgcgacgcttcgtcccggcgagaccgttctggctggactggaactcgacctcgacgcgaggctgcattttacccaagggtggctggttgtgacggaccggcggctcctggcccgtgctcccggtgaaaaaagtgtgcgggaatgggccatcgagccgggcctgcgcctgacccataccgaccacgccggcgttggcaccctcgaactgtgcgatgccgcgggccggctcggcagctggcgctacacgcttggttacaatcccgccgcgctgcggctggtggatcagttcgaagcacgccgcgatacggccccttccatggtccccgaggatgacggcgaagtgctgtgccccacgtgcaaggcaccgttgccaccgggcgaggaagaatgcccgcagtgcagccgcgagctcgaaaccccgtcgtcgacatgggcacttctgcgcctgtggcgttttgcgcgcccgtaccgctgggaattgctcactggcttcatgctgacgctgctgtccaccgcggccacgctggtaccgccttacctgaccatgccgctgatggacaaggtgctgatcccgtttcagaacggcgtgccgatcaactacgacctggtgcgcctgtacctcgccgggctgctcggtgcggcgctggtggcatggagcctgggctgggcgcgcacctacctgctggcgcgcgtgtcggaacgcatcggcgcggatcttcgcactaccacttacgagcatctgctgaagctgtcactcgagtatttcggcggcaagcgtacgggcgacctgatggcgcgcattggctcggaaagtgaccgcatctgcgtcttcctgtcgctgcacctgctcgacttcgcgaccgacgtgctgatgatcgtgatgaccgcgttgatcctggtgtcgatcaacccgtggctcgcgctcgtgacgctggtgccgctaccgttcatcgcctggatgatccaccttgtgcgcgacaagctgcgccatggcttcgagaagatcgaccggatctggtcggagatcaccaatgtgctggccgacacgattcccggcatccgcgtggtcaaggcgtttgcgcaggaaaagcgagaagtcgcgcggttccgcgaagccaacaagcacaaccttgccatcaacgatcgcgtgaatgcggtgtggtcgctgttcacgccgaccgtcacgctgctcacggaaatcggcctgctcgtggtgtgggtgttcggcatctggcaggtgtcgcacagcgccattacggtcggtgtgctggtggccttcctcacgtacatcagccgcttttatacgcggctcgattcgatgagccgcatcgtctcggtcacgcagaaggccgcggccggcgcgaagcggatcttcgatattctcgaccacgtatcaagcgtgcctgagcccgtgcggccggcaaagctggacaaggtagagggcgccatcgaaatgcgcgacctcggtttccgctacggtaaccgcgcggtgattcgcgggctggatctgtcgatcgcgccgggcgagatgattggcctggtgggtcacagcggctcgggcaagagcacgctcgtcaacctgatctgccgcttctatgacgtgtccgaaggcgcgatccgtgtcgacggcatcgacatccgctcgctgccggtgtcggaataccgtcgccatatcggcctggtgctgcaggagccgttcctgttcttcggcacgatcgccgagaatattgcttacggcaagcccgatgccacacgcgaggaaatcgtcgcggccgcgcgcgccgcgcacgcgcatgagttcatcctgcgcctgccgcacggctatgactcgctggtcggcgaacgcggacaggcgctgtccggcggcgagcgccagcgtatttcgatcgcgcgcgcgctgctgatcaatccgcgcatcctgatcatggacgaggccacgtcgtcggtcgacacgcagacggagaaggaaatccagaaggcgctcgacaatctcgtgcagggacggaccactatcgcgatcgcgcaccggctttcgacgctgcgcaaggccgatcgcctcgtggtgatggaccgcggcaagatcgtcgaagtcggcggtcacgacgaactgctggcgaaagagggcgcctactacaagctataccaggcgcaggcgcgcaatgtggataccgaggacgacgacaccgagagcgaaagcgaggtgcttgcgagggaagcggaggctgccaatgctcaatga

SEQ ID NO: 34684 - protein, 768 aa, Ralstonia eutropha JMP134
MTQSSLPVSQSLAPDEPWRAEAGATLRPGETVLAGLELDLDARLHFTQGWLVVTDRRLLARAPGEKSVREWAIEPGLRLTHTDHAGVGTLELCDAAGRLGSWRYTLGYNPAALRLVDQFEARRDTAPSMVPEDDGEVLCPTCKAPLPPGEEECPQCSRELETPSSTWALLRLWRFARPYRWELLTGFMLTLLSTAATLVPPYLTMPLMDKVLIPFQNGVPINYDLVRLYLAGLLGAALVAWSLGWARTYLLARVSERIGADLRTTTYEHLLKLSLEYFGGKRTGDLMARIGSESDRICVFLSLHLLDFATDVLMIVMTALILVSINPWLALVTLVPLPFIAWMIHLVRDKLRHGFEKIDRIWSEITNVLADTIPGIRVVKAFAQEKREVARFREANKHNLAINDRVNAVWSLFTPTVTLLTEIGLLVVWVFGIWQVSHSAITVGVLVAFLTYISRFYTRLDSMSRIVSVTQKAAAGAKRIFDILDHVSSVPEPVRPAKLDKVEGAIEMRDLGFRYGNRAVIRGLDLSIAPGEMIGLVGHSGSGKSTLVNLICRFYDVSEGAIRVDGIDIRSLPVSEYRRHIGLVLQEPFLFFGTIAENIAYGKPDATREEIVAAARAAHAHEFILRLPHGYDSLVGERGQALSGGERQRISIARALLINPRILIMDEATSSVDTQTEKEIQKALDNLVQGRTTIAIAHRLSTLRKADRLVVMDRGKIVEVGGHDELLAKEGAYYKLYQAQARNVDTEDDDTESESEVLAREAEAANAQ

SEQ ID NO: 34685 - DNA, 2070 bp, Exiguobacterium sp. 255-15
  CDS (1)..(2070)
atgtcgaacgtgaaggaagaagaattatatctattagatcccgttcgtcggaaaacgacgattcgatcacttgttcgttatgcgatgtatgaaaaacaagcaattttcctcggattatttctcttgattctggcagtcggagcagaattgaccggaccatatattgcgaaagtcatcatcgatgaacatattgttgcgattgaaaaggattgggttgaagtgaaggacggaggaagggtcgagtatgacgggcgccagtttgcgaagaagcaggatgtgccgtcttccgatgtcattcaagcgatttcagttgttcaatcgaagagcggttattattttgtgcccgaacaagtcgtcagcggaggagaacgcaacgtgaccggtggaacgttaaccgtcacgcgtggggaagaaacgtttcgttattcgggcgtcaagaagctgacgcaaggacaggtgtatgatttttatgcctctgacttaaaagcggtcggctggctgtctttgctgtatatcgtcctgctgttaatcgcggccggtttgaactgggtccaacaaatcctgcttcagcggtcggcgcataaaatcgtcaaatggatgcggctcgatgtctttacacatttacaacggttaccggtccgctattttgaccagacaccgatcggaaagattgtcagtcgtgtcacgaacgatacggaaacaatccgcgatttgtacttgggtgtgctcgcacgcgtcttttcgggattgattacgatggccggaattttagtggcgatgtttttcctcgatgtccgtctcggactcgtttcgctgttgattattccgatcgtctacttctggattcagctgttccagaaacttgcaacggaaaataacttcaaggtccggtcgcttgtcgcagatatgaatggtcagttaaacgagaacattcaaacgatgccgatcattcaagcgtatgcgcgggaaaaagaagtgttggcggaatttgaacaaaaaaatgaagagaattatcaaacccgttcgaagttgttgcggcttgatgccttaatgtcgcataacttatcgtatttcctgaaaaacctgacgctggccttattgatctgggtcgtggcgggtaaaagtctgaccgacggaacctttttatcgctcgggattttatatgcctacatcgactatgtctcgcgtctctttgaaccggtcacacaaatcatgaatcagttgtcgccgttgcaacaagcactcgtttcagcagaccggatgttccaactgctcgacgaaaagggagaagacgtcggaaagggacgtttaccccgtttcgccggacgtgtggagttcaagcaggtcggtttcagctatgatccgggtcatcctgtcttacaggacatcgaaattgatgcccgtcccggagcgacaatcgctctcgtcggacatacgggtagcgggaaaagttcaatcatgaatctgctgatgcgtttttatgatccatcgtccggtcaattgctgattgatggacaggatgtcacgtcactgccgaaacaggcggtccgcgatcatatgggcatcgtcctgcaggatccgtttttgttcacgggaacaatccgttcgaacatcacgctcggcaatccgatgatttccgaggaacggattcgggaagcgatcgtcgccgttggggcagaccggttcatcgaccgtcttcctaaaggtcttgatgaacccgtcatcgaaaaaggcgcgaccttatctgccggcgaacggcagttgatcagttttgcccgggctttggcgtttgatccggccattttagttctcgatgaagcgacggcaagcgtcgattcggaaacggaagcgatgattcaggacgccttattgacgttgacgaaagggcgcacgaccttcatcattgcccaccgtttgtcgacgatcaaagacgctgacgaaatcatcgtcctcgaccatggacggatatccgaacgcggaacgcatgaagagttactcgcaaaacaaaaaatctatgccaaaatgtatgcgttgcaaagtaaacgcaatctcgaattgaaatcaagctaa

SEQ ID NO: 34686 - protein, 689 aa, Exiguobacterium sp. 255-15
MSNVKEEELYLLDPVRRKTTIRSLVRYAMYEKQAIFLGLFLLILAVGAELTGPYIAKVIIDEHIVAIEKDWVEVKDGGRVEYDGRQFAKKQDVPSSDVIQAISVVQSKSGYYFVPEQVVSGGERNVTGGTLTVTRGEETFRYSGVKKLTQGQVYDFYASDLKAVGWLSLLYIVLLLIAAGLNWVQQILLQRSAHKIVKWMRLDVFTHLQRLPVRYFDQTPIGKIVSRVTNDTETIRDLYLGVLARVFSGLITMAGILVAMFFLDVRLGLVSLLIIPIVYFWIQLFQKLATENNFKVRSLVADMNGQLNENIQTMPIIQAYAREKEVLAEFEQKNEENYQTRSKLLRLDALMSHNLSYFLKNLTLALLIWVVAGKSLTDGTFLSLGILYAYIDYVSRLFEPVTQIMNQLSPLQQALVSADRMFQLLDEKGEDVGKGRLPRFAGRVEFKQVGFSYDPGHPVLQDIEIDARPGATIALVGHTGSGKSSIMNLLMRFYDPSSGQLLIDGQDVTSLPKQAVRDHMGIVLQDPFLFTGTIRSNITLGNPMISEERIREAIVAVGADRFIDRLPKGLDEPVIEKGATLSAGERQLISFARALAFDPAILVLDEATASVDSETEAMIQDALLTLTKGRTTFIIAHRLSTIKDADEIIVLDHGRISERGTHEELLAKQKIYAKMYALQSKRNLELKSS

SEQ ID NO: 34687 - DNA, 1842 bp, Methylobacillus flagellatus KT
  CDS (1)..(1842)
atggcaaatgatttccgcggcgacaagccgcttaatgacatcgagctggaacaggccttcgcccgcaaaaagctggatcgcagcatgttctggcgcctgctgccgctgctacaggatgtgaagggccgaattctcgtcgtcatcctgctcgaaatcattctggtgggtgtgatcttcatccgcccgtggttcctgcgcgaggtgatcgacaacggcttcctccagaccgcgcaaggcatcgtcctcaataccccgctgctagtctggatgtcggtcgccaccggtttgagctgggcattgcgctttagcttgggcagctattcgcaatacctcgccggcacggcggccatcgacatcctcaacaagttgcgcattcgcgtgttcagccatgtgcaggcgttgagcgtgcgctacttcgaccagaccaaggcaggccgcatcatctcccgcgccgaccgcgatatcgatacgctggagcccttgctggtgcaaggtccgcccgagctgttctcggcggtgttgcgcctggtcgtggcctcgctggccctgtggtggatttcgcccaaactgtttttagccctggccagcatcgtccctttcctcattctgggcacgtggctgttcaagcgcatctcggagaaaatctggggccgtgtcgccgaggcgcgtgcgcgctttaccgcgcacttggtggaaaccgtctctggcgtgcgcatcctcaagcagaccgtcaacgagtctagcaacgcacgccgttatcgcggattactggaagacttcaacaatatcctcatcagggggtccatgaagtcaagctggttcctgccgttgacgcaagtgctcagcatggtcggcatggctctcctgctcatggtaggcggtatcggcattgccgaccaggagatgacagtcggccagctcgcgcaaagcctattctacgtccaactgttcctcgggccgctgcaggagctgaatgatttgtttgagcgctacacttcaggtgcttcatcggcgcagcgcattttcctgatgctggataccgagcctgaaatccaggacccggcaatgccctcgacgcctgagcaggaatccggcaaggtggaattcgacaacgttgttttcggctaccagccggaaaagcccgtcatccgcggcttcaacctcgacattcatccgggcgaagtattggcgatcgtcgggccgaccgggcatgggaaaagcacattggtacagctgctgacgcgcttctatgaagtcaatgcgggcgcggtcaggatagacggccaggatgtgcgggagtatgcgcagcaggatctgcgccgcaaggtaggcatcgtgctgcaggacaacgtcctgttctccgggacagtgctggacaacctgcggctggcagcgcctggagccagcgacgaagccctgattgccgccacacgcgaactgggtgcggatgaagtgctggagcgactgcctgagggctatcgcacccaagtcggaccgcttggcgcattcctcagccacgggcagcgccaactggtttgcctggtacgcgcctatctcgccaacccatctgtgctggtgctggatgaagcgacttctgccgtggatatccacacagagcgtcgtatccaggccgccctgcgacgcttgtgcgaaggccgcaccgccatcatcatcgcccaccggcttgccaccatccgggatgcagaccgtattgccgttatctgggacggcaacatccaggagctgggcaaccaccaagtgcttatccaacaaggcggcgcctactcccggctttaccaggcatacgaagaagcctccaataccaacaaccagcctgcctag

SEQ ID NO: 34688 - protein, 613 aa, Methylobacillus flagellatus KT
MANDFRGDKPLNDIELEQAFARKKLDRSMFWRLLPLLQDVKGRILVVILLEIILVGVIFIRPWFLREVIDNGFLQTAQGIVLNTPLLVWMSVATGLSWALRFSLGSYSQYLAGTAAIDILNKLRIRVFSHVQALSVRYFDQTKAGRIISRADRDIDTLEPLLVQGPPELFSAVLRLVVASLALWWISPKLFLALASIVPFLILGTWLFKRISEKIWGRVAEARARFTAHLVETVSGVRILKQTVNESSNARRYRGLLEDFNNILIRGSMKSSWFLPLTQVLSMVGMALLLMVGGIGIADQEMTVGQLAQSLFYVQLFLGPLQELNDLFERYTSGASSAQRIFLMLDTEPEIQDPAMPSTPEQESGKVEFDNVVFGYQPEKPVIRGFNLDIHPGEVLAIVGPTGHGKSTLVQLLTRFYEVNAGAVRIDGQDVREYAQQDLRRKVGIVLQDNVLFSGTVLDNLRLAAPGASDEALIAATRELGADEVLERLPEGYRTQVGPLGAFLSHGQRQLVCLVRAYLANPSVLVLDEATSAVDIHTERRIQAALRRLCEGRTAIIIAHRLATIRDADRIAVIWDGNIQELGNHQVLIQQGGAYSRLYQAYEEASNTNNQPA

SEQ ID NO: 34689 - DNA, 1746 bp, Dechloromonas aromatica RCB
  CDS (1)..(1746)
atgaccagccgtgagctgtacctccggctgctgacttatgtccgcccatactggaaggcctttctcgccgcgctggcgtgcatgggggtggcctcgctggcggagccggtctttccggcgatcatgaaatcgctgctcgacgacggattttccaaggcaaatggcccatgggactggttgttctatccgctggccatcatgggcatcttcctggtccgcgccatttttggcttccttggcgattacctgatgagctgggtgtcgaacaacgtcgtggctgaattgcgccaggccatgtttgcccgcatggtccgcctgccgacccgctactacagcgacaacctgtccggtcgtctgatgtcgcgcattgcctacgacgtgaccggcgtggccggtgcggcgaccaatgcgctgacctcgctgatcaaggattcgctatccattgtcggcctgctcgtctggctgctctggctgaattggcagctgacgctgatcaccctgagcgtcgtgccattcatcgccatcgtcgtgcgtgtcttcagcaagcgcctgcgcagcgtggcccgggggcagcaggagtcgatgggcaagattacccaggtgctgcaggaggccattgagggccacaaggtcgtcaagattttcggcggtcagtcctacgaagaagatcgtttctatgaatcgatccgcgagcagcgccgcttggccatgcgcgcgacgctggcttctgccgcacaaagcccgctggtccagttctttgccgcttccggtgtggcgatcatcatgggcgttgcgctcaagcaggcctccagcgaccagacgacggtcggcagtttcgtttccttcgttaccgccatgctgatgctgatggcgccgctgaagcgggtcactgacgtcaacgcgccgatccagcgtggtctggccgcagcggaaagcgtcttttcgctggtcgatgaagagaccgagccggatagcggcaaggaagagctgggtcgcgcccaggggctggtcgaattcgacggggtgaccttcacctatccggggtcagaacgtccggcgctcgacagtgtgtcgctgaccgtgcggcccggcgagtgcgtggcgctggtcggcccctcaggcagtggcaagacgacggcggccaatctgttgccccgtttctacgccctcgacgccggcgaaatccgggtcgacggccatgcgctgccgaacatccgcctgaacagcctgcgcgacaacatcgcgctggtcagccaggatgtcgtgctgttcaacgacactattggcgccaacatcgcctacggtggcaagcgcgacgcgaccctcgacgaaatccgcgcggcggccaaggcagcgcatgcgctggaattcatcgatgccctgccagagggtttgaacaccatgatcggcgaaaatggcgtcaagctttccggcggccagcgccagcgtctggctattgcccgtgccattctgaaggacgcgccgatcctgattctcgacgaagcaacctcggccctcgataccgaatccgaacgccatgtccaggccgctctcgacgaactgatgcgtggccgcagcaccttggtcattgcgcaccggttgtcgaccatcgaacgcgccgaccgcattatcgccttggcccacggccacaagcaggaagagggctcgcatgccgaactgctcgcccacgatggcctgtacgcccgcctgtaccgcatgcagaaggcggaagaggtcgcggtctga

SEQ ID NO: 34690 - protein, 581 aa, Dechloromonas aromatica RCB
MTSRELYLRLLTYVRPYWKAFLAALACMGVASLAEPVFPAIMKSLLDDGFSKANGPWDWLFYPLAIMGIFLVRAIFGFLGDYLMSWVSNNVVAELRQAMFARMVRLPTRYYSDNLSGRLMSRIAYDVTGVAGAATNALTSLIKDSLSIVGLLVWLLWLNWQLTLITLSVVPFIAIVVRVFSKRLRSVARGQQESMGKITQVLQEAIEGHKVVKIFGGQSYEEDRFYESIREQRRLAMRATLASAAQSPLVQFFAASGVAIIMGVALKQASSDQTTVGSFVSFVTAMLMLMAPLKRVTDVNAPIQRGLAAAESVFSLVDEETEPDSGKEELGRAQGLVEFDGVTFTYPGSERPALDSVSLTVRPGECVALVGPSGSGKTTAANLLPRFYALDAGEIRVDGHALPNIRLNSLRDNIALVSQDVVLFNDTIGANIAYGGKRDATLDEIRAAAKAAHALEFIDALPEGLNTMIGENGVKLSGGQRQRLAIARAILKDAPILILDEATSALDTESERHVQAALDELMRGRSTLVIAHRLSTIERADRIIALAHGHKQEEGSHAELLAHDGLYARLYRMQKAEEVAV

SEQ ID NO: 34691 - DNA, 1704 bp, Rhodobacter sphaeroides 2.4.1
  CDS (1)..(1704)
atgctccgtgacttcttcacctattaccggccgtggctcggcctcttctggctcgacttcggctgcgccatagcctcggggctgctggaacttgccttcccgcttgcggtgcagggcttcatcgaccgtctgctgccgcagggcgactggagcctgaccatccttgctgcagcggggcttcttgcgatctatctcgtgaacaccgggctcatggcgatcgtgacctactggggccacatgctcgggatcaacatcgagaccgagatgcgccggcgcgccttcgagcatctccagaagctctcgttccgctacttcgaccgggtgcggaccggcaagctcgtggcgcgggtgacgcgcgatctcgaggagatcggcgaggtggcccaccacgggcccgaggatctcttcatcgcgatcatgaccttcatcggcgccttcctcctgatgctcgcgatcaatgtgaagctcgcgcttctgaccgcgctggtggttccggccacggtggcgctcgtctcgatctacggcggccgcatgaccgcgacctggcgcgcgatctatgcgcgggtggccgacttcaacgtgcggctcgaggagaatgtgggcggcatccgcgtggtgcaggccttcgccaacgagagccacgagaaggcgctcttcgcccgcgacaatgcccgctaccgcgacaccaagctcgcggcctaccgggtgatggccgcctcgcaggcgctgaactacatgggaatgcgctcggtgcaggtgatcgtcatggtcgcgggcgcggccttcgtgctctcgggcgagctgacgaccgggggcttcgtgggcttcctgttgctcgtcagcgtgttcttccgcccgctcgagaagatcgccgccgtgatcgagacctacccgcgcggcatcgcgggcttccgccgctaccgcgagctgctggacaccgagccggagatcgccgatgcccccggcgcccggcccgcacccgccctgaccggcgagatccgcttcgagggggtgggcttcggctatgaccagggccgcccggtgttgagcgggatcgacctctcggtgcggcccggcgagaccctggccttcgtcggcccctcgggggcgggcaagaccacgcttctggcgctcgtgccgcgcttctacgaccccgaatgcggccgcatcaccatcgacggcatggacctcaccgacatgacgctcgagagcctgcgccgtcggatcggcatcgtgagccaggatgtgttcctgttcggcggcacgctgcgcgagaacatcgcctacgggcggctcgaggcgaccgaggccgagatccgccgcgcggccgatcaggcgcagctcgggccgatgatcgccgccctgccggaggggctcgacacggtggtgggcgagcgcggcgtgatgctctcgggcgggcagaagcagcgcgtggccattgcacgggccttcctgaagaacccgccgatcctgatcctcgacgaggcgacctcggcgctcgacaccgagaccgagcgcgagattcaggcggcgctcgacgcgctagcggtggggcgcaccaccctcatcatcgcccaccgcctggccaccatccgccacgccgaccggatcgtggtgatggaggcgggccggatcgtcgaggtcggcacccatgccgaactcgccacgagcggcgggcgctacgcgcggctctcggccgcctga

SEQ ID NO: 34692 - protein, 567 aa, Rhodobacter sphaeroides 2.4.1
MLRDFFTYYRPWLGLFWLDFGCAIASGLLELAFPLAVQGFIDRLLPQGDWSLTILAAAGLLAIYLVNTGLMAIVTYWGHMLGINIETEMRRRAFEHLQKLSFRYFDRVRTGKLVARVTRDLEEIGEVAHHGPEDLFIAIMTFIGAFLLMLAINVKLALLTALVVPATVALVSIYGGRMTATWRAIYARVADFNVRLEENVGGIRVVQAFANESHEKALFARDNARYRDTKLAAYRVMAASQALNYMGMRSVQVIVMVAGAAFVLSGELTTGGFVGFLLLVSVFFRPLEKIAAVIETYPRGIAGFRRYRELLDTEPEIADAPGARPAPALTGEIRFEGVGFGYDQGRPVLSGIDLSVRPGETLAFVGPSGAGKTTLLALVPRFYDPECGRITIDGMDLTDMTLESLRRRIGIVSQDVFLFGGTLRENIAYGRLEATEAEIRRAADQAQLGPMIAALPEGLDTVVGERGVMLSGGQKQRVAIARAFLKNPPILILDEATSALDTETEREIQAALDALAVGRTTLIIAHRLATIRHADRIVVMEAGRIVEVGTHAELATSGGRYARLSAA

SEQ ID NO: 34693 - DNA, 1662 bp, Burkholderia cepacia R18194
  CDS (1)..(1662)
ttgcgcgaaagccgcgcgtcactcgtgctggcgctcaccgcgtgcgtattgaacggcgtcgcgagcgtgctgctcgtcgcgacgctgaaccgtgcactctcgcagcccggcgcggccgatgcgtcgctcgcgtggcgcttcgcgctgtgcgcggtgatcgcactcgtcacgcggatcgtgtcgggcacgctgttcgcgcgcctgtcgcaggacacgatggcgcgactgcgcgtgcatctcgcgcggcgcgtcggctcggccgaactgcgcgacatcgagcggatcggcgcggcgcccgtacagtcggtactgaccgacgacgccaccaacgtatcgatgctgttcttcgcgctgccgaacctggtcatgcacggctcgatcgtgttcggctgcctcggctacctcgcgtggctgtcgtggccggtgtgcctgctggcactggccgcgatcatcgccggctcgctcggctatcacaccggcgaccgccgcgcgatcgcatcgctcgaagcggccggccaggcgcaggaccgcctgttcggctatctcggctcgctgttttccggcgcgaaggaactgaagttgcatgacgagcgcgcgcgccagttcgtcgacggccagctcggcgccgcgatcggcgaagtgcgcgaccaccgccgccgcgcgttcagcgcgtacgcggtcggggtcggctggatcatcttcctgttctacgtgttcctcggcatcgcgtcgttctggccgcagctcggcgtgcatgccgatccggccgcggccgccggctacgtcgtcgtgttcctgttcatgctcgtgccgctcgacgggctgctgaacaacctgccgaccgtcaacgcggcccgcgtgtcgctcacgcggatcgaaggcgtgatggccgaattcggcgcgctgcgcacggtaccgccggcgtccgacgcgcccgacgtgccgccggccggcgccgtcacgctgcgcggcgtcacgcatgcgtacttccatgaacgcgacgaacggatgttcagcatcgggccgatcaacctgacgatccagccgggcgagctcctgttcatcgtcggcggcaacggcagcggcaagacgacgctcgcgaaggtgctgacggggctctacgagccggaagaaggcacgatcgaggtcgatggccgcacgatcggctggcgcgagcgcgccgcataccggcagcgtttcagcgcggtgttcaacgatttccacctgttcgatgcgctgctcggcatcgtcgatcccgacgatccgtcccgcgcgcaggccgatgcgcgcgcgaacgcgctgatcgcgaagctcgcgctcgatcacaaggtgaaggtagtggacggcgcgttctcgacccgcgcactgtcgaccgggcagcgcaagcggctcgcgctcgtcgtcgcgtacctggaggaccggccgttctacctgttcgacgaatgggcggccgaccaggacccgtcgttcaaggccgtgttctacgagcagttgctgcccgagctgcgtgcgcgcggcaaggccgttatcgtgatcacgcacgacgaccgctacttcgatctcgccgaccgcttgctgaagctcgacaacgggaaaatcgtcagcgacacgacgccggccaggacgcgcgcgcaggatggtgtcgacgcgctgagcgcgtaa

SEQ ID NO: 34694 - protein, 553 aa, Burkholderia cepacia R18194
MRESRASLVLALTACVLNGVASVLLVATLNRALSQPGAADASLAWRFALCAVIALVTRIVSGTLFARLSQDTMARLRVHLARRVGSAELRDIERIGAAPVQSVLTDDATNVSMLFFALPNLVMHGSIVFGCLGYLAWLSWPVCLLALAAIIAGSLGYHTGDRRAIASLEAAGQAQDRLFGYLGSLFSGAKELKLHDERARQFVDGQLGAAIGEVRDHRRRAFSAYAVGVGWIIFLFYVFLGIASFWPQLGVHADPAAAAGYVVVFLFMLVPLDGLLNNLPTVNAARVSLTRIEGVMAEFGALRTVPPASDAPDVPPAGAVTLRGVTHAYFHERDERMFSIGPINLTIQPGELLFIVGGNGSGKTTLAKVLTGLYEPEEGTIEVDGRTIGWRERAAYRQRFSAVFNDFHLFDALLGIVDPDDPSRAQADARANALIAKLALDHKVKVVDGAFSTRALSTGQRKRLALVVAYLEDRPFYLFDEWAADQDPSFKAVFYEQLLPELRARGKAVIVITHDDRYFDLADRLLKLDNGKIVSDTTPARTRAQDGVDALSA

SEQ ID NO: 34695 - DNA, 1740 bp, Burkholderia cepacia R1808
  CDS (1)..(1740)
atgacagccgcccacgagccctcttccccgccgtccctcgacgcctcccccggccgccccgccgcgcgcctgatcctcgcgctgctgcgcgaaagccgcgcctcgctcgcgctcgcgctcgccgcctgcgtgctcaacggcgtcgcgagcgtgctgctcgtcgcgacgttgaaccgcgcgctcgcgcagccgggcgcggccgatgcggcgctcgcgtggcgcttcgcgctgtgcgcggtgatcgcgctcgtcacgcggatcgtgtcgggcacgctgttcgcccggctgtcgcaggacacgatggcgcggctgcgcgtgcatctcgcgcggcgcgtcggcgcggccgagctgcgcgacatcgagcggatcggcgcggcgcccgtgcagtcggtgctcaccgacgacgcgaccaacgtgtcgatgctgttcttcgcgttgccgaacctggtgatgcacggctcgatcgtgttcggctgcctcagctatctggcgtggctgtcgtggcccgtgtgcgtgctcgcgctcgccgcgatcgtcgccggctcgctcggctatcacaccggcgatcgccgcgcgatcgcgtcgctcgaggcggccggccgcgcgcaggaccggctgttcggccatctcggctcgctgttctccggcgcgaaggagctgaagctgcacgacgcgcgcgcgcgccagttcgtcgacggccagctcggcacggcgatcggcgaggtgcgcgaccatcgccgtcgcgcgttcagcgcgtatgcggtcggcgtcggctggatcatcttcctgttctacgtgttcctcggcgccgccgcgttctggccgcaactcggcgtgcacgccgacgcgtccacggccgccggctacgtcgtcgtgttcctgttcatgctggtgccgctcgacgggctgttgaacaacctgccgaccgtcaatgccgcgcgcgtgtcgctcgcgcgcatcgaagccgtgatggccgaattcggcgcgctgcgcacggtgccgcccgccagcgacgcgcccgacgtgccgccggccggcgccgtcacgctgcgcggcgtcacgcacgcgtatttccacgaacgcgacgagcggatgttccggatcggcccgatcgacctgacgatccggcccggcgagctggtgttcatcgtcggcggcaacggcagcggcaagaccacgctcgcgaaggtgctgaccggcctctacgaacccgaggaaggcacgatcgaggtcgacggccggccgatcggctggcgcgagcgcgccgcgtaccggcagcgcttcagcgcggtgttcaacgacttccatctgttcgacgcgctgctcggcatcgtcgatccggacgacccggcgcgcgcgcaggccgatgcgcgcgcgaacgcgctgatcgcgaagctcgcgctcgatcacaaggtgaaggtcgtcgacggcgcgttctcgaatcgcgcgctgtcgaccgggcagcgcaagcggctcgcgctcgtcgtcgcgtatctggaggaccggccgttctacctgttcgacgaatgggcggccgaccaggacccgtcgttcaaggccgtgttctacgagcaattgctgcccgagctgcgcgcgcgcggcaaggccgtgatcgtcatcacgcacgacgaccgctatttcgatctcgccgaccggctgctgaagctcgacaacgggcagatcgtcagcgatacggcgcccgcgcgggcgcgcgacggggagaacgcgctgagtgcgtga

SEQ ID NO: 34696 - protein, 579 aa, Burkholderia cepacia R1808
MTAAHEPSSPPSLDASPGRPAARLILALLRESRASLALALAACVLNGVASVLLVATLNRALAQPGAADAALAWRFALCAVIALVTRIVSGTLFARLSQDTMARLRVHLARRVGAAELRDIERIGAAPVQSVLTDDATNVSMLFFALPNLVMHGSIVFGCLSYLAWLSWPVCVLALAAIVAGSLGYHTGDRRAIASLEAAGRAQDRLFGHLGSLFSGAKELKLHDARARQFVDGQLGTAIGEVRDHRRRAFSAYAVGVGWIIFLFYVFLGAAAFWPQLGVHADASTAAGYVVVFLFMLVPLDGLLNNLPTVNAARVSLARIEAVMAEFGALRTVPPASDAPDVPPAGAVTLRGVTHAYFHERDERMFRIGPIDLTIRPGELVFIVGGNGSGKTTLAKVLTGLYEPEEGTIEVDGRPIGWRERAAYRQRFSAVFNDFHLFDALLGIVDPDDPARAQADARANALIAKLALDHKVKVVDGAFSNRALSTGQRKRLALVVAYLEDRPFYLFDEWAADQDPSFKAVFYEQLLPELRARGKAVIVITHDDRYFDLADRLLKLDNGQIVSDTAPARARDGENALSA

SEQ ID NO: 34697 - DNA, 2001 bp, Bacillus cereus G9241
  CDS (1)..(2001)
atgagcgtttcaaaacgattgtttcaatatgcgatgaaagtgaaaggaacgatttttgcagcgatgctaatgttatttattttcgttatcgcagagcttgctggtcctttcgtcgcgaaaacgatgattgatgatcatatcgttggaatagagaagccttggtatgaaacagaaaagagtgaagaggctgtttcgtataatggcaccttttataagcgaagcgatcgcttccaggaaggtgagaaaaaaggaaaagaagtacgcgtgatgcaagtcggttttcaatattattttgtaccgaataaagtaaatgcggaagggtcacgttctgtaaaagatgatatgattaccgttcaaaatggtaaggcggtgcaagtatataaagcgaaagcattaacgaaagaagaagtgtttgcgttttataaaccagaaataaaccgtctattattacttggtggtggctattttgctttattagtagtcgtttcattatttgcatatggaaagcaatttttcttacagaaggcagcgaacaaaattattcaaattatgagggaagatgtgttttctcatattcaaacgttgccgattcgttattttgatcatttaccggcggggaaaattgtttcgcgcgtgacgaatgatacagaggctattcgtgatttatatgtaacggtgcttgcaacattcgtttcaagtatcatctatattattgggatattcgctgcgctatttttacttgatgtaaaattggcgacgttatgtttacttatcatcccgattttaatcgtttgggccattctttatagaaagtacgcgtctgtatacaatcataaaatgcgttcgcgtttatctgatattaacggaacagtaaatgaatccattcaagggatgccaattattcaagcgttccgtcaagagcgtgaaacgaaaaaagagtttgaagaattaaatggcgattattttaagtatcaaaataaaattttgaatttaaatgcagcaacttctcataatttagtatccgtattaagaaatatcgctttcacaggtgtgatttggtatttcggtggcgcttcattaagtgctacaggcgtcatttctctagggatactgtatgcgttcgttgattatttaacacgattgttctcaccaattacaaatatggtgaatcagcttgctaacttagaacaatcgcgtgttgcatcagagcgtgtttttgaattgttagaggaaaaaggagaagcagtagaagaagagcgtatgcctcgcttacaaggaaatgtgaagtttgataatgtgtcgttttcttataatgggaaagatgaagtgttaaaaaatatttcttttgaagcgaaacaaggcgagaccgtggcacttgtcggtcatactggatcaggaaaaagttctattatgaacgtactctttcagttttacgagtttgaaaaaggaaagctgacgattgatggtcatgatgtaaaagagatgccgaaacaagcaactcgtgaacatatgggaattgtactgcaagatccgtttttatttagcggaacagtagcatctaatgtaagtttagaaaatgaaaaaatttcaaaagatcgcatcataaaagcgttgcgtgatgttggtgcggaaagatttgcgaacaatataaatgaagaaattacagagaaaggaagtactctttcaaccggagaacgtcagcttatatcgtttgctagggcgctcgcttttgacccagccattttaattttagatgaagcgacatctagtatcgatacagaaacagaggcgatgattcaacaagcgctagaagttgtgaaaaaaggaagaacgacatttattatcgctcaccgactttcaacaattaaaagcgcagatcaaattattgtgcttgatagaggaaccattttagaaaaagggtctcatgatgagctaatgaaaaagcgcgggcgttattatgatatgtacaaaacgcaaatggaagggaaccagagcgcttaa

SEQ ID NO: 34698 - protein, 666 aa, Bacillus cereus G9241
MSVSKRLFQYAMKVKGTIFAAMLMLFIFVIAELAGPFVAKTMIDDHIVGIEKPWYETEKSEEAVSYNGTFYKRSDRFQEGEKKGKEVRVMQVGFQYYFVPNKVNAEGSRSVKDDMITVQNGKAVQVYKAKALTKEEVFAFYKPEINRLLLLGGGYFALLVVVSLFAYGKQFFLQKAANKIIQIMREDVFSHIQTLPIRYFDHLPAGKIVSRVTNDTEAIRDLYVTVLATFVSSIIYIIGIFAALFLLDVKLATLCLLIIPILIVWAILYRKYASVYNHKMRSRLSDINGTVNESIQGMPIIQAFRQERETKKEFEELNGDYFKYQNKILNLNAATSHNLVSVLRNIAFTGVIWYFGGASLSATGVISLGILYAFVDYLTRLFSPITNMVNQLANLEQSRVASERVFELLEEKGEAVEEERMPRLQGNVKFDNVSFSYNGKDEVLKNISFEAKQGETVALVGHTGSGKSSIMNVLFQFYEFEKGKLTIDGHDVKEMPKQATREHMGIVLQDPFLFSGTVASNVSLENEKISKDRIIKALRDVGAERFANNINEEITEKGSTLSTGERQLISFARALAFDPAILILDEATSSIDTETEAMIQQALEVVKKGRTTFIIAHRLSTIKSADQIIVLDRGTILEKGSHDELMKKRGRYYDMYKTQMEGNQSA

SEQ ID NO: 34699 - DNA, 1725 bp, Bacillus cereus G9241
  CDS (1)..(1725)
atgagtagctggattaaaccgtatatacagcaaaataaaggtagaatgactgtaactattttccttggtcttcttggagttagttcaggtgcgatgttacttttcatttcaggttatttaatctctaaatctgctcttagaccagaaaatgtaatggctgtatatgttcctatcgttgcaacacgtgcgtttagtataggacaagcggtatttcattatttagagcgtttagttggacacgatgttgtactacgcatattagaaaagatgagaacgaaactatatggaatagtagaaccacaggcgttatttttccgttcacgatttcaaacgggcgatatgttaggagtattatccgaagatatagagcatttgcaaaacctatatttacgtacaatatttcctagcatattagcattagttgtatacagcatattcgtagttgttattggtgcatttgacgtagtgtttgcacttattgcagcatgtatgttagctattatcgtttttcttcttccatttgtatcactgcttttaatgaagcaacatcatgttactttaaagcaaggaagaagccgtttgtatcaacaactaacagacgctgtttttggattatctgactggcaagcaagtggtagaaaagatgaatttattgataagtatgtagagcaaaatgctcaattgctaaaaacggaaaaaagaatgaagcgctggaatcatattcgggacagtatcattcaattagtagtagggattgtagttatttcaatgattatatggactggaaatgaggctgcgagtgaacagattgctcctaccgttattgcagctttcgtcttaatgacgttatctgtcacaaacgcgttaattcctttttcagatgctatcgatcgaattccatcatatgtagaatctgctcatcgtctcaatcaagtagaaggtaatggtgttttacaggatgaaaaggaattacctagagataaagattatgttgcaccaaaacatatagacattgaattaaatcatgtatcgtatagttacccagatagtaatgaagttgtattgaaagacgtatcattacaaataaaagcaggaaaaaaaatcgcgattttaggaagaagcggaactggaaaatctactttgttaaaattgttaacaggtgcactaagcccattgcatggtgaagttttattgaatagtgaacatgctcacacgaatcttttatcaaaatatatttctgtattgaatcaaaagccgcatttattcgatacgacaattgggaataatgtgcgaatcggcaaaccagaggcaacagatgaagagatatggaatgctttagagaaagcacaattagcttcgcatgttgcttctcttccagatagattacaaacaaaaatgcatgagatggggaaaagattttctggcggggaaagacaacgggttgcttttgctagaacgctaatgcaagaagcaccaatcattgtactagatgaacctacaatcggcttagatccaaagacagaattatctttaatagaaacaatgttttctgcaacggaagaaaagacagtaatttggattacgcaccatcttgtaggaattgagcatgttgatgaagtaatattccttgatcgtggtcaaattgtgatgcaaggtagtcatgaacaacttctgaaagaaaatgaaaagtatcgtatgctttatgagttagacaaaggaatataa

SEQ ID NO: 34700 - protein, 574 aa, Bacillus cereus G9241
MSSWIKPYIQQNKGRMTVTIFLGLLGVSSGAMLLFISGYLISKSALRPENVMAVYVPIVATRAFSIGQAVFHYLERLVGHDVVLRILEKMRTKLYGIVEPQALFFRSRFQTGDMLGVLSEDIEHLQNLYLRTIFPSILALVVYSIFVVVIGAFDVVFALIAACMLAIIVFLLPFVSLLLMKQHHVTLKQGRSRLYQQLTDAVFGLSDWQASGRKDEFIDKYVEQNAQLLKTEKRMKRWNHIRDSIIQLVVGIVVISMIIWTGNEAASEQIAPTVIAAFVLMTLSVTNALIPFSDAIDRIPSYVESAHRLNQVEGNGVLQDEKELPRDKDYVAPKHIDIELNHVSYSYPDSNEVVLKDVSLQIKAGKKIAILGRSGTGKSTLLKLLTGALSPLHGEVLLNSEHAHTNLLSKYISVLNQKPHLFDTTIGNNVRIGKPEATDEEIWNALEKAQLASHVASLPDRLQTKMHEMGKRFSGGERQRVAFARTLMQEAPIIVLDEPTIGLDPKTELSLIETMFSATEEKTVIWITHHLVGIEHVDEVIFLDRGQIVMQGSHEQLLKENEKYRMLYELDKGI

SEQ ID NO: 34701 - DNA, 1761 bp, Bacillus cereus G9241
  CDS (1)..(1761): k means g or t/u, m means a or c
atggaagttagaaatgagacaaagaaaaaagggagctggaggcagtttttacgccttattcaagatacaaatcctccgaaagggattcttgtttttgcgttattaatgmgtttgctttctactggagcaagtttatttattccgatgttaacaaaaggattagtagataatttttcactttcgtcaattagtacaggacaaattgttgggctagttgcattctttataatgcaaacggtagctgcaggattatctatatatttactaaattatataggacagaagattgtagctggactgagagaacgtttgtggaaaaaggtgcttatattgccagtatcttattataatcaaaatagaacaggcgatacaattagccgaatgacaaatgatacaggagttgtgaaaacattaatttctgagcatttatcaaacttattaacaggtggtatttcaatcgtcggatcattaattgtactattcgttttagattggaaaatgacacttttacttttaacggttatcccattatcagtactaattttagttccacttggacgaaaaatgtataagattttaaaagcacttcaagatgaaacagcttcttttacaagtgtgctaacgcaagtattatcagaaattcgtttagtgaaatcttcaaakacagaaaaaagagaatatgaaacagggaatacaggtatacaaaagttattacaatttggtttgaaagagggaaaagtgcaagcgttaatttcaccagttatgtcgtttgttttaatggcattacttgttatcatcgtaggctatggtggaatgcgagtttctagtggtgcattaacaacgggtgaacttgtagcgtttattttatatttagttcaaattattatgccgatgagtcaattatctatgttctttacacaattccaaaaggcaattggtgcaacggaaagaattaataccattttagaatatgaagtagaagaccatgaaactggtgcgaaagttacaaatgctaaacaaccaatcgttcttgaaaatgtacattttgagtacaacgaagaagagcaagtgttaaagaatattgatttcacaattgaatcaggaaaagtgacagcgattgtagggccaagtggtagtgggaaaacaacgttattctcattattagagcgtttttatgagccaactagcggtgccattaaattaggaaaagactcaattacgaactattcattacagtcatggcgccgtcaaattggttacgtttcacaagatagtccgttaattgatggaacgattcgtgataatatttgttacggtgttgagggcgaagtgacagatgaagaaattgaaaaagtagcggcgatggcatatgttgatgcatttattcatgatttaccgaacggatatgcaacagaagttggagaacgtggtgtgaagctttctggaggacaaagacagcgaattgccattgcccgagcattacttagaaatccacaaattcttatgttagatgaggcaacttcaagtttagatagtaaatcggagtctgtcgttcaaaaggcattaaataacttaatgaagggcagaacaacgttagttattgcacatagactttctacagttgtagatgcagataaaattatctttatagaaaaagggaatcttacaggaagtggtacgcacgatgaattattacgtacacatgacatgtatcgtgaatttgcaacgcaacaattgaaaattaaagaggctgcattataa

SEQ ID NO: 34702 - protein, 586 aa, Bacillus cereus G9241
  misc_feature (37)..(37): Xaa can be Arg or Ser
  misc_feature (221)..(221): Xaa can be Asn or Lys
MEVRNETKKKGSWRQFLRLIQDTNPPKGILVFALLMXLLSTGASLFIPMLTKGLVDNFSLSSISTGQIVGLVAFFIMQTVAAGLSIYLLNYIGQKIVAGLRERLWKKVLILPVSYYNQNRTGDTISRMTNDTGVVKTLISEHLSNLLTGGISIVGSLIVLFVLDWKMTLLLLTVIPLSVLILVPLGRKMYKILKALQDETASFTSVLTQVLSEIRLVKSSXTEKREYETGNTGIQKLLQFGLKEGKVQALISPVMSFVLMALLVIIVGYGGMRVSSGALTTGELVAFILYLVQIIMPMSQLSMFFTQFQKAIGATERINTILEYEVEDHETGAKVTNAKQPIVLENVHFEYNEEEQVLKNIDFTIESGKVTAIVGPSGSGKTTLFSLLERFYEPTSGAIKLGKDSITNYSLQSWRRQIGYVSQDSPLIDGTIRDNICYGVEGEVTDEEIEKVAAMAYVDAFIHDLPNGYATEVGERGVKLSGGQRQRIAIARALLRNPQILMLDEATSSLDSKSESVVQKALNNLMKGRTTLVIAHRLSTVVDADKIIFIEKGNLTGSGTHDELLRTHDMYREFATQQLKIKEAAL

SEQ ID NO: 34703 - DNA, 1755 bp, Bacillus cereus G9241
  CDS (1)..(1755)
atgaaatcatttcgtaagttattacagtatttaaaaccatacatgttcttcgctattattggaccgctatttatggtacttgaggttgcgatggacttaattcaaccgactattatgcaacatattattgatgttgggatagcaaatcgggatatgaattatgtaataaaaatgggacttcttatgataggagctgcagcactcggtttaattggaggactggggtgtatgatgtattctacaaaagcagctgttaatttcgctactgacatacgaaaagatgtgtttgcgaaaatagaaacattttctagtgaaaatcgtgattcgtttggaactggaaagttattaacaattgtgacaaatgatattacttctattcaatcggcgatgacgatgacattacgtgttcttgttcgtggtcctttgctatttattggaagtgtaatcattgtttttgtgacagcacgcgagttatttcctatattactcgtagtcgttccaattttattacttgcgattatattcattgcaagtaaagcaagcgggacgttcagaaaagtgcaagaagcattagataaagtgaatacaaagttacaagaaaatttatctggagtacgtgttattaaagcgtatgtaagacaaaaatatgaaattaatcagtttggaaatgttaatacaaatttaacgaagataaatattcgagcagtgcagcttatttccataatgatgccaatcattatgttagttgtgagcggcgggattgtcgcaacattatggattggtggagaaaaagtatttaatggaactcttcaagtaggggctatattagcatttataaactatttgaatattattttaatgtcacttatgtctataagtatggtatttatgcaaatcgcacgagcatttccgtcagcggatcgtgtacagcaagtgttaaatactgaggttgatattatgaccccaaaaaatgcacttgcacctaagcaaattgaggggcaaattgactttaaaaatgttagttatagttacacgaaaaataatgaatatgttttaaaagatatttcatttcgcatatgtaaaggtgaaaaaatagggattattggttctacagggagtggtaaatctacgttagcaaaactaataccgcgtttatacgatgttgatcaaggagaaatatgcattgatggaataaatgttagggcgtatgatttacaaaaacttcgtgcttcaatcgggtttgtaccccaaaaggcattgttgttttcaggtagcatagaagagaatttacgttatggtaaagaagatgcatcgaatgacgaattggaagtagcggcttcatcagcttgtgcgactgagtttattaacaagttggaagattcatatcaataccatttaacacaaggtgcgacgaatttgtcaggtggacaaaaacaacgtgtatcaattgcaagggcgcttgtgagaaagccatccattcttatattagatgattctacatcagcagtggatgcaaaatcagaatctaacattcaatcggcattaagaacagaatataaaggaacaacaacattattaatcgcttctaaaatctcatctataatagatgctgataaaattcttgttttagataacggtgaattagttggtgatggtacacatgaagaactgttagaacaatgtgaggtatataaagaaatctatctttcccaaggtggctatttacataaagaaggtgggaaagaacatgcgtaa

SEQ ID NO: 34704 - protein, 584 aa, Bacillus cereus G9241
MKSFRKLLQYLKPYMFFAIIGPLFMVLEVAMDLIQPTIMQHIIDVGIANRDMNYVIKMGLLMIGAAALGLIGGLGCMMYSTKAAVNFATDIRKDVFAKIETFSSENRDSFGTGKLLTIVTNDITSIQSAMTMTLRVLVRGPLLFIGSVIIVFVTARELFPILLVVVPILLLAIIFIASKASGTFRKVQEALDKVNTKLQENLSGVRVIKAYVRQKYEINQFGNVNTNLTKINIRAVQLISIMMPIIMLVVSGGIVATLWIGGEKVFNGTLQVGAILAFINYLNIILMSLMSISMVFMQIARAFPSADRVQQVLNTEVDIMTPKNALAPKQIEGQIDFKNVSYSYTKNNEYVLKDISFRICKGEKIGIIGSTGSGKSTLAKLIPRLYDVDQGEICIDGINVRAYDLQKLRASIGFVPQKALLFSGSIEENLRYGKEDASNDELEVAASSACATEFINKLEDSYQYHLTQGATNLSGGQKQRVSIARALVRKPSILILDDSTSAVDAKSESNIQSALRTEYKGTTTLLIASKISSIIDADKILVLDNGELVGDGTHEELLEQCEVYKEIYLSQGGYLHKEGGKEHA

SEQ ID NO: 34705 - DNA, 1833 bp, Pseudomonas fluorescens PfO-1
  CDS (1)..(1833)
atgctctatcgccgtttcgaacaactgatcgacatattccgcgacgccccgacggcgtctccgccggaccgcgttctgcccttctatacctattacctgaagcaggtctggccgagtttcgccgccctgctgatcgtcggcctgttcggtgcactgatcgaagtggcgctgttcagctacctgagtcgcatcatcgacctcgcccagggtacgccgaacgtcgacttcttcaaggtgcacggcgtcgaactggcgtggatggcggtggtagcgttactgctgcgcccgctgttcctggcgctgcacgacatgctggtgcaccagaccctgagcccgagcatgaccagcatgattcgctggcagaaccacagttacgtgctcaagcagagcctgaatttcttccagaacgacttcgccgggcgcattgcccagcgcatcatgcagaccggcaactcgctgcgcgattccgccgtgcaagcggtggatgcgctgtggcacgtgctgatctacgcgatcagttcgctggtgctgttcgccgaggccgactggcgcctgatgatcccgctgctgacgtggatcgccgcctacatcggcgcgctctattacttcgtgccacgggtcaagaaccgctcggtggaagcctccgatgcgcgctcgaagctgatgggccggatcgtcgacggctacaccaacatcgccaccctgaagctgttcgcccacaccaatttcgaacagcactacgcccgcgaagcgatccaggaacagaccgaaaaagcccagctggccggccgcgtggtcaccagcatggacgtggccatcaccaccatgaacggcctgttgatcgtcggcaccacggcgctggccctgtggctgtggacgcaatcgctgatcagcgtcggcgcgatcgccctggccaccggtctggtgatccgcatcgtcaacatgtccggctggatcatgtgggtggtcaccgggatcttcgaaaacatcggcatggttcaggatggtctgcagaccatctcgcaaccggtcagcgtcaccgaccgggagcaggccaaaccgctggccgtcgcccgtggcgaagtgcgtttcgagcacgtggattttcactacggcaagaagaaaggcatcatcggcgaccttaacctgaccatcaaaccgggcgagaaaatcggtttgatcggcccgtccggcgccggcaaatcgaccctggtcaacctgctgttgcgcctgtacgacgtcgagggcgggcggatcctgatcgacggccagaacatcgccgaagtcggccaggaaagcctgcgcgcacggatcggcatgatcactcaggacacctcgctgctgcaccgctcgatccgcgacaacttgctgtacggcaagcccgacgccactgacgcggagctctgggaagcggtgcgcaaggctcgcgccgatgagttcatcccgttgttgtcggacgccgaaggacgcaccgggttcgatgcgcatgtcggcgaacgcggggtgaaactgtccggtggtcagcgtcagcggatcgcgattgcgcgggtgctgctcaaggacgcgccgatcctgatcatggacgaagcgacctcggccctggactcggaagtcgaagcggcgatccaggaaagcctggaaaccctgatgcagggcaagaccgtgatcgccatcgctcaccgcctctcgaccattgcccgcatggaccgactggtggtgctggagaacggcaagatcgccgaaagcggcaaccatgccgaactgctggcccatggcggattgtatgcgcggttgtgggcgcaccagaccggagggtttgtcggcatcgactga

SEQ ID NO: 34706 - protein, 610 aa, Pseudomonas fluorescens PfO-1
MLYRRFEQLIDIFRDAPTASPPDRVLPFYTYYLKQVWPSFAALLIVGLFGALIEVALFSYLSRIIDLAQGTPNVDFFKVHGVELAWMAVVALLLRPLFLALHDMLVHQTLSPSMTSMIRWQNHSYVLKQSLNFFQNDFAGRIAQRIMQTGNSLRDSAVQAVDALWHVLIYAISSLVLFAEADWRLMIPLLTWIAAYIGALYYFVPRVKNRSVEASDARSKLMGRIVDGYTNIATLKLFAHTNFEQHYAREAIQEQTEKAQLAGRVVTSMDVAITTMNGLLIVGTTALALWLWTQSLISVGAIALATGLVIRIVNMSGWIMWVVTGIFENIGMVQDGLQTISQPVSVTDREQAKPLAVARGEVRFEHVDFHYGKKKGIIGDLNLTIKPGEKIGLIGPSGAGKSTLVNLLLRLYDVEGGRILIDGQNIAEVGQESLRARIGMITQDTSLLHRSIRDNLLYGKPDATDAELWEAVRKARADEFIPLLSDAEGRTGFDAHVGERGVKLSGGQRQRIAIARVLLKDAPILIMDEATSALDSEVEAAIQESLETLMQGKTVIAIAHRLSTIARMDRLVVLENGKIAESGNHAELLAHGGLYARLWAHQTGGFVGID

SEQ ID NO: 34707 - DNA, 1794 bp, Pseudomonas fluorescens PfO-1
  CDS (1)..(1794)
atgatcccgatgctttcctcgcgccaccgccgggccttgcgcctgaccagttctttccttgccccttatcgctggccggcctttggtgcgctgctggcactgatcgtcacggcgggcatcaccctgtcgatggggcagggcatcaagttgctggtcgatcaaggcttcatgactcaatcgccgcacttgctcaatcaatccatcggcctgttcatgctgttggtgctcggcctcgcggtcggcacgtttgcgcggttttatctggtgtcctggatcggtgagcgcgtggtggcggacatccgtcggcaggtgttcaaccatctggtgtacctgcatcccgggttttacgaggacaaccgcagctcggaaatccagtcgcggctgaccgctgacaccacgctgctgcaatcagtgatcggctcgtcgctgtcgctgttcctgcgcaatttgctgatggtcattggcggtgtggtgctgctgttcatcaccaaccccaagctcaccagcatcgtggtaatagcactgccgctggtgattgcgccgatcctgatttttggccgccgcgtgcgtaacctctcccggctgagtcaggaccggatcgccgacattggcagttacgtctcggaaaccctcggccagatcaaaaccgtgcaggcctacaaccatcaggtgcaagacgaacagcgtttcgccagcaccgtcgagcaggcattcgagactgcgcgcaaacggattttccagcgggcctggctgatcacgctggtaatcgtgctggtgctcggcgccgtcgcggtgatgttgtgggtcggcggcatggacgtgatcgccgggcggatttctgccggtgaactggcggcgttcgtgttctacagcctgatcgtcggcagtgcgtttggcacgttgagcgaagtgatcggagagttgcagcgagcggctggcgccgccgagcgcatcgccgaattgctgcgttcggaaaacatcatccagccaccgaccacaggattggtgacgctgccggagcgggtcaaaggcgagctggagttgcaggatgtacgtttttcctacccttcgcgtcccgatagcctcgccgtcgatggcttgagtctgacgatcaacgccggggaaaccctcgcgctcgtgggaccgtccggcgcgggcaagtccacggtgtatgacttgctgctgcgtttctacgatccccgggaagggcggatcctgatcgatggcgtaccgctgacgagcctcgatccgctggacctgcgtcgctgcttcgcgctggtctcgcaaaccccggcactgttcttcggcagtgtcgaagagaacattcgctacggctgcccgaccgccacgctggagcaggtgcgggaggcggccagaatcgcccacgcccacgacttcatcgaacagatgcccgacggctaccagacccatctgggcgacggtggcctcggtctgtcaggcggacaacgccagcgcctggccattgcccgggcgttgctggtcgacgcgccgatcctgctgctcgacgaagccaccagcgcccttgatgcccaaagcgaacacctgattcagcaagcactgccgagcctgatgcaaaaccgcaccacgctggtcattgcccaccggttggcgacggtgaaaaacgccgaccggattgcggtgatggatcagggcaaactggtggcgatcggtacgcatcaggagttgatcgccagtaatccgctgtatgcgcggttggcggcgttgcagttcagtgatggtcgtcaggtttcaaccgaccctgtaaccgactaa

SEQ ID NO: 34708 - protein, 597 aa, Pseudomonas fluorescens PfO-1
MIPMLSSRHRRALRLTSSFLAPYRWPAFGALLALIVTAGITLSMGQGIKLLVDQGFMTQSPHLLNQSIGLFMLLVLGLAVGTFARFYLVSWIGERVVADIRRQVFNHLVYLHPGFYEDNRSSEIQSRLTADTTLLQSVIGSSLSLFLRNLLMVIGGVVLLFITNPKLTSIVVIALPLVIAPILIFGRRVRNLSRLSQDRIADIGSYVSETLGQIKTVQAYNHQVQDEQRFASTVEQAFETARKRIFQRAWLITLVIVLVLGAVAVMLWVGGMDVIAGRISAGELAAFVFYSLIVGSAFGTLSEVIGELQRAAGAAERIAELLRSENIIQPPTTGLVTLPERVKGELELQDVRFSYPSRPDSLAVDGLSLTINAGETLALVGPSGAGKSTVYDLLLRFYDPREGRILIDGVPLTSLDPLDLRRCFALVSQTPALFFGSVEENIRYGCPTATLEQVREAARIAHAHDFIEQMPDGYQTHLGDGGLGLSGGQRQRLAIARALLVDAPILLLDEATSALDAQSEHLIQQALPSLMQNRTTLVIAHRLATVKNADRIAVMDQGKLVAIGTHQELIASNPLYARLAALQFSDGRQVSTDPVTD

SEQ ID NO: 34709 - DNA, 1818 bp, Pseudomonas fluorescens PfO-1
  CDS (1)..(1818)
atgtctgacccggccgatgacacgccagccgtcaagcgtgtcgaccggctgagctgggctgaagtccggcgactggcacttcatcacaaaaaatccctgtggatcgccaacggcgtggccgtactggcgacgctgtgcagcgtgccgattccgctgctgttgccgttgctggtggacgaagtcttgctcggccatggcgacgccgcgctgaaagtcatgaaccacctgctgccctcgatgtggcagcaggcggcgggctatatcggcctgatgctggtggtgacgctgaccctgcgttgcagcgccctgtgttttggcgtgttgcaggcgcgattgtttgcgcgactggccaaggacatcgtgtaccgcatccgcgtgcggctgatcgagcgtctgaaacggatctcgctgggtgaatacgaaagcctgggcagcggcaccgttaccacgcacctggtcaccgacctcgacaccctcgacaagtttgtcggcgaaaccctcagccgttttctggtggcgatgctgacgctggtcggcactgccagcatcctgatgtggatgcactggaaactggcgctgctgatcctgctgttcaaccccttggtgatttacgccacggtgcagttgggcaaacgggtcaaacacctgaagaaactggagaacgacagcacctcgcgtttcacccaggcgctgagcgaaaccctcgatgcgatccaggaagtgcgtgccggcaaccgtcagggcttcttcctggggcgccttggcctgcgggctcaggaagtgcgcaactacgcggtcaactcacagtggaagaccgacgcttcgaaccgcgccagcggcctgttgtttcagttcggcatcgatatctttcgcgcggcagccatgttgacggtgttgttctctgacctgtcgattggccagatgctcgcggtgttcagctacctgtggttcatgatcggcccggtcgaacaactgctgaacctgcaatacgcctactacgcggcaggcggggcgctgtcgcggatcaacgaactgctggcccgcgccgacgagccgcaataccccggcggcgtcgacccgttcaagggccgcgatacggtcgggattcaagtgcagggtctgagcttcggttacggcgacgaactggtgctggatcagttgaacctgtccatcgcccccggtgaaaaagtggcgattgtcggcgccagcggtggcggcaaaagtaccctcgtgcaattgctgctgggcctgtacacgccactggcggggacgatccgtttcggcggctcgagccagcaggaaatcggcctggaaacggttcgggaaaacgtcgctgtggtgttgcaacatccggcgctgttcaacgacaccgtgcgcgccaacctgaccatgggtcgtacccgcagcgatgaagcctgctggcaggcactggaaatcgcccagctcgaacccaccatccgcgccttgccggacggcctcgacagcatcgtcggccgctccggcgtgcgtctgtccggggggcagcggcaacggctggctatcgcccggatgatcctcgccgaacccaaagtggtgatcctcgacgaagcgacgtcagccctcgatgccgcgaccgagtacaacctgcaccaggccatggcgcgcttcctccatggccgcacaacgctgatcatcgcccaccgcttgtcggcggtgaaacaggcagaccgggtgctggtgttcgacggcgggcaagtggccgaagatggcgaccatcagcaactgattgccgatggtgggttgtacgccaagctttatgggcatttgcagcggttgtag

SEQ ID NO: 34710 - protein, 605 aa, Pseudomonas fluorescens PfO-1
MSDPADDTPAVKRVDRLSWAEVRRLALHHKKSLWIANGVAVLATLCSVPIPLLLPLLVDEVLLGHGDAALKVMNHLLPSMWQQAAGYIGLMLVVTLTLRCSALCFGVLQARLFARLAKDIVYRIRVRLIERLKRISLGEYESLGSGTVTTHLVTDLDTLDKFVGETLSRFLVAMLTLVGTASILMWMHWKLALLILLFNPLVIYATVQLGKRVKHLKKLENDSTSRFTQALSETLDAIQEVRAGNRQGFFLGRLGLRAQEVRNYAVNSQWKTDASNRASGLLFQFGIDIFRAAAMLTVLFSDLSIGQMLAVFSYLWFMIGPVEQLLNLQYAYYAAGGALSRINELLARADEPQYPGGVDPFKGRDTVGIQVQGLSFGYGDELVLDQLNLSIAPGEKVAIVGASGGGKSTLVQLLLGLYTPLAGTIRFGGSSQQEIGLETVRENVAVVLQHPALFNDTVRANLTMGRTRSDEACWQALEIAQLEPTIRALPDGLDSIVGRSGVRLSGGQRQRLAIARMILAEPKVVILDEATSALDAATEYNLHQAMARFLHGRTTLIIAHRLSAVKQADRVLVFDGGQVAEDGDHQQLIADGGLYAKLYGHLQRL

SEQ ID NO: 34711 - DNA, 1659 bp, Pseudomonas fluorescens PfO-1
  CDS (1)..(1659)
atgaccactaaatcccgtggcgccatcagcgaagttctcagcctgctcaagccctattggctggtggtcctgatttcgatcatgctcggcatggtcggcggcctcagcgtcacggcgttgctggcgaccatcaatgacgccctgaacgccaacgggagcccgtcactgggtgtgctcgccagtttcgccgggctctgtgcactggcgctgctgagttcgatcctgtccgacatcggcaccaaccatgtcggccagcacatcattgccggactgcgaaaatcgctcggtgaaaaagtcctgctggcgccgatcgagcagatcgaacgcttccgcagccatcgcctgatcccggtgctgacccatgacgtcgacaccgtcagcgacttcgcgttttccttcgcgccactggccatcgccttcaccgtcaccctcggttgcctgggttacctggcctacctctcggtgccgatgttcgcgctgttgctggtggcgatcatcatcggcaccgtcgtgcagtacatcgcccgagccaaaggcatcaaaggctttgaagccgcccgtgaagccgaagacgaactgcaaaagcactacagcgccatcgcggccggcgccaaggaactgcgcatccatcgcccgcgccgtcagcgcatgttcagccagcgcatcgaaggcaccgccgattacatctgcaacacccacatccgttcgatcaacaccttcgtggtcgccaagacgtttggctcgatgctgttcttcgtggtgatcggcctggcactcgccctgcaatccttctggctgggcaccgacaaagcggtgctcagcggtttcgtgctggtgctgctgtacatgaagggcccgctggaatacctggtgaccaccctgccggtggtcagtcgcgccaacatcgccttcaaacgcattgccgatctggcggaacagttttcctccccggaaccgcacctgctgctgagcgacaccgccagcgtcaaaccggtggtcgagcatctggaactgcgtgatgttcactatgcatttgcagccgtgggcgacaacaaaccgttcaccctcggcccggtcaatctgtcgatccgtcagggcgaaatcgtgttcatcgtcggcgaaaacggcggcggcaaaaccaccctgatcaaattgctgttggggctgtatgcgccaaagggtggggaaatcctgctcaacggcgcacccgtggtggctgagaaccgtgacgattaccgtcagttgttcaccacgatttttgccgactactacctgttcgacgaactggtgcaaggcgatcaacaagtgcccgaggacgccaaccgctacctcgaacgcctggagatttcgcacaaggtcagcattcgcgatggcgcgttcagcaccaccgacctgtccaccggccagcgcaagcgtctggctctgctcaatgcctggctggaggaacgtccggtgctggtgttcgacgaatgggcggccgatcaggacccggtgttccggcggattttctacaccgagctgctgccggaactcaaatacctgggcaagaccatcattgtgatctcccacgacgaccgttatttcgacgtcgccgaccaactggtacgcatgcaaggcggccaggtcatcagcgaaaaagccccggcagccgtctgctga

SEQ ID NO: 34712 - protein, 552 aa, Pseudomonas fluorescens PfO-1
MTTKSRGAISEVLSLLKPYWLVVLISIMLGMVGGLSVTALLATINDALNANGSPSLGVLASFAGLCALALLSSILSDIGTNHVGQHIIAGLRKSLGEKVLLAPIEQIERFRSHRLIPVLTHDVDTVSDFAFSFAPLAIAFTVTLGCLGYLAYLSVPMFALLLVAIIIGTVVQYIARAKGIKGFEAAREAEDELQKHYSAIAAGAKELRIHRPRRQRMFSQRIEGTADYICNTHIRSINTFVVAKTFGSMLFFVVIGLALALQSFWLGTDKAVLSGFVLVLLYMKGPLEYLVTTLPVVSRANIAFKRIADLAEQFSSPEPHLLLSDTASVKPVVEHLELRDVHYAFAAVGDNKPFTLGPVNLSIRQGEIVFIVGENGGGKTTLIKLLLGLYAPKGGEILLNGAPVVAENRDDYRQLFTTIFADYYLFDELVQGDQQVPEDANRYLERLEISHKVSIRDGAFSTTDLSTGQRKRLALLNAWLEERPVLVFDEWAADQDPVFRRIFYTELLPELKYLGKTIIVISHDDRYFDVADQLVRMQGGQVISEKAPAAVC

SEQ ID NO: 34713 - DNA, 1674 bp, Rhodospirillum rubrum
  CDS (1)..(1674)
atgacggcgcccggcacggcccccgcgcccgcctcttcttcggcggcggccgcgtcaccgctggctctcgccttgcgcctgctgcggcccttctggcggcttgttctgctgtcgacgctgatgggcaccctgggcggcatcgccaccgccctgctgctggcggtcatcaaccgggccctgcgcggcgagggggatatggtcagcttcgcctgggccttcggcgggctgtgccttgccgccctgcttggccagggggcggccggattgggcagcgccatcgttggccagaaggtggtggtggcggtgcgtcgggagttggtcgcccatatcctgaccgcgccgatcgctcgcctggaacgcctgcgcgttcaccggctgatggcgacgctgggcggcgatgtcgatgctttgagcggcttttccctggtgctgtcgggattgggcgtggcagtggcgatcacctgcggctgccttggctatctcgttttgctgtcaccgccgctgtttctcgtcacgcttctggttctggggctgggcgtggggggtcatgcccgcatgcggcgcctggggcaggcgcgcttcgccgccgcccgcgccgccgaagacgatcttcagcgccattaccgggcgatcaccgaaggggccaaggaactgcggctcaaccggccaaggcgcatccgcctgttccacgccgatctcgaggccaccatcacccgcatcgccaagctgaggctgcgcgggcttggcgtgttccttggcgccaatctgtttggctcgctggcgcttttcgcggtgatcggcgggattttgctgatgacgcgggcggcgcccgaggctatcggggtcgaggacgtcagcggcttcgttctggttttattgttcatgaaggggccgatgcagcagattcttggcgccctgcccagcctgggccgcgcccagatcgccctgcgccgcatcgccgagcttggcgccgccggccaggaggggggcgatctgccggggttggcccccgggatgggcgaaggcgccgtgccgatgccagccgagatcacccttgaggcggtgagctaccgctttcccgagagcgccgccggcccgggattcaccctggggccgctcaccctgaccctgcgccggggcgagagcgtggtgatcaccggcgagaacggctgtggcaaaacgacgctgatcaagctgatccttggtctttaccagcccaccgccgggcgcgttctgcttgatggccgacccgttcgcgccggcgaatgggacgagtaccgccagcttttttcggcggttttcgccgattaccatctgtttgacgatggcatggccgaggggcggcaggcggcggaggcggcgcggctgctcgatgcctttgacctagcgacgaaaaccgcgctcaaggacggacgcttcaccaccaccgacctgtcggcgggcgaacgcaagcgtcttgccctgattttgctcgccctggaaggccggccgatcgtggtctttgatgaatgggccgccgaacaggatccggggttccgtcaccgcttctatcacacggtcttgcccgacctgaagcgccagggcagaaccgtgatcgtcgtgtcccacgatgaagggtatttcgactgcgccgatcgccgcatcgttttgaaaaacggcaagctcgccggctaa

SEQ ID NO: 34714 - protein, 557 aa, Rhodospirillum rubrum
MTAPGTAPAPASSSAAAASPLALALRLLRPFWRLVLLSTLMGTLGGIATALLLAVINRALRGEGDMVSFAWAFGGLCLAALLGQGAAGLGSAIVGQKVVVAVRRELVAHILTAPIARLERLRVHRLMATLGGDVDALSGFSLVLSGLGVAVAITCGCLGYLVLLSPPLFLVTLLVLGLGVGGHARMRRLGQARFAAARAAEDDLQRHYRAITEGAKELRLNRPRRIRLFHADLEATITRIAKLRLRGLGVFLGANLFGSLALFAVIGGILLMTRAAPEAIGVEDVSGFVLVLLFMKGPMQQILGALPSLGRAQIALRRIAELGAAGQEGGDLPGLAPGMGEGAVPMPAEITLEAVSYRFPESAAGPGFTLGPLTLTLRRGESVVITGENGCGKTTLIKLILGLYQPTAGRVLLDGRPVRAGEWDEYRQLFSAVFADYHLFDDGMAEGRQAAEAARLLDAFDLATKTALKDGRFTTTDLSAGERKRLALILLALEGRPIVVFDEWAAEQDPGFRHRFYHTVLPDLKRQGRTVIVVSHDEGYFDCADRRIVLKNGKLAG

SEQ ID NO: 34715 - DNA, 1719 bp, Rhodospirillum rubrum
  CDS (1)..(1719)
atgccgcccattcttgaagccttgaaccgggtcatcgccaccagcggccggccaaagggcgcgctgtggcgcggcctgggcttgcgggtgcttgaacggattttcgccatcaccccctttttcctcggctccctatggctggccgacgccgtctccggcagggaaccggcgttgtcgctgcccctgctcgggatgtgtctcgccgccctgctcgccggtcagatgctgtgttcctatctggggcagatggcctgtttccttggtgcctatgatctgatgatcggctaccgggaacaggtgatcgaccatatcggccgcctgcccttgggcgtcttgcaaaagcggcggatcgggcacctagcggccatcgtcaccgacgacgtgaagcgcgtggaagagatcttcacccatgtcgccatcgacctagtggcggcggccagcgcccctttgctgttcctggccgtgctgacctgggtggactggcggttgtcgctggcgctgatggtgactttgcccatggcgatcatcggcctgaatgccgccagggggtttttcctggccaggggccggaccaagcagaccctggtccaggagacctcggggctgatcgtggaattcgtcaccggcctgaaaaccctgcggcttttcaaccaaaccgcgccctggctcgatcgtctggaccggcgcttcgccgcccttcgcgagatcagcttgggggtggaggcctggggtggcgggtcgatccagctgtatcggctttgccttgaaggcgggctggtaagcctgttgctgaccgccggttggttggcgaaccgcggcgcgctcgatcctttggcctgggtgctgttcgccctggtcgccggcaagcttctcgagccactgctcgacgccgccgcgtttctgaccgaactgcgcttgatggtgctggccgagggccggatcgcggccttacgggccgagccgcttttgcccgagggaacggcgacgctcgccgccgccggcgaggtcgccttccagaacgtgagcttccgctatgacgacgcctgggtgctgcgcgacgtgtccttccgggtgggggcgggaaccatgaccgccatcgtcggcccctcggggtcgggcaaaaccacgttgctgcacctgctggcccgcttcttcgacccccaggccggagcggtgacgatcgccggccgggacatccgaacgctcgacacgcaagatctttaccggcacctgggcttcgtcttccaggacgttcaattgttcgacggaacccttctggaaaacctgctcatcggccgccccggagcggacgaggcggcggtggcggcggcctgcacggcggcctattgcgaccccttcctcgcgcgcctgcccgatggcttggccagccgcatcggcgagaacggccagcgtctgtcggggggcgagcgtcagcgcctgtccatcgcccgcgccatcctcaaagatgcccccattctgctgctcgacgaggcgacggcctcggtggatccggccgcccaatatgaaatccagcgcgccctgtcgcatctggcccaaggccggacggtgatcatggtggcccaccggctgcacaccattcgccatgcggaccagatcctggtccttgaccagggacggatccttgaacagggccgccatgacgacctcctcgcccaggccggcctttatgccgcgctgtggcgggaacaaagccgctaa

SEQ ID NO: 34716 - protein, 572 aa, Rhodospirillum rubrum
MPPILEALNRVIATSGRPKGALWRGLGLRVLERIFAITPFFLGSLWLADAVSGREPALSLPLLGMCLAALLAGQMLCSYLGQMACFLGAYDLMIGYREQVIDHIGRLPLGVLQKRRIGHLAAIVTDDVKRVEEIFTHVAIDLVAAASAPLLFLAVLTWVDWRLSLALMVTLPMAIIGLNAARGFFLARGRTKQTLVQETSGLIVEFVTGLKTLRLFNQTAPWLDRLDRRFAALREISLGVEAWGGGSIQLYRLCLEGGLVSLLLTAGWLANRGALDPLAWVLFALVAGKLLEPLLDAAAFLTELRLMVLAEGRIAALRAEPLLPEGTATLAAAGEVAFQNVSFRYDDAWVLRDVSFRVGAGTMTAIVGPSGSGKTTLLHLLARFFDPQAGAVTIAGRDIRTLDTQDLYRHLGFVFQDVQLFDGTLLENLLIGRPGADEAAVAAACTAAYCDPFLARLPDGLASRIGENGQRLSGGERQRLSIARAILKDAPILLLDEATASVDPAAQYEIQRALSHLAQGRTVIMVAHRLHTIRHADQILVLDQGRILEQGRHDDLLAQAGLYAALWREQSR

SEQ ID NO: 34717 - DNA, 2265 bp, Ralstonia metallidurans CH34
  CDS (1)..(2265)
ttgcaaggaccttggagcgccgaaatcggcgccaccctgcagcctggggaaaacgtcctggccggactgacgctggacctggacgcaaggttgcattttacccaagggtggctggttgtgacggaccgtcgcctgattgcgcgcgcgcccggtgaaaaaaccctccaggactgggaaatcacggccggccagacgctggcccatggggaccacgccggggtgggcacgctggaactgtcggatggccagcgccgcctggcaagctggcgctatacgcttggttacaatcccgacgcattgagactggccgaccagttcgatacgcgtcgcgacgccctggcaacgggccgcgccccggagccagccgataccgagatctgccccacctgcaaggcgccgttgccgccgggcgaggaacagtgcccgcaatgcagccgggaactggaaacgcccccgtcgacatgggcgctcctgcgcctgtggcgcttcgcgcggccctaccgctgggaactgctgggcggcttcgtcctgctactgctgggtaccgccgccacgctcgtaccgccgtacctgaccatgccgctgatggacaaggtgctgattccctaccagaacggtgtgccgatcgatatcggccttgtcaaactctacctggccggcctgctgggcgccgccctggtcgcctgggtgctgggctgggcacgtacctacctgctggcccgggtgtcggagcggatcagcgccgacctgcgcaccaccacctacgaacatctgctcaagctgtcgctcgagtatttcggcggcaagcgcaccggcgacctgatggcgcgcatcggctcggagagcgaccgcatcagcgtattcctgtccttgcacctgctggacttcgccaccgacgtgctgatgatcgcgatgacgtccatcatcctcgtgtcgatcaatccgtggctggcgctggttacgctggtgcccctgccgttcatcgcgtggatgatccatctggtgcgcgaccgcctgcgccatggcttcgagaagatcgaccggatctggtcggagatcaccaacgtgctggccgatacgattccaggtatccgggtggtgaaggccttcgcgcaggaaaagcgcgaagtgacgcgctttcgcgaggcgaacaagcacaacctggccatcaatgaccgggtcaacgcggtgtggtcgctgttcacgccgacggtcacattcctgaccgaggtgggtctgctggtggtctggatcttcggcatctggcaggtcagccacgatgcgatcaccgtgggtgtgctggtggcgttcctgacctatatcagccgcttctacacgcgtctggattcgatgagccgcatcgtctcggtgacgcagaaggctgccgccggcgccaagcggatcttcgatattctcgatcacgtgtcgagcgtgccggagccgcagaagccggtgcacatcgacaacgtccagggcgccatcgaattgcgcgacctcgggttccgctacgggaaccgtgccgtgatccgcgggttgaacctgtcgatccagccgggcgagatgatcggcctggtggggcatagcggctcgggcaagagcacgctggtcaacctgatctgccgtttctatgacgtgtccgaaggtgcgatccgcgtggacggtgtcgatatccgctcgctgccggtttcggagttccgccgccatatcggcctggtcctgcaggagccgttcctgttctttggcacgatcgccgacaatatcgcctacggcaagcccgacgcgacccgagaggagatcatcgcggccgcccgtgccgcccacgcccacgagttcattctgcgcctgccgcacggctacgattcgctggtgggagaacgtggtcaggcgttgtccggcggcgagcgccagcgcatctcgatcgcccgcgcgctgctgatcaatccgcgcatcctgattctggacgaagccacctcgtcggtggatacgacgacggagaaggaaattcagaaggcgctggacaatctcgtgcagggccgtaccacgatcgccatcgcgcaccgcctctccacgctgcgcaaggccgaccgtctggtggtgatggatcgtggccagatcgtcgaagtggggaatcacgacgaactgatggcgcgtgaaggcgcgtactacaagctgtaccaggcacaggcgcgcaacgtggataccgacgccgatacgatcagcgacggcgaagtcgcggaagcgaaggaggccgtcggtgcgcagtaa

SEQ ID NO: 34718 - protein, 754 aa, Ralstonia metallidurans CH34
MQGPWSAEIGATLQPGENVLAGLTLDLDARLHFTQGWLVVTDRRLIARAPGEKTLQDWEITAGQTLAHGDHAGVGTLELSDGQRRLASWRYTLGYNPDALRLADQFDTRRDALATGRAPEPADTEICPTCKAPLPPGEEQCPQCSRELETPPSTWALLRLWRFARPYRWELLGGFVLLLLGTAATLVPPYLTMPLMDKVLIPYQNGVPIDIGLVKLYLAGLLGAALVAWVLGWARTYLLARVSERISADLRTTTYEHLLKLSLEYFGGKRTGDLMARIGSESDRISVFLSLHLLDFATDVLMIAMTSIILVSINPWLALVTLVPLPFIAWMIHLVRDRLRHGFEKIDRIWSEITNVLADTIPGIRVVKAFAQEKREVTRFREANKHNLAINDRVNAVWSLFTPTVTFLTEVGLLVVWIFGIWQVSHDAITVGVLVAFLTYISRFYTRLDSMSRIVSVTQKAAAGAKRIFDILDHVSSVPEPQKPVHIDNVQGAIELRDLGFRYGNRAVIRGLNLSIQPGEMIGLVGHSGSGKSTLVNLICRFYDVSEGAIRVDGVDIRSLPVSEFRRHIGLVLQEPFLFFGTIADNIAYGKPDATREEIIAAARAAHAHEFILRLPHGYDSLVGERGQALSGGERQRISIARALLINPRILILDEATSSVDTTTEKEIQKALDNLVQGRTTIAIAHRLSTLRKADRLVVMDRGQIVEVGNHDELMAREGAYYKLYQAQARNVDTDADTISDGEVAEAKEAVGAQ

SEQ ID NO: 34719 - DNA, 1695 bp, Burkholderia fungorum LB400
  CDS (1)..(1695)
atgacatccacgacacccgcggccgattcgaaggcaggcctttcgcgcgaactggtgcgccttttgcgccccttttggcgcgtgacgctgttcgcgaccgtgatgggcgcgatcggcggtctgtccacggcatggctgctcgcaaccatcaacaacggactgcatgcgccgggcggtgcgagcgcgcgcaccatcgggctgttcgtcgcgctgtgcgcggtcacgctggtggggcgagcggcggccggcgtcggcaacagcatgatcggccagcagattatcgcggcgctgcgcaaggaaatctcggcgcgcatcgtctgcgcgccgatcgccgcgatcgaacgctacaaggtgcatcgcctgctcgcgacgctgaacggcgacgtggacaccatcagcgccttcaccttcaatttctccggcttcgcgatcgcgttcgccatcgtgatcgggtgcatcgtttatatgctggtgctgtcgccgttgctgttcgtgcttgcggccgccgcgatcgcgctcgggctgctgatcaaccgcaacgcgtcgcgccgctggattcgtcactacgaaggcgtgcgcagcgcgcaggacgagttgcagaaacaataccgcgcaatcagcgaaggcgcgaaggagttgcgcctgaatcgcgagcggcgtcaacgcgtatacggtgcgcaattgtccggtgcggccgacaccatcgccgatctgaaaacgcgcgcgatgcgcgtgttctgggccaccgacgccgctagttcaacgctgtttttcgccgtgatcggcgtgctgctggcggcacagtaccggctcggcgtcgatccgcgcgtgattagcggcttcgtgatcgtgctgctgtatgtgcgcgggccggtcgatcaactggcgggtgcattgcccgcgctcggtcaggcgcaggtgtcgttccggcgcatcgcggaattgactgcgcagttcacgagccgcgagccgtatctgctcgacgatcaggcgaacgcgtgcgagccggaacgcatgacggtgcgcgaggacatctccttacgcgctgcgagctatacgtatgcttcgagcggcgaagcggtgccgttcagcctcggcccaatcgatctgacgatacggcgcggcgagaccctgttcattgtcggcgagaacggctgcggaaagacgacgctcgtcaagttgctgctcggactttatagtccgagctccgggcaactgctactcgacggcacgccgattccagctgaacgcatcgacgcttaccggcagatgttttccgcagttttctccgattactacctgttcgacgacctcgtcgcgcgcgatccggagatggtggcgcgcgcgcagaaatggctcgaacatctggagatcgcgcacaaggtgaaggtgagcgacggcgtgttctcaaccatcgatctctcggccgggcagcgcaaacgcctcgcactcgtgcatgcgatgcttgaggagcggccggtgatgatgttcgacgagtgggctgccgaccaggatcccactttccgtcgcgtgttttacaacgagttcctgccggaattgaagcggcagggcaagacgttgatcgtgatctcgcacgacgaccgtttcttcgatacggccgatcgcgtgatccggctggcgggcgggaagattgtggaaacgatcacggggggtgaactcgtgcgcggcgtgtaa

SEQ ID NO: 34720 - protein, 564 aa, Burkholderia fungorum LB400
MTSTTPAADSKAGLSRELVRLLRPFWRVTLFATVMGAIGGLSTAWLLATINNGLHAPGGASARTIGLFVALCAVTLVGRAAAGVGNSMIGQQIIAALRKEISARIVCAPIAAIERYKVHRLLATLNGDVDTISAFTFNFSGFAIAFAIVIGCIVYMLVLSPLLFVLAAAAIALGLLINRNASRRWIRHYEGVRSAQDELQKQYRAISEGAKELRLNRERRQRVYGAQLSGAADTIADLKTRAMRVFWATDAASSTLFFAVIGVLLAAQYRLGVDPRVISGFVIVLLYVRGPVDQLAGALPALGQAQVSFRRIAELTAQFTSREPYLLDDQANACEPERMTVREDISLRAASYTYASSGEAVPFSLGPIDLTIRRGETLFIVGENGCGKTTLVKLLLGLYSPSSGQLLLDGTPIPAERIDAYRQMFSAVFSDYYLFDDLVARDPEMVARAQKWLEHLEIAHKVKVSDGVFSTIDLSAGQRKRLALVHAMLEERPVMMFDEWAADQDPTFRRVFYNEFLPELKRQGKTLIVISHDDRFFDTADRVIRLAGGKIVETITGGELVRGV

SEQ ID NO: 34721 - DNA, 1767 bp, Burkholderia fungorum LB400
  CDS (1)..(1767)
atgaccgctgccaacgagcgctacgacgcgccaccctcgtcttcctcctctcccaccaaccccgcgggcaagcccgccatgcgcctgatcgttgcgctgctcaaacgttcgcgcggctcgttcgcgatcgcgctgagcgcgtgcgtgctgaacggcattgccagcgtgctgctcgttgcgaccttgagccgcgcgctgtcgcaaccgggcgccgccgatatgtcgctcgccatgcgttttgcgctgtgcgcgatcgtcgcgctcgtcacgcgtgtgattaccggcgtgctgttcgcgcgcctctcgcaggacacgatggcgcagttgcgcgaacacgtcgcgcgccgcgtcgcggaagccgaattgcgcgatgtcgagcgcattggcgcggcgcccgtgcagtccgtgctgaccgacgacgccaccaatgtttcgatgctgttcttcgcgctgcccaatctcgtgatgcacggctcgatcgtgttcggctgcctcggctatctggcgtggctgtcgtggccggtctgtctgctcgcggtggccgcgatcctggtcggctcgctcggctatcacgccggcgacaagcgcgcgatcgcctcgctcgaagccgcgggccgttcgcaggacaaactgttcggctatctcggtgcgctcttcaccggcgcgaaggaactgaagctgcaccaggcgcgctcgcgccagttcgtggacggccagctcggctcggccatcgacgaagtgcgcgatcatcggcgccgggcgttcagcgcgtatgcggtcggggtcggctggatcgtgttcctgttttacgtgtttctcggtgtcgcggcgttctggccggcactcggcgtgcatgcggacgcgccttccgcatcgggctacgtggtcgtgttcctgttcatgctgctgccgctggacggtctgctcaacaacgtgccgacgctgaacgcggcacgcgtctcgctcgatcgcatcgagaaggtgatgggcgaattcggcgcgctgcgcacctcgccgccgcccgacgagaacgcctcgcatgcgccgtatcgcactctcacgctcagcaatgtcacgcactcgtacttccacgagcgcgacgagcgcatgttccgcgtcgggccggtcaatctgactttcaggccgggcgagctggtgtttatcgtcggcggcaacggcagcggcaaaacgacgctcgcgaaagtgctcaccgggctctatgaacccgaagacggcaccattgaactggacggcaaaccggtcggcctcgccgaacgcgccgcgtatcgtcagcgcttcacggccgtgttcaacgactttcatctgttcgacgcgctgctcggcatcgtcgatccgaacgacgcctcgcgcgcgcaggctgacgcccgcgccaacgcgctggtggcgaagctcgcgctcgatcacaaggtgcaggtcgtgaacggcgcattctcgacgcgagcgctttccaccggtcagcgcaaacgccttgcgctggttgtagcgtatctggaagaccggccgttctatctgttcgacgagtgggctgcggatcaggatccgcagttcaaggcggtgttttatgaacaactgttgccggagctgcgttcgcgcggcaagacggtgctcgtgatcagtcacgacgaccgctatttccatctcgcggatcgtgtgctgaagctggagaacggcagtatcgtcagcgagacgcatggctcggcacaagtggtgcagaacccgtcggcggccaacggtacgatgggttga

SEQ ID NO: 34722 - protein, 588 aa, Burkholderia fungorum LB400
MTAANERYDAPPSSSSSPTNPAGKPAMRLIVALLKRSRGSFAIALSACVLNGIASVLLVATLSRALSQPGAADMSLAMRFALCAIVALVTRVITGVLFARLSQDTMAQLREHVARRVAEAELRDVERIGAAPVQSVLTDDATNVSMLFFALPNLVMHGSIVFGCLGYLAWLSWPVCLLAVAAILVGSLGYHAGDKRAIASLEAAGRSQDKLFGYLGALFTGAKELKLHQARSRQFVDGQLGSAIDEVRDHRRRAFSAYAVGVGWIVFLFYVFLGVAAFWPALGVHADAPSASGYVVVFLFMLLPLDGLLNNVPTLNAARVSLDRIEKVMGEFGALRTSPPPDENASHAPYRTLTLSNVTHSYFHERDERMFRVGPVNLTFRPGELVFIVGGNGSGKTTLAKVLTGLYEPEDGTIELDGKPVGLAERAAYRQRFTAVFNDFHLFDALLGIVDPNDASRAQADARANALVAKLALDHKVQVVNGAFSTRALSTGQRKRLALVVAYLEDRPFYLFDEWAADQDPQFKAVFYEQLLPELRSRGKTVLVISHDDRYFHLADRVLKLENGSIVSETHGSAQVVQNPSAANGTMG

SEQ ID NO: 34723 - DNA, 1764 bp, Enterococcus faecium
  CDS (1)..(1764)
atgaaagtaaaaaaattatccttgcagacgctccgccgattcattccttaccttactgcctatgcaaaagacatttggctagctgtgatactaggaatcatcaatgggattgcaacagttgtgatgacgttacaaattggtcaaagtatcgatcaaatgattggagaaggacaggtccgcttcaatcgactgttccatttacttattctattcggtggtatcgttttaatcaacgtagtcagtcaatggctcatccaagtgttaagcaatcggttagcttacttatccgttgcaaaattaagaaaagatgcatttgctcatctgaatcgattgccacttcgttattatgatcaaaactcccacggaaatatcgtcagtcgatttacaaatgatatggacaatatttccattgcaatttctgcggccttcaatcaattattttctggagtggcaatcatcattctttcgtttatttttatgatgcgtctaagtccacttctgacattggtcgttctttgttctacaccaattattttccttgtgagttggatcgttgctcgtgcttcacaaacaaatttcgatagacagcaaaggattattggggatatctcgggctttgtgaccgaacgaatcggtaaccagaaaatcgtgaaagcttttcagcaagaagaagctagtcaacagcaatttgaactgctaaatgctgatctatatgaaaaaggacaacgggcacaattttcttcttccttgacaaacccgtcttctcgttttgtagatcaccttgcttatttatcgattggtttagttggcggcctattggcattgaagagtggttcgtcaatcactgttggtgtgatttccagctttacgatctactcaagtcagttttctaaaccatttatcgaactttctggaatcacgacacaactgcaaaccgctttttctggtctagaacgagcatttgatttgatcgatcagccagaagaaaagcctgatttgccagatgcctatgccttggaacccaaaaatatcaaaggaaaagtctcttttgatcatgtttctttttcttatgaccccaagcagcgtttgatcgaagatttcaattttactgcttatccaggtcaaaccattgctatagtaggaaaaacaggggccggaaaatccacacttgttaatttgctgatgcgtttttatgacacaacaaaaggaacaattacagtcgatgaccatgacatccgctctatccaacgtgatacattacgtaaaagttttggaatggtgttacaagatacttggctatttgacagtacattgcgagaaaatcttcgttttgggaatccggaagcaagtgacgcagaaatcaatgatgccctaaaagcctcttatatgtatgaatttgtagaacgtttgccggaaaaattagatactaagattggcggtcaagggttaaagatatcagatggacaacgccaactgttgacgattgctcgaacgatgatcagtaatccccctatgttgatcttagatgaagctaccagctcagtcgatacattgacagagaaaaaaatccaacaagccttcttagcaatgatggaaggaaaaaccagttttgtgattgcccatcgcctgtccacaatcaaaaatgcggaccagatattagtgatggatcagggagctattgtcgaaatgggcacccatgatgagctgcttcaaaaagatggttattaccgacggctctatcaagcacaattcacagcacaataa

SEQ ID NO: 34724 - protein, 587 aa, Enterococcus faecium
MKVKKLSLQTLRRFIPYLTAYAKDIWLAVILGIINGIATVVMTLQIGQSIDQMIGEGQVRFNRLFHLLILFGGIVLINVVSQWLIQVLSNRLAYLSVAKLRKDAFAHLNRLPLRYYDQNSHGNIVSRFTNDMDNISIAISAAFNQLFSGVAIIILSFIFMMRLSPLLTLVVLCSTPIIFLVSWIVARASQTNFDRQQRIIGDISGFVTERIGNQKIVKAFQQEEASQQQFELLNADLYEKGQRAQFSSSLTNPSSRFVDHLAYLSIGLVGGLLALKSGSSITVGVISSFTIYSSQFSKPFIELSGITTQLQTAFSGLERAFDLIDQPEEKPDLPDAYALEPKNIKGKVSFDHVSFSYDPKQRLIEDFNFTAYPGQTIAIVGKTGAGKSTLVNLLMRFYDTTKGTITVDDHDIRSIQRDTLRKSFGMVLQDTWLFDSTLRENLRFGNPEASDAEINDALKASYMYEFVERLPEKLDTKIGGQGLKISDGQRQLLTIARTMISNPPMLILDEATSSVDTLTEKKIQQAFLAMMEGKTSFVIAHRLSTIKNADQILVMDQGAIVEMGTHDELLQKDGYYRRLYQAQFTAQ

SEQ ID NO: 34725 - DNA, 1893 bp, Enterococcus faecium
  CDS (1)..(1893)
atgagtaaaacaaacacacgtccctctcatggaccagcaggcggtccaggacatggtggacctggcagaaatctcggtgtaaaaggtgaaaagcctaaaaatttctggggaacggtacgccgattgtttggctatatgtctaaacgtatggttgcgatcatcgctgtatttgtactagcaatagcagccgtgatcttccaaatccaaacaccaaaggtcttggggaaagcaaccacagaaatattcaaaggtgtaatggctggcgctcaacagatgcaacaaggccaacaagtaacaaaatttccgatagactttgataaaatcgcgcagatcattgcgacagtaatcgtgatgtatttgatttctgctgtattcaactttttacagcaatttattatgacacgtgtttcccaacgaacagtttatgaattacgtcatgatttggaagccaaaatgaatcgtgtaccgatttcctattatgatacacatacaaatggggatatcatgtctcgagcaatcaatgatatggataacatcgcaagcacgctgcagcaaaatttgactcaatttgtaactagtgcagtcacattgattggggtcatcgtgatgatgctttcaatcagctggcaattgacgttagtcgcgttattgatgatccctttaagcttgatcatcgtgatgatcgtagcgccgaaatcacaagtgtttttcgcagatcagcaaaaaagtttaggtttattgaataaccaagtagaagaaacatatggtggtcataccattgttaaaacattcaatcatactgaaaaagaccaggaagtatttgaaaaagaaaatcagaatctgtatgccgctggttggaaagctcaatttatttcggcaatcatcatgccgttgatgaatttcgttaaaaatctaggctatgtgttcgtcgctgtactaggcggagtaaaagttgcaaatgggaacatgacattaggggatgttcaagcgttcttgcaatatacaacacagttctctcaaccaatcactcaacttgcaagtttgatgaacactatccaatcaacagttgcttcagccgaacgggtatttgaagtgttggatgaagaagagatgtccaatgaaaaatctggccttccagaagaaaaagatacaccatacaaagttcgttttgaaaatgttcaattcggctacacaccagataacttgctaatgactgattttaacttggatgtcaaacctggtgagatggtcgctattgtaggtccgactggtgcagggaagacgacactgatcaaccttcttgaacggttctacgatgtttctggaggtagtattcgttacgatggtgtagatacccgtgatctttcacgtgatgaattgcgcgcacagttttcaatggtactgcaagatacttggctgtttacaggaagtatctatgacaatatcaaatatgggaacgacgatgcaacagacgaacaaatcattgaggctgctaaagctgctcacgtagacgattttgttcgtaaattgccagaaggatataacactgtattaaacgaggatgcaagcaatatttcgcaagggcagcgtcagctaatcacaattgcgcgggcattcttagcaaatccagatgtcctgatccttgatgaagcaacatctagtgtagatacacgaacagaaatactgattcaaaaagcgatgaaccgcctattggaaaaccggacaagtttcgttgttgctcaccgcttgtctacaatacgcgatgcagacaacattattgtgatgaatcatggttcgatcgtagaaacaggaaaccacgatacattgatggaaaaagacggattctatgcagatctttataacagtcagttttctgaagaagaagcttcatag

SEQ ID NO: 34726 - protein, 630 aa, Enterococcus faecium
MSKTNTRPSHGPAGGPGHGGPGRNLGVKGEKPKNFWGTVRRLFGYMSKRMVAIIAVFVLAIAAVIFQIQTPKVLGKATTEIFKGVMAGAQQMQQGQQVTKFPIDFDKIAQIIATVIVMYLISAVFNFLQQFIMTRVSQRTVYELRHDLEAKMNRVPISYYDTHTNGDIMSRAINDMDNIASTLQQNLTQFVTSAVTLIGVIVMMLSISWQLTLVALLMIPLSLIIVMIVAPKSQVFFADQQKSLGLLNNQVEETYGGHTIVKTFNHTEKDQEVFEKENQNLYAAGWKAQFISAIIMPLMNFVKNLGYVFVAVLGGVKVANGNMTLGDVQAFLQYTTQFSQPITQLASLMNTIQSTVASAERVFEVLDEEEMSNEKSGLPEEKDTPYKVRFENVQFGYTPDNLLMTDFNLDVKPGEMVAIVGPTGAGKTTLINLLERFYDVSGGSIRYDGVDTRDLSRDELRAQFSMVLQDTWLFTGSIYDNIKYGNDDATDEQIIEAAKAAHVDDFVRKLPEGYNTVLNEDASNISQGQRQLITIARAFLANPDVLILDEATSSVDTRTEILIQKAMNRLLENRTSFVVAHRLSTIRDADNIIVMNHGSIVETGNHDTLMEKDGFYADLYNSQFSEEEAS

SEQ ID NO: 34727 - DNA, 1812 bp, Magnetococcus sp. MC-1
  CDS (1)..(1812)
atgagtcccccgcccatcgaagccgttaccgaagagacccgttatggtgcctttttggatctgcatctgttacggcgttttttccgttacgccaaaccccatacacgctgggtcttgttggccctcgccattttgcccttgaacacccttattcagttagggcaacccctactgttaaggcaagcggtggatgaacacctcatccccggcacgctggatggctttgctggattgctggttgcattgggcgttttgttgttgctacaagccttggcgggctatggcatgtcggtggttaatgccaccctggggcagcgggtggtgcgagatctgcggcgcgacctgtttggccatttattacgcttggatgccagctattttaataaacacgcctcgggtcgtaccaccaatcgcgttaccaatgatgtggaggcggttagccagatggtctccgcgggtttaatccaccttattggcgatgtggtgctgctgacgggcattctcatcagcatggcgctgttagccccaaccctttctctcacgctggttgtggcactgcccctgattgtggggggaaccctgctggccgccaaaaaaagccgcctcgcgcaacgggaaaaccgcttgatgctggcccgcatggccagccgcctgacagaagagattgaaggacagcaagaggtacgactgtttcatcggcagcagcgcaaccatgcggaatttgagcagcaaaatcaggtttattttacctcatcactggtgagcaacacttgggaagccttccaatttagctttattgatgcactctctaccgtggttatcgcagcgctattttggattggcgccagcatgagcagcgccgacggcgtgaccattggcaccctggtggcttttattgattatgtgcgccgggtttttcaaccggtacgggatctatcggggaaatttaccaccatgcaggcagccatgaccgcgttggaacgtatttttggccttttggacagcaaaccacagatcacggacgcccaagttaaccatgccttcaccctgcccgcccgcccccgcttggtgatgcaggaggtcggctttgcctatggcgagcagcccatattaaaaaatctctcgctgaccgtggaacccggtgaacaggtcgcagtggttggccccaccggggccggtaaaagcaccctcattaaactgctcaaccgtacctacgaaccccaacaggggatcattcaactgggcggtcaagatctgcaaaatattcccatggctactctgcgtcgtacggtgggggtggtccctcaagagacctttttatttagcggtaccattgctgagaacattcacttgcgcgacccttctatcccacaagcggcggtggaggaggccgcccacaaaaccggcgccatggcttttatcgccgacctgcctgaaggcctgaatacccgattgaccgaacgggggggcaatctttctagtgggcagcggcagttgttgggcattacccgtgcgtttgtgtttaaccctgccttgctgatcttggatgaagccaccagctcggtggataccatcagcgaacgcttgatccaaaacgccttacaggagctgatggtcgggcgtaccgccattgtgattgcacaccggctgaacaccattattggagcagatcgtgtcattgtgatgcatgggggagagatcatccaggggggctcacaccaaacactggtcactcagcctgggctctatcgtaagttgtgtgaactgcaatttggtttagacggcagcctaccgacgctccagcagggttaa

SEQ ID NO: 34728 - protein, 603 aa, Magnetococcus sp. MC-1
MSPPPIEAVTEETRYGAFLDLHLLRRFFRYAKPHTRWVLLALAILPLNTLIQLGQPLLLRQAVDEHLIPGTLDGFAGLLVALGVLLLLQALAGYGMSVVNATLGQRVVRDLRRDLFGHLLRLDASYFNKHASGRTTNRVTNDVEAVSQMVSAGLIHLIGDVVLLTGILISMALLAPTLSLTLVVALPLIVGGTLLAAKKSRLAQRENRLMLARMASRLTEEIEGQQEVRLFHRQQRNHAEFEQQNQVYFTSSLVSNTWEAFQFSFIDALSTVVIAALFWIGASMSSADGVTIGTLVAFIDYVRRVFQPVRDLSGKFTTMQAAMTALERIFGLLDSKPQITDAQVNHAFTLPARPRLVMQEVGFAYGEQPILKNLSLTVEPGEQVAVVGPTGAGKSTLIKLLNRTYEPQQGIIQLGGQDLQNIPMATLRRTVGVVPQETFLFSGTIAENIHLRDPSIPQAAVEEAAHKTGAMAFIADLPEGLNTRLTERGGNLSSGQRQLLGITRAFVFNPALLILDEATSSVDTISERLIQNALQELMVGRTAIVIAHRLNTIIGADRVIVMHGGEIIQGGSHQTLVTQPGLYRKLCELQFGLDGSLPTLQQG

SEQ ID NO: 34729 - DNA, 1716 bp, Geobacter metallireducens GS-15
  CDS (1)..(1716)
atggaaaccttcaaacgcctcttacgctacagcaaaccctacgggtggcgcattgccatttccatggtggcctccctgtgtgtcggcggaaccgacgcggccatcgcctggctggtggagccgcttctcaagaagatattcaccgaaaaggacatgacgatttttatcctcctccccgtggcggtgatgatcgtctttatcctccggggcgtcgcccgtttcgtgcagcaatactacatctccaccgcggggcagttggcgatccaggacatccgcaacgaagtgtaccagaagcacatggggctgccgctgcgctatttcgccgacaatcccacgggcgttctcatgtcccgggtcatgagcgatgtgggacagatgcagtcaggagtggccaatgtggtgacgggactgttgcgggacggggtgacggccattgggctcctcggtgtcatcttttaccggaactggcagctggccctcatcaccttcatcgttctccccctcacggccgtgccggcccagaagatcggcaagcggatcaagaacctggcaaagcagtcccttggccagatgggggagattacgagcatcctccaggaaaccttcaccgggatcaaggtggtcaaggcgttccgcctggagcggcgtttcatcgaccggttcagccagacgaatctcggcctctaccattacctcagaaagagtatcaagtacgagtcgctccacacgccgatcatggagattatcacctcccttggtgtagcaggggtcatctggttcggggggagccaggtcatgcacggccgcatgtccgcgtccgagttcttctccttcctgaccgccatggtaatgctctacgggccggtgaagaagctgctcagttcctataatactgtccagcaggctgtgggggccgcggagcgggtctttgaggtgatcgaccagagggccgacatagaggaccccgccgagccggtggagatggggccgccccagggctccgtggagttgcgcaacgtctcgttccgctataacgacgaggaagtcctgcgcaacgtgtcgctctcggcgggaaggggcgaggtggtggcgctggtgggcccgtcgggggcaggaaagacgaccatcatgtcgctcattccacgcttctacgacgtaaccggcggcgcggtcctcgtcgacggggtcgacgtgcggcaggcgcgcctggatgaccttctcagccatgttgccctggtggatcaggaaacggtcctcttcaacgatactattgccaacaatatcaggcttggcaactctgatgcccccatggaggcggtggagcgggctgcccgggccgcctttgcccacgatttcatcatggatatgccggaaggatacgatacgaacatcggcgatcggggggtgcggctctccggcggccagcgccagcggctctgcatcgcccgggccattctcaaggatgcgcccatactcctcctggacgaggccactagcgccctcgataccgagagcgagcatatggtccagcaggcccttgccaatctcatgaagaaccggaccaccctcgtcattgcccaccggctttccaccgtgctccatgcggaccggatcgtggtcatcgacaggggagaagtggtggaggtggggaccaacgacgaactcctggcccgcggcggcctctaccgcaagctctacgatatgcaattcagttag

SEQ ID NO: 34730 - protein, 571 aa, Geobacter metallireducens GS-15
METFKRLLRYSKPYGWRIAISMVASLCVGGTDAAIAWLVEPLLKKIFTEKDMTIFILLPVAVMIVFILRGVARFVQQYYISTAGQLAIQDIRNEVYQKHMGLPLRYFADNPTGVLMSRVMSDVGQMQSGVANVVTGLLRDGVTAIGLLGVIFYRNWQLALITFIVLPLTAVPAQKIGKRIKNLAKQSLGQMGEITSILQETFTGIKVVKAFRLERRFIDRFSQTNLGLYHYLRKSIKYESLHTPIMEIITSLGVAGVIWFGGSQVMHGRMSASEFFSFLTAMVMLYGPVKKLLSSYNTVQQAVGAAERVFEVIDQRADIEDPAEPVEMGPPQGSVELRNVSFRYNDEEVLRNVSLSAGRGEVVALVGPSGAGKTTIMSLIPRFYDVTGGAVLVDGVDVRQARLDDLLSHVALVDQETVLFNDTIANNIRLGNSDAPMEAVERAARAAFAHDFIMDMPEGYDTNIGDRGVRLSGGQRQRLCIARAILKDAPILLLDEATSALDTESEHMVQQALANLMKNRTTLVIAHRLSTVLHADRIVVIDRGEVVEVGTNDELLARGGLYRKLYDMQFS

SEQ ID NO: 34731 - DNA, 1809 bp, Geobacter metallireducens GS-15
  CDS (1)..(1809)
atgcatttcggtggtgcctacgaagacgagatagttggcaaggcctatgacgggaggctcatggcgcggtttatccgctacgtgctcccctaccggtggctcgccgtggcagccctctgcctccttcccctctcggcggcggcccggctggcccagccgtggatcatgaaggtggccatcgatgagcacattatcaccggccggatggagggtctgccgctggtggcggccggatttctcgccctgatccttgccgagtcgctcctgacgttctttgaggtctggctcctccagtacctggggcagagggtgatgttcgatctccgcatggagctcttcagccacgtccagcggcttccggtcgcctttttcgaccggactcccaccgggagcctcgtgacaaggctcaccagcgacgtggaagtcctcggcgagatgttcgccgcagggatcattacggtggtgggggacatcctcttcctggccgggatcgtcggggtgatgctctggatgaacctgaagctctccctagtcaccttcgcagtcctgccggtgctcatctgggtcgcctttacgtttcgggtcaggatgcgcaaggccttccgggaggtacgtgcccggctggcgaacctcaacacctttctggccgagaccatcggcggcatggcggtggttcagcttttcaaccggcaagaaaccgagcggcgggagttttcgcggctcaacgccgcttaccgggacgccaacctcccggtcatcacctgggacgcctccctctatgccttggtggagaccctttcctccatcgccgtggggctcatcatctggtacggcgggggggagatcgtcagcggcgcccttaccttcggggcactggtggccttcatccagtacaccgaaaaatttttcggccccatccgggatctttcggccaagtactccatcatgcagggagccatggcggccctagagcggattttcaacctgctggacaccgagaaggatggatacccctcacccggccttcggccaccctctccctccaggcggggggccggggatgagggggcagtcaacaccatcgccttcaaggatgtctggttcgcttacaaggacgaggagtacgtcctccgggggatagacctcaccatccggcggggggagaaggtggcgttggtgggggagacgggcggcggcaagacgacggtgacccggctcctctcccgcttctacgacgtgagcagggggagcatcctctttgacggcgccgacatccgggagctgccccttcccgacctccggcgccggatcggcgtggtcctccaggaaccgtatcttttcaccggcaccatcgggttcaatatctccctgggggacgagggggctgctgccaggatggaggaggcggcacggcttgtgggggccgcccggttcatcgaggcgcttcccaaaaagtacgacgaggaggtgcgggagcggggggtgaacctctccgccggcgagcggcagctcatttcctttgcccgtgccgtggctttcgacccggagatcctcgtcctcgacgaggccacctccagcgtcgacagcgagtctgagcggctcatccaggaggggctccgggcgctcatggcgggccgtacgtctctggtggtggctcaccgcctctccacggttcaggatgccgaccggatcgtcgtcatccaccggggtgaaaaggtggaggaggggacccaccgcgaactcctggccgccggaggagtctacgcacggctctatcagcttcagttcagggagcaggacaatccatga

SEQ ID NO: 34732 - protein, 602 aa, Geobacter metallireducens GS-15
MHFGGAYEDEIVGKAYDGRLMARFIRYVLPYRWLAVAALCLLPLSAAARLAQPWIMKVAIDEHIITGRMEGLPLVAAGFLALILAESLLTFFEVWLLQYLGQRVMFDLRMELFSHVQRLPVAFFDRTPTGSLVTRLTSDVEVLGEMFAAGIITVVGDILFLAGIVGVMLWMNLKLSLVTFAVLPVLIWVAFTFRVRMRKAFREVRARLANLNTFLAETIGGMAVVQLFNRQETERREFSRLNAAYRDANLPVITWDASLYALVETLSSIAVGLIIWYGGGEIVSGALTFGALVAFIQYTEKFFGPIRDLSAKYSIMQGAMAALERIFNLLDTEKDGYPSPGLRPPSPSRRGAGDEGAVNTIAFKDVWFAYKDEEYVLRGIDLTIRRGEKVALVGETGGGKTTVTRLLSRFYDVSRGSILFDGADIRELPLPDLRRRIGVVLQEPYLFTGTIGFNISLGDEGAAARMEEAARLVGAARFIEALPKKYDEEVRERGVNLSAGERQLISFARAVAFDPEILVLDEATSSVDSESERLIQEGLRALMAGRTSLVVAHRLSTVQDADRIVVIHRGEKVEEGTHRELLAAGGVYARLYQLQFREQDNP

SEQ ID NO: 34733 - DNA, 1812 bp, Novosphingobium aromaticivorans DSM 12444
  CDS (1)..(1812)
atggcccaggaaacacccgcccaggaaacacccgccgccaacgtcgaggagcccccccgcgcccgcacgcttggccccctgcgcatgatctggggcgaggcggcgaaatacccgggccgtgtcgctgccgcgtcggccgcgctgatcgtcacgtccgccgcgacccttgcgataccgtcgggcttccgcctgatcatcgacaagggctttgccgccggcgcggatgtttcggccatagggcgatggttccagtacctgctgctgatcgtgctggtccttgccatcggcacggcctgccgcttctacttcgtgtcctggctgggcgagcgcgtggttgccgacatccggctcaaggtccaggcgaacctgctgcgcctgcccccgtcgttcttcgagaccaacagtcccaaggaaatctcctcgcggatgacgtcggacactgcggtcatcgaacaggtcgtaggcacgaccgtgtcggtggcgctgcgcaacacgatcaccgcgatcgggggcctgggctacctgttctaccttgcgccgaagctgaccgcgatcctgatgatcggcatcccgctggtggtgggccccatcgtgttcttcggccgccgcgtgcgcaacgtctcgcgctccagccaggaccgggtggcagtgatcggcgtgatcgtttccgaagtgcttggtgcgatgaagatcgtccaggcattcgggcaggagaagcgcgagcttgaacgcttcggcgaaaaggtcgaggcgaccttccagaccgcgctgcgccgcatcagcctgcgcgcggtgatgaccgcgatcgtcatcctgctggtcttcggcggcatcaccatgctggtctggcagggcgccgtcggcgtggcggaaggcaggatcagcggcggcacgatctttgccatcgtcatcacggcaggccttgtcgcgggcgcgctcggggcgctctccgaggtctacggtgacctgctgcgcggggccggcgccgcaggacggctcaacgaactgctgcgcgaacagcccgagatcgcgccgcccgcccgccccacggcgctgccgatcccgccgcgcgggcagatcgcgttccagaacgtctcgttccgttatccctcgcgcccggaagttcttgcgctcgacgatttctcgctgacggtcgagccgggcgagaccgtcgccatcgtcggcccttcgggcgcgggcaagtcgacgctcttcctgctggcacagcggttctacgatccgcacggcggcacgatccgcatcgacggcgttcccctcaccagcgccgaccctgccgagattcgccagcgcagcgcgctcgtaccgcaggacgccacgctgttcgccgcctcggcgcgcgacaacctgcgctatggcaactggggcgcgagcgacgaggccatctgggaagcggcacgggccgccaatgccgaacagttcctgcgcgacctgccgcagggcctcgacaccttcctcggcgaggatggcgcgcgcctttccggcggccagcgccagcgcatcgccattgcccgcgccgtgctgcgcgaggcaccgatcctgctcctcgacgaggcgaccagcgccctggacgccgaaagcgagcgccttgtccaggaagctctggaccggctgatgaaggaacgcaccacgctggtcatcgcgcaccgccttgccaccatccgcgcggcggaccgcatcgtcgtgatggacgcgggcaggattgtcgaacagggcacccactccagcctgacggcagcggatggcctgtatgcccgcctggcgcggttgcagttcgaagggcttgccgcgtaa

SEQ ID NO: 34734 - protein, 603 aa, Novosphingobium aromaticivorans DSM 12444
MAQETPAQETPAANVEEPPRARTLGPLRMIWGEAAKYPGRVAAASAALIVTSAATLAIPSGFRLIIDKGFAAGADVSAIGRWFQYLLLIVLVLAIGTACRFYFVSWLGERVVADIRLKVQANLLRLPPSFFETNSPKEISSRMTSDTAVIEQVVGTTVSVALRNTITAIGGLGYLFYLAPKLTAILMIGIPLVVGPIVFFGRRVRNVSRSSQDRVAVIGVIVSEVLGAMKIVQAFGQEKRELERFGEKVEATFQTALRRISLRAVMTAIVILLVFGGITMLVWQGAVGVAEGRISGGTIFAIVITAGLVAGALGALSEVYGDLLRGAGAAGRLNELLREQPEIAPPARPTALPIPPRGQIAFQNVSFRYPSRPEVLALDDFSLTVEPGETVAIVGPSGAGKSTLFLLAQRFYDPHGGTIRIDGVPLTSADPAEIRQRSALVPQDATLFAASARDNLRYGNWGASDEAIWEAARAANAEQFLRDLPQGLDTFLGEDGARLSGGQRQRIAIARAVLREAPILLLDEATSALDAESERLVQEALDRLMKERTTLVIAHRLATIRAADRIVVMDAGRIVEQGTHSSLTAADGLYARLARLQFEGLAA

SEQ ID NO: 34735 - DNA, 1689 bp, Microbulbifer degradans 2-40
  CDS (1)..(1689)
atgcttatcgccatacttgaagtgtcgctatttaactttttaggcaatttggttgataacttaaacaactcaagcccaacaacctactggcaaacccacggccgcgacctactattttatggccttcccgtactactggggctgcctctgtgcgtgtttattcactcgctaatattgcatcaaacactgcttggcaactttgccatgcgcgtgcgttggttagcccacagacacctactcggccaaagcgtggcgttttaccaaaacgaatttgccgggcgcatggccaccaaagtaatgcaaacagccctctctgtgcgcgaagccattattaaattgctggatgttattttatatgtggcagtgttttttgccggtgtgcttaccctgctggccactctcgatttgcgcttggctattccgctaaccgtttggattattatttacgtaagcattctaaaatattttttaccaaggctcgcgcgcgtgtcgtcgcttcaagccgatgctcgctcagacatgactgggcgcattgtcgacacctacaccaacattaatactgtaaaactgttttcgcacagccagcgcgaagaacactacgcccgcgaaggcatggaaaatttcttacaaacggttcaccctcaaatgcgcctggtaaccaaattaagcaccagtgtttggtcgcttaacgcggtactcattttttgtactacgtcactttctatttggttgtgggctaataacgctattaccactggcagcattgcaattgccgtgggcttagtactgcgcatgtacggtatgtcgcaatggataatgtgggaagtatctgggctgtttgaaaacttaggcaccgcgcgcgacggtatgaacacgctggcagtagaacgctcagttttagattccgagcaagccgcgcctattgccattaccaaaggcaaaatagcttacaacaatgtttcgtttcactacggtaaagaaaacggcgtgattgaaaactttaacttaaccatcgcacccggtgaaaaaattggtttagttggccggtcaggtgcggggaaatcgacactggttaatttgcttttacgcttttacgatatagagagcggcagcattactatcgataaccaaaatatcgccacacatcaacaggaatctttgcgacagcatattgccatggttacacaagacacctctctactacaccgctcggtgcgcgataatttactttacggcaaccccactgcgagtgaagaacaaatgctgctcgccgcgcagcgagccaaagcacacgaatttattttagagctagaagacggccaaggccgaaagggctacgacgcccatgtgggcgaacgcggggtaaaactttcaggcggccaacgtcaacgtatagccattgcgcgagccttcttaaaagatgcgcctattttggtattagatgaagcgacctcggcattagattctgaagttgaatcggccatccaagaaaacctcaatcaactaatgcaaggtaaaacagttattgctattgcccataggctttctaccattgccgcattagataaacttgtggtgatagatcaaggaaatataatcgagcacggtacgcataaagaattgcttgctgctaacggcacctacgcaaaactttggcaacatcaatctggcggttttttaggggaataa

SEQ ID NO: 34736 - protein, 562 aa, Microbulbifer degradans 2-40
MLIAILEVSLFNFLGNLVDNLNNSSPTTYWQTHGRDLLFYGLPVLLGLPLCVFIHSLILHQTLLGNFAMRVRWLAHRHLLGQSVAFYQNEFAGRMATKVMQTALSVREAIIKLLDVILYVAVFFAGVLTLLATLDLRLAIPLTVWIIIYVSILKYFLPRLARVSSLQADARSDMTGRIVDTYTNINTVKLFSHSQREEHYAREGMENFLQTVHPQMRLVTKLSTSVWSLNAVLIFCTTSLSIWLWANNAITTGSIAIAVGLVLRMYGMSQWIMWEVSGLFENLGTARDGMNTLAVERSVLDSEQAAPIAITKGKIAYNNVSFHYGKENGVIENFNLTIAPGEKIGLVGRSGAGKSTLVNLLLRFYDIESGSITIDNQNIATHQQESLRQHIAMVTQDTSLLHRSVRDNLLYGNPTASEEQMLLAAQRAKAHEFILELEDGQGRKGYDAHVGERGVKLSGGQRQRIAIARAFLKDAPILVLDEATSALDSEVESAIQENLNQLMQGKTVIAIAHRLSTIAALDKLVVIDQGNIIEHGTHKELLAANGTYAKLWQHQSGGFLGE

SEQ ID NO: 34737 - DNA, 2031 bp, Trichodesmium erythraeum IMS101
  CDS (1)..(2031)
atgtctggaaaagaatttatattaaaatttattcttcgtaagccgtttaattttcaagttattggaaatattatattaggatttgctagcggattatttaatggagttaatacaactctaatagtacctatattattacaaatttctgggcaagaaattgagattacaggttctccgccgataattaaatttttactatatccttttgaaggagttccagaaaattatcgccttatcgtaatgcttttagtagttatactcactattgttctgaaaaatttaacggcatatttaagaagtttgttgatggtagtttttgatcgtagtcttacaaataatattaaatcagaaatgttccaaacattaatggatagtgatttagattttttcacaaaagtcaaagttggagatttaacaaaacgtttaggttcagatacagctcaatgcacccaaactattaatggttatattaatctagtaactcagttgataattctttctttgtttgtcagcatactaatttctatttcttggcagcttactttaatttcttctctattggtagtttttatagcagtaattaatcagctatttattcgtcgttcaaagaaatttggagtggttttaaatcaggaacaaaaaaaatattacataaaggttattgaagttctcactggtattcggttaattaaatcagtaaatagtgaaaatagagaatataaacagttaagaaaattaatgctttccctagaagatatagcactgaaagaaaaaatgaattcagcattaatagctccagtcaatgaagtgataagcatgattacggtaattagtattctattattaggtagatatttatttgccaatcaaattacaaatgcttctcctatcctacttacttatcttttagttctatttcgcttactgcctattgtatctcaaattaatagcagtcgtaatgcaattgctaagggtgttgctagttttaatacggctgtagacttatggagaagggataacaaaccaattatgaaaacaggttttataccttttcatgaagtgaaaaataaaattcattttgagaaaatttccttcgcttatccaggtaatgataatttaattatccaaaatgttgatatatccttacctagaggtaaaactttggcattagtaggagcttcaggagcaggtaaatcaacgtttgctgatctactaccaagactttatgaccctacttctggttctattactatagacggcattgacttgcgtgagtttgatattaatagtctcaggaagaaaactggtattgttagtcaagatacttatttgtttaacgatactatcaaaaataatgttatttatgcttgtcctgatgctacagaggataaaattattgatgcggttagacaagctaatgcttatgattttattatggacttgcctaagcaatgggacacagaaataggcgatcgcggtgttatgctttcgggaggtcaacaacaacgattggctattgctagggccttattgcaaaatccagaaatattaatcttagatgaggccactagtgcccttgatacagtttctgaacgtttggtgcaggaggctattgataaattaagtcgcgatcgcacagttttagttattgcccaccgtctctcaacaattcaaaatgctgatcaaatagctgttttagatcggggaaaattagttgagatgggtactcattcagaacttttagaaaaagaaaatggttactatcgaaatctctattatgtacagtttggaaatcagtctgaactggataaatatattgaccagcaggttttaactaaagcatcttatgacgctcgtagttttctcaacacaattattggctctttaacattactggctgatgaaacatttgataaacctgaagaaaaaatagaacttactgaagaagcttttcgctcatcaacttctcttctcaaaaccttagagatatttgaaaatctaatagcaaagcataataaatctggcttataa

SEQ ID NO: 34738 - protein, 676 aa, Trichodesmium erythraeum IMS101
MSGKEFILKFILRKPFNFQVIGNIILGFASGLFNGVNTTLIVPILLQISGQEIEITGSPPIIKFLLYPFEGVPENYRLIVMLLVVILTIVLKNLTAYLRSLLMVVFDRSLTNNIKSEMFQTLMDSDLDFFTKVKVGDLTKRLGSDTAQCTQTINGYINLVTQLIILSLFVSILISISWQLTLISSLLVVFIAVINQLFIRRSKKFGVVLNQEQKKYYIKVIEVLTGIRLIKSVNSENREYKQLRKLMLSLEDIALKEKMNSALIAPVNEVISMITVISILLLGRYLFANQITNASPILLTYLLVLFRLLPIVSQINSSRNAIAKGVASFNTAVDLWRRDNKPIMKTGFIPFHEVKNKIHFEKISFAYPGNDNLIIQNVDISLPRGKTLALVGASGAGKSTFADLLPRLYDPTSGSITIDGIDLREFDINSLRKKTGIVSQDTYLFNDTIKNNVIYACPDATEDKIIDAVRQANAYDFIMDLPKQWDTEIGDRGVMLSGGQQQRLAIARALLQNPEILILDEATSALDTVSERLVQEAIDKLSRDRTVLVIAHRLSTIQNADQIAVLDRGKLVEMGTHSELLEKENGYYRNLYYVQFGNQSELDKYIDQQVLTKASYDARSFLNTIIGSLTLLADETFDKPEEKIELTEEAFRSSTSLLKTLEIFENLIAKHNKSGL

SEQ ID NO: 34739 - DNA, 1833 bp, Trichodesmium erythraeum IMS101
  CDS (1)..(1833)
atgagtagaaactcaagcaaaaataataatagcaaatattacactaaaaacattgaaacagactggcaactaattcaacgcttgctaaactacacccgaccttacaaaaccttagtagcaacatcactaatattattattaccactatcaattgcaggtacaattcaaccactattagtcggacaagcaatttctctaattttaagagaaaaaacttggctatttctccaacaaatatcattatctcaaggactaaatactttagcaataatattaaccctaagcatcattgtacaattcctatttcaatctgtacaaggttttttagtagaaaaaatcggacagcaaattaccgctgatattagaaatgatttatttaaacacgttctttccctaggagtaaaattttttgacactgcccctgtaggtaaattaattactcgccttaccagcgatgttgaagctttaggagatgtcttttctacaggtgctattgggataataagggatttattctcaattttaatcattgcagtcaccatatttattcttcaatggcaattggccttaacactcatactaatgatgttaccagtaacagcaattgttatctatttccagcaaaaatatcggcacgctaattacaaagctagagatgaactttccgatttaaattctcagctacaagaaaacttagttggcattgaaatagtgcaattatttcgcagagaaaagttcaactcagaattatttagagccaataatataaattatgtaaaagcattagataaaactatcttttatgactctgctatctctggtattttagaatggatttctttaattgctatcgctacagttttattcttaggaggacaattttttttagcaggaaatctagactttggtactctatcttccttcattttatatgctcaacgtttattcaaccccttacgacaatttgctgaaaaatttacagctattcaagctggattaaccgccattgaacgcattgcaaatattctcaacgaaaaaattgaaattattgacccagaaaaagaaattcaaaagttatcaaaccttcaaattaataattcccaaataggtgaaattagatttgaaaatgtctggtttgcctacaaatcaaatcaatatattctcaaaaacattaactttactattaaaccaggagaaaaaattgccttagtcggaccgactggagccggaaaaagttctataattcgcttactttgtcgtttatatgatgtaaataaaggtaggattttagttgatggaattaatattaaaaacttacctcaagcagaattacggaaacatattggtgtgattctacaagatggatttttatttactggagatgtaaaaagtaatattactctcggagaaaaatattcatttgaagaaattaaagcatcagcaaaaagcacaaatatagataaattcattgccgaattaccccaaggatataatactcaattacgagaacgaggatctaacatttcaggtggtcaaaaacaattattagcatttgcccgtgctgctattcgtaacccgaaaattttagtacttgacgaagcaactgctagtttagatgtcagaacagaagctttaattcaatcagcattagaaaaaattttagcacaacgaacaggtattattattgctcatcgactttccacaattagaaatgttaatcggatatttgtactgaaaacaggagaattaactgagtcaggtacccatcaagaattactacaacaaaacggtacttatgctagtttatataaattgcaaacgttaggaacttga

SEQ ID NO: 34740 - protein, 610 aa, Trichodesmium erythraeum IMS101
MSRNSSKNNNSKYYTKNIETDWQLIQRLLNYTRPYKTLVATSLILLLPLSIAGTIQPLLVGQAISLILREKTWLFLQQISLSQGLNTLAIILTLSIIVQFLFQSVQGFLVEKIGQQITADIRNDLFKHVLSLGVKFFDTAPVGKLITRLTSDVEALGDVFSTGAIGIIRDLFSILIIAVTIFILQWQLALTLILMMLPVTAIVIYFQQKYRHANYKARDELSDLNSQLQENLVGIEIVQLFRREKFNSELFRANNINYVKALDKTIFYDSAISGILEWISLIAIATVLFLGGQFFLAGNLDFGTLSSFILYAQRLFNPLRQFAEKFTAIQAGLTAIERIANILNEKIEIIDPEKEIQKLSNLQINNSQIGEIRFENVWFAYKSNQYILKNINFTIKPGEKIALVGPTGAGKSSIIRLLCRLYDVNKGRILVDGINIKNLPQAELRKHIGVILQDGFLFTGDVKSNITLGEKYSFEEIKASAKSTNIDKFIAELPQGYNTQLRERGSNISGGQKQLLAFARAAIRNPKILVLDEATASLDVRTEALIQSALEKILAQRTGIIIAHRLSTIRNVNRIFVLKTGELTESGTHQELLQQNGTYASLYKLQTLGT

SEQ ID NO: 34741 - DNA, 1791 bp, Trichodesmium erythraeum IMS101
  CDS (1)..(1791)
ttgccaaaaaaaacattaaaaccaaaacatccctttctccgcttactcaactatggaaatgcttataaagctcaaacttggcaaggggttatctactcaattttaaataaaatatttgacctagcacctccagttttaatcggtgcagcagtagacgttgtagtcaaaaaagaagattctctaatcgctaaatttggaattcaagatacctttagccaactgctagctttagcatttttgagcttaattgtttggggcttagaatcaatttttcaatatgcttatcaacgactttggcgaaatttagctcagaatattcagcataatttacgcattgaagcttacagtcatttacaagatttagaattagcctactttgaagaacgtagtacaggcaatttaatgacaattttaaatgatgatattaaccagttagaaagatttttagacgtaggggccaataaaataattcaagtcacagtaacagtaataattattggtagtgctttctttgttttagttcctagctttgctttgtgggcagtgttacctatgccttttattatttgggcttcaacttggtttaaaaattttctggctcctcgttatgctgaagttcgagaaaaagttagtttattaaatagtcaattatctaataatctctcaggaattaccacaataaaaagcttcacagccgaaacttatgaagtaggaagaattactagaaatagtaatgcttataaaagcaaaaatacaaaggcgatcgctttttctgctgcttttgtacccctaattagaattataatttttatcgcttttgtagcaactttattattaggaggattagaagcagttgatggtagattagccgtaggtacttatagtatcatggtatttttaactcaacgattattatggcctttaactagtttaggagaaactcttgatttatatcaaagaagcatggcttccataaatagggtgatgaacttattagatactccaattaccattcatcccggagataaacctttatctgttgagtttattaagggagaattagaattagaaaatgtgactttttcctatcagaaaaattttccaaccatacaaaatatttccatgaaaattccagcaggaaaaaccattggaattgtcggctcaacaggttccggaaaaagtactatcgtcaaattattactgagattttatgaaattcaatcaggcaaaataactcttgatggaattgaaataaatcaaattaatttacaagatttaagacgtgcaataggtttagttagtcaggatatatttctatttcatggaactgtgatagaaaatattagttatgggagttttgatgcaactttgtcagagattattgcagcagctaaaattgctgaagcagataattttattaataagttaccccagggttacgatactattattggggaaagaggacaaaaattatcaggaggtcaaagacaacgaattgctctggctagagcagtgttaaaaaatcctcctattttgatacttgatgaagcaacttcagcagtggataatgaaactgaagcagcgattcaaaaatctttagaaaaaatcactcaaaatcggacaactattgccattgcccatcgtctttcaactattagaaatgctgattgtatttatgtgatggaacatggccaaatagtagaagttggtcgtcatgaagaactattaaaaaaatcaggaacttattctactttatggcgcgtacaatctggtttaaaattagtaagctag

SEQ ID NO: 34742 - protein, 596 aa, Trichodesmium erythraeum IMS101
MPKKTLKPKHPFLRLLNYGNAYKAQTWQGVIYSILNKIFDLAPPVLIGAAVDVVVKKEDSLIAKFGIQDTFSQLLALAFLSLIVWGLESIFQYAYQRLWRNLAQNIQHNLRIEAYSHLQDLELAYFEERSTGNLMTILNDDINQLERFLDVGANKIIQVTVTVIIIGSAFFVLVPSFALWAVLPMPFIIWASTWFKNFLAPRYAEVREKVSLLNSQLSNNLSGITTIKSFTAETYEVGRITRNSNAYKSKNTKAIAFSAAFVPLIRIIIFIAFVATLLLGGLEAVDGRLAVGTYSIMVFLTQRLLWPLTSLGETLDLYQRSMASINRVMNLLDTPITIHPGDKPLSVEFIKGELELENVTFSYQKNFPTIQNISMKIPAGKTIGIVGSTGSGKSTIVKLLLRFYEIQSGKITLDGIEINQINLQDLRRAIGLVSQDIFLFHGTVIENISYGSFDATLSEIIAAAKIAEADNFINKLPQGYDTIIGERGQKLSGGQRQRIALARAVLKNPPILILDEATSAVDNETEAAIQKSLEKITQNRTTIAIAHRLSTIRNADCIYVMEHGQIVEVGRHEELLKKSGTYSTLWRVQSGLKLVS

SEQ ID NO: 34743 - DNA, 1665 bp, Streptococcus suis 89/1591
  CDS (1)..(1665)
atgttcttgtttggaatagcgctgagtgctcttggggttggaatgggcttattccttccccagtttattggtcagttgctagatcaaacctatttaagcaatctattaacacgaccagaattgctggctggcttcatccttttctttgtatcggtttatacggtacaagccctatccaattatttcatcgggcgtagtggtggtaacgcactcaaacagttgcaacaatatatttatgaatccttgttgaccacatatgtaaaggacttggatcagtaccaatccggtgatcttgccagtcgtttgaccaatgatatgtcggttgttctgaacttcatcaccgttattcttccaaatttcttgatgaatggtttgatggttatcgggtcaatttattttctgtggaccatcagtccgtggctcacaggtcttagtctcttgttgcttcctatgttgtcaatggttatgattccaatgaatcagcggttggaaggttactactctgcttatcaagagggattagggcaggtttctagtagaattagtcataaatttacaacgattcgtttgatgaaggcctttcagggagaaaagcatgaacaacgagagatgggcaagtcttttcagaaactgtcgcaaacctttgagagaatgattagactgtcagcggtgcaacatactttggttagtagcttgatgacgggttttatcattctgatgttgctggtagcaggtatagaagtgaccaagggagtgatgaccatggctacattgacaacctttgtattgtacatgatgcaactgattgatccagtaacagatattgcctcttccttaaatgaactaacggagtttcaggcggtgtctaaacgtttggtagagttgctggagctgactaaggaagaacaggcagatacagagttggttgatgaagctagtatccagttggaaaatgttcggttttcctatcatacagatccggttttgaatggagtatcggttagaattcctgaaggagctcatgtggcgattgttggtccaagtggagcaggaaaatcaactatttttgccttgctgatgaaatactatcaagactaccaaggagagattcggattggtcaacaatgcttaagtgatatttcaaccaaggagatgagaagattgatttcctttatacctcaagataataccctcttccatgggacgattagagaaaatctattgtatggaaagaacgagtcagtgtctgaagagcgtattgctcatattctcaaggagttgggattgtctcatttagtagctgagttggaagatggtttagatactcggatttcagaaaatgggacaggtttgtcggaaggccaaaaacaacgatttagcattgcgagagccttgttgttagagcatcctatctatttgttggatgaggcgacagcaagtttagatactgtcacagaacgtgtcattagcaaagcgattgaccgtttaacagctgggaaaacaaggctaaccattgctcaccgtttgcacacagtgcgtgaggcggatgcgattctggtcttagataaaaatgggcaagtagccgattatggtcctcaccagcagttagtggagagaaatcatctctatcaagatttcttaagaggcttaccgcaagccagttag

SEQ ID NO: 34744 - protein, 554 aa, Streptococcus suis 89/1591
MFLFGIALSALGVGMGLFLPQFIGQLLDQTYLSNLLTRPELLAGFILFFVSVYTVQALSNYFIGRSGGNALKQLQQYIYESLLTTYVKDLDQYQSGDLASRLTNDMSVVLNFITVILPNFLMNGLMVIGSIYFLWTISPWLTGLSLLLLPMLSMVMIPMNQRLEGYYSAYQEGLGQVSSRISHKFTTIRLMKAFQGEKHEQREMGKSFQKLSQTFERMIRLSAVQHTLVSSLMTGFIILMLLVAGIEVTKGVMTMATLTTFVLYMMQLIDPVTDIASSLNELTEFQAVSKRLVELLELTKEEQADTELVDEASIQLENVRFSYHTDPVLNGVSVRIPEGAHVAIVGPSGAGKSTIFALLMKYYQDYQGEIRIGQQCLSDISTKEMRRLISFIPQDNTLFHGTIRENLLYGKNESVSEERIAHILKELGLSHLVAELEDGLDTRISENGTGLSEGQKQRFSIARALLLEHPIYLLDEATASLDTVTERVISKAIDRLTAGKTRLTIAHRLHTVREADAILVLDKNGQVADYGPHQQLVERNHLYQDFLRGLPQAS

SEQ ID NO: 34745 - DNA, 1740 bp, Thiobacillus denitrificans ATCC 25259
  CDS (1)..(1740)
atgagcgcgccgactagccgtcatctctacgggcgcctgctcggctacgtgaagccgcactggcgcatgttcgcgctctcgattgtcggcctgatcctcaccgccgcgaccgagccgatgctgccggcgctgttcaaaccgctgctggacgagggcttcgtcgccaaggaccaggacttcatccgctgggtgccgctcttgctgctgggcctgttcgtcctgaggggggtcgcgagcttcatcagcacctacagcatggcctgggtcggcagtcgcctcgtgatggacctgcgcgcggcgatgttcgacaagctgatggcgttgccgacgcgttacttcgaccagaaccccagcggccagctgattgcgcagctcgcgttcaacgtcacccaggtcacgcagtcggcgacgagttcgctgacgacgctcgtgcgcgacacggtcaccgttctggggctgctcggctatctcgtgtggctcaactggcggctcacgctgatcgtgttcgcgctcgtgccgctgaccttgtgggtcgtgcgcgtcgcgagcaagcgcctgcgcggcctctcgcgcaaggcgcaggagaacatcggtgacctcacgcaggtggtcgacgaggccgtcggcggccatcgcgtggtcaagctctatggcggcgaaacctacgagcaggcgcgtttccatcgcgcggcgaacctcgcgcgccagttcgagatgaagcgcgtcgcggccaacgcggtgtacgagccggtgatccagttcatcgccgccatcgcgcttgcgatcatcgtgttcatcgcggccgggcaggcgagtgcgaacacgacgacggtcggcggcttcgtcgccttcttcatggcaatgctgctgctgttcgcgccgctcaagcgcctgaccgcggtcaacgaccagctgcagcgcggcctcgcggcgtcggagacgatcttcgcgctgctcgaccaggacgccgagcgcgacaccggcacccgcgaaccggcgcacatcgaaggccgcctcgcgttccgtgacgtgggcctgacctaccccggcaagcagacgcctgcactcgcgcgcatttcactcgacatcgcgccgggcgaaacggtcgcactcgtcggtgcgtcgggttcgggcaagacgacgttggcgaacctcgtgccgcgtttctacgacccggatgctgggaggatcgagctcgacggcgtcgacatccgcgacgtcaagctgcaaagcctgcgcggccacatcgcgctggtgtcgcaggacgtcgtgctgttcaacgacacgctcgcgcacaacatcgcctacggcagcaagcgcgaggcgagccccgacgagatccgcgcggcctgcgtcgcggcgcatgcctgggatttcatccaggcgatgcccgacggcctcgacacgttgatcggtgagaacggcatgcgcctgtcgggtggccagcgccaacgaatcgccatcgcgcgcgcgatcctcaagaacgcgccgatcctgattctcgacgaagcgacctcggcgctcgacagcgagtccgaacgccacgtccaagcagcactcgagacgctcatgcaaaaccgcacgacgctcgtcatcgcgcaccggctgtcgaccatcgagcgcgcgaaccgcatcgtcgtactcgaaggcggacgcatcgtggaaaccggcgcccacgccgacctgctcgcgaagcagggccgctacgcgcaactccacgcgctgcagttttcgcaatga

SEQ ID NO: 34746 - protein, 579 aa, Thiobacillus denitrificans ATCC 25259
MSAPTSRHLYGRLLGYVKPHWRMFALSIVGLILTAATEPMLPALFKPLLDEGFVAKDQDFIRWVPLLLLGLFVLRGVASFISTYSMAWVGSRLVMDLRAAMFDKLMALPTRYFDQNPSGQLIAQLAFNVTQVTQSATSSLTTLVRDTVTVLGLLGYLVWLNWRLTLIVFALVPLTLWVVRVASKRLRGLSRKAQENIGDLTQVVDEAVGGHRVVKLYGGETYEQARFHRAANLARQFEMKRVAANAVYEPVIQFIAAIALAIIVFIAAGQASANTTTVGGFVAFFMAMLLLFAPLKRLTAVNDQLQRGLAASETIFALLDQDAERDTGTREPAHIEGRLAFRDVGLTYPGKQTPALARISLDIAPGETVALVGASGSGKTTLANLVPRFYDPDAGRIELDGVDIRDVKLQSLRGHIALVSQDVVLFNDTLAHNIAYGSKREASPDEIRAACVAAHAWDFIQAMPDGLDTLIGENGMRLSGGQRQRIAIARAILKNAPILILDEATSALDSESERHVQAALETLMQNRTTLVIAHRLSTIERANRIVVLEGGRIVETGAHADLLAKQGRYAQLHALQFSQ

SEQ ID NO: 34747 - DNA, 1767 bp, Thiobacillus denitrificans ATCC 25259
  CDS (1)..(1767)
atgctgacctggcgcagcatcgtcgacgagcttcgccgccaccgcgcggcgctgctgcaggcgaatctcgcggccgtgctggcggtcgtcgcggccgttccggtgccgttgttgctgccgctcatggtcgacgaggtgctgctgcaccatccgggcaggatcgtcgacgcgatcggcgcctggtttccgacgtcctggcatgggccggtgctgttcatcggcgtcgcgctgctggcgacggtcgcgctgcggctcgccgcgatcgtgctcaacgtgtggcaggggcggaccttctcgctgctcgcgaaggaagttgtctaccgcatccgtgaacgcatgctcgcgcggctctcgcgcactgcgctgtccgagttcgagaccgtcggcgcggggcgcgtcacctcgcatttcgtcaccgacctcggcgcgatcgacactttcctcggggcttcgatttcggggctgctcgtctcggtactgacgctggtcggcgtggctggcgtgctgttctggatgcactggcagctcgcgctcttcatcctgctgctcaacccggtcgtgatcctgttttcgacccgactcggcaaacgggtcaaggacttgaagaagttcgagaaccgcgccttcgaggcgtttcaggacgcgctcgccgaaacgctcgacgcgctgacgcagatccgcgcgatgaaccgcgaaaagcactacctcgcgcgcgtgaccgagaaggccgccgatatccgccgccacgccgcggccttcgcctggaagtccgacgcgatgagccgcttttccttcttcatctttctcgccggcttcgacgcctttcgggccggcgcgatgctgatggtcgtctactccgacctctcgatcggcgagatgctcgcggtgttcggctacctctggttcatgatgacgccggtgcaggagctcgtgaacatgcagtattcgtggttcgccgcgaacgccgcgctgacgcggatcaacgcgctgctcggcctgcacagcgaggcgcggtacccggcgcgcgagaacccgttcgccggcgtgccgaccgtcggcatcgcgctcgagcacgtgagtttcgcctacggcgaaggcgaggacgtgctcgaggacgtcagtctgagcgtcgcgcccggggaaaaggtcgcgctggtcggcgcctccggcggcggcaagtcgacgctcgtgcaggccctgcttgggctctatccgctccgcgtagggcagatctgctacggcggcgtgccggtgagcgcgatcggctgggaaaccgtgcgcgaatacgtcggtgtcgtgctgcagcatccggtgctcttcaacgacacggtgcgcgccaacctcacgctcggccgcagcgccgacgacgcgacgctgtggcgcgcgctcgcgatcgcccagctcgacgcgaccgtcgcggagctgccgcagggtctggacaccatggtcgggcgccaaggcgtgcgtctatcggggggccagcggcagcgcctcgcgatcgcgcgcatggtcgtcgccgagccgcgtatcgtgatcctcgacgaggcgacgtcggcgctcgataccgagaccgagcgccgcctgcaccaggcgctcggcgaattcctcgctggccgcacgacgctgatcatcgcccaccgcctgtcggccgtgcgccaggccgaccggattctggtgttcgaaaacggccgcgtggtcgaggagggcgatcacgccgcgctgatcgaccgcggcggcctctatcacaagctttatcaccacgcctag

SEQ ID NO: 34748 - protein, 588 aa, Thiobacillus denitrificans ATCC 25259
MLTWRSIVDELRRHRAALLQANLAAVLAVVAAVPVPLLLPLMVDEVLLHHPGRIVDAIGAWFPTSWHGPVLFIGVALLATVALRLAAIVLNVWQGRTFSLLAKEVVYRIRERMLARLSRTALSEFETVGAGRVTSHFVTDLGAIDTFLGASISGLLVSVLTLVGVAGVLFWMHWQLALFILLLNPVVILFSTRLGKRVKDLKKFENRAFEAFQDALAETLDALTQIRAMNREKHYLARVTEKAADIRRHAAAFAWKSDAMSRFSFFIFLAGFDAFRAGAMLMVVYSDLSIGEMLAVFGYLWFMMTPVQELVNMQYSWFAANAALTRINALLGLHSEARYPARENPFAGVPTVGIALEHVSFAYGEGEDVLEDVSLSVAPGEKVALVGASGGGKSTLVQALLGLYPLRVGQICYGGVPVSAIGWETVREYVGVVLQHPVLFNDTVRANLTLGRSADDATLWRALAIAQLDATVAELPQGLDTMVGRQGVRLSGGQRQRLAIARMVVAEPRIVILDEATSALDTETERRLHQALGEFLAGRTTLIIAHRLSAVRQADRILVFENGRVVEEGDHAALIDRGGLYHKLYHHA

SEQ ID NO: 34749 - DNA, 1791 bp, Pseudomonas aeruginosa UCBPP-PA14
  CDS (1)..(1791)
atgagtgagcgcggagaccgcctgagctgggcggagattcgtcgactcgcactgcgccacaagaaagccctgttgctcgccaacctggtggcggtgctggccaccctctgcaccgtgccgatccccttgctgctgccgttgctggtggacgaagtgctgctcggcaagggcgacggcgcgctgcgtttcatggaccgcctgttgcccgccgactggcaggtggcgttcggctacatcggcctgatgctggcggcgaccctcctgttgcggggggcggcgctggtgttcaacgtgctccaggcgaagctgttcgcgcggctgtccaaggacatcgtctaccgcatccgcctgcgtctgatcgagcgcctccggcatatcgccctgggcgaatacgaaaccctcggcggcggttcgatcagcgcccacctggtgaccgacctggacaccctggacaagttcgtcggggaaaccctcagccgcttcctggtcgccttgctgacgctgctcggcaccgccgcgatcctggtctggatgcactggcagctggccttgctgatcctgctgttcaacccgctggtgatctggtccacggtacaactgggcaagcgcgtcaagcacctcaagaagctcgagaacgacagcaccgcgcgcttcacccaggcgctcaccgagaccctcgaggcgatccaggaagtccgcgccggcaatcgccagggctatttcctcggccgcctcggccaccgcgcccaggaagtccgcgactacgccgtggcctcgcaatggaaaagcgacgccgccgggcgcgccagcggcctgctgttccagttcggcatcgatgtgttccgcgccgcggcgatgcttaccgtgctgctctcggacctgtcgatcggccagatgctcgcggtgttcagctacctctggttcatgatcggtccggtcgaacagctgctcggcctgcaatacgcctactacgccgctggcggcgcgttgcagcggatcaacgagttgctggcgcgggccgacgagccgcgctacccgccgctgcgcgatccgttcgccggccgcacgaccgttggcatcgaggtgcgcgggctggatttcgcctacggcgaggacaaggtcctggagcagttggacctgaacatcggcgccggcgagaaggttgccctggtcggcgccagcggcggcggcaagagcacgctggtgcaactgctactcggcctctacagtgcgcagcgcggcagcatccgctacggcggggtgcccctggaggaaatcggcctggactgcgtgcgcgaacatgtcgcggtggtcctccagcatccggcgctgttcaacgacagcgtgcgggccaacctgaccatgggccgcgaacgcagcgaccaggcctgctggcgggcgttggagatcgcccagttggccgacggcgtgcggcgcctgccgcaggggctggacaccgtggtcgggcgttccggggtgcgcctgtcgggcggtcagcggcagcgcctggcgatcgcccggatgatcctcgccgagcccaaggtggtgatcctcgacgaggccacctcggccctcgacgccgctaccgagtacgccctgcaccaggcgctcggcgacttcctcgaaggccgcaccacattgatcgtggctcatcggctgtcggcggtgaagcaggccgaccgggtcctggtcttcgatggcgggcatatcgccgaagacggcgaccaccagcaactgatcgccgaaggcggcctctacgcccggctctacggacatctgcaacagatgtga

SEQ ID NO: 34750 - protein, 596 aa, Pseudomonas aeruginosa UCBPP-PA14
MSERGDRLSWAEIRRLALRHKKALLLANLVAVLATLCTVPIPLLLPLLVDEVLLGKGDGALRFMDRLLPADWQVAFGYIGLMLAATLLLRGAALVFNVLQAKLFARLSKDIVYRIRLRLIERLRHIALGEYETLGGGSISAHLVTDLDTLDKFVGETLSRFLVALLTLLGTAAILVWMHWQLALLILLFNPLVIWSTVQLGKRVKHLKKLENDSTARFTQALTETLEAIQEVRAGNRQGYFLGRLGHRAQEVRDYAVASQWKSDAAGRASGLLFQFGIDVFRAAAMLTVLLSDLSIGQMLAVFSYLWFMIGPVEQLLGLQYAYYAAGGALQRINELLARADEPRYPPLRDPFAGRTTVGIEVRGLDFAYGEDKVLEQLDLNIGAGEKVALVGASGGGKSTLVQLLLGLYSAQRGSIRYGGVPLEEIGLDCVREHVAVVLQHPALFNDSVRANLTMGRERSDQACWRALEIAQLADGVRRLPQGLDTVVGRSGVRLSGGQRQRLAIARMILAEPKVVILDEATSALDAATEYALHQALGDFLEGRTTLIVAHRLSAVKQADRVLVFDGGHIAEDGDHQQLIAEGGLYARLYGHLQQM

SEQ ID NO: 34751 - DNA, 1749 bp, Exiguobacterium sp. 255-15
  CDS (1)..(1749)
atgaaacctgctacatttaaatcatttttatcattactcaaaaaaagcgaaccaccgattggactgctgtcggctgccgtaacggtttccatcattcaggcactcgctgccctgatgattccatggttcttgaagtctttgattgacaatttttccgtcgatcgcctgacacccgggttgatcaccctgttcatcgtgatcttcatcgtccaaatgatcagcaatgcgttttccatctattggctgcacattgcgggacaacggatcgtcgcgaatttacggacgatgttatggaaacacctgctagctttacccattccattttacgacgaaacgaaatccggtgaactcgtctcgcgtctcaataatgatgcgacgacgttacaacagctattatcggagcaactcgtgcgtctgttgacatcgatcgtctcgatcgtcggtgcaatcacgatcttatttttcctcgactggcagatgacgctcgtgatggtgattgccgtgccgattacgttattgatcatcatcccgctcgttcggaagcttcaccagatttcccgtgagacgcaaaaagaactggccggattatccggattttttgcggaaatgctgggtgaagtccgcctgatcaaatcacaggcgacggaagagtatgagatggaccggggacagacccggattgagaatctgtatggttttggtgtcaaggaagggaaagtccaagccatcttgctgccggtcttcaacgttgccttgacttcgatgctgatcatcatcatcagcttcggtgcttaccgcgtcgcaacgaatcagattacagccggtgagctcgtcgccttctcgttatacctgttccaaatcatgactccgctcgtgacgatgaccgaattcgtctcaaaactgcaaaaagcacgcggagcgacggaacggatttccgaattgctcgaagaacagccggaaaccgacggaacacgtcaggtcgagcgcccgttcgcagcggttcattttaaccaactgtcgttcggttatgatgatacgacactgttgcacgacgtcaccttctccttgccgcgtggtcaaacgacggcaatcgtcggaccaagcggctccggaaaatcaacgttgttcgctctgctcgaacgcttttatcaaccgacggctggtcagatcgaactcggtccacatgccatcaacgagtttgaactggcgagctggcggaattcaatcggttacgtcgctcaggattcgccggtcttgtccgggacgattcgcgacaacctgttatatggcttaacgggtgaggtcacggagcaacaaatccgggaagcggccgagatggccaatgccgacgaattcattcggtcgtttgcgcaaggatacgaaaccgagatcggcgaacggggcgtcaaactgtccggcggtcagcggcaacggattgccattgcccgcgcccttctgcgcgatccggagctgttactgcttgacgaagcaacctcaagtcttgactccgagtcggaacgtgtcgttcaggaagcgctcgaacggctgatggaaggacggacgacattcgtcatcgcccaccgtctcgccaccgtccgccatgccgatcaaatcgtcgtcctcgaacaaggacgtgtttccggcatcgggacacatgacgccctcgtcgcgtcgaatgttttgtataataaactcgtaacgcaacaattcatcggtcaaaccgaaacgaccagggggagtaacagatga

SEQ ID NO: 34752 - protein, 582 aa, Exiguobacterium sp. 255-15
MKPATFKSFLSLLKKSEPPIGLLSAAVTVSIIQALAALMIPWFLKSLIDNFSVDRLTPGLITLFIVIFIVQMISNAFSIYWLHIAGQRIVANLRTMLWKHLLALPIPFYDETKSGELVSRLNNDATTLQQLLSEQLVRLLTSIVSIVGAITILFFLDWQMTLVMVIAVPITLLIIIPLVRKLHQISRETQKELAGLSGFFAEMLGEVRLIKSQATEEYEMDRGQTRIENLYGFGVKEGKVQAILLPVFNVALTSMLIIIISFGAYRVATNQITAGELVAFSLYLFQIMTPLVTMTEFVSKLQKARGATERISELLEEQPETDGTRQVERPFAAVHFNQLSFGYDDTTLLHDVTFSLPRGQTTAIVGPSGSGKSTLFALLERFYQPTAGQIELGPHAINEFELASWRNSIGYVAQDSPVLSGTIRDNLLYGLTGEVTEQQIREAAEMANADEFIRSFAQGYETEIGERGVKLSGGQRQRIAIARALLRDPELLLLDEATSSLDSESERVVQEALERLMEGRTTFVIAHRLATVRHADQIVVLEQGRVSGIGTHDALVASNVLYNKLVTQQFIGQTETTRGSNR

SEQ ID NO: 34753 - DNA, 1872 bp, Chloroflexus aurantiacus
  CDS (1)..(1872)
atgtctcgtccatttggcggtcgtccgcgtccattccctgtccgatcacgtccacaaacctggcggcaatgggtacaagagacccgtaaagccttacgcaatgttcccgcagccttccgcctggtctggcaggctgatcgcacccatacgattgcgatggcatgtatcacgctgctggccgcagggttgccactggcgcaggcgtatatggctaaacagattgttgataccgttgttgcggctgtgcaacagggtcttaccgcgttgagtggccttgagcaaacgttgccgtggttgttgggtgaattcgggctgattacgctgggagcagtgctgatgcagatgcgaacgctgagtgaacacatcttgaatgcccggctgagcaatatggtcaacgtcatgattatgcaaaaagcgctgctcctcgatctgcactattttgaagatgctcagtattatgacaagttgcaaaacgcacgtcgcgaaaccaactggcgggccatggcaatggtgaacaccgcattcagcgccattcaacaaatattgacccttggctcgtttgcggccagtctgctctggtttagccctctcatagcgttgatcttgtttggcgcaaccattccggcctttctcgctcagactcattttagccagttacggtttcgcttactgacctggcgcgcaccagaatttcgccgcatgcagtaccttgaacatctgctgaccgttgatactgcggcgaaagaggtaaaattgttcgcacttggtttgccactgctgcaacgccatcaggaacagtatcaacgcttcttcactgaagatgcagctctggcccgccgccgttcgctgatcagcatggtgtggggggtcgtagccagcgccggttattacgtcgcatacggatggatcatctggcaaacagtggctggcgcaattaccattggcggcatgaccttctatttgaccctgtttcgccaaagtcagtcagtcgtgcagaccttgttcggcaatctggcgcagctctacgaaggtggattgtttttgggaaatctattcgattttctggcgctggagccacagatgcgcagtggtcgcaatctcccggtaccacccatcatccgccacggcattgagttccgtaatgtcagttttcgttatcccgaccgggaagattgggcattgcgctcgatcaatctgcacattgcaccgggcgagaagatcgccctcgtaggcgcaaatggggccggcaagacgaccttaatcaagctgttgacccgactgtacgatccgactgaaggtcagattctgctcgatggtgtcgatctgcgcgattatgatcttgagcaattacgccagcggattggcgtcatttttcaagactttgttcgctatcaggccactgcgcgcgagaatattgggtttggtcagattgatgatctggctaacgaaccgcgcatccgttcggcagccgagcggggcggggctgatgaagtgctgcgtcatttgcctgacggctacgagacgatgctgggacgctggtttgaaaatggggccgaactgtcgggtgggcaatggcagaagatagcgcttggccgcgcctttatgcgtgatagcgaaatcctggtgctcgatgagccaacggctgcgctcgatgccgagcgtgaatacgaaatctttcagcgctttcgtgatttaactgccggacggattgcggtgttgattagccatcgcttctcgacggtacggatggcagaccggattgtggtgctcgaacacgggcagatcaccgagatgggtacccatcaggaattactggcccgtgatggcacttacgcacggctgttccacatgcaggcagagggctatcggtag

SEQ ID NO: 34754 - protein, 623 aa, Chloroflexus aurantiacus
MSRPFGGRPRPFPVRSRPQTWRQWVQETRKALRNVPAAFRLVWQADRTHTIAMACITLLAAGLPLAQAYMAKQIVDTVVAAVQQGLTALSGLEQTLPWLLGEFGLITLGAVLMQMRTLSEHILNARLSNMVNVMIMQKALLLDLHYFEDAQYYDKLQNARRETNWRAMAMVNTAFSAIQQILTLGSFAASLLWFSPLIALILFGATIPAFLAQTHFSQLRFRLLTWRAPEFRRMQYLEHLLTVDTAAKEVKLFALGLPLLQRHQEQYQRFFTEDAALARRRSLISMVWGVVASAGYYVAYGWIIWQTVAGAITIGGMTFYLTLFRQSQSVVQTLFGNLAQLYEGGLFLGNLFDFLALEPQMRSGRNLPVPPIIRHGIEFRNVSFRYPDREDWALRSINLHIAPGEKIALVGANGAGKTTLIKLLTRLYDPTEGQILLDGVDLRDYDLEQLRQRIGVIFQDFVRYQATARENIGFGQIDDLANEPRIRSAAERGGADEVLRHLPDGYETMLGRWFENGAELSGGQWQKIALGRAFMRDSEILVLDEPTAALDAEREYEIFQRFRDLTAGRIAVLISHRFSTVRMADRIVVLEHGQITEMGTHQELLARDGTYARLFHMQAEGYR

SEQ ID NO: 34755 - DNA, 1860 bp, Chloroflexus aurantiacus
  CDS (1)..(1860)
atggtgaacgataagcaggttcgcctgcttgcgttcaaggagcgtactttgttacggttaccgtttcaattgataccgccaccacaagctgccagtaatgtaagctggtcccggctactttcctatctgcgtccttaccgtggttggatcgtagtagcgctgatcgccatggtcatcagtgccggtttgggtctggtaattccgttagcgattggtcaggttgttaatctgataaccggcgaccaggcattaccggtcgtccagattgcccaacttctgggtattgtgatgattgggcaacttctgaccggtgttattcagacctactgtctaagcttcgttggtgagcgtgttgtcagcgatctacgcattgcagcgtatgaacatctgcaaaagctcgatctcgcctttttcgagcagcgtcgaacaggtgaaatcacgtcgcgcattaccaacgacgtgacccttatccagacaacggtgaccaatagtctgccaacgctactgggaggtgtcattcagttagttggggctgttgctctgatgctcgttgtctcgtggcagctcagtggtctggcgttgatcctggtgccgacgctggtgttgattggggttttcttcggtcgctggctacgccagatttcgaccgccgtgcaagaccggctggccgatgcaaccagcattctggaagagacggttgccggtgtgcgggtcgttcgctcgttcagacgtgaggactacgaaattacccgttttcgggcagcggtcgaagcaacctttgcgacagcgttgaagcttgcccggattcgcgcgatctttcagccggcaatgtcgctggcggtgtggatggcgttgatcggcattctggctatcggcggctatctggtgagcaccggtgtgctgacgacgggcagcctgatctcgtttctgttctacgcagtgatggctgccgggtcaatgggtgtgtttgcaagcctgtttgctcagttgcaagaggcacttggggcaaccacccgggtcttcgagctgctcgatcagcaaccattggtggccgatgcgcctgatgccattcccttaccgcctgtcgaggggcggattgagttccgcgaggtgtcgtttgcctatcaatcggcaaccagcaatggctcgcctgcaccggtagtcctgcgcgacttttcgctcaccattgaagcaggggaaatggtagccctggttgggcctagcggtgccggcaagagtacgattgccagcctgatcccacggttctacgacgtgagtgccggtagcgtgctcatcgatggttatgatgtgcggcgggtccagatacagtcgctccgggatcagatcggaatcgtgttgcaggaaacccaactcttcagcggcagtgttcgcgataacatccgctatggccgtctcgaagccactgatgaagagattgaagcggctgcccggatggcgaatgcgcacgagttcatctgtcaattgccagatgggtacgatacaccggtcggcgagcgtggggtgcgcttgagtggcggtcagcgccagcggattgccattgcccgggcgattctgaaaaatccgcgcatcctgattttggacgaggccaccagttcgctcgacagcgagagcgagcggttggtgcaagaggccctggaacggctcatggccggacgtaccagtatcgtcattgcccatcgcctgagcacagtgcagcgcgctgatcgcattgcggtgatcgtagcgggtgagctggttgaaattggtactcatcacgagctgcttgcccgtgatggtgtctatgcccggttgtacgaacgacaatttttgcagccaataccggcaacggctgctgtgtaa

SEQ ID NO: 34756 - protein, 619 aa, Chloroflexus aurantiacus
MVNDKQVRLLAFKERTLLRLPFQLIPPPQAASNVSWSRLLSYLRPYRGWIVVALIAMVISAGLGLVIPLAIGQVVNLITGDQALPVVQIAQLLGIVMIGQLLTGVIQTYCLSFVGERVVSDLRIAAYEHLQKLDLAFFEQRRTGEITSRITNDVTLIQTTVTNSLPTLLGGVIQLVGAVALMLVVSWQLSGLALILVPTLVLIGVFFGRWLRQISTAVQDRLADATSILEETVAGVRVVRSFRREDYEITRFRAAVEATFATALKLARIRAIFQPAMSLAVWMALIGILAIGGYLVSTGVLTTGSLISFLFYAVMAAGSMGVFASLFAQLQEALGATTRVFELLDQQPLVADAPDAIPLPPVEGRIEFREVSFAYQSATSNGSPAPVVLRDFSLTIEAGEMVALVGPSGAGKSTIASLIPRFYDVSAGSVLIDGYDVRRVQIQSLRDQIGIVLQETQLFSGSVRDNIRYGRLEATDEEIEAAARMANAHEFICQLPDGYDTPVGERGVRLSGGQRQRIAIARAILKNPRILILDEATSSLDSESERLVQEALERLMAGRTSIVIAHRLSTVQRADRIAVIVAGELVEIGTHHELLARDGVYARLYERQFLQPIPATAAV

SEQ ID NO: 34757 - DNA, 1749 bp, Xylella fastidiosa Dixon
  CDS (1)..(1749)
atgcgttatgccacgccctggcggacgtaccgtcgcttgctgtcgtatgcgcgggagtatcgttggttactcgttgttgctgcgtgtggtgctttacttgaggcagttgctggttctacctttctggcgttgatgaagcccatcaccaacgaaacctttatcgagcgaaaccgtgaggtggccctgtggctgcctcttggaattgtcggtttgtttttgttacgcggtattgctggctatatcactgatatggcgatgggccgcgctgcgcgtagcattgctcgggattttcgtgtgtgtgtcctgaccaaatattttcgtttgcctggtggccgttttgacggtgagccagtggcttcgatgttggtgcggctcggttcagacagtgagcaagttgcgcatgcggttatcgacgcgatgaaggtgatggtgcagcagacgcttcaggtgattggtgcgttggttgtgatgttgtggtacagctggacagtcacgctcgccatccttttggtcgctccgttgctggcttgggtcatgcagcgggttgctaagcgttaccgtcgtatcagccatcacatccaagagagtaatgcgcagctcatgcaagctgccgatcaagcgttaagcaactaccaggacgttaaagtgtatgccgcgcaagagagcgagttggagcgctatgctcggttggccaatatcaatttgggtttggcgataaaggttgagtcgacacgtagtatctcttcggcggcggttcagttgcttggtgcggttgggttggcaatgttgttgctcattgctggccatgaagctttggccggtcgcctcagtccaggcgattttgtctcgctgatgacttcaatgatcgcggttattcccgcgttgaaacagttgaccaatgtacagaacatgttgcagagcggtattgcttctgcacaacgtctgttctcggtactagatagtcctgatgagcttgatactggcagacgaccgttggggcgtgccagaggattaatcgagttccgcgggatcaccgcacgctatcctggtcggtctgctcccgtgctggatagtgtcagctttgttgctgcaccgggcacggtcactgcgattgttggtcgttcaggaagcggtaagtcaagtttaatcaagttgattccgcgtttttacgagccggagtctgggcagatattgttggatggccatccattacaggattatcttttagctgatctgcgccgtcagattgcattggtaggacagcaggtcatgttgttcgatggcagcatcgcggaaaatattgcttatggtgagatgcatcaggtcgtttctgagcagattgaacgtgtcgtggttgatgcaaacgctcaggattttgtgaatcaacttccagagggattacagtttcaggttggggttaagggggggcgtctttctgggggacaacgtcagcgtttggccattgcgcgcgcgatgctgaaggatgcgccgattcttatcctggacgaggccacggctgcgcttgataacgaatctgagcgcttagtgcaggatgcgttgcagcgcttgatgccggagcgcaccacacttgtgattgcgcatcgactgtcaacgatcaagcatgcggatcaggtgttggtgatggaccaggggcgcatcattgagtctggtacccatgtcgatctgttggcacgtgatgggttgtacgcttatttgtacagcatgcaatttcgcgaacgtccaacatga

SEQ ID NO: 34758 - protein, 582 aa, Xylella fastidiosa Dixon
MRYATPWRTYRRLLSYAREYRWLLVVAACGALLEAVAGSTFLALMKPITNETFIERNREVALWLPLGIVGLFLLRGIAGYITDMAMGRAARSIARDFRVCVLTKYFRLPGGRFDGEPVASMLVRLGSDSEQVAHAVIDAMKVMVQQTLQVIGALVVMLWYSWTVTLAILLVAPLLAWVMQRVAKRYRRISHHIQESNAQLMQAADQALSNYQDVKVYAAQESELERYARLANINLGLAIKVESTRSISSAAVQLLGAVGLAMLLLIAGHEALAGRLSPGDFVSLMTSMIAVIPALKQLTNVQNMLQSGIASAQRLFSVLDSPDELDTGRRPLGRARGLIEFRGITARYPGRSAPVLDSVSFVAAPGTVTAIVGRSGSGKSSLIKLIPRFYEPESGQILLDGHPLQDYLLADLRRQIALVGQQVMLFDGSIAENIAYGEMHQVVSEQIERVVVDANAQDFVNQLPEGLQFQVGVKGGRLSGGQRQRLAIARAMLKDAPILILDEATAALDNESERLVQDALQRLMPERTTLVIAHRLSTIKHADQVLVMDQGRIIESGTHVDLLARDGLYAYLYSMQFRERPT

SEQ ID NO: 34759 - DNA, 1752 bp, Bacillus brevis
  CDS (1)..(1752)
atgaaagcgaaaaagcgcgcgtattttttggggctactcggtgatggaatcggtcaagccgctgttttggtcgctttgccatttgtgtttaaagatttgacagactttgcgagctcgaaagacccggcactgctcaccagagcgatcgtgaccatggctgcgatgtttcttttgttcagtctgctgtcgccttttttcagctacatatatcggcgctgcgtccgcgaggtggttgccaacattcggctgcttgtctttcagcgattgagccgcttgcctttcgcctactacgagcagcatcattcgggcgatacgatgtcgcggctgggcaacgacgtccagctgatggagcgggcgtatgccgaacagttgaaaacgctgtgcatcattatgttgtcgctggttggctcgatcgtcgggatgtttgctttggatgggaaaattgccacggtccttttgctcgtgagcacgctgaccctttacgtgaatgcgcagtttgccaagtcggtgcggcgcattggcgaccaaatgcagcagcagcttggaacgggcacagaacggctgagcgattttttggcaggcttgcccgtcatcaagatgtttcatttacagaaggttgtgacggcacgctacacggaagccaatgaacaagtgaccttgtccgcgatcaagcaaggacataaacacgcgctgttggaaggaaccaactttttcatccagtttgtcagcttcgggggaatgcttgtgtttggcatcatgatggtcgccaaacaaatgatcggactcggtgtgctggtcgcgatggttcagcagcaaatgctggtgacactggcttttttgcagcttgggcaggtcatcacgacattgcaaggctcgctggcaggcgcttcgcggattgtcggctttctccaggaaccgctcgaaccgaagcggtacgaaccagcttccgcccctaccgcaacccggatatacgacagcatgctgacagtggagcaggtcgactttggctacaccgccgatacaaaggtgctccaaggtgtgtcgctgcaagtcgggcgaggtcaaatggctgcgctggtagggacgagcggaggcggaaaaagcacggtgatgaagctgttgttaggctattacccgccttcagccggctcgcttcctttgctgggcaaaccgatcggccaatattcgatcgcggagatgcggagcctgatttcctacgtgccgcaggacgcctttttgttcgagggaaccatcgaagaaaacattcgctacggttgcctcgacgccacggaagaagaggtgataagagcgagcaaagccgcctacgctcacgatttcatcatggaactgccggacggctatcagacccgcacaggcgagcgaggggccaagctatcgggaggacagcgccaacgcatcgcgattgccagagcgatcctgaaaaatgcgccgattcttttactggatgaagcaacctctgctttggatacggaatcggagttctgggtgcagcgagcgttggcggctctcatgcaggaaaaaaccgtcctggtcatcgctcatcgcctgtcgaccatcgagcatgcggacatgatttacgtgctgcacgaaggaaaagtgatggaacagggaaggcatgcggaattgctggcgcaaaacggcttgtatgccagcatgtatgaagtacagcaaagaaaggacagacctgctcccgccttgtcggcgccggaaagcagcgcaagtctcatctga

SEQ ID NO: 34760 - protein, 583 aa, Bacillus brevis
MKAKKRAYFLGLLGDGIGQAAVLVALPFVFKDLTDFASSKDPALLTRAIVTMAAMFLLFSLLSPFFSYIYRRCVREVVANIRLLVFQRLSRLPFAYYEQHHSGDTMSRLGNDVQLMERAYAEQLKTLCIIMLSLVGSIVGMFALDGKIATVLLLVSTLTLYVNAQFAKSVRRIGDQMQQQLGTGTERLSDFLAGLPVIKMFHLQKVVTARYTEANEQVTLSAIKQGHKHALLEGTNFFIQFVSFGGMLVFGIMMVAKQMIGLGVLVAMVQQQMLVTLAFLQLGQVITTLQGSLAGASRIVGFLQEPLEPKRYEPASAPTATRIYDSMLTVEQVDFGYTADTKVLQGVSLQVGRGQMAALVGTSGGGKSTVMKLLLGYYPPSAGSLPLLGKPIGQYSIAEMRSLISYVPQDAFLFEGTIEENIRYGCLDATEEEVIRASKAAYAHDFIMELPDGYQTRTGERGAKLSGGQRQRIAIARAILKNAPILLLDEATSALDTESEFWVQRALAALMQEKTVLVIAHRLSTIEHADMIYVLHEGKVMEQGRHAELLAQNGLYASMYEVQQRKDRPAPALSAPESSASLI

SEQ ID NO: 34761 - DNA, 1722 bp, Shigella flexneri
  CDS (1)..(1722)
atgcgcgctttgctaccctatctggcactgtataaacgtcataaatggatgttaagtcttggtattgtgctggcaattgtgacgctgctcgccagtatcggtctgttgacactttccggctggttcctctcggcctcagcggttgcgggggttgccggactgtacagcttcaactatatgctacccgctgcgggcgtgcgtggtgccgcaatcacccgtactgccgggcgttattttgaacgtctggtaagtcacgacgcgactttccgcgtgttgcagcatctgcgcatttacaccttcagcaaattgttgcccctctcccctgccggactggcgcgctatcgtcagggcgaattgctcaaccgcgtggtggcggatgttgatacgctcgatcatctttacctgcgcgttatctcgccgctggtgggcgcttttgtggtgattatggtggtgacaatcgggttaagtttccttgatttcaccctcgcctttacgctgggcagcgttatgttactgacgcttttcctgatgccaccgctgttttatcgtgcgggaaaaagcaccgggcaaaatctgactcatcttcgcggacagtatcgccaacaactgacggcctggctgcaagggcaagctgagctgaccatttttggtgccagcgatcgttatcgcacgcaactagagaatacagaaattcaatggctggaagcgcaacgccgtcaatctgaactgaccgcattgtcgcaagcgataatgctgctcattggcgcgttagcggtgatcctgatgctgtggatggcgtctggcggcgttggcggcaatgctcaacccggcgcattaattgccctgtttgtcttctgcgcgttagccgcgtttgaagcactggcaccagtaacgggtgcatttcagcatctggggcaagtcattgcctctgccgtacgtatctctgacttaacggatcaaaaaccggaggtcaccttccctgatacccaaactcgtgttgccgatcgcgtttcgctgacattacgggatgttcagttcacttatccggagcaatcccaacaggcacttaaagggatttctcttcaggtaaacgccggggaacatatagcgattctcgggcgaaccggatgcggcaaatcaacactgttacaactgctgacccgcgcatgggacccgcaacagggcgagattttgcttaacgatagccccatagccagcctgaatgaagcggctctacgacagaccatcagcgttgttcctcagcgagtgcatctgtttagcgccacactgcgtgataatctgttactcgcctcgcctggcagtagtgatgaggctctgtcggagatcttgcgtcgcgttggtctggagaagctgctcgaggatgcaggtctcaacagttggttaggtgaaggcggacgccagctctccggtggtgaacctggccgtctggctatcgcccgtacgctgttacatgatgcgccactggtgttgctggatgaacctaccgaaggcttagatgccacaaccgaaagccagatccttgaattgcttgcaaaaatgatgcgtgagaaaacggtgttaatggtcacccatcgacttcgcggactctctcgtttccaacaaataatagtgatggacaacgggcaaattattgagcaaggtactcacgcagaactgcttgccagacaggggcgttattaccagttcaagcagggtttgtaa

SEQ ID NO: 34762 - protein, 573 aa, Shigella flexneri
MRALLPYLALYKRHKWMLSLGIVLAIVTLLASIGLLTLSGWFLSASAVAGVAGLYSFNYMLPAAGVRGAAITRTAGRYFERLVSHDATFRVLQHLRIYTFSKLLPLSPAGLARYRQGELLNRVVADVDTLDHLYLRVISPLVGAFVVIMVVTIGLSFLDFTLAFTLGSVMLLTLFLMPPLFYRAGKSTGQNLTHLRGQYRQQLTAWLQGQAELTIFGASDRYRTQLENTEIQWLEAQRRQSELTALSQAIMLLIGALAVILMLWMASGGVGGNAQPGALIALFVFCALAAFEALAPVTGAFQHLGQVIASAVRISDLTDQKPEVTFPDTQTRVADRVSLTLRDVQFTYPEQSQQALKGISLQVNAGEHIAILGRTGCGKSTLLQLLTRAWDPQQGEILLNDSPIASLNEAALRQTISVVPQRVHLFSATLRDNLLLASPGSSDEALSEILRRVGLEKLLEDAGLNSWLGEGGRQLSGGEPGRLAIARTLLHDAPLVLLDEPTEGLDATTESQILELLAKMMREKTVLMVTHRLRGLSRFQQIIVMDNGQIIEQGTHAELLARQGRYYQFKQGL

SEQ ID NO: 34763 - DNA, 1695 bp, Campylobacter jejuni
  CDS (1)..(1695)
gtgctaaaaaaacttttttttattttaagcaaggaagataaaaattttttatttttcttgcttgttttttcagtatttgtttcttttatagaaacttttgcgatttctttggtaatgccttttatcactttggctagtgatttttcttattttgatcgtaataaatatttaatcagcctaaaagaatatcttaatatccctgtttttgaaatcattgtttattttggagtggggcttattgttttttatgtatttagagctttgttaaatgcgtattattttcatcttttggcaagattttctaaaggacgttatcatgcgatcgcttataaggttttttctaaatttttaaatattaattatgaaaaatttactcaaaaaaatcaatctgaaattttaaagtccattacaggggaagtttataatctaagcactatgatttcatcatttttacttttgatgagtgaaatttttgtagtgcttttgctttatgctttaatgcttttgattaattataaaatcactttatttttaagtatttttatggtgttaaatgcttttattttagtgaaaattttaagccctatcattaaaaaagcaggactaagacgcgaagaagcgatgaaaaatttcttcgaaattttaaatacaaatttaaataattttaaatttatcaagcttaaaaccaaagaagatggagtattaagtctttttaaagcacaaagtgaagctttttctaaagcaaatattaccaatgaaagcgtagctgcggtgcctagaatttatcttgaaggaataggcttttgtgtgcttgtttttatcgtggtatttttggttttgaaaaatgaaagtgatatttcaggtattttatccacgatttctatttttgttttagcgctttatcgcttaatgccaagcgcaaatcgtattatcacaagttatcatgatttgctttattatcattcttctttgaatattatttatcaaaatttaagacaagaagaagaaaatttgggcgagggaaaattaagttttaatcaagagcttaaaatttgcaatcttagctttggttatgagggaaaaaaatatttatttaaaaatcttaatttaaacattaaaaaaggtgaaaaaatcgcttttataggggagagtggttgtggaaaaagtaccttagtagatcttatcataggacttttaaaaccaaaagaagggcaaattttaattgataagcaagaattaaatgcaagtaatgcaaaaaattatcgccaaaaaataggctatatcccgcaaaatatctatctttttaatgatagcatagctaaaaatatcacttttggagatgcggttgatgaagaaaaacttaataaggttatcaaacaagcaaatttagagcattttataaaaaatttacctcaaggagttcagacaaaagtaggcgatggggggagtaatttaagcgggggacaaaaacaacgcatagctatagcaagggctttgtatttagagcctgaaattttagtgcttgatgaagcaacttctgcgcttgatactcaaagtgaagcaaaaatcatggatgaaatttataaaatttctaaagataaaaccatgattattatcgcacatcgcctttctacgataacgcaatgtgataaggtttatcgtttagaacacggtaagcttaaagaggagaaatga

SEQ ID NO: 34764 - protein, 564 aa, Campylobacter jejuni
MLKKLFFILSKEDKNFLFFLLVFSVFVSFIETFAISLVMPFITLASDFSYFDRNKYLISLKEYLNIPVFEIIVYFGVGLIVFYVFRALLNAYYFHLLARFSKGRYHAIAYKVFSKFLNINYEKFTQKNQSEILKSITGEVYNLSTMISSFLLLMSEIFVVLLLYALMLLINYKITLFLSIFMVLNAFILVKILSPIIKKAGLRREEAMKNFFEILNTNLNNFKFIKLKTKEDGVLSLFKAQSEAFSKANITNESVAAVPRIYLEGIGFCVLVFIVVFLVLKNESDISGILSTISIFVLALYRLMPSANRIITSYHDLLYYHSSLNIIYQNLRQEEENLGEGKLSFNQELKICNLSFGYEGKKYLFKNLNLNIKKGEKIAFIGESGCGKSTLVDLIIGLLKPKEGQILIDKQELNASNAKNYRQKIGYIPQNIYLFNDSIAKNITFGDAVDEEKLNKVIKQANLEHFIKNLPQGVQTKVGDGGSNLSGGQKQRIAIARALYLEPEILVLDEATSALDTQSEAKIMDEIYKISKDKTMIIIAHRLSTITQCDKVYRLEHGKLKEEK

SEQ ID NO: 34765 - DNA, 1785 bp, Thermoanaerobacter thermosulfurogenes
  CDS (1)..(1785)
atggctaaaaatacggtgaagcaagacgaagacttaaggcgaatgtcaaattttgtcatattgaaaaggctatttagttaccttggcaaatataaattaaaggtatttgtagtgataatgtttttaatatttgagatggctgtaagcttggtaaatccagttcttatgaagacagcaatcgataaaaacatacgaaatggcgatataaacggattgtttgtcatcgggattttgatggtgtcattaaattttttatcaatgatggcatcaagaaccaggatagtaaagatggcttctgtcacaaatgacatacttttaaatataaggcatgaactttatagtcacatacagaaactttcgttttcgttttttgactcgaggccagtaggcaaaatcttagcaagggtcataggagatgtgaattcactgcaagatttgtttaacaacagcgttacaaattttataccgcagattcttacagtaatatgcgttggtaccatgatgttttatttaaacagcaaattggctttagcatctatgattttgttgccgatgcttgtgattggacttttttcaatagagactttgtcaagaagaagatggcaagaatttagaagaaagaggtctacgtttaatgcttacacacatgaagatttttcagggataaaagttgtgcaggagtttgcaaatgaagacaagacttcttcagtgttctttaagcttgtcaaggatatgatggacagcttcattaaagctgtaaggcttaatgaccttttttggcctatggttgatgcgtcttatgggattggagctgtaatactttattattttagtgcaaagtttatgggatacggcgttacaatcgggacaataatagcatttaccatgtatataggcatgttctggaggccgatccttgacataagcaatttttacaatagcttagtcatgtctttcgcatctgcagagagaatatttgagataatggacattgagccagatattgtagacatgaaaaatgccattaagatgcctaagataaaagggaatgttgagtttaaaaatgtcacgtttggctatgaagatggcagtgttgtattagatgacgtaagctttaaagtgaatgctggggagactattgcgcttgtaggacctactggtgcaggaaagactacgattgtaaatctcataagccgtttttacgacccgtccaaaggtgctgtcttgatagatggcaaagacataaagcatgtggagctggagtcactgagaagccagatgggcataatgctgcaggacacgttcctgttttccgctacaataaaggaaaatataaggtacggcaagcttgatgctacagacgaggaaatcatagctgcggcaaaagcggtaaatgctcatgaatttataatgaagatggaaaaaggatacgacacagaggtaaacgagaggggctcaaggctttctgtggggcaaagacagttaatatcatttgcaagagcgcttttggcaaatcctcgcatattgattttggatgaagccacatctaacatagatacacagacggaaaggctcgtgcaaaaaggcatacaaaggcttctttcgggaagaacgtcttttgtcatagctcacaggctttctaccattagggatgccgataggataatggtgatagacggaggaaagattgtcgagacaggcacacacgatgagcttatgaatcttagaggcctttattatgacctctacatgtcacagtacaaatttttaagtgaaggcccttaa

SEQ ID NO: 34766 - protein, 594 aa, Thermoanaerobacter thermosulfurogenes
MAKNTVKQDEDLRRMSNFVILKRLFSYLGKYKLKVFVVIMFLIFEMAVSLVNPVLMKTAIDKNIRNGDINGLFVIGILMVSLNFLSMMASRTRIVKMASVTNDILLNIRHELYSHIQKLSFSFFDSRPVGKILARVIGDVNSLQDLFNNSVTNFIPQILTVICVGTMMFYLNSKLALASMILLPMLVIGLFSIETLSRRRWQEFRRKRSTFNAYTHEDFSGIKVVQEFANEDKTSSVFFKLVKDMMDSFIKAVRLNDLFWPMVDASYGIGAVILYYFSAKFMGYGVTIGTIIAFTMYIGMFWRPILDISNFYNSLVMSFASAERIFEIMDIEPDIVDMKNAIKMPKIKGNVEFKNVTFGYEDGSVVLDDVSFKVNAGETIALVGPTGAGKTTIVNLISRFYDPSKGAVLIDGKDIKHVELESLRSQMGIMLQDTFLFSATIKENIRYGKLDATDEEIIAAAKAVNAHEFIMKMEKGYDTEVNERGSRLSVGQRQLISFARALLANPRILILDEATSNIDTQTERLVQKGIQRLLSGRTSFVIAHRLSTIRDADRIMVIDGGKIVETGTHDELMNLRGLYYDLYMSQYKFLSEGP

SEQ ID NO: 34767 - DNA, 2160 bp, Lactobacillus sakei
  CDS (1)..(2160)
atgttatcttatataaattactatgttgcacaagtcgatgaaatggattgtggggtagctgcacttgctatggtgctcaaacactatggctcaacttactcattagcttatttacgtcaaaaagctaaaactgatctagagggaacttcggcacttggtttgatgaaaactgctgagtcgtttgactttgaaactaaagcgatacaagcagatatgagcctttttgaagtggaagatttaccattgccgtttatagcgcacgtcataaaagaaggtggtttactccactattatgttgttttaagtattaaaaagaatcaaatcgtaattgctgatccggatccaacagttagcatcactaaaatttataaagaccaatttgcgagtgaatggtcgggtgttgcaatattcatggccccaaagccaacctataagccagttaaagaagcagaaaaagcttctttatggtcatttgtgccaacgttattaaaacaaaaatttctagtcatccacattaccctagcagcattattaataacgatcattagtattttaggttcttattttttacaaacggtcatcgacacctatattcctaataaaatgactagtaccttgggaattgttacattgggattgctggtcttttatgttttccaagctatttttacatatacgcagaattttctattggttgttctgggacaacgactatcaattgaaattatattgagctacttaaggcatgtttttgaacttcccatgtctttttttgcgacccgtaaaacgggtgaaatcatttcgcggtttaacgatgccaacaaaataattgacgcacttgcaagttcaatcatttcaatctttttagatgtcacgattgtggttgtgatgggaattattttaatgattcaaaacacaactttattttggattacattaatggcaatccctctttatattgcggttattaccttatttgttaaaccttttgaaaaattaaatcaaaaggaaatgcaaagtaacgccatgttaaattcagctattattgaggatctgcacgggattgaaacaattaaagcacttagtagtgagcacgaacgttatcaaaagattgatacagcttttattgattatctcaagaagaactttaattacgttaaaacagacactttacaacaagccattaaattatttatccaacttggtttaaatttaattgtcctttgggttggggctattttagtaacccataatgaattatcaattgggcaattaatgacttataatgccctgctggcttattttgtgaacccattacaaaatattattaatttacaaaccaagcttcaaagtgcaaaagttgctaataatcggcttaatgaagttttcttagttgattcagagttcactgagaaaagagcaatcaaacgagcagaacaattagttggaccgattaagattgaaaatgttagttattgttacggttatggtaaaaatgttttagaacaaattaatctaacaatccatcctggagaaaaattaacaattgttggcatgagtggctctggtaaatccacgttagttaaattattagttgatttttttcaaccaaatgaaggtcaagtaacgataaatcaacataacatcactaacattgataaaaaagtactccgacaaacaatcaattatattccgcaagatccatatcttttctcaggtacaatcttagataatttaaaattaggtaatcggactaacgttactcaatctgatcttattaaagcttgtgaactagctgaaattaaacaagatatcgagaaaatgccactacagtttgaaacacttttagacgaagaaggaagtactttatctggcgggcaaaaacagcggttgacaattgcacgagcgttactatcacccgctaaagtattaatctttgatgaatcaactagtgggttagatacgattactgaaagccgattagttgaacatttaatgaccttgactgataagacaattatttttattgcgcaccgtttatcaattgccaaaaagacgaataacgtcatcgttatggaaaatggtcgtatcattgaaagtgggagtcatgatgatctaattgcaaaaaaagaaacctattatcaattgattaataactaa

SEQ ID NO: 34768 - protein, 719 aa, Lactobacillus sakei
MLSYINYYVAQVDEMDCGVAALAMVLKHYGSTYSLAYLRQKAKTDLEGTSALGLMKTAESFDFETKAIQADMSLFEVEDLPLPFIAHVIKEGGLLHYYVVLSIKKNQIVIADPDPTVSITKIYKDQFASEWSGVAIFMAPKPTYKPVKEAEKASLWSFVPTLLKQKFLVIHITLAALLITIISILGSYFLQTVIDTYIPNKMTSTLGIVTLGLLVFYVFQAIFTYTQNFLLVVLGQRLSIEIILSYLRHVFELPMSFFATRKTGEIISRFNDANKIIDALASSIISIFLDVTIVVVMGIILMIQNTTLFWITLMAIPLYIAVITLFVKPFEKLNQKEMQSNAMLNSAIIEDLHGIETIKALSSEHERYQKIDTAFIDYLKKNFNYVKTDTLQQAIKLFIQLGLNLIVLWVGAILVTHNELSIGQLMTYNALLAYFVNPLQNIINLQTKLQSAKVANNRLNEVFLVDSEFTEKRAIKRAEQLVGPIKIENVSYCYGYGKNVLEQINLTIHPGEKLTIVGMSGSGKSTLVKLLVDFFQPNEGQVTINQHNITNIDKKVLRQTINYIPQDPYLFSGTILDNLKLGNRTNVTQSDLIKACELAEIKQDIEKMPLQFETLLDEEGSTLSGGQKQRLTIARALLSPAKVLIFDESTSGLDTITESRLVEHLMTLTDKTIIFIAHRLSIAKKTNNVIVMENGRIIESGSHDDLIAKKETYYQLINN

SEQ ID NO: 34769 - DNA, 1647 bp, Pseudomonas aeruginosa
  CDS (1)..(1647)
atgaccaatcccaagcgcggcgccattcgcgaactgctcgccctgctcaggccctttcgagcgatcgtggccgtctccatagcactgggcatggccggcggccttgccatcaccctgctgctggccagcatcaacaacgccttgcactcggaaaacggcctcggccaaggcgtactgctgtcgttcggcggactctgcctgctggcattggtcagttcgatcgtctccgacatcggtaccagctacgtcggccaacacatcatcgcgaacgtgcgcaaggaactcggcgagaaagtcctctcggcgcccatcgagcagatcgagcgctaccggacccaccgtctcattccggtactgacacacgacattgacaccatcagcgacttctccttttccttcaccccactggccatcgccctgaccatcactttcggctgcctgggttacctcgcctacctatcggtcccaatgttcctgctgacagtcgtcgccatcgtcatcggcacggcagcccagtacctggcgcgctcccgcggtttcaaagggttctatgccgcccgcgatctcgaagacgaattgcagaagcactacaccgccatcgcttcgggcgcgaaggaactgcgcatccaccgcccgtcgctatcgcatgcacacggccgcatcagcgaaaccgcgaacaacatccgcgacctccacatcagctccatcaatatattcatcctggccaagaccttcggctcgatgctgttcttcgtggtgatcggtctggcgcttacgctccaggcctactggccttcgtccaatccggccgccatcactggcttcgtgatggtcctgctgtacatgaagggaccactcgaacaggtggtgaccatccttcccatcgtcagtcgcgcccaggtcgccttccagcgggtcgccgaactttccgagcgtttttcctctcccgaaccccatcttctgctcagcgaacaggaggccccggacaagaccgtcgacagcctggaactgcgcgacgttcgctacagcccccccgccgtcgaaggcagcgaaccgttccatctgggccctatcaatctgcgtatcgcccaaggtgacatcgtcttcatcgtcggcgagaacggctgcggcaagacgaccctgatcaagctgctgctcggcctctatcgcccgcagtccggcgagatccttctcaacggagaaccggtcagcgcggagacccgcgacgattaccgccagctcttcagcaccatcttcgccgactactacctattcgacgacctggtccagggcaagcaggcttcgttgcagaacgcgacccaatatctgcaacgcctggaaatcgcccacaaggtcagcgtcatggacggcaacttcagcaccaccgatctctccaccgggcagcgcaagcgccttgcgctgatcaatgcctggctcgaagagcgaccggtcctggtcttcgacgaatgggccgcagaccaggacccggctttccgcagggtcttctacaccgaactgttgccggacctgaaacgccagggcaagaccatcatcgtgatcagccacgatgatcgctatttcgaaatggcggaccagttgataaggctctcggcaggcaaggtcgtcaaggaaaccgagacggcgtga

SEQ ID NO: 34770 - protein, 548 aa, Pseudomonas aeruginosa
MTNPKRGAIRELLALLRPFRAIVAVSIALGMAGGLAITLLLASINNALHSENGLGQGVLLSFGGLCLLALVSSIVSDIGTSYVGQHIIANVRKELGEKVLSAPIEQIERYRTHRLIPVLTHDIDTISDFSFSFTPLAIALTITFGCLGYLAYLSVPMFLLTVVAIVIGTAAQYLARSRGFKGFYAARDLEDELQKHYTAIASGAKELRIHRPSLSHAHGRISETANNIRDLHISSINIFILAKTFGSMLFFVVIGLALTLQAYWPSSNPAAITGFVMVLLYMKGPLEQVVTILPIVSRAQVAFQRVAELSERFSSPEPHLLLSEQEAPDKTVDSLELRDVRYSPPAVEGSEPFHLGPINLRIAQGDIVFIVGENGCGKTTLIKLLLGLYRPQSGEILLNGEPVSAETRDDYRQLFSTIFADYYLFDDLVQGKQASLQNATQYLQRLEIAHKVSVMDGNFSTTDLSTGQRKRLALINAWLEERPVLVFDEWAADQDPAFRRVFYTELLPDLKRQGKTIIVISHDDRYFEMADQLIRLSAGKVVKETETA

SEQ ID NO: 34771 - DNA, 1815 bp, Streptomyces verticillus
  CDS (1)..(1815)
gtgacgcacccgcccgcgccgggggaggacgcgccggaggaggaagcgccgtcccgtcccgacgagcggtggcggaacgcccgcgtcctgtggcgcttcgtccgcccgcaccgccgcgcgctcctgctgggcctggtactcggactcggcaccaccatggcccagctcgccaccccgctggtcaccaagggcgtcctcgacggcctggatgcgcaagcgccggtcggcccggccatcgccctgctcgtggccctgctgctcgtcggcacgggctgcgccctcgccgagtggatcctgctgggcggtctggccgaacgcatcgtgctcgacgcccgcagcgccatggtccggcggctgctgcgggcccgggtgacggcactgtccggccgctccagcggcgagatcgtcacccgcgtcacctccgacaccctgctgctgcgcgaagccgccgcgacgtccgccgtcgacctcgtcaacgcggcggtgctgctcgtcggcgccctcgtcctgatgggcacgctcgactgggttctgctggccaccaccctcggcgccatcgcggtcatcggcgccgtggtcgccgtcctgatgccccccatggcggtcgcccagcgcgaggcccaggcggccgtgggccgcctgggcggcgtgctcgaagggacgctgcgggccatccgcacggtcaaggccgggcgggcggaggaccggcagtgcgccaagatcctggccgaagcgcgggaatcgacccgccagagcatccgggccgtccgcttcgaggccgtcgcctggaccgtggccaccggcggcatccacatcgccatcctggccgtcctcgccctgggcgcctggcgcgtgacggagggcgtactgccggtctccagcctcgtcgccttcctgctctacgccttccagatcctggacccggtgaccagcctcacccgtaccgtcagccagttccaggccggaacggcggccgccgcccgcatcggcgaagtgcagacgatggaagcggagccactgtccacaccccgggcaccggcgcctcgcggcgccatcggccaccacatcgtgaccttccggaacgtcacggcacgccaccgcccggacggccccccgaccctcagcgacatcaccttcggcatcccccgccgcggccacaccgccgtcgtcggcccctccggcgcgggcaagaccacccttttctccctgctgctgggcttcctccagccgcagcacggagaactcgccctcgacggaaggccgttcgcccaatggccgctggacgcgatccgcgcccgcatggcctacgtcgaacaggacgccccgctgctcccgggcaccctccgggagaacctgctctgccggcaccgggaagtcgacgacgacacactctggaccgtcctccgagccgtacggctggaggaccggacacgcgccctgcgcgacggactcgacaccgtcctgacggacacggccctgtccggcggcgaacgccagcgcatcgctctggcccgcgccctggtcggcgaccccgacctgctgctcctcgacgaggccaccgcccaactggacggcctcaccgaggtcgccgtacgcgacgtcgtccgccacacggccgcccggcgcgccgtcgtcaccatcgcccaccgcctctccaccgtcagcgacgccgaccggatcctcgtcctggaccggggccgcctccgggccctgggcacccacacccaactgctcggccgggacgcgctctaccgcgacctggtggcggccctgcgcatcactcccgccccggcgccgacggacgacgggccgtga

SEQ ID NO: 34772 - protein, 604 aa, Streptomyces verticillus
MTHPPAPGEDAPEEEAPSRPDERWRNARVLWRFVRPHRRALLLGLVLGLGTTMAQLATPLVTKGVLDGLDAQAPVGPAIALLVALLLVGTGCALAEWILLGGLAERIVLDARSAMVRRLLRARVTALSGRSSGEIVTRVTSDTLLLREAAATSAVDLVNAAVLLVGALVLMGTLDWVLLATTLGAIAVIGAVVAVLMPPMAVAQREAQAAVGRLGGVLEGTLRAIRTVKAGRAEDRQCAKILAEARESTRQSIRAVRFEAVAWTVATGGIHIAILAVLALGAWRVTEGVLPVSSLVAFLLYAFQILDPVTSLTRTVSQFQAGTAAAARIGEVQTMEAEPLSTPRAPAPRGAIGHHIVTFRNVTARHRPDGPPTLSDITFGIPRRGHTAVVGPSGAGKTTLFSLLLGFLQPQHGELALDGRPFAQWPLDAIRARMAYVEQDAPLLPGTLRENLLCRHREVDDDTLWTVLRAVRLEDRTRALRDGLDTVLTDTALSGGERQRIALARALVGDPDLLLLDEATAQLDGLTEVAVRDVVRHTAARRAVVTIAHRLSTVSDADRILVLDRGRLRALGTHTQLLGRDALYRDLVAALRITPAPAPTDDGP

SEQ ID NO: 34773 - DNA, 1776 bp, Streptomyces glaucescens
  CDS (1)..(1776)
atgagccggacccggctgcccgtcgccggcaccgccgaagtccgggcgcacggagcggcgctggcccgccgtcacgcccgcgacctcacctggatgctggccctgcacgggctggccgccgtctgcggcctgctcgggccctggctgatcggacgcctcctcgacgaggtcgtccggggcaccaccctcagcaccgtcgaccacatcgggatcgccctgctgctgtccctggtggcacaggccgtcctgacctactgggcggtgcagcgctcctgccggttcggcgagaaggtcaccgccgaggtccgcgaggacttcgtcgaccgcgtcgtccggctgcccctgccgaccgtggaggacgccgagcccggcgacctcatcacccgggcctcccgcgacaccgacgcgctcaccaacaccgtgcgctacggagtgcccgaaaccctgatcgcactgatgacctgcctgttcaccttcgcggcgctggtgctggtcggccccctcaccgcgctgcccagcctcgttgtcgtcccgctgctgtgggccggcacgcgctggtacctgcgccggtcgcaggccgcctaccggcgccgcggcgccagctacaccgcgctcggcgacaccctcgcggagacggttcccggcgcccgcacggtcgaggcgctgcggctccaggcatggcggcggcgcgccctcgaccgcgacctcgccgaggcctacgaagccgaacggcacacgatgtgctggcgcagctcctggtacctgacggtcgagctcagctacgtcgtccccgtcgtggcgaccctggcgatcggcgggctgctctacacccagggcctggccaccgtgggccaggccgtcgcggccacgctctacgtacggcagctgatcttcccgctggacgacgtgctgagctggatggacgaactccagatcggctccgcctcgctcgcccgggtgctcggcgtcagcgaactccccgacgaccgccgccccagcggcgcccgccccgacggccggcagctcaccgcccgctcggccggctactcgtacgtgccgggccgcgacatcctgcacggcgtcgacctggatctcgcccccggggagcggctggccgtggtcggcccgtccggttccgggaagtccaccctcggcaaactcctggccggcgtctacgaaccggtctccgggaccgtcgaactcggtggcgtgcgactggtcgacctcggcaccgaggaactcagacgccgtatcgcgctggtcacccaggaccaccacatcttccgcgggcacctgcgggagaacgtcacgctcgcccggcccgccgccgacgacgaggtcgagcacgcgctgaaggcggtcggtgccgcggagtgggcggcggccctgcccgacggaccggagacggtggtcggctccggaggccaccagctgaccgccgcccaggcgcagcagatcgcgctggcccggctggtcctcgccgacccgcacaccgtggtcctcgacgaggccaccgcgctggtggacccggccaccgcccggcacaccgagcgcgccctcgccgccgtactgagcgaccgcaccgtcatcgccatcgcgcaccggctgcacaccgcgcagagcgccgaccggatcgccgtgctggagaacggccggataaaggaactcggaagtcatcaggaactcctggccgcgaacgcgcctacgccgccctgtggcgcgtatggcacggcgattgaactcattgccgaaatcccgcgtccggtcctagcctga

SEQ ID NO: 34774 - protein, 591 aa, Streptomyces glaucescens
MSRTRLPVAGTAEVRAHGAALARRHARDLTWMLALHGLAAVCGLLGPWLIGRLLDEVVRGTTLSTVDHIGIALLLSLVAQAVLTYWAVQRSCRFGEKVTAEVREDFVDRVVRLPLPTVEDAEPGDLITRASRDTDALTNTVRYGVPETLIALMTCLFTFAALVLVGPLTALPSLVVVPLLWAGTRWYLRRSQAAYRRRGASYTALGDTLAETVPGARTVEALRLQAWRRRALDRDLAEAYEAERHTMCWRSSWYLTVELSYVVPVVATLAIGGLLYTQGLATVGQAVAATLYVRQLIFPLDDVLSWMDELQIGSASLARVLGVSELPDDRRPSGARPDGRQLTARSAGYSYVPGRDILHGVDLDLAPGERLAVVGPSGSGKSTLGKLLAGVYEPVSGTVELGGVRLVDLGTEELRRRIALVTQDHHIFRGHLRENVTLARPAADDEVEHALKAVGAAEWAAALPDGPETVVGSGGHQLTAAQAQQIALARLVLADPHTVVLDEATALVDPATARHTERALAAVLSDRTVIAIAHRLHTAQSADRIAVLENGRIKELGSHQELLAANAPTPPCGAYGTAIELIAEIPRPVLA

SEQ ID NO: 34775 - DNA, 1851 bp, Haloarcula marismortui ATCC 43049
  CDS (1)..(1851)
atgccacagtctgttccaacggtcccgtggatgacaactgaacagatgaccggcagaaactcagacaccatttcacggcaggagaaacttgatgcgcttctctatgcggcccgatatgccccaaaattcacggtgatgatcgtcgggctcggtctggtaacggccgtattagaaggcgttggactgacgtttatcattccaatcattgaactcatgcagtcatcagaaccggtgacacaggctgatggcatagcgggtattttctttaccgtttatcagacactcgggattccgttcacgatcgagtacgtcattggcggagtggcgttagcgacctgtctgcgctatacgtcgtcgtttctcctcacgtggctacgcgatgtactccagctttcctacgagcgacacatccgcgagaacctctttgacagcgctctggagacagagatggaatttctcgaccgaaaggggtcagacaacatcttgaacgcgatcgtcaccgagtcgaaagcagcctcgaaagtcatcaagcggttcgtgaaactattcgatctgctactactcactgttgcctatctcgctcttgcaacgtggatctcaccacaactcacagcatttgctatttttatcatcggtggtgtgggactcggtctgcggcatctcatcggctcaggatacgatctgggtgatcgcgttgcagcggcaaacgaacggatgcaacaagtggttcaggccggcatgattggcattcgagacattcgagttttcaatctcgaaacagaaatctatgacgagtatgaggaagccctagaagagtacacgcgttcgaaagtcgcgaaccgccggaatcgggcagcgatcaaaaagtcacagaatctcgtcgtctccgtactcatcttcgcacttatctacgtggccctgacattcaccaatctctcgttcggtgaactcggcctgttcttgtttctcatgtttcagctcggtcccaaagcaagcgggattaacaagcggttctacaaagtcgaagagaaccttccccatctggttcggacacagtcattcatgcgggatctcgaagagtgggaagaaccggacaccggagagcaaccgaccccgaaagaggtcgaaacagtcgagttcgacgatgtcacgttctcatatacggacgacgaggtcgttcttcgggaggtcgatttcgaactcaagaaaggcgagttcgtcgccttcgttggacagtccggtgccgggaagtcgacaatagtctccctgttggctcgctactatgagccagacagcggtcagatacgtgcaaatgggaacccaatcggccaaatggatatcagcgagtggcgtgaccgaatctcaatagtccgccagaacccatatatgttcaacgacacgcttcgacataacctcaccgtcggcaatcgggatgcgacggacgctgagatcaaacgggcttgcgaaatcgcgaaggtggaccagttcatcacggacctcccgaacggacttgattctcaactcggtgacgacggtgtccgcttgtcgggtgggcagaaacagcgcgtcgctcttgcgcgagcgattctgaaagacgcggacctgttaattctagacgaagcaacgagcgacctagattcgaaccttgagaaggaagtgcaggcggcaatcgaagcgatggagcgagattatgcgattatcgctatcgctcatcgcctttcgactgtcgagaatgctgatcgcatctatacgatggaagacgggtggatttccgagtgtggcggtcacgacgaactggttgaaagtgaagggaaatacgctgaattgtatgcgatacagtcaggtgggtaa

SEQ ID NO: 34776 - protein, 616 aa, Haloarcula marismortui ATCC 43049
MPQSVPTVPWMTTEQMTGRNSDTISRQEKLDALLYAARYAPKFTVMIVGLGLVTAVLEGVGLTFIIPIIELMQSSEPVTQADGIAGIFFTVYQTLGIPFTIEYVIGGVALATCLRYTSSFLLTWLRDVLQLSYERHIRENLFDSALETEMEFLDRKGSDNILNAIVTESKAASKVIKRFVKLFDLLLLTVAYLALATWISPQLTAFAIFIIGGVGLGLRHLIGSGYDLGDRVAAANERMQQVVQAGMIGIRDIRVFNLETEIYDEYEEALEEYTRSKVANRRNRAAIKKSQNLVVSVLIFALIYVALTFTNLSFGELGLFLFLMFQLGPKASGINKRFYKVEENLPHLVRTQSFMRDLEEWEEPDTGEQPTPKEVETVEFDDVTFSYTDDEVVLREVDFELKKGEFVAFVGQSGAGKSTIVSLLARYYEPDSGQIRANGNPIGQMDISEWRDRISIVRQNPYMFNDTLRHNLTVGNRDATDAEIKRACEIAKVDQFITDLPNGLDSQLGDDGVRLSGGQKQRVALARAILKDADLLILDEATSDLDSNLEKEVQAAIEAMERDYAIIAIAHRLSTVENADRIYTMEDGWISECGGHDELVESEGKYAELYAIQSGG

SEQ ID NO: 34777 - DNA, 1752 bp, uncultured bacterium 582
  CDS (1)..(1752)
atgagtgatagtccgcaacagggtctcttccgatggctgtggcacgcctatatggcccgccacatatgggttatcttacttgcaatgctgtttatgaccatcgagggcagcatgctgggtgcgatgagctatatcatgaagccgatgtttgatcaggtgtttgtcggtggcgacgccgatgccgcactttttgtcggactgttgattttgggtatattcattctgcgcgcctcggccagcattgcgcaaaaagtcctgcttgcgaggctttcagaagttacggccgcccatatccgcacagatatgattggccacttaatgcgcttggacggggattttcacgccacccatccaccaggattggtaatgcagcgcatcgagggcgatgtcgggtctatcaatcaggtctgggcgacgatcatcaccggggccggacgcgactttgtcgccgtcattgccctgatggcagtggctgtttccgtcgattggcgctggacactcatagcctgtattgccacaccatttctgattttaccgtcgatcctggtgcagcactttgtgcgcagtaatgcccgcttggtgcgcgatatctcagcggacctctcgacgcgcttgaacgagattttccacggcatcaatccgatcaaactcaacaccctcgaagactatcaggtaaaccggtatcgggcgttggccaaaaaacgaattaattttcaaaccaaagcggtgctaggccaaggcgggatgtcgggcattatggatgtgatgtcgggcatcggatttctggccgtggtcgtctatggagccaacgagattatttcaggccaaaaaagcgttggcgacttcatgagttttttcacagcaatcggactggcgtttgagccattgcggcgcctcggcacgctcagtgccacgttgcaaatcgctgccgcagggatcgagcgcgtcaaaggtctgctagatttcaaaccaagccttctgtctccggagacccccgatacggccccgtctggggcgccagtgattgcgcttgaaaatgtatcgctaagctatgccgggacagaagttttaaaaaatgtctcttttacggccgaggctggaaaaaccacagcattggtgggcgcgtcaggcgctggaaaatcaacaatatttaacttgctaacccgcttggtggacccccagatcggcaagatcaccctgtcgggcgtgtcagttgacagtctgcgtctggaagatttgcgacagctttattctgtggttgcccaagatgcgctgctgttcgatgaaagcctgcgcgaaaacatcctgctcggtcagaccgatattgcgcccgaaacactgcaagtggtactggatgcggcgcatatcagcgatttcttgccacggctgaccaaggggcttgaaacacctgttggtccccgggggtctttgttgtcaggggggcaacgacaacgcgtcgccatcgcgcgggctctgctgaggaatacgccgattctgttgcttgacgaagccacgtcggcgctggatgcacaatctgaaaatatggtacaagcggcgcttgacaaattgagcaaaggtcgcacgacgctggtaatcgcccaccgtctcgccacaatccgcaatgctgataagattattgtcatggcccatggcaaagtcgtcgaaatcgggacccacgaggcattgatggcccgcaacggcgcctatgcggaactttacaacctacaactcaacgaggccaaaactgcctag

SEQ ID NO: 34778 - protein, 583 aa, uncultured bacterium 582
MSDSPQQGLFRWLWHAYMARHIWVILLAMLFMTIEGSMLGAMSYIMKPMFDQVFVGGDADAALFVGLLILGIFILRASASIAQKVLLARLSEVTAAHIRTDMIGHLMRLDGDFHATHPPGLVMQRIEGDVGSINQVWATIITGAGRDFVAVIALMAVAVSVDWRWTLIACIATPFLILPSILVQHFVRSNARLVRDISADLSTRLNEIFHGINPIKLNTLEDYQVNRYRALAKKRINFQTKAVLGQGGMSGIMDVMSGIGFLAVVVYGANEIISGQKSVGDFMSFFTAIGLAFEPLRRLGTLSATLQIAAAGIERVKGLLDFKPSLLSPETPDTAPSGAPVIALENVSLSYAGTEVLKNVSFTAEAGKTTALVGASGAGKSTIFNLLTRLVDPQIGKITLSGVSVDSLRLEDLRQLYSVVAQDALLFDESLRENILLGQTDIAPETLQVVLDAAHISDFLPRLTKGLETPVGPRGSLLSGGQRQRVAIARALLRNTPILLLDEATSALDAQSENMVQAALDKLSKGRTTLVIAHRLATIRNADKIIVMAHGKVVEIGTHEALMARNGAYAELYNLQLNEAKTA

SEQ ID NO: 34779 - DNA, 1824 bp, uncultured bacterium 580
  CDS (1)..(1824)
atgtttcaatggtttgaaaatttaattaaccccttccctaaggacctaatagagacacctccaaaatccttattaaaatttgcgtggttatgcattaaagatattaaaatttatgttgccttgatggccattttaactgccgttatagcaagttttgaggctattctttatgctattttaggtaaattaattgatctcatggtgacaagtggacccagtgatttttttaataatcacatgtcttttctttttttggttgggacaatcataataagtagcaccctttttgttgcgctaaggactatggtaaagcatcaaacgctagcgggcacctttcctatgaggttgagatggaattttcatcgactgctcttaaatcaaagtattaatttttacaataatgagttttctggaagaatttctgccaaagtcatgcagacgacaattgctttgcgggacatgtggtttatattatccgatattttagtttttgtaattgtttacattgctaccatgattatcttggttggtagcttaaataccctgttatatgcgccatttctaatttggttgactgcttacgttatcagtcttttttattttattccaaaacttgcaaagctctcaaaaaatcaagcggatgctcgatctatgatgactggaagaataacagatgcttatactaatataagtaccgttaaacttttctctcatgcaggtcgtgagtcaagttacgcaaaagattcaatgaaggatttccttcataccgtcacaatgcaaatgcgtaagataacagctattcagattatcaatcattttctgagtatgtttttgattttagcaacgactgggactgccatttatttatggtccaacaatgaaatagctattggtgttgtggctgctgcctctgccatgtcgctgagattaaatggcatatcacattgggtgatgtgggaaatgacatcgctttatgaacaaataggcattggtcaggacgggcttaatatgctttcaaaaaaacaaatagtgaatgacaaactcaatgccacgactattgatattaagaaggcatctatttcattcaagaatgtttatttttcatataacgagaatgatagttttttttctgagtttaatttggatattaaaaaaggtgaaagagtcggtatcgtgggtagatcaggagctggaaaatcatccttagtaaacctgttacttagattctatgaattagactcaggcgcaattttaataaacaataaaaatattacttcaatgactcaagatagcttgagatctaatatcgcaatggtgactcaagatacatccttacttcatcgatctattgaagataacattgcctacagcaaaccaagctcatcagataaagagattgttatggcggctaaaaaggcacaggcacatgaattcattatgagcctaaaggatcaatatggaaatattggttataaatcattagtcggggaaagaggagtcaagctttcaggtggtcagaagcaaagaatagccattgcaagagtaatccttaagaacgcgcctatactcttgcttgatgaagcaacaagtgcattggattcaggagtggaagcaattattcaagaaagtttagatattctgatgcagggcaagactgttattgccatagcgcatcggttatcaactattgcggctatggatcgactgatcgtaatggataatgggaaaataattgaggatggaaatcataaggcactcttgaagaaaaaaggtctttaccacgatttatggcagcaccaaagcggaggtttcattggtgattaa

SEQ ID NO: 34780 - protein, 607 aa, uncultured bacterium 580
MFQWFENLINPFPKDLIETPPKSLLKFAWLCIKDIKIYVALMAILTAVIASFEAILYAILGKLIDLMVTSGPSDFFNNHMSFLFLVGTIIISSTLFVALRTMVKHQTLAGTFPMRLRWNFHRLLLNQSINFYNNEFSGRISAKVMQTTIALRDMWFILSDILVFVIVYIATMIILVGSLNTLLYAPFLIWLTAYVISLFYFIPKLAKLSKNQADARSMMTGRITDAYTNISTVKLFSHAGRESSYAKDSMKDFLHTVTMQMRKITAIQIINHFLSMFLILATTGTAIYLWSNNEIAIGVVAAASAMSLRLNGISHWVMWEMTSLYEQIGIGQDGLNMLSKKQIVNDKLNATTIDIKKASISFKNVYFSYNENDSFFSEFNLDIKKGERVGIVGRSGAGKSSLVNLLLRFYELDSGAILINNKNITSMTQDSLRSNIAMVTQDTSLLHRSIEDNIAYSKPSSSDKEIVMAAKKAQAHEFIMSLKDQYGNIGYKSLVGERGVKLSGGQKQRIAIARVILKNAPILLLDEATSALDSGVEAIIQESLDILMQGKTVIAIAHRLSTIAAMDRLIVMDNGKIIEDGNHKALLKKKGLYHDLWQHQSGGFIGD

SEQ ID NO: 34781 - DNA, 2172 bp, Lactobacillus sakei
  CDS (1)..(2172)
atgagaaaaataaaattggttaagcaacatgatgaaaaagattgtggtgttgcctgtctttctatgatcctaaatttttatgatacgagcgttcctatcagtaaattacgtttaatgtcagggacaaacagccagggtacctcagcctttggattagttcaagcattaaatgatttccaatttcaaacgcaggtttttcaaactgatgaatcaatttggaaggaagaagaagtgacctatccattgattgcccatgtaatcattgatggagctttcttccattatgttgtcgtttatggaatgaaaaatgggaagttgcttctggctgatccagctaaaggaaaaattgaacgaacgccaaaagagtttgcttctatatggacaggaatcttattaactactgctcctactgaaaattatcatcccacacaagataaatccaatggtttattctcttttgtgccgttattggcaagtcataagaagacaatcgctggtattgtatttctttcttttatattaactgggtttggcatcataggttcttattattttcaagtgataattgatcgaattgttccctcaagatctgtgaacttattagaaataatctcaattggtcttttatcaatgtatgtgatacaaacactattccaatattttaaacagtatcttttaattaggttaggacaacagctgagttcttcgattatgctgaggtatttcaagcatgttttgaatttaccaatgaacttcttttcaacaagaaaatcaggggagattgtctcaagatttttagatgccaataaaattatcgatgccttggcgaatgccacactatccttatttttagatgtgtcaatggttatatttattggaacttctttgtttttacaaaatcgtcttttgtttttaattagtttcagtacacttccaatttacggcttaatcgtctttctatttatgaaaccatttgatcgaacaaatgaagagcaaatggaatctagtgctgtagtcaattctcagattattgaaagtttgaaagggatagagacaataaagtcctttaatgcgacagatcaagtatttgagaaagttcagagtcaattcaaagagatgatggataagtcattcaaaaatgcgaatcttgataacctgcaatcgaacctaaaaacggcacttcaagtattaggttctactacgttattgtgggtaggtacgtacttagtaatcgaagggagcttgtctattggacaattgattacttataatgccctgatgtctttcttcacaacacctttgcaaaatatcattaatcttcaggtaaagattcaaacggctaaagtagctaacgatcgactaaatgaagttttctttctggatcgagaattgatgggcgaaccaaccagtcaacaaatggataatgttgaattgtttacgaaaaagccattaatcgaagtaaagcacttatcctttgcatatggattcgacgaaaacgttctaaatgatctttccttttcaattaaatcaaatcagaaagtagcaatcgttggaatgagtggatcaggaaaatcgactttagctaaattgttcgtgaacttctatactgctcaaaaaggtgaaatagaaattcaaggaaaatctattcaagatattccaagaattgatttgagaaataagattgggtatgtatcacaagaaaccttcttttttagtggcagcatctttgaaaacttaatttttggtatagactatcaacccacggaggaacagattctttgggcatgtgaaatggctcagataaaagaatacattgaaggactgccccttcaattcaagtctcctattgaagaaggtgccagcaatctttcaggtggtcagaaacagcgtttagctctggcgagagcgttgttaaagaactcagaaattctcatcctcgatgaaataactagcggtttagatactcgatcagagcatcaaataattcaaaatttgatgaacttagagaataaaacaattctgttcatcgcccatcacttatccattgcaaaagattgtgatcaggtatttgtcttagataaagggcagcttgtcgaatctggaactcatacccaattaagagcactacatgggacctatgaagaactttgggaaatgatggcaatcgcttaa

SEQ ID NO: 34782 - protein, 723 aa, Lactobacillus sakei
MRKIKLVKQHDEKDCGVACLSMILNFYDTSVPISKLRLMSGTNSQGTSAFGLVQALNDFQFQTQVFQTDESIWKEEEVTYPLIAHVIIDGAFFHYVVVYGMKNGKLLLADPAKGKIERTPKEFASIWTGILLTTAPTENYHPTQDKSNGLFSFVPLLASHKKTIAGIVFLSFILTGFGIIGSYYFQVIIDRIVPSRSVNLLEIISIGLLSMYVIQTLFQYFKQYLLIRLGQQLSSSIMLRYFKHVLNLPMNFFSTRKSGEIVSRFLDANKIIDALANATLSLFLDVSMVIFIGTSLFLQNRLLFLISFSTLPIYGLIVFLFMKPFDRTNEEQMESSAVVNSQIIESLKGIETIKSFNATDQVFEKVQSQFKEMMDKSFKNANLDNLQSNLKTALQVLGSTTLLWVGTYLVIEGSLSIGQLITYNALMSFFTTPLQNIINLQVKIQTAKVANDRLNEVFFLDRELMGEPTSQQMDNVELFTKKPLIEVKHLSFAYGFDENVLNDLSFSIKSNQKVAIVGMSGSGKSTLAKLFVNFYTAQKGEIEIQGKSIQDIPRIDLRNKIGYVSQETFFFSGSIFENLIFGIDYQPTEEQILWACEMAQIKEYIEGLPLQFKSPIEEGASNLSGGQKQRLALARALLKNSEILILDEITSGLDTRSEHQIIQNLMNLENKTILFIAHHLSIAKDCDQVFVLDKGQLVESGTHTQLRALHGTYEELWEMMAIA

SEQ ID NO: 34783 - DNA, 1767 bp, Pseudomonas aeruginosa
  CDS (1)..(1767)
atgccagccattctctcctcccgccaacgtatcgccctgcgcctggcctggcgcttcatggcgccttaccgctggcgcatgctcggggccctggtggcgttgctgttcaccgcggcgatcaccctgtccctgggccagggcatccgcctgctggtggaccaggggttcctcaccgcctcgcccgaattgctcaatcgctacatcctgctgttcttcgtgctggtgctcggcctggccgtgggcaccttcgtgcgcttctacctggtgtcctggatcggcgagcgcttcgtcgccgatatccgcaagcgcgtgttcgaccacctgatcgagttgcatcccggtttctacgaaaccaaccgtagctccgagatccagtcgcgcctgaccgccgacactacgctgctgcagacggtgatcggttcctcgctgtcgatggccctgcgcaatgccctgatgctggtcggcggggtgctgctgatgttcgtcaccaacgccaagctgaccagcatcgtggtgctggcgttgccgctggtgatcgccccgatcctgctgttcggccgccgcgtgcgcagcctgtcgcgggaaagccaggaccgggtggccgacgtcggcagctacgtcggcgaaaccctcggccagatcaagaccgtgcaggcctacaaccaccaggcgcaggatcgccagcgcttcgccggcaccgtcgaacgcgccttcgacaccgcgcgcaagcgcatcgcccagcgcgcctggctgatcaccgtggtgatcgtgctggtgctcggcgcagtcggcatcatgctctgggtcggcggccgcgacgtgatcgccggcagcatctcggccggcgaactggccgcgttcgtcttctacagcctgatcgtcggcatggccttcggcaccctcagcgaggtgatcggcgaattgcagcgcgccgccggcgccgcagagcgcatcgccgagctgctcagggcgcgcagcgagatccgcccgccagcgcaaccacgcaagctggcggcacgggtgagcgggaggatcgaattgcaggcggtgcgcttcgcctatccgacccgtcccgaacactgggccatcgacgacatcagcctggccgtcgaactgggggaaaccctggccctggtcggaccttccggcgccggcaagtcgaccctgttcgatctgctcctgcgtttcttcgatccgcagcagggacggctgctgctggacgggcagccgatcgtcgaactggacccggccgacttgcgccgcagctttgccctagtgtcgcagaaccccgcgctgttctttggcagcgtcgaggaaaacatccgctacggccgtccgcatgccagcgccgccgaggtcgaggccgcagcgcgtgccgcgcatgcccacgagttcatcctgggtctgccgcagggctacgccacccacctgggcgagggcggcatcggcctgtccggcggccagcgccagcgcctggcgatcgcccgggcgttgctggtagacgcgccggtgctgctgctcgacgaggcgaccagcgccctggatgcggaaagcgagcacctgatccagcaggccctgccaggcctgatgagcggacgtaccaccctgatgatcgcccatcgcctggccacggtacagagcgccgaccgcatcgcggtgatcgaccaggggcggctggtggccattggtagccatgcccggctgatcgccgagaacccgctctatgcgcgcctggcggaactgcagttcgctgccggcggacgctag

SEQ ID NO: 34784 - protein, 588 aa, Pseudomonas aeruginosa
MPAILSSRQRIALRLAWRFMAPYRWRMLGALVALLFTAAITLSLGQGIRLLVDQGFLTASPELLNRYILLFFVLVLGLAVGTFVRFYLVSWIGERFVADIRKRVFDHLIELHPGFYETNRSSEIQSRLTADTTLLQTVIGSSLSMALRNALMLVGGVLLMFVTNAKLTSIVVLALPLVIAPILLFGRRVRSLSRESQDRVADVGSYVGETLGQIKTVQAYNHQAQDRQRFAGTVERAFDTARKRIAQRAWLITVVIVLVLGAVGIMLWVGGRDVIAGSISAGELAAFVFYSLIVGMAFGTLSEVIGELQRAAGAAERIAELLRARSEIRPPAQPRKLAARVSGRIELQAVRFAYPTRPEHWAIDDISLAVELGETLALVGPSGAGKSTLFDLLLRFFDPQQGRLLLDGQPIVELDPADLRRSFALVSQNPALFFGSVEENIRYGRPHASAAEVEAAARAAHAHEFILGLPQGYATHLGEGGIGLSGGQRQRLAIARALLVDAPVLLLDEATSALDAESEHLIQQALPGLMSGRTTLMIAHRLATVQSADRIAVIDQGRLVAIGSHARLIAENPLYARLAELQFAAGGR

SEQ ID NO: 34785 - DNA, 1695 bp, Campylobacter jejuni
  CDS (1)..(1695)
gtgctaaaaaaacttttttttattttaagcaaggaagataaaaattttttatttttcttgcttgttttttcagtatttgtttcttttatagaaacttttgcaatttctttggtaatgccttttatcactttggctagtgatttttcttattttgatcgtaataaatatttaatcagcctaaaagaatatcttaatatccctgtttttgaaattattgtttattttggagtggggcttattgttttttatgtatttagagctttgttaaatgcgtattattttcatcttttggcaagattttctaaagggcgttatcatgcgatcgcttataaggttttttctaaatttttaaatattaattatgaaaaatttactcaaaaaaatcaatctgaaattttaaagtccattacaggggaagtttataatctaagcactatgatttcatcatttttacttttgatgagtgaaatttttgtagtacttttgctttatgctttaatgcttttgattaattataaaatcactttgtttttaagtattttcatggtgttaaatgcctttattttagtgaaaattttaagccctatcattaaaaaagcaggactaagacgcgaagaagcgatgaaaaatttctttgaaattttaaatacaaatttaaacaatttcaaatttatcaagcttaaaaccaaagaagatggagtattaagcctttttaaagcacaaagtgaagctttttctaaagcaaatattaccaatgaaagcgtagctgcggtgcctagaatttatcttgaaggaataggtttttgtgtgcttgtttttatcgtggtatttttggttttgaaaaatgaaagtgatatttcaggtattttatccacgatttctatttttgttttagcactttatcgcttaatgccaagtgcaaatcgtattatcacaagttatcatgatttgctttattatcattcttctttggatattatttatcaaaatttaagacaagaagaagaaaatttgggcgaggaaaaattaagctttaatcaagagcttaaaatttgcaatcttagctttggttatgagggaaaaaaacatttatttaaaaatcttaacttaaacattaaaaaaggcgaaaaaatcgcttttataggggagagtggttgtggaaaaagcaccttagtagatcttatcataggacttttaaaaccaaaagaagggcaaattttaattgataagcaagaattaaatgcaagtaatgcaaaaaattatcgccaaaaaataggctatatcccacaaaatatctatctttttaatgacagcatagctaaaaatatcacttttggagatgcggttgatgaagaaaaacttagtaaggttatcaaacaagcaaatttagagcattttataaaaaatttacctcaaggagtgcaaacaaaagtaggtgatggggggagtaatttaagcgggggacaaaaacaacgcatagctatagcaagagctttatatctagagcctgaaattttagtgcttgatgaagcaacttctgcgcttgatactcaaagtgaagcaaaaatcatggatgaaatttataaaatttctaaagataaaaccatgattattatcgcacatcgcctttctacgataacgcaatgtgataaggtttatcgtttagaacacggtaagcttaaggaggagaaatga

SEQ ID NO: 34786 - protein, 564 aa, Campylobacter jejuni
MLKKLFFILSKEDKNFLFFLLVFSVFVSFIETFAISLVMPFITLASDFSYFDRNKYLISLKEYLNIPVFEIIVYFGVGLIVFYVFRALLNAYYFHLLARFSKGRYHAIAYKVFSKFLNINYEKFTQKNQSEILKSITGEVYNLSTMISSFLLLMSEIFVVLLLYALMLLINYKITLFLSIFMVLNAFILVKILSPIIKKAGLRREEAMKNFFEILNTNLNNFKFIKLKTKEDGVLSLFKAQSEAFSKANITNESVAAVPRIYLEGIGFCVLVFIVVFLVLKNESDISGILSTISIFVLALYRLMPSANRIITSYHDLLYYHSSLDIIYQNLRQEEENLGEEKLSFNQELKICNLSFGYEGKKHLFKNLNLNIKKGEKIAFIGESGCGKSTLVDLIIGLLKPKEGQILIDKQELNASNAKNYRQKIGYIPQNIYLFNDSIAKNITFGDAVDEEKLSKVIKQANLEHFIKNLPQGVQTKVGDGGSNLSGGQKQRIAIARALYLEPEILVLDEATSALDTQSEAKIMDEIYKISKDKTMIIIAHRLSTITQCDKVYRLEHGKLKEEK

SEQ ID NO: 34787 - DNA, 1653 bp, Pseudomonas aeruginosa
  CDS (1)..(1653)
atgtccgcaacaccccgtagcgccactcgcgaactcctgagcattctcaaacccttctggccagcgctcagcctgtcgatcggactgggtatcgtcggcggcctggccatcaccgcgctgctcacctcgatcaaccgcgtactgaacgccgagggcggcatgaccagcggcatgatgctggctttcagcgcgatctgcgcgctggccctgctcagttcgatcctgtccaacatcggcaccaactacgtcggccagaaggtcatcgcccggctgcgcaagaccctcggcggccgggtgttgtccgccccgatcgaacaactcgaacgctatcgcacgcaccgcctgatcccggtgctcacccacgacatcgatacggtcagcgatcttgccttcggcctgccgcaactggtgatctccctgaccgtgacccttggctgcctgggctacctggccaccctgtcgctgccgatgttcctggtcgccgccagcgccgtggtgctcggcaccatcgcccagtacatcgcccgcggctatggaatggccggtttcgaagcggcgcgcgaagaggaagacttgctgcagaagcactaccgcggcatggccgagggagccaaggagctgcgcatcaaccgcccgcgccggcagcgcctgcacgggcgtctgctggacgagaccgtggagcgcatctgccgcctgcaggtgcgttcggtgaatatattcctcactgccagcaccttcggttcgctgctgttcttcgtggtcatcggcaccgccctggcggtccagacctggtggccgacctccgaccgcagcgtgctcagcggcttcgtcatgaccctgctgttcatgaaggggccgctggaaagcgtactcagcctgttgccgctgatcagtcgcaaccgtatcgccctgcgccggatcgccgaactcaacgagcagttctccaatcccgaaccctacctgctgctcgagaacgacgcctccagaccggctcaagaggtgcgcagcatcgagttgcgcgatgtcggctacagctatccgggcgtgccgggctcgacgcccttccgcttcggcccggtcaacctgacgatccgcccgggagagatcctcttcatcgtcggcgagaacggctgcggcaagaccaccctgatcaagctgttgctcgggctgtacacgccccacgagggctcgctgctgctcaacggagaggaagtgacggcacaggcgcgcgacgactatcgtcagctgttcaccaccgtgttcgccgactactacctgttcgacgacctcgtcgacggcgagcaacacttgccggaagaagccgggcgctacctgaagcgcctggaaatcgcccacaaggtcagcgtcagcgacggcagcttcaccaccaccgacctctccaccggccagcgcaagcgcctggcgctggtcaatgcctggatcgagaagcgcccggtgctggtcttcgacgaatgggccgccgaccaggatcccaccttccgccggatcttttataccgagctgcttcccgagctgaagcgaatgggcaagaccatcatcgtgatctcccatgacgaccgctacttcgacagcgccgaccaactgctgcgtctggccggcggtcgagtggtcgaggagctgcaaccggcctga

SEQ ID NO: 34788 - protein, 550 aa, Pseudomonas aeruginosa
MSATPRSATRELLSILKPFWPALSLSIGLGIVGGLAITALLTSINRVLNAEGGMTSGMMLAFSAICALALLSSILSNIGTNYVGQKVIARLRKTLGGRVLSAPIEQLERYRTHRLIPVLTHDIDTVSDLAFGLPQLVISLTVTLGCLGYLATLSLPMFLVAASAVVLGTIAQYIARGYGMAGFEAAREEEDLLQKHYRGMAEGAKELRINRPRRQRLHGRLLDETVERICRLQVRSVNIFLTASTFGSLLFFVVIGTALAVQTWWPTSDRSVLSGFVMTLLFMKGPLESVLSLLPLISRNRIALRRIAELNEQFSNPEPYLLLENDASRPAQEVRSIELRDVGYSYPGVPGSTPFRFGPVNLTIRPGEILFIVGENGCGKTTLIKLLLGLYTPHEGSLLLNGEEVTAQARDDYRQLFTTVFADYYLFDDLVDGEQHLPEEAGRYLKRLEIAHKVSVSDGSFTTTDLSTGQRKRLALVNAWIEKRPVLVFDEWAADQDPTFRRIFYTELLPELKRMGKTIIVISHDDRYFDSADQLLRLAGGRVVEELQPA

SEQ ID NO: 34789 - DNA, 2094 bp, Dictyostelium discoideum
  CDS (1)..(2094)
atgtattcgattaatagaattggtatacatggtatatcaaataaaatactaagtaggccaaaattttttcattcaagttcatcaatattctccctaaaccaaaatttaaataattttaaaaataataataattatattttaaatggttacaataaaataacacataatcatcatcatcaaacattatttcatagacattattcaaatttaaagcaagagcaagaaaataaacaacaaaatgtagggaaaaatagcgaaacatcaccttcatcaacaacaacaacagaaaatataacaacagcaacaacagcaacaacaaaaacagatattaaagaaactcaaaattctacaatgtcaatgttaaaaacagtatttaaatatttatggccaaaagataataatgattcaaagattagaattataacatcagtattattattattaagtgccaaagtgttaacggttcaaataccatttatatttaaagatatagttgatagtttaacgactacacaatcagagatgttaacattaccattaggattattattagcatatggtgcagtgaagataacatcaaatggttttcaagaacttagacaaaccattttctcaaaggtagcacatgatgcaattcgtgatgtttcatgtagtacctttaagagattacatcaattggatttaacatttcatttatcacgtcaaaccggttcactatcacgtatcattgatagaggtggtcgtggtatcaatttcctcttaaattcaatactatttcatgtggtaccaactgcatttgaaatttcattggtaagctatgtaatgtatacaacattgggttgggagtactctgcattgtcattggcaaccattgctgcctataccgtattcaccgtgaaagtaaccaaatggagaactcaatttcgtgtgaaaatgaataaaatggataatgaagcaagcaataaaatgatggattctctcatcaatttcgaaactgtaaaatactttaacaacgatgctttggaagtggaacgttatcataactatttaaaagagtatgataaagcttccttaaagacaacaagtagtttatcatttctaaattttggtcaagctttaatcttttcactctcaatgaccgctatgatgattatggctgctcaaggtgtggttcaaggtaatctatccgttggtgatttggttttagtaaatggtttattatttcaaatctctttacctttaaattttttaggtacagtttatagagaaattaaacaatcattagttgatatggatcatttattctctttattaaatttaaatccaaaaatttctgataataaagattcaaaaccattaaaattagaaaatggtacaattgtttttagagatatttcatttaaatataatgattcagtacaagttttaaataatgtatcatttgaatgtgaaggtggtaaaagaattgcaattgttggatcatcaggttcaggtaaatcaactctattaagattattatatagattttatgacgtttcatctggttccattgaaatcgatggtcaagatattagaggtattcaattggaaagtttaagaaaacatattggtgttgtaccacaagatactgttctattcaatgataccatttactataacattgcctatggtaatccaaacgctacaaaagaacaagttgaaaatgctgctcgtgctgctcacattcatgaagttattttaaatatgaaaaatggttatgatacagttgtaggtgaacgtggtttaaaattatctggcggtgaaaaacaaagagtttcaattgctcgtgcaatcttaaaggattctccaatcgttttctatgatgaggctacctcttcattggatactgaaaaagagaaattaattatggacgctctaagagaattatttaaaggtcgtaccactattatgatagctcatcgtttaagtacaatcgtagatgctgatgaaatcatagttttaggtactggtggtattattttagaacgtggtaatcatcaacaattattagaattagaaggaaaatatagatcaatgtggttggcacaacaataa

SEQ ID NO: 34790 - protein, 697 aa, Dictyostelium discoideum
MYSINRIGIHGISNKILSRPKFFHSSSSIFSLNQNLNNFKNNNNYILNGYNKITHNHHHQTLFHRHYSNLKQEQENKQQNVGKNSETSPSSTTTTENITTATTATTKTDIKETQNSTMSMLKTVFKYLWPKDNNDSKIRIITSVLLLLSAKVLTVQIPFIFKDIVDSLTTTQSEMLTLPLGLLLAYGAVKITSNGFQELRQTIFSKVAHDAIRDVSCSTFKRLHQLDLTFHLSRQTGSLSRIIDRGGRGINFLLNSILFHVVPTAFEISLVSYVMYTTLGWEYSALSLATIAAYTVFTVKVTKWRTQFRVKMNKMDNEASNKMMDSLINFETVKYFNNDALEVERYHNYLKEYDKASLKTTSSLSFLNFGQALIFSLSMTAMMIMAAQGVVQGNLSVGDLVLVNGLLFQISLPLNFLGTVYREIKQSLVDMDHLFSLLNLNPKISDNKDSKPLKLENGTIVFRDISFKYNDSVQVLNNVSFECEGGKRIAIVGSSGSGKSTLLRLLYRFYDVSSGSIEIDGQDIRGIQLESLRKHIGVVPQDTVLFNDTIYYNIAYGNPNATKEQVENAARAAHIHEVILNMKNGYDTVVGERGLKLSGGEKQRVSIARAILKDSPIVFYDEATSSLDTEKEKLIMDALRELFKGRTTIMIAHRLSTIVDADEIIVLGTGGIILERGNHQQLLELEGKYRSMWLAQQ

SEQ ID NO: 34791 - DNA, 1860 bp, Vibrio cholerae non
  CDS (1)..(1860)
atgtttaagctatttgaaggtttcaccgacccttttcccaaaggtgaaccccaacgcccacccaacactttgtgggcattttgtcgccactacactcgcgggtttgaaaaaccattgatcgtgatggcgttactcagcacggcgatcgcgattatcgaggtctctctgtttggctttatgggccaactggtggactggctttccactagctcgccagacacatttttaaccgaaaaccagagcactttgattgggttaggcttattggtattggtcggtatgccgctactgatcgccttctattcactactgatccaccaatctttgctcggtaactacccgatgtcgatccgttggttggcgcaccgctatctgctcaagcaaagcgtgtcgttttatcaagacgagtttgcagggcgcatctcaaccaaagtgatgcaaacggcgctcgcggtacgtgaaaccgtgatgaaaagtctcgatgtgtttgtgtatgtgatggtttatttcaccgcgattgtagtgattttggcgcaggctgattggcgcttaatgatcccgatgctgatttggctggcgatttacgttacggtgcaaatgtattacgtgcctaagctgaaaaaagtcgcttccgagcaagccgatgcccgctcactgatgagcggccgtatcgtcgatagctacaccaatattatgactgtaaagctgttttctcacagtcaacgtgaaacgcaatacgccgaagaaggcatgcaagattttctgggcaccgtccatcgccaaatgcgtttggtgactggctttaatatttgggtagaaatggccaactacttattggtgtttaccattgctgccctatcgatttatctgtggaccaccagcgccatcagcgtcggtgccattgcggttgcggtcagtttatccttacgtatcaacggcatgtctaagtggatcatgtgggaagtcagcgccctgtttgaaaacatcggtaccgttgtggatggcatgaccatgcttggcaaaccgatcacagtgaaagataagcaggatgctaaacctttggaggttaagcatggcggcattacctttgacgatgtgagcttccactacggtgaaaacaaaggcgtgatcaaccatctcaatctcaacatcaaaccgggtgaaaaggtcggtttagtgggacgttcgggagccggtaaatcaaccttggtgaacctattactgcgttttcatgatgtagagagcggccggattttaattgatggtcaacccatttcagaggtgactcaagaatcgctgcgcagcaaaatcggcatggtgacacaagatacgtcactgctgcaccgctccattcgcgacaacattttgtacggcaatccgaacgccaccgaggagcagctgttgaaagcaacggcgcaagccaccgctcatgagttcatcctcggtttgaccgatccgcatggcaacagtggttacgatgcacaggtcggtgaacgtggcgtcaaactctctggtggacaacgtcagcggattgcgatctctcgcgtactgctgaaagatgcgccactgttggtgctggatgaagcaacttccgcgctcgattctgaagtggaagccgcgattcaagagagcctcaatgagctgatgcagggcaaaactgtgattgcaattgcccaccgtctgtcgaccatcgcagcgatggatcgcctgatcgtgctcgataaaggccaaattgttgagcaaggtactcaccaagagttgattgcgcaaaacggcatttatgctcacctgtgggcgcatcaaaccggtggttttatcggctgtgatgaagacgaagtagaagaagccatactggcataa

SEQ ID NO: 34792 - protein, 619 aa, Vibrio cholerae non
MFKLFEGFTDPFPKGEPQRPPNTLWAFCRHYTRGFEKPLIVMALLSTAIAIIEVSLFGFMGQLVDWLSTSSPDTFLTENQSTLIGLGLLVLVGMPLLIAFYSLLIHQSLLGNYPMSIRWLAHRYLLKQSVSFYQDEFAGRISTKVMQTALAVRETVMKSLDVFVYVMVYFTAIVVILAQADWRLMIPMLIWLAIYVTVQMYYVPKLKKVASEQADARSLMSGRIVDSYTNIMTVKLFSHSQRETQYAEEGMQDFLGTVHRQMRLVTGFNIWVEMANYLLVFTIAALSIYLWTTSAISVGAIAVAVSLSLRINGMSKWIMWEVSALFENIGTVVDGMTMLGKPITVKDKQDAKPLEVKHGGITFDDVSFHYGENKGVINHLNLNIKPGEKVGLVGRSGAGKSTLVNLLLRFHDVESGRILIDGQPISEVTQESLRSKIGMVTQDTSLLHRSIRDNILYGNPNATEEQLLKATAQATAHEFILGLTDPHGNSGYDAQVGERGVKLSGGQRQRIAISRVLLKDAPLLVLDEATSALDSEVEAAIQESLNELMQGKTVIAIAHRLSTIAAMDRLIVLDKGQIVEQGTHQELIAQNGIYAHLWAHQTGGFIGCDEDEVEEAILA

SEQ ID NO: 34793 - DNA, 1803 bp, Yersinia enterocolitica
  CDS (1)..(1803)
atgaaagacaataatcctgcggataacctggcctggcgcgtcatctggcgccagcttatctccagcgttggcagtcaggccaggatgctgcggcgcagtatgctggcgctgttgctggcggcattcatgcaggggatcgcctttgcctgtctttatccgatcattgatgcgctgttacggggagacgcgccgcaacttctcaactgggctgtggccttcagcgtcgccgcgattgtgacgctggcgctacgctggtatggcttgggctttgaataccgtggtcatctggcgcaggccacccatgagttgcgcctgcgacttggcgagcagttacgccgcgtgccgctggagaagatccagcgtggcagggcgggcgaaatgaacgccttgctgctgggctgcgtggatgaaaaccttaattatgttattgcgatagccaatattttgctgctcaccattgtcacgccgctgacggcgtcgctggcgacattgtggatagactggcggctggggctggtgatgttgctgatcttccctctgctggtgccgttttattactggcgccgcccggcgatgcggcgacaaatgcagacgctgggggaagcgcaccagcgtctgagcggcgatatcgttgaatttgctcaggggatgatggtattgcgcacctgcggcagcgatgccgataaaagccgggcgctgctggcgcatttcaatacgctggaaaacttacagacccgcactcaccgtcagggcgctggcgcgacgatgctgatcgccagcgtcgtggagttgggcctacaggtggtggtgttatccgggatcgtctgggtggtgacgggcactctgaacctcgcctttttgattgccgccgtcgcgatgattatgcgcttcgcagaaccgatggcgatgtttatcagctacacctcggttgtggaactgatcgccagcgccctgcaacggattgagcagtttatggcgatagcaccgcttcccgtcgcagcgcaaagcgagatgccggaacgttacgatatccgctttgacaacgtcagctatcgctacgaagaaggcgacggccacgcgcttaatcatgtttctttgacgttcccggcggccagtatgagcgcgctggtgggcgcctccggcgcaggcaaaaccacggtcactaaactgttaatgcgctatgccgatccgcagcaagggcagatttctattggcggcgtcgatattcgccgcctgacgccggaacagctcaatagcctgatttctgttgttttccaggatgtctggctgtttgatgacacgctgctggcgaatatccgtatcgcgcgcccacaggcgacgcgacaggaggtggaagaggcagcccgcgcggcgcagtgccttgagtttatttcccgtcttccgcaaggctggctgacgccaatgggggagatgggcggccagctatcgggcggcgagcgccagcggatttccattgccagagcgttattgaaaaacgcgccggtcgtcattctcgatgaaccgaccgccgcgctggatattgaaagcgagctggcggtgcaaaaagcgatcgataacctggtccacaaccggacggtgattatcatcgctcaccgtttatccaccatcgccggggccggaaacatcctggtgatggaagagggacaggtggttgagcagggtactcatgcgcaattgctctctcatcatggacgttatcaggcgctgtggcaggcgcaaatggccgcgcgcgtgtggcgcgacgacggggtttccgcgtctggagagtgggtgcatgagtga

SEQ ID NO: 34794 - protein, 600 aa, Yersinia enterocolitica
MKDNNPADNLAWRVIWRQLISSVGSQARMLRRSMLALLLAAFMQGIAFACLYPIIDALLRGDAPQLLNWAVAFSVAAIVTLALRWYGLGFEYRGHLAQATHELRLRLGEQLRRVPLEKIQRGRAGEMNALLLGCVDENLNYVIAIANILLLTIVTPLTASLATLWIDWRLGLVMLLIFPLLVPFYYWRRPAMRRQMQTLGEAHQRLSGDIVEFAQGMMVLRTCGSDADKSRALLAHFNTLENLQTRTHRQGAGATMLIASVVELGLQVVVLSGIVWVVTGTLNLAFLIAAVAMIMRFAEPMAMFISYTSVVELIASALQRIEQFMAIAPLPVAAQSEMPERYDIRFDNVSYRYEEGDGHALNHVSLTFPAASMSALVGASGAGKTTVTKLLMRYADPQQGQISIGGVDIRRLTPEQLNSLISVVFQDVWLFDDTLLANIRIARPQATRQEVEEAARAAQCLEFISRLPQGWLTPMGEMGGQLSGGERQRISIARALLKNAPVVILDEPTAALDIESELAVQKAIDNLVHNRTVIIIAHRLSTIAGAGNILVMEEGQVVEQGTHAQLLSHHGRYQALWQAQMAARVWRDDGVSASGEWVHE

SEQ ID NO: 34795 - DNA, 1767 bp, Proteus mirabilis
  CDS (1)..(1767)
atgaataaaacaatagatactttgccacttaactttcgtattttaataaaattagccccactccctctgattagtggcattattatggcaataatctcaacaatgctaagtttagcaccattatggatcatctataaaatcagccagatttgtttttcaacatcacctaatattcaacaaataaataatctagtttatatcactgtgattattttaattttacgttggggattaatggcaataagtcatattgccgcacatcggggtgctttttatattcagcatcaattacaactcgcaatagctaaaaaaatcagtaaagtaccattatcattttttgctcaatatggcagtggaaatctgcgacgtattatcaatgatgatataaaaagcttagaaggttttttcgcacatatgctacctgatctcgtctcagccatagtgactccctttatcgctattatattacttttttatgtaaattggcctcttgccttattatctctaaccccattacccattgcttttatggctcaacttctcatgttgcgtcgagccaataaacaaaccaatgagtggatgaatattcagaaaaaaattgctaatgaaataggagaatatattaaaggaatacgagaaataaaagcgtttaacttaacctcccatacttttggtaaattatctcaatctatcaattcctctgttaaatggataaaaaataatgtcaaagctagtacaggctcttggatggtatttagtgggatattaacagcgaatctcgttattatagcaccagtaggtgggtggatgtatttaaatcaaaatattgatttatctacttatattttatttttaatgacatcccccctcgtacttgcgccgttattacgactaacatttgtgctaggagaacaagctcaacgaaaacaaaccttaaaacatatcagtatgatccttgaactttcagagcataaacaacatgataaacattttactctccctaaaaatagcgatattacttttaaagatgtctgtttggatcatggtgataaaccgatattagagaaaattagttttaatgcccaagcgggtacaacaactgcaattgtaggccacagtggtgcaggaaaatcctcattattaaaactaattccccgtttttatgattgtacttctggccaaataaaaataggtcaatatgatatcaactactggccagaaattgatttactttctcaaataagtgttgtttttcaagatgtatatctatttcatggaactattttagaaaatttactcatagcaaatcctaatgccttatttgaggatattatcaaagcaactaaagcagccaatattcatcatgttattgaaaaactcccagcaggatataatacattaattggtgaacaaggaaataaactttcaggtggagagaaacagcgattatcaattgcaagagcactattaaaaaactctccaatcctacttctcgatgaaattactgccaatgttgatgctgaaaatgaaattttgatctatcgcgcattaaagagtctatgccagaatcggactgttattatgatcactcataacctacatactattattaacgcagataaaattattgtgcttgataatggaaagattattgatacaggtacacacacccatttattaaaccaatgcccaacctatcaaaaattatggaatgattatagtcacactattcattggcaattaatccaggagaataataatgattaa

SEQ ID NO: 34796 - protein, 588 aa, Proteus mirabilis
MNKTIDTLPLNFRILIKLAPLPLISGIIMAIISTMLSLAPLWIIYKISQICFSTSPNIQQINNLVYITVIILILRWGLMAISHIAAHRGAFYIQHQLQLAIAKKISKVPLSFFAQYGSGNLRRIINDDIKSLEGFFAHMLPDLVSAIVTPFIAIILLFYVNWPLALLSLTPLPIAFMAQLLMLRRANKQTNEWMNIQKKIANEIGEYIKGIREIKAFNLTSHTFGKLSQSINSSVKWIKNNVKASTGSWMVFSGILTANLVIIAPVGGWMYLNQNIDLSTYILFLMTSPLVLAPLLRLTFVLGEQAQRKQTLKHISMILELSEHKQHDKHFTLPKNSDITFKDVCLDHGDKPILEKISFNAQAGTTTAIVGHSGAGKSSLLKLIPRFYDCTSGQIKIGQYDINYWPEIDLLSQISVVFQDVYLFHGTILENLLIANPNALFEDIIKATKAANIHHVIEKLPAGYNTLIGEQGNKLSGGEKQRLSIARALLKNSPILLLDEITANVDAENEILIYRALKSLCQNRTVIMITHNLHTIINADKIIVLDNGKIIDTGTHTHLLNQCPTYQKLWNDYSHTIHWQLIQENNND

SEQ ID NO: 34797 - DNA, 1722 bp, Escherichia coli
  CDS (1)..(1722)
atgcgcgctttgctaccctatctggcactgtataaacgtcataaatggatgttaagtcttggtattgtgctggcaattgtgacgctgctcgccagtatcggtctgttgacactttccggctggttcctctcggcctcagcggttgcgggggttgccggactgtacagcttcaactatatgctacccgctgcgggcgtgcgtggcgcagcaatcacccgtactgccgggcgctattttgaacgtctggtaagtcacgacgcgactttccgcgtgttgcagcatctgcgcatttacaccttcagcaaattgctgcccctctcccctgccggactggcgcgctatcgtcagggcgaattgctcaatcgcgtggtggcggatgttgatacgctcgatcatctttacctgcgcgttatctcgccgctggtgggcgcttttgtggtgattatggtggtgacaatcgggttaagtttccttgatttcaccctcgcctttacgctgggcggcattatgttactgacgcttttcctgatgccaccgctgttttatcgtgcgggaaaaagcaccgggcaaaatctgactcatcttcgcggacagtatcgccaacaactgacggcctggctgcaagggcaagctgagctgaccatttttggtgccagcgatcgttatcgcacgcaactagagaatacagaaattcaatggctggaagcgcaacgccgtcaatctgaactgaccgcattgtcgcaagcgataatgctgctcattggcgcgttagcggtgatcctgatgctgtggatggcgtctggcggcgttggcggcaatgctcaacccggcgcgttaattgccctgtttgtcttctgcgcgttagccgcgtttgaagcactggcaccagtaacgggtgcatttcagcatctggggcaagtcattgcctctgccgtacgtatctctgacttaacggatcaaaaaccggaggtcacctttcctgatacccaaactcgtgttgccgatcgcgtttcgctgacgttacgggatgttcagttcacttatccggagcaatctcaacaggcacttaaagggatttctcttcaggtaaacgccggggaacatatagcgattctcgggcgaaccggatgcggcaaatcaacactgttacaacagctgacccgcgcatgggacccgcaacagggcgagattttgcttaacgatagccccatagccagcctgaatgaagcggctctacgacagaccatcagcgttgttcctcagcgagtgcatctgtttagcgccacgctgcgtgataatcttttactcgcctcgcctggcagtagtgatgaggctctgtcggagatcttgcgtcgcgttggcctggaaaagctgctcgaggatgcaggtctcaacagttggttaggtgaaggcggacgccagctctccggtggtgaactgcgccgtctggctatcgcccgtgcgctgttacatgatgcgccactggtgttgctggatgaacctaccgaaggcttagatgccacaaccgaaagccagatccttgaattgcttgcagaaatgatgcgtgagaaaacggtgttaatggtcacccatcgacttcgcggactctctcgtttccaacaaataatagtgatggacaacgggcaaattattgagcaaggtactcacgcagaactgcttgccagacaggggcgttattaccagttcaagcagggtttgtaa

SEQ ID NO: 34798 - protein, 573 aa, Escherichia coli
MRALLPYLALYKRHKWMLSLGIVLAIVTLLASIGLLTLSGWFLSASAVAGVAGLYSFNYMLPAAGVRGAAITRTAGRYFERLVSHDATFRVLQHLRIYTFSKLLPLSPAGLARYRQGELLNRVVADVDTLDHLYLRVISPLVGAFVVIMVVTIGLSFLDFTLAFTLGGIMLLTLFLMPPLFYRAGKSTGQNLTHLRGQYRQQLTAWLQGQAELTIFGASDRYRTQLENTEIQWLEAQRRQSELTALSQAIMLLIGALAVILMLWMASGGVGGNAQPGALIALFVFCALAAFEALAPVTGAFQHLGQVIASAVRISDLTDQKPEVTFPDTQTRVADRVSLTLRDVQFTYPEQSQQALKGISLQVNAGEHIAILGRTGCGKSTLLQQLTRAWDPQQGEILLNDSPIASLNEAALRQTISVVPQRVHLFSATLRDNLLLASPGSSDEALSEILRRVGLEKLLEDAGLNSWLGEGGRQLSGGELRRLAIARALLHDAPLVLLDEPTEGLDATTESQILELLAEMMREKTVLMVTHRLRGLSRFQQIIVMDNGQIIEQGTHAELLARQGRYYQFKQGL

SEQ ID NO: 34799 - DNA, 1728 bp, Bacillus subtilis
  CDS (1)..(1728)
atgaagaaagaagaatggattttgccgtatatcaagcaaaatgcccgcctgttcgttctggttatctttttgggtgcggtgacgattttttctgctgcttttctcatgttcacctcaggttttttgatttctaaagcggcgacaaggccggaaaacattctgctcatttatgtgccgattgtcgctgtgcgcacctttgggattgcgcgctctgtgtcgcgatatgtggaacggctcgtcggccatcacatcattttgaaaatcgtatctgacatgcgcgtccgcctttacaatatgcttgagccgggtgctttgatgctgcgttcccgttttcgcacgggggatatgctcggcattttgtctgaggatattgagcatttgcaggatgctttcttaaaaacgatttttcctgcgatctcagccttgctcctgtatgctgtgtcagtgatagcgctcggcttcttctcttggccgtttgccatattgcttgcgctgtatttgtttgttcttgttgtattgtttccggttgtgtctttgctcgtgacgagagcgaagaatgcgaagctgaaaagcggacggaatgtgctgtacagccgtctgacagatgctgtgatgggtgtcagcgactggatgttcagcggacgccggcatgcttttattgatgcttatgaaaaagaggaacgtgattggtttgagcttgaacggaaaaaacaacgctttacaagatggcgggactttgctgcgcaatgccttgtcgctggccttattttgctgatgctgttttggacagcgggacagcaagcggacggcgagctcgctaaaacgatgattgccgcttttgtgctagtggtgtttccgttgacggaagcctttttgccgctttcggatgccttaggcgaagtgccgggctatcaggattctatcagacgcatgaacaatgtggctcctcagccggaggcgtcacaaactgaatcaggggatcaaattctcgatcttcaagatgtcaccttggcctttcgtgatgtgacgttttcttatgacaacagcagccaagtgctgcacaacttttcctttacgctgcgccaaggagaaaaaatggcgctgctcggccgaagcggctctgggaaatcaacatcgcttgcattaatcgaaggcgccttgaaaccggactccggttctgtgacgttaaacggagtggagacagcgctgttaaaggatcagattgcggatgcggtggccgtgttaaatcaaaaaccgcacctgtttgatacaagcattttgaacaacatcaggctcggaaacggagaagcaagcgacgaggatgtgcgccgcgccgcaaagcaggtcaagctgcatgactacattgagtcattgcctgacggatatcatacctctgtacaagaaaccggcatccgtttttccggtggagagcgccagcggatcgcacttgcgaggattttgctgcaggatacaccgatcatcatcctcgatgagccaacagtcggcctcgatcctattaccgaacgtgaattgatggaaacggtgtttgaggtgctgaaaggaaaaacgattttatggattacacaccatctcgcgggagtggaagcagccgataaaatcgtatttctcgaaaacggcaaaacagaaatggaaggaacccatgaggagctgctggcggcaaacgaacgatatcgccgcctgtatcaccttgatgttcctgtaaaataa

SEQ ID NO: 34800 - protein, 575 aa, Bacillus subtilis
MKKEEWILPYIKQNARLFVLVIFLGAVTIFSAAFLMFTSGFLISKAATRPENILLIYVPIVAVRTFGIARSVSRYVERLVGHHIILKIVSDMRVRLYNMLEPGALMLRSRFRTGDMLGILSEDIEHLQDAFLKTIFPAISALLLYAVSVIALGFFSWPFAILLALYLFVLVVLFPVVSLLVTRAKNAKLKSGRNVLYSRLTDAVMGVSDWMFSGRRHAFIDAYEKEERDWFELERKKQRFTRWRDFAAQCLVAGLILLMLFWTAGQQADGELAKTMIAAFVLVVFPLTEAFLPLSDALGEVPGYQDSIRRMNNVAPQPEASQTESGDQILDLQDVTLAFRDVTFSYDNSSQVLHNFSFTLRQGEKMALLGRSGSGKSTSLALIEGALKPDSGSVTLNGVETALLKDQIADAVAVLNQKPHLFDTSILNNIRLGNGEASDEDVRRAAKQVKLHDYIESLPDGYHTSVQETGIRFSGGERQRIALARILLQDTPIIILDEPTVGLDPITERELMETVFEVLKGKTILWITHHLAGVEAADKIVFLENGKTEMEGTHEELLAANERYRRLYHLDVPVK

SEQ ID NO: 34801 - DNA, 2148 bp, Lactococcus lactis
  CDS (1)..(2148)
atgaaatttaaaaagaaaaattatacctcccaagtagatgaaatggattgtggatgtgctgctttatcaatgattttaaaatcctatgggacagaaaaatcgcttgcctctcttcgtttacttgctggtacaacaatcgagggaacttccgctttaggaataaaaaaagcaggagaaggtttaggttttgtagttcaagtactaagagctgatgcaagcctttttgaaatgaagaaagtcccttacccttttattgctcatgtcatcaagaaccaaaagtatccacactactatgtgataactggcgcaaataaaaattcggtattcatcgcagatcctgacccaaccgttaaaatgacaaaactttcaaaagaagttttcttatcagagtggacaggcattagcttatttctttcacctaccccatcctatcagcccactaaagaaaaaacttcttcattattatcttttatcccaattatcacccgtcaaaagaaagtcattctcaatattgtaattgcctcattcattgtaacgttgattaatattctagggtcttactacctccagagcatgattgatagttacattccaaatgccttaatgggaactttagggattatctcagtagggctattgttaacttatattatccaacaagtcttagagtttgctaaggctttcttactaaacgttctttctcaaagattagccattgatgtcatcctttcctatattagacacattttccaactcccgatgtctttcttttcgactagaagaacaggggaaattaccagtcggttttccgatgccagttctattttggatgctattgcctcaacgattctttcgctctttttagatttaaccattgttcttatgacaggactgattttagggcttcaaaatatgcaactctttcttctcgttcttttggcaatcccactttatattgttgttattattatttttactccgctttttgaaagacaaaatcatgaagttatgcaaaccaatgccatcttaaattcctcaattattgaagacattaatgggattgaaaccatcaaagcgctcgccagtgaacaagagagatatcaaaaaattgactacgaatttgcaagttatctaaaagaggctttcactttacaacagtcagaagccattcagacggcaataaaaacgacagtacaacttgtactaaatgttcttattttatggtttggtgcaactttagtcatgcatcaaaaaattaccctcggacaactcattacttttaatgccttgctttcttactttacaaatccaattactaatatcattaaccttcaaacaaaactacaaaaggcaagggtagccaatgaacgattaaatgaggtctatcttgtacccagtgaatttgaagaaaagaaaacagaactgtccctctcacattttaatttaaacatgtctgagatttcatatcaatatggttttggcagaaaagtcttatctgagataaaactgtctattaaagaaaatgaaaagttgaccattgttggtataagcggttcagggaagagtactcttgttaaattattggtcaacttctttcaacccacttctggtaccattactttaggtggaattgaccttcaacagtttgataaacatcaacttcgacgattaatcaactatcttccccaacaaccttatattttcacaggttcaattatggataatttacttttaggcgctagtgaagctacttcacaagaagagattattagagcggtggaattggcagaaatccgtgcagatattgaacaaatgcaattaggttatcaaactgaactctcaagtgatgcaagtagtttatcgggaggacaaaaacagagaattgcgctcgctcgtgccctcctttctcctgccaaaatactcatcttagacgaagccaccagtaatcttgatatgattactgaaaagaaaatattaaagaatttgttggcactagataagacaattattttcattgctcaccgcctctctgtagcggaaatgagccatcgtatcattgtcattgaacaaggaaaagtgatagaaagtggttcacattcagaactgcttgctcaaaatggcttttacgcacaactttaccataactaa

SEQ ID NO: 34802 - protein, 715 aa, Lactococcus lactis
MKFKKKNYTSQVDEMDCGCAALSMILKSYGTEKSLASLRLLAGTTIEGTSALGIKKAGEGLGFVVQVLRADASLFEMKKVPYPFIAHVIKNQKYPHYYVITGANKNSVFIADPDPTVKMTKLSKEVFLSEWTGISLFLSPTPSYQPTKEKTSSLLSFIPIITRQKKVILNIVIASFIVTLINILGSYYLQSMIDSYIPNALMGTLGIISVGLLLTYIIQQVLEFAKAFLLNVLSQRLAIDVILSYIRHIFQLPMSFFSTRRTGEITSRFSDASSILDAIASTILSLFLDLTIVLMTGLILGLQNMQLFLLVLLAIPLYIVVIIIFTPLFERQNHEVMQTNAILNSSIIEDINGIETIKALASEQERYQKIDYEFASYLKEAFTLQQSEAIQTAIKTTVQLVLNVLILWFGATLVMHQKITLGQLITFNALLSYFTNPITNIINLQTKLQKARVANERLNEVYLVPSEFEEKKTELSLSHFNLNMSEISYQYGFGRKVLSEIKLSIKENEKLTIVGISGSGKSTLVKLLVNFFQPTSGTITLGGIDLQQFDKHQLRRLINYLPQQPYIFTGSIMDNLLLGASEATSQEEIIRAVELAEIRADIEQMQLGYQTELSSDASSLSGGQKQRIALARALLSPAKILILDEATSNLDMITEKKILKNLLALDKTIIFIAHRLSVAEMSHRIIVIEQGKVIESGSHSELLAQNGFYAQLYHN

SEQ ID NO: 34803 - DNA, 1773 bp, Lactococcus lactis
  CDS (1)..(1773)
atggaaagaggtccacaaatggccaatcgtatcgaaggaaaagcggttgacaaaacatccattaaacatttcatcaaattgattcgtgctgcaaagccacgttatcttttctttatcattgggattctagcaggaatcgttggaacactaattcaattacaagtccccaaaatggttcaaccacttgttaatagttttggacatggagtaaacggtggcaaagttgccttagttatcgctctttatattggttcagctgctgtttcggctattgcagcaattgtccttgggatatttggtgaatcagttgtaaaaaatctaaggacgcgtgtctgggataaaatgattcatctgccagtaaaatattttgatgaagttaaaacaggagaaatgagttctcgtttagccaacgataccacccaagttaaaaatttaattgcaaacagtattccacaagcttttacgtctattttacttttggttggttcaattgtcttcatgcttcagatgcaatggcgtttgacccttgccatgattattgctgttccagtagttatgctcattatgttcccgattatgacttttggccaaaaaattgggcgaactagacaagattctttagcaaatttccaagggattgctagtgaatcattatcagaaattcgcttagtaaaatcttcaaatgctgaaaaacaagcctctaaaaaagcagaaaatgatgtcaatgccctttataaaattggggtaaaagaagccatctttgatggtttgatgtcaccagttatgatgttatcaatgatgctgatgatctttggacttcttgcttacggaatttatctcatctcaacaggagtcatgagtcttgggactttgcttggaatgatgatgtatttgatgaacttaatcggcgccgtaccaactgtggcaactttctttacagaacttgctaaagcttcaggatcaacaggtcgtttgaccgaattacttgatgaagaacaagaagtacttcatcaaggagaaagtcttgatttggaaggaaaaaccctctcagctcgccatgttgactttgcttatgatgattctgaacaaattttacgtgatatctcttttgaagctcaacctaattcaattattgcctttgccggaccttcaggtggtggtaaatcaacaattttctctcttttagaacgtttttatcaaccaacggcaggagaaattacaattgatggtcaaccgattgataatatttctttggaaaattggcggagtcaaattggttttgtcagtcaagattcagcaattatggctggaaccattcgtgaaaatttaacttatggacttgaaggagactatacagatgaagacctttggcaagttcttgacttagcttttgcaagaagctttgttgaaaatatgcctgatcaacttaatacggaagttggtgaacgaggtgtgaaaatatctggtggtcaaagacaacgtttagcaattgctcgtgctttcttgagaaatccaaaaatcctgatgcttgatgaagcaacggctagtttagatagtgaatcagaatcaatggttcaaaaggctttagatagtttgatgaaaggtcgcacaacgctcgtaattgcgcatagactttcaacaattgttgatgcggataagatttacttcattgaaaaaggtcaaatcacagggagtggcaaacataatgaacttgttgccacacatccactctatgctaagtatgtttcagaacaattgactgttggtcaataa

SEQ ID NO: 34804 - protein, 590 aa, Lactococcus lactis
MERGPQMANRIEGKAVDKTSIKHFIKLIRAAKPRYLFFIIGILAGIVGTLIQLQVPKMVQPLVNSFGHGVNGGKVALVIALYIGSAAVSAIAAIVLGIFGESVVKNLRTRVWDKMIHLPVKYFDEVKTGEMSSRLANDTTQVKNLIANSIPQAFTSILLLVGSIVFMLQMQWRLTLAMIIAVPVVMLIMFPIMTFGQKIGRTRQDSLANFQGIASESLSEIRLVKSSNAEKQASKKAENDVNALYKIGVKEAIFDGLMSPVMMLSMMLMIFGLLAYGIYLISTGVMSLGTLLGMMMYLMNLIGAVPTVATFFTELAKASGSTGRLTELLDEEQEVLHQGESLDLEGKTLSARHVDFAYDDSEQILRDISFEAQPNSIIAFAGPSGGGKSTIFSLLERFYQPTAGEITIDGQPIDNISLENWRSQIGFVSQDSAIMAGTIRENLTYGLEGDYTDEDLWQVLDLAFARSFVENMPDQLNTEVGERGVKISGGQRQRLAIARAFLRNPKILMLDEATASLDSESESMVQKALDSLMKGRTTLVIAHRLSTIVDADKIYFIEKGQITGSGKHNELVATHPLYAKYVSEQLTVGQ

SEQ ID NO: 34805 - DNA, 1764 bp, Haemophilus influenzae
  CDS (1)..(1764)
atgcaagagcaaaaattacaagaaaatgatttttcaaccttacaaacgtttaagcgtttgtggccaatgattaaaccttttaaagcggggcttattgtttctggcgtcgcgttagtttttaatgcattagctgactcaggcttgatttatttgttaaaaccgttgttggacgatggttttggtaaggcaaaccattcatttttgaaaatgatggcttttgtcgtcgttgggatgattattttacgcggcattaccaactttatttctaattattgcttggcgtgggtatcaggcaaagttgtcatgacaatgcgtcgccgcttgtttaaacatttaatgtttatgccagtgagtttctttgatcaaaattcaacagggcgtttactttctcggattacttatgattcccaaatgattgcaagttcttcttcaggatctttgattacaattgtgcgagaaggagcatatattatttcgctattcgcagtgatgttttataccagttgggaattaacaattgtgctttttattataggtccaatcattgctgttttaattcgtttggtatcaaaaatttttcgtagattaagtaagaacttacaagattcaatgggtgaacttacgtctgctacagaacagatgttaaaaggtcataaagttgtgctttctttcggagggcaacatgtggaagaagtgcattttaatcatgttagtaatgatatgcgtcgaaaaagcatgaaaatggtgacagcaaattccatttctgatcctgtggtgcaagttattgcatctctcgcattagctacggtgctctatttagctaccactccattgattgcagaagataatttgagtgcaggctcatttacagtggtattttcttcaatgttagctatgatgcgtccgttaaaatcattaactgcggtgaatgcacaatttcaaagtggaatggcagcatgtcaaacgctatttgccattttagatttagagccagaaaaagatgacggggcttataaagcagaacctgcgaaaggcgagttagaatttaaaaatgtgagttttgcatatcaaggaaaagatgaacttgcattaaataatatttcttttagcgttccagctggaaaaaccgtagctctagtgggacgttctggatcgggcaaatcaaccattgctaatttagtgacacgtttttacgatattgagcaaggcgaaattttactggatggcgtaaatatccaagattatcgtttatctaatttacgtgaaaactgcgctgtggtttctcaacaagtccatttatttaacgatactattgcgaataatattgcttatgcagcacaagataagtattctcgcgaagaaattatcgctgcagcaaaagcggcttatgctttagagtttatcgaaaaattaccgcaagtttttgatacggtaattggcgaaaatggcactagcctatcaggtgggcaacgtcagcgtttagcgattgctcgtgctttattgcgtaattcgccagtattaattttagatgaagctacatctgcactagatacggaatcagaacgagcaatccaatctgcattagaggaattaaagaaagatcgcacggttgttgtgattgcccatagattatctactattgaaaacgcggatgaaattcttgtgattgatcacggagaaattcgtgagcgtggcaaccataaaacattgcttgaacaaaatggtgcctataaacagttgcatagtatgcagtttactggctaa

SEQ ID NO: 34806 - protein, 587 aa, Haemophilus influenzae
MQEQKLQENDFSTLQTFKRLWPMIKPFKAGLIVSGVALVFNALADSGLIYLLKPLLDDGFGKANHSFLKMMAFVVVGMIILRGITNFISNYCLAWVSGKVVMTMRRRLFKHLMFMPVSFFDQNSTGRLLSRITYDSQMIASSSSGSLITIVREGAYIISLFAVMFYTSWELTIVLFIIGPIIAVLIRLVSKIFRRLSKNLQDSMGELTSATEQMLKGHKVVLSFGGQHVEEVHFNHVSNDMRRKSMKMVTANSISDPVVQVIASLALATVLYLATTPLIAEDNLSAGSFTVVFSSMLAMMRPLKSLTAVNAQFQSGMAACQTLFAILDLEPEKDDGAYKAEPAKGELEFKNVSFAYQGKDELALNNISFSVPAGKTVALVGRSGSGKSTIANLVTRFYDIEQGEILLDGVNIQDYRLSNLRENCAVVSQQVHLFNDTIANNIAYAAQDKYSREEIIAAAKAAYALEFIEKLPQVFDTVIGENGTSLSGGQRQRLAIARALLRNSPVLILDEATSALDTESERAIQSALEELKKDRTVVVIAHRLSTIENADEILVIDHGEIRERGNHKTLLEQNGAYKQLHSMQFTG

SEQ ID NO: 34807 - DNA, 1749 bp, Pasteurella multocida
  CDS (1)..(1749)
atgcaagataaagatctttcaacagtacagacatttaaacggttatggccaattattagcccttttaaacttggattagtggtatctggtattgccttagtgattaatgcattagctgatgcaggattaatttctttattaaaaccgcttttagatgaaggctttggcaaggcagatgtttcttttttacgtacaatgtcatacgttgtggtccttgttatcttcctgcgtggtatcagtaattttatttcatcttattgcttatcttgggtttctggcaaagtggtgatgattatgcgtcgtcgcatttttaaacacctgatgtttatgcccgtccctttttttgaccaaaactccagcggacgactgttgtctcgcatcacttatgattctgagctagtagcgaattcctcttcgggggcgttaattacaatagtcagagaaggtgcctatattatttctttgttagcggtgatgctttataccagttggcagttatctattgttctgtttttaattggtccgattattgccgtgctcattcgttttgtttcaaagcgttttcgcgaattaagtaaaaatatgcaaaactcaatgggagaattgacctctactgcagaacaaatgttaaaagggcataaagtagtactctcttttggtggacaaatagtggaagaagagcgtttcaaccatgtgagtaacgatatgcgccgtaagggaatgaaaatggcagttgccgatgcgatttccaatccagttgtgcaaattatagcttcttttgccttggcagctgtgttgtatttagcgacagtcccaaccattatggatcaaaatctaacagcgggttcctttactgtcgtcttttcatcgatgctagcgatgatgagaccgctaaaatccttgacgaacgtgaatgcacagtttcaaaaagggatggctgcttgtcaaactttgtttgcgttattagatttagaaacggagaaagatctaggaacacataaaggggaaaatgttcaaggctatttgagctttaaaaatgtcacttttacttaccaaagtcgcgatgagccagcattacgtaatttatcttttgatgttgaaaaagggaaaactgtagcacttgttgggcgttctggttcgggtaagtcaacgatcgcgaatttggtgacgcgtttttacgatgttgatcaaggtgaaattacattagatggcatcaatattcaagattatcgtttatccagtttacgtaagaactgtgcggttgtttcacaacaagttcatttatttaatgacaccattgcaaataacatcgcctatgcggcaaaagacaaatatagtcgtgaggaaattattaaagccgcaaaagatgcttatgctatggagttcattgaaaagcttgaacatggcttagatacggtaattggagagaatggggtgaatttatctggaggtcaacgtcagcgtttggcgattgctcgcgcattattgcgaaattccccagtgttaattttagatgaggcaacttctgcattggatacagaatctgaacgctcaattcaattagcgttggagaaattacagaaagaacgtaccgtcattgtgattgcacatcgcttatctacgattgaaaatgctgatgaaattttggtaattgagcatggtgaaattaaagaacgtggttcacatagcgaactgcttgcattaaatggtgcatacaaacagttacatcatattcaagttaatcattaa

SEQ ID NO: 34808 - protein, 582 aa, Pasteurella multocida
MQDKDLSTVQTFKRLWPIISPFKLGLVVSGIALVINALADAGLISLLKPLLDEGFGKADVSFLRTMSYVVVLVIFLRGISNFISSYCLSWVSGKVVMIMRRRIFKHLMFMPVPFFDQNSSGRLLSRITYDSELVANSSSGALITIVREGAYIISLLAVMLYTSWQLSIVLFLIGPIIAVLIRFVSKRFRELSKNMQNSMGELTSTAEQMLKGHKVVLSFGGQIVEEERFNHVSNDMRRKGMKMAVADAISNPVVQIIASFALAAVLYLATVPTIMDQNLTAGSFTVVFSSMLAMMRPLKSLTNVNAQFQKGMAACQTLFALLDLETEKDLGTHKGENVQGYLSFKNVTFTYQSRDEPALRNLSFDVEKGKTVALVGRSGSGKSTIANLVTRFYDVDQGEITLDGINIQDYRLSSLRKNCAVVSQQVHLFNDTIANNIAYAAKDKYSREEIIKAAKDAYAMEFIEKLEHGLDTVIGENGVNLSGGQRQRLAIARALLRNSPVLILDEATSALDTESERSIQLALEKLQKERTVIVIAHRLSTIENADEILVIEHGEIKERGSHSELLALNGAYKQLHHIQVNH

SEQ ID NO: 34809 - DNA, 1779 bp, Ralstonia solanacearum
  CDS (1)..(1779)
atggcagtgacttcttcttcgtcttcccagccgcccgcggccagccagccgggccacttcaagcgcctgtgggcctacctgcgtcccgaactcagcagcttcatcctcgccatggtcgccatgggcgtggtggcggccaccgaggggatcatccccaaggtggtgaaggacctgctggaccagggcttcggcggcgaatacgccggcaagctgtggcgggtgccggccatgctggtcggcatcgcggtggtgcgcggcgtcgcccagttcggggccacgtacttcctgagcctggtgtcgaacaaggtgctgctgaacctgcgcatgaagatgttcgagcgcctgctgcaggcgccggcggcgttctaccagcgcaatacggcggcctcgctcatcaacgccgtcatcttcgaggtcaaccaggtgctgcaggtgctgaccggcgtgttcatcacgctggtgcgcgattcgatgacggtgctggcgctgctgatcttcctcttctataccaactggcgcctgacgctggtggtggccgtgatcctgccggtcatcgggttcctgatgtcgcgcatcaaccgccgcctgcgttcgctcaatcgcgagcaccagaacctgaccaacgaagccgcgtacgtggtggaggaggcggccggcggctacaaggtcgtcaagctgcacggcggcgaggcctacgagtcacgccgcttcaatgccatgaccaaccgcctgcgcggctacgccatgcgcatggccgtggccggcggcctgaaccagccggtgacgcagttcctggcggcgctggcgctgtccgtcatcctggcgatcgcgatggtgcaggcgcaagccaaccagaccaccgtcggcggcttcaccggcttcgtgatggcgatgctgctgctgatctcgccgctcaagcacctgaccgacgtcaaccagccgatgcaacgcggcctgactgccgccgagttcatcttcggcctgatcgacacgccgatcgagccccaggacggcggcaagcacatcgaccgcgcgcgcggcgacctgcgcttcgagcacgtcaccttccgctacggcccggacggccgggcggcgctcgacagcatcgacctgcacgtcaaggcgggcgagatcgtcgcgctggtgggcccgtcgggcagcggcaagaccacgctggtcaacctgctgccgcgcttcttcgagccgacctcgggccgcatcgtgctcgacggcgacgcgctggccgacctgtcgctgcaggatctgcgccgccagatcgccttcgtgagccaggacgtggtgctgttcaacgataccattgccgccaacgtggcgtatggcgcgcgcgatgcctccgagatcgatatggcgcgcgtgcgtcgtgcgctggaagccgcctacctgaccgatgtggtcgacaacctgcctgatggcgtcgacaccaacatcggtgacaacggctccaagctgtccggcggccagcgccagcgcctggcgatcgcccgcgccgtctacaaggacgcgccgatcctgatcctggacgaagccacctccgcgctcgattccgagtccgagcgccaggtgcaggccgcgctggaagccctgatgcagggccgcacgacgctggtgatcgcgcaccgcctgtcgaccatcgagaatgccgaccgcatcgtcgtgctcgaacacggccagatcgtcgaggccggcacgcatcgcgagctgctcgatcgcgatgggttgtatgctggattgcatcgcatccagttcgccacgcaatag

SEQ ID NO: 34810 - protein, 592 aa, Ralstonia solanacearum
MAVTSSSSSQPPAASQPGHFKRLWAYLRPELSSFILAMVAMGVVAATEGIIPKVVKDLLDQGFGGEYAGKLWRVPAMLVGIAVVRGVAQFGATYFLSLVSNKVLLNLRMKMFERLLQAPAAFYQRNTAASLINAVIFEVNQVLQVLTGVFITLVRDSMTVLALLIFLFYTNWRLTLVVAVILPVIGFLMSRINRRLRSLNREHQNLTNEAAYVVEEAAGGYKVVKLHGGEAYESRRFNAMTNRLRGYAMRMAVAGGLNQPVTQFLAALALSVILAIAMVQAQANQTTVGGFTGFVMAMLLLISPLKHLTDVNQPMQRGLTAAEFIFGLIDTPIEPQDGGKHIDRARGDLRFEHVTFRYGPDGRAALDSIDLHVKAGEIVALVGPSGSGKTTLVNLLPRFFEPTSGRIVLDGDALADLSLQDLRRQIAFVSQDVVLFNDTIAANVAYGARDASEIDMARVRRALEAAYLTDVVDNLPDGVDTNIGDNGSKLSGGQRQRLAIARAVYKDAPILILDEATSALDSESERQVQAALEALMQGRTTLVIAHRLSTIENADRIVVLEHGQIVEAGTHRELLDRDGLYAGLHRIQFATQ

SEQ ID NO: 34811 - DNA, 1770 bp, Xanthomonas axonopodis
  CDS (1)..(1770)
gtgaccatctccatcgaccgcccggcgccagtgtcttcctggcgcacgtaccgtcgcctgctggcgtttgccaagccgtatcgtttgttgctggtggccgcgctgatcgctgcgttgatcgaagcggccggcaccaccggttttctggcgttgatgaagccaatcaccgacgagaccttcatctacaagaacgccgaggtcagtcgctggttgccggtgcagatcatcctgctgttcgtggtgcgcggcgtggccggctacatcaccgacatggcgatgggcaaatccgcacgcagcatcgcgcgcgatctgcgcatcaaggtgatggccaagtatctgcgcctgccagggtcacgctttgattcggagccggtgccgtcgatgttgatacgcctgggctcggattcggaccaggttgcgcaggccgcagtggatgcggtcaaggtcatgatccagcaatcgctgcaggtgatcggtgcgctggcgctgatgctgtggcatagctggcaggtgacattgaccatcctggtgctggccccggtgctggcctgggtgatggacaaggtggcgcggcgctaccggcgtatcagccacagcatccaggaaagcggtgcgcagctgctgcaggccgccgaccagaccttgtccagccatcaggaggtcaagatctacggggctcagcagaccgaaatggagcgctatggcgcgctggccaatcgcaacctgcgcctggcgatgaaggtcgaatccacccgcggcatttccactgccaccgtgcagatgatcggcgcgatcggcttgtcggcattgctgttcgtggccggtgcgcaggccttggccgggcgactgacggccggcgatttcgtcgtgctgatgacctcgatgctgacgatcattcctggcctcaagcagctgaccaatgtgcagaacatggtgcagcgcggcctggcatcggccgagcgtctgttttcggtgctcgacagcccggacgagccggatcaaggtaccgtgccgctgacgcgtgccaagggcttgatcgaatttcgcgatgtcacggcgcgctaccccggccaggtcaatccggcgctggcagatgtcagcttcgttgcgcaaccgggcaccgtcaccgccatcgtcgggcgttccgggagcggcaaatccagtctgatcaagttgattccgcgtttttacgaagccgaggccgggcagatcctgctcgacgggcatccggtgcaggcgtatgcgttggcggatctgcgtcggcaaattgcgctggtcggccagcaggtgatgctgttcgacggcagcatcgccgataacgtggcgttcggcgaaatgcgcaacgccgatgccggcaagttggagcgcgcgattctgggagccaatgcaatggagtttgtcgcgcagctgcccgaaggtctgcagtcgcatgtcggcaccaagggtgggcgcctgtccggcggccagcgccagcgtctggcgatcgcacgcgccatgctcaaggacgcgccggtcctgattctggacgaggccaccgcagcgctggacaacgagtccgaacgactcgtgcaagatgcgttgcacaagctgatgcctgaccgcaccacgctggtcatcgcgcatcgtctatccaccatcgagcatgccgatcaggtgctggtgatggaccagggccggatcgtcgagcgtggtacgcatcaccaattgctggcgcagggcggcttgtattcgcacctgcacggcatgcaattccgcgaacgccaggcatga

SEQ ID NO: 34812 - protein, 589 aa, Xanthomonas axonopodis
MTISIDRPAPVSSWRTYRRLLAFAKPYRLLLVAALIAALIEAAGTTGFLALMKPITDETFIYKNAEVSRWLPVQIILLFVVRGVAGYITDMAMGKSARSIARDLRIKVMAKYLRLPGSRFDSEPVPSMLIRLGSDSDQVAQAAVDAVKVMIQQSLQVIGALALMLWHSWQVTLTILVLAPVLAWVMDKVARRYRRISHSIQESGAQLLQAADQTLSSHQEVKIYGAQQTEMERYGALANRNLRLAMKVESTRGISTATVQMIGAIGLSALLFVAGAQALAGRLTAGDFVVLMTSMLTIIPGLKQLTNVQNMVQRGLASAERLFSVLDSPDEPDQGTVPLTRAKGLIEFRDVTARYPGQVNPALADVSFVAQPGTVTAIVGRSGSGKSSLIKLIPRFYEAEAGQILLDGHPVQAYALADLRRQIALVGQQVMLFDGSIADNVAFGEMRNADAGKLERAILGANAMEFVAQLPEGLQSHVGTKGGRLSGGQRQRLAIARAMLKDAPVLILDEATAALDNESERLVQDALHKLMPDRTTLVIAHRLSTIEHADQVLVMDQGRIVERGTHHQLLAQGGLYSHLHGMQFRERQA

SEQ ID NO: 34813 - DNA, 1770 bp, Xanthomonas campestris
  CDS (1)..(1770)
gtgaagaccatcaacgagaacgcgccgcaggtgtcgtcctggcagacctatcggcgtctgctggcattcgctaaaccttaccggctgctgttggtggccgcgttgatcgccgcattgatcgaggccgccgggaccaccggcttcctggccttgatgaagccgatcaccgacgagaccttcatttacaagaacgccgaggtcagccgctggctgccggtgcagatcatcctgttgttcgtgatccgcggtgcggccggttacatcaccgacatggcaatgggcaagtctgcgcgcagcatcgcgcgcgatctgcgcgtcaaggtcatgtccaagtatctgcgcctgccgggctcgcgcttcgactccgaaccggtgccgtcgatgctgatccgcctcggctcggactcggatcaggtcgcgcaggccgccgtggatgccgtgaaggtgatgatccagcagtcgctgcaggtgatcggcgcgttggcgttgatgctgtggcatagctggcaggtcacgctcaccattctggtgctggcgccggtgctggcttgggtgatggacaaggtggcgcgccgttatcggcggatcagtcacagcatccaggagagtggcgcgcatctgttgcaggccgccgaccagaccttgtccagccatcaggaggtcaagatctacggcgcgcagcagagcgagatggagcgctactcgggcctggccgaccgcaatctcaggctggccatgaaagtcgaatccacgcgcggcatttccaccgccaccgtgcagatgatcggcgcgatcggtctgtccgcgctgctgttcgtggcgggcgcgcaggcattggccgggcgcctgacggccggcgattttgtggtgttgatgacctcgatgctgacgatcattccgggcctcaagcagctcaccaatgtgcagaacatggtgcagcgcggcctggcgtctgccgaacgcctgttctcggtgctggacagccctgacgagcccgaccagggccaggtgccgttgacgcgcgccaagggtttgatcgaattccgcgatgtcaccgcgcgctatccggggcaggccaatcctgcgttggccgatgtcagcttcgtggcacagccgggcaccgtcacggcgatcgtcggccgctccggcagcggcaaatccagcctgatcaagctgattccacgcttttatgaggccgagtccgggcagatcctgctcgacggtcacccggtgcaggcctatgcattggccgatctgcgccgccagattgccctggttggccaacaggtgatgctgttcgacggcagcattgccgagaacgtggcgtacggcgaaatgcgccagtgcgatgccgggcaactggagcgcgccatccagggtgcgaatgcgatggagtttgtcgcgcagctgccggagggcctgcagtcgcacgtgggtaccaagggcgggcgcctgtccggcggccagcgccagcgtctggcgatcgcacgcgcgatgctcaaggacgcgccgatcctgatcctggacgaggcgaccgccgcactcgataacgaatccgagcggctggtgcaggacgccttgcacaagttgatgcccgaccgcaccaccttggtgatcgcgcaccggctgtcgacgatcgagcatgccgaccaggtgctggtgatggaccagggccgcatcgtcgagcgcggtacgcatcaggaactgctcgcgctgggcgggctgtactcgcacctgcacggcatgcagtttcgcgaacgtcaggcatga

SEQ ID NO: 34814 - protein, 589 aa, Xanthomonas campestris
MKTINENAPQVSSWQTYRRLLAFAKPYRLLLVAALIAALIEAAGTTGFLALMKPITDETFIYKNAEVSRWLPVQIILLFVIRGAAGYITDMAMGKSARSIARDLRVKVMSKYLRLPGSRFDSEPVPSMLIRLGSDSDQVAQAAVDAVKVMIQQSLQVIGALALMLWHSWQVTLTILVLAPVLAWVMDKVARRYRRISHSIQESGAHLLQAADQTLSSHQEVKIYGAQQSEMERYSGLADRNLRLAMKVESTRGISTATVQMIGAIGLSALLFVAGAQALAGRLTAGDFVVLMTSMLTIIPGLKQLTNVQNMVQRGLASAERLFSVLDSPDEPDQGQVPLTRAKGLIEFRDVTARYPGQANPALADVSFVAQPGTVTAIVGRSGSGKSSLIKLIPRFYEAESGQILLDGHPVQAYALADLRRQIALVGQQVMLFDGSIAENVAYGEMRQCDAGQLERAIQGANAMEFVAQLPEGLQSHVGTKGGRLSGGQRQRLAIARAMLKDAPILILDEATAALDNESERLVQDALHKLMPDRTTLVIAHRLSTIEHADQVLVMDQGRIVERGTHQELLALGGLYSHLHGMQFRERQA

SEQ ID NO: 34815 - DNA, 1770 bp, Xylella fastidiosa
  CDS (1)..(1770)
gtgaacgtcttatcaggggctatgcgttatgccacgccctggcggacgtaccgtcgcttgctgtcgtatgcgcgggagtatcgttggttactcgttgttgcggcgtgtggtgctttacttgaggcagttgctggttctacctttctggcgttgatgaagcccatcaccaacgaaacctttatcgagcgaaaccgtgaggtggccctgtggctgcctcttggaattgtcggtttgtttttgttacgcggtattgctggctatatcactgatatggcgatgggccgcgccgcgcgtagcattgctcgcgattttcgtgtgtgtgtcctgaccaaatattttcgtttgcctggtagccgttttgacggtgagccagtggcttcgatgttggtgcggctcggttcagacagtgagcaagttgcgcatgcggttatcgacgcgatgaaggtgatggtgcagcagacgcttcaggtgattggtgcgttggttgtgatgttgtggtacagctggacagtcacgctcgccatccttttggtcgctccgttgctggcttgggtcatgcagcgggttgctaagcgttaccgtcgtatcagccatcacatccaagagagtaatgcgcagctcatgcaagctgccgatcaagcgttaagcaactaccaggacgtcaaagtgtatgccgcgcaagagagcgagttggagcgctatgctcggttggccaatatcaatttgggtttggcgataaaggttgagtcgacacgtagtctctcttcggcggcggttcagttgcttggtgcggttgggttggcaatgttgttgctcattgccggccatgaagctttggccggtcgcctcagtccaggcgattttgtctcgttgatgacttcaatgatcgcggttattcccgcgttgaaacagttgaccaatgtacagaacatgttgcagagcggtattgcttctgcacaacgtctgttctcggtactagatagtcctgatgagcttgatactggcagacgaccgttggggcgtgccagaggattcatcgagttccgcgggatcaccgcacgctatcctggtcggtctgctcccgtgctggatagtgtcagctttgttgctgcaccgggcacggtcactgcgattgttggtcgttcaggaagcggtaagtcaagtttaatcaagttgattccgcgtttttacgagccggagtctgggcagatattgttggatggccatccattacaggattatcttttagctgatcttcgccgtcagattgcattggtaggacagcaggtcatgttgttcgatggcagcatcgcggaaaatattgcttatggtgagatgcgtcaggtcgtttctgaggagattgaacgtgtcgtggttgatgcaaacgctcaggactttgtgaaccaacttccagagggattacagtttcaggttggggttaagggggggcgtctttctgggggacaacgtcagcgtttggccattgcgcgcgcgatgctgaaggatgcgccgattcttatcctggacgaggccacggctgcgcttgataacgaatctgagcgcttagtgcaggacgcgttgcagcgcttgatgccggagcgcaccacacttgtgattgcgcatcgactgtcaacgatcaagcatgcggatcaggtgttggtgatggaccaggggcgcatcattgagtctggtacccatgtcgatctgttggcacgtgatgggttgtacgcttatttgtacagcatgcaatttcgcgaacgtccaacatga

SEQ ID NO: 34816 - protein, 589 aa, Xylella fastidiosa
MNVLSGAMRYATPWRTYRRLLSYAREYRWLLVVAACGALLEAVAGSTFLALMKPITNETFIERNREVALWLPLGIVGLFLLRGIAGYITDMAMGRAARSIARDFRVCVLTKYFRLPGSRFDGEPVASMLVRLGSDSEQVAHAVIDAMKVMVQQTLQVIGALVVMLWYSWTVTLAILLVAPLLAWVMQRVAKRYRRISHHIQESNAQLMQAADQALSNYQDVKVYAAQESELERYARLANINLGLAIKVESTRSLSSAAVQLLGAVGLAMLLLIAGHEALAGRLSPGDFVSLMTSMIAVIPALKQLTNVQNMLQSGIASAQRLFSVLDSPDELDTGRRPLGRARGFIEFRGITARYPGRSAPVLDSVSFVAAPGTVTAIVGRSGSGKSSLIKLIPRFYEPESGQILLDGHPLQDYLLADLRRQIALVGQQVMLFDGSIAENIAYGEMRQVVSEEIERVVVDANAQDFVNQLPEGLQFQVGVKGGRLSGGQRQRLAIARAMLKDAPILILDEATAALDNESERLVQDALQRLMPERTTLVIAHRLSTIKHADQVLVMDQGRIIESGTHVDLLARDGLYAYLYSMQFRERPT

SEQ ID NO: 34817 - DNA, 1701 bp, Pseudomonas syringae
  CDS (1)..(1701)
atgaaaaccaagcaagagaagaaggccagaccaggctcgatcatgcgtctgttatggagcagccatccctggctgacgttctttacgctgctgacagggctcatcagcggcgttgcgtccattgccgtggtcaatgtgatcaaccaggcgattcacgaggagacctttcagcgtcagtcgctgttctggtttgtcggcctgagcgtggtggcgctcctgttccgcaacggtgcgtcgctgtttccggcttacgccagcatgcgcatcatgacccgtctgcgcattgccctgtgccgcaagatcctcggcacgccgcttgaggaagtcgaccgccgcggtgcgccgaatgtgctgaccctgctgaccagcgatattccgcaactcaacgccacgctgttgatcatgccgacgatcctggtggagtcggcggtgttcctgttcggtattgcctacctggcctacctgtcctgggtggtgtttgcgataaccatctcgctgatgatcctgggcgttgcaatgtacctgctgtttttcatgggtggcatgaagttcacccacaaggtgcgcgacgaattcacggccttcaacgaatacacacacgcgcttgtgttcggcctcaaggaactgaaactcaacggtattcgccgccgctggttcagccgctcggcgatccaggagtcttcggttcgggtcgcgaagtacaactacatcgaacggctctggttcactgccgccgaaaacgttggccagttgaccctgtcgttgctggtcggctgcctgctgttcgctgcgccgatgttcgctgttatcgacgccaagaccatgagcgccagtgtgctggcggtgctgtacatcatgggcccgctggtgatgctggtcagcgccatgccgatgctggcccagggacgtattgcctgcacgcgactggcggatttcggattctccatcaacgaaccgcatccggagccggaaaccagcgatgcagacaatgtgctgcttctcgatcacaagaagtcctggggcagtatccagctcaagaacgtacacatgaactacaaggacccgcagagcagttccggttttgccctgggacctatcgacctgacgatccactccggtgagctggtctacatcgtcggcggcaacggttgtggcaaaagcaccctggccaaagtgttctgcggcctgtacatcccgcaagagggtcagctactgctcgacggtgcggcggtcacggacgactcgcgcggcgactatcgcgacctgttctcggcggtgttctctgacttccatctgttcaaccgattgataggtcctgacgagaaagaacatcccagcaccgatcaggcgcagacatacctctcgactctgggcctggaagacaaggtcaagatcgagggacttggttactcgaccaccacggccttgtcatacggccagcagaaacgcctggcactggtgtgcgcctacctggaggaccgtccgatttacctgctggacgagtgggccgccgaccaggacccgccgttcaagcgcttcttttacgaggaactgctgccggacctcaagcgccggggcaagacgatcctgatcattactcacgacgatcagtacttccagctggccgaccgcatcatcaagttggcggacggttgcatcgtctccgacgtgaagtgcgcggttgagggcaagcgcgcctga

SEQ ID NO: 34818 - protein, 566 aa, Pseudomonas syringae
MKTKQEKKARPGSIMRLLWSSHPWLTFFTLLTGLISGVASIAVVNVINQAIHEETFQRQSLFWFVGLSVVALLFRNGASLFPAYASMRIMTRLRIALCRKILGTPLEEVDRRGAPNVLTLLTSDIPQLNATLLIMPTILVESAVFLFGIAYLAYLSWVVFAITISLMILGVAMYLLFFMGGMKFTHKVRDEFTAFNEYTHALVFGLKELKLNGIRRRWFSRSAIQESSVRVAKYNYIERLWFTAAENVGQLTLSLLVGCLLFAAPMFAVIDAKTMSASVLAVLYIMGPLVMLVSAMPMLAQGRIACTRLADFGFSINEPHPEPETSDADNVLLLDHKKSWGSIQLKNVHMNYKDPQSSSGFALGPIDLTIHSGELVYIVGGNGCGKSTLAKVFCGLYIPQEGQLLLDGAAVTDDSRGDYRDLFSAVFSDFHLFNRLIGPDEKEHPSTDQAQTYLSTLGLEDKVKIEGLGYSTTTALSYGQQKRLALVCAYLEDRPIYLLDEWAADQDPPFKRFFYEELLPDLKRRGKTILIITHDDQYFQLADRIIKLADGCIVSDVKCAVEGKRA

SEQ ID NO: 34819 - DNA, 1755 bp, Streptomyces coelicolor
  CDS (1)..(1755)
gtgaccaccgcacagcctcagaccggtacgcccgcctggcggctgctcctgtcgtacgtacgaccgcaccgcacggccctgttcgcgggcgcgctgctctccctggtcaccggcgccacggggctgctgctgccgctggtggcgcgggagctgatcgacgacctggcgcaggaccgggccatcaccggcgcgctactggccatgtcggggctggtggtcgccaacacggcgctgggcgcgctgggttcgtacgtgctgcggcgcaccgcggagtcggtggtgctcggggcgcggcgcaccctgtcgtcgtatctgctgcggctgcggatcgcggcggtggaccgtaccgagcccggcgacctgatggcccggatcacctccgacacgacgctgctgcgcgaggtgaccaccgactccctcatcggcctcggcaccggtgggctgacgctggtggcgacgctggtgatgatgggcgtcgtcgatcccgtgctcctcggggtgacgctggccgtggtgctgggcgcgggcacggtgctggggctgatcgtgccgcgcatcaaccgggcgagccggcaggcgcaggacgcggtgggcgtgatgggcgccgcgctggagcggattctcggcgcgctgcgcacggtgaaggcgtcgggcgccgagccacgggaggagcgggtgctgcacgaggccgccgaggagtcctggcggcagagtgtgcgggccgccaagtggtcggccgccgcgggcaacacggcggggctcgcgatgcagatcgccttcatcacggtgctcgcggtgggcggggcgcgggtggcgacgggagcgatcgacgtgggaactctggtcgcgttcctgctgttcgtcttctatctgatgtccccgatccagcaggtcgtcggcgcgatcacgcagtaccagacgggccgagcggcgctgggccggatccaggacgcgctgggcctgcccgcggagccgcaggcccggccggtcccgctgccgtcggcgggcgcgccaccggcgtccgtctccttccgcgaggtccgcttccgctatgccgacgatcttccgtacatccaccacggggtgagcttcgaggtgccggctcgggggatgacggcgttcgtcggtccgtccggtgcgggcaagaccaccgtgttctccctcgtcgagcggttctacgacccggactccggggagatcacgctggacggccggagcctcggggactgggaactgtcctcgctgcgggcctcgatcggctatgtggagcaggacgccccggtgctgtccggttcgctgcgggacaacctgctgctgggcaatccggagggggacgaggcgaccctcgccgccgtgctgaagacgacccgcctggacggcctggtcgaacggctgccgaacgggctggagacgctcgtcgggcatcggggcacgaaactgtccgggggtgagcgccagcgggtggccatcgcccgggcgctgttgcgccggccgcgtctgctgctgctcgacgaggccacctcgcagctggacgcggtcaacgaggcggcgctgcgcgacaccgtggcggacgtggcccggacgaccacggtgctggtggtcgcgcaccggctgtccacggtgacgatggcggaccggatcgtggtgatggacgcggggcgcgtgcgtgcggtcggcacgcaccgggagctggtgaccgccgatccgctgtacgcggagctggcggccacccagttcctggcgaccggtggctga

SEQ ID NO: 34820 - protein, 584 aa, Streptomyces coelicolor
MTTAQPQTGTPAWRLLLSYVRPHRTALFAGALLSLVTGATGLLLPLVARELIDDLAQDRAITGALLAMSGLVVANTALGALGSYVLRRTAESVVLGARRTLSSYLLRLRIAAVDRTEPGDLMARITSDTTLLREVTTDSLIGLGTGGLTLVATLVMMGVVDPVLLGVTLAVVLGAGTVLGLIVPRINRASRQAQDAVGVMGAALERILGALRTVKASGAEPREERVLHEAAEESWRQSVRAAKWSAAAGNTAGLAMQIAFITVLAVGGARVATGAIDVGTLVAFLLFVFYLMSPIQQVVGAITQYQTGRAALGRIQDALGLPAEPQARPVPLPSAGAPPASVSFREVRFRYADDLPYIHHGVSFEVPARGMTAFVGPSGAGKTTVFSLVERFYDPDSGEITLDGRSLGDWELSSLRASIGYVEQDAPVLSGSLRDNLLLGNPEGDEATLAAVLKTTRLDGLVERLPNGLETLVGHRGTKLSGGERQRVAIARALLRRPRLLLLDEATSQLDAVNEAALRDTVADVARTTTVLVVAHRLSTVTMADRIVVMDAGRVRAVGTHRELVTADPLYAELAATQFLATGG

SEQ ID NO: 34821 - DNA, 1815 bp, Bacillus subtilis
  CDS (1)..(1815)
atgctaaaagacatccgcaagcctttccaatatcccaaactgccaattgacaaaaaagaaggcgcgaaaaagcgggcgaaagcaaaggatacaaagggcacactgagacgaatctggtcttacttggctgaaagaaaaggactgctcatacttgtcatgctaatggttgtcatcagcgccatattcggactccttggtccctttgtgatcggaaaggccatcgaccattttatcgtcgggaaaacggtcagcggcttgattcctgttttgcttcttctgctcgctatctatatcattcagtccctgtcgctttggtttcaaaactattggatgattacgatctcgcagggcacggttttcagaatgagaagcgaattgttcacccatctgcatgagctgccgattccattttttgataaacagcggcacggcgagctgatgagccgggtgacgaatgacatcgaaaatgtcagttctaccttaaacacgtcagtcattcaaattttgtcaagtgtgatcacctttgtcgggacgattgcggtgatgctgtacatgagcccgctccttactttgattacgctgaccattattccggtgatggcagcgagcctgaaatggatcaccaaccgaacgggaaagctgtttaaagaacagcagaaaaaccttggtgatctgaatgggtatattgaggaatctgtttcaggcgcaaaggtcatcaaagcatattcacgtgagaagcagattactgctgaattcctcgaaaaaaacgctgcactcaagacgtcgggcttttgggcgcagacgatttccgggtttattccgaaggtcatgaactctttgaataacttaagctttacaatgattgcggcaatcggcggtttgtttgcgctgaaaggctggatctcgatcggctccatcgttgtctttgccgagtattcaagacaatttacacgccctttaaacgatctggccaaccagtttaatacgatgctgtccgcaatcgccggcgctgaacgggtgtttgacgtgcttgatgaaaaagaagagcgcgaggatgaaaagaacgccgtgcatcagcccatccaaacaggcagcattgaattccgggatgtgtccttcggttacgataaagggcagcagacactgaagcatttacagtttaccgtgcctgcggggcagtccatcgcgtttgtaggaccgacgggggcggggaagacaaccgtcactaaccttctcgcccgtttttacgagcctaacgatggaaaaattttaatcgatggtacagatattaaaacccttactagagcaagcctaagaaaaaacatggggtttgttcttcaggattctttcttatttcagggaacgatcagagaaaacattcgctacggcaggcttgatgcttctgatcaggaagtcgaagccgctgcaaaaacagcgaatgcccatagttttattgaaaggctgccaaaagggtatgacaccgtactgacgcaaaacggttcgggcatcagtcaagggcagaagcagttgatttctatagcgagggcggtgcttgccgatccggttcttctcattttggatgaagcgacaagcaacattgataccgttacagaagtcaacattcaagaagcgctcgcccgtttaatggaaggaagaacaagcgtcatcattgcccacaggctgaacaccattcaaagagcggaccagattgtggtgctaaaaaacggtgaaatgattgaaaaaggcagccatgacgagctgattcggcaaaaaggattttacagtgacttatatgaaagccaatttgagaaatag

SEQ ID NO: 34822 - protein, 604 aa, Bacillus subtilis
MLKDIRKPFQYPKLPIDKKEGAKKRAKAKDTKGTLRRIWSYLAERKGLLILVMLMVVISAIFGLLGPFVIGKAIDHFIVGKTVSGLIPVLLLLLAIYIIQSLSLWFQNYWMITISQGTVFRMRSELFTHLHELPIPFFDKQRHGELMSRVTNDIENVSSTLNTSVIQILSSVITFVGTIAVMLYMSPLLTLITLTIIPVMAASLKWITNRTGKLFKEQQKNLGDLNGYIEESVSGAKVIKAYSREKQITAEFLEKNAALKTSGFWAQTISGFIPKVMNSLNNLSFTMIAAIGGLFALKGWISIGSIVVFAEYSRQFTRPLNDLANQFNTMLSAIAGAERVFDVLDEKEEREDEKNAVHQPIQTGSIEFRDVSFGYDKGQQTLKHLQFTVPAGQSIAFVGPTGAGKTTVTNLLARFYEPNDGKILIDGTDIKTLTRASLRKNMGFVLQDSFLFQGTIRENIRYGRLDASDQEVEAAAKTANAHSFIERLPKGYDTVLTQNGSGISQGQKQLISIARAVLADPVLLILDEATSNIDTVTEVNIQEALARLMEGRTSVIIAHRLNTIQRADQIVVLKNGEMIEKGSHDELIRQKGFYSDLYESQFEK

SEQ ID NO: 34823 - DNA, 1728 bp, Bacillus subtilis
  CDS (1)..(1728)
gtgctgcggcaatttttttcatattataaaccatataaaacgttgttctttctcgactttttctcagcgatcgcgggaggtttaatggagctgagttttcctttgatcgtcaattattttattgataccttgctgccgggcagggactggggactgatcatcgcgacctcaatcgggttatttgcggtgtacgcgctcagctcggctcttcagtatatcgtgacctactggggacacatgcttggtatcaatattgagactgatatgagaaagtcgctttttgaccatttgcaaaagctctcgttcaaattttacgacaacaacaagacgggaacgctgatgtcgaagctcacgaacgatttaatgtatatcggtgaagtcgcccatcacggaccggaagacttattcattgcggtcatgaccattctcggggcgttcggagtgatgctgtttattaactggcagcttgctttattaacgtttatcattatgccgatcgtcatttggctagcgctttatttcaacaaaaaaatgaccaaagcatttaccacgctgaacaaggatatcggagacttcagcgcgcgtgtagaaaataacatcggcggcatccggcttgtgcaggcgttcggaaatgaagcatttgaaaaagaacgcttcgccgtcaacaaccagcgttttcgtgtcacaaagctttcttcctacaaaatcatggcgaaaaacggttcaatcagctatatgctgacccggtttgtcacgctgtttgtccttttgtgcgggacgtggtttgtcattcgcggctccttatcgtacggggaatttgtggcgtttgtactcttgacgaatgtgctgttcaggcctattgacaaaattaatgccattatcgaaatgtatccgagggggatcgcgggtttcaaaagctatatggagctcatggagacagagccggatattcaggactcacctgattcgaaagatgtttccggcctgaagggcaatatccgctataaacatgtttcgtttggctatgatgaccatcacaatgtcctcaatgacatcaacctatccattcaagcgggggaaacggtggcgttcgtcggtccgtcaggtgctgggaaatcaacgctttgcagtctgcttccgcgtttttatgaagcatcggagggcgacattacgattgacggcatcagtataaaagacatgacgctttcttcgttgcgcgggcagattggcgtcgtgcagcaggacgttttcttattctcgggcacgcttagagaaaatatcgcctacggccgactaggcgcatcagaagaagacatttggcaagctgtgaagcaggcgcatctggaagagctcgtccataacatgcccgatgggttggatactatgattggcgaacgcggcgtgaagctttccggcgggcaaaaacagcgtctgtcaattgcaaggatgttcttgaaaaatccgtcgatcttgattctcgacgaagccacctcagcccttgatacagagacggaagcggcgatccaaaaggcgcttcaagagttgtctgaggggcgcacgacgcttgtcatcgcccacaggctggcaacaatcaaagacgcggacagaattgtagtcgtcacaaacaacggtattgaagaacaaggccgtcatcaagacctgatcgaagccggaggcctatacagcaggctgcatcaagcgcaattcgggcaaatggtgcatcgatag

SEQ ID NO: 34824 - protein, 575 aa, Bacillus subtilis
MLRQFFSYYKPYKTLFFLDFFSAIAGGLMELSFPLIVNYFIDTLLPGRDWGLIIATSIGLFAVYALSSALQYIVTYWGHMLGINIETDMRKSLFDHLQKLSFKFYDNNKTGTLMSKLTNDLMYIGEVAHHGPEDLFIAVMTILGAFGVMLFINWQLALLTFIIMPIVIWLALYFNKKMTKAFTTLNKDIGDFSARVENNIGGIRLVQAFGNEAFEKERFAVNNQRFRVTKLSSYKIMAKNGSISYMLTRFVTLFVLLCGTWFVIRGSLSYGEFVAFVLLTNVLFRPIDKINAIIEMYPRGIAGFKSYMELMETEPDIQDSPDSKDVSGLKGNIRYKHVSFGYDDHHNVLNDINLSIQAGETVAFVGPSGAGKSTLCSLLPRFYEASEGDITIDGISIKDMTLSSLRGQIGVVQQDVFLFSGTLRENIAYGRLGASEEDIWQAVKQAHLEELVHNMPDGLDTMIGERGVKLSGGQKQRLSIARMFLKNPSILILDEATSALDTETEAAIQKALQELSEGRTTLVIAHRLATIKDADRIVVVTNNGIEEQGRHQDLIEAGGLYSRLHQAQFGQMVHR

SEQ ID NO: 34825 - DNA, 23 bp, Primer
atggaacttcttgtacttgtctg

SEQ ID NO: 34826 - DNA, 21 bp, Primer
ttatgccgtccgggcaacggc

SEQ ID NO: 34827 - protein, 231 aa, consensus
  MISC_FEATURE (1)..(231): consensus for the disclosure of xaa see table XV
YXXXXXXXXXXXXXXXXXXXXXXXGXXXXXXGXXGXGKXTXXXLXXXXXXXXXGXXXXXGXXXXXXXXXXXRXXXXXVXQXXXLFXXXXXXNXXXXXXXXXXXXXXXXXXXXXXXXXXXXXXXXXXXXXXXXXXXXXXXXXXXXLSXGXXQXXXXARXXXXXXXXXXLDEXTXXXDXXXEXXXXXXXXXXXXXXXXTXXXIXHRLXXXXXXDXXXXXXXGXXXXXGXXXXL

SEQ ID NO: 34828 - protein, 65 aa, consensus
  MISC_FEATURE (1)..(65): consensus for the disclosure of xaa see table XV
XXXXXXXXXXXXXXXXXXXXXXXXXXXXXXXXXXXXXXXXGXXGXGKXXXXXXXXXXXXXXXGXX

SEQ ID NO: 34829 - protein, 78 aa, consensus
  MISC_FEATURE (1)..(78): consensus for the disclosure of xaa see table XV
XSXGXXXXXXXXXXXXXXXXXXXXDXXXXXXDXXXXXXXXXXXXXXXXXXXXXXXXXXHXXXXXXXXXXXXXXXXGXX

SEQ ID NO: 34830 - DNA, 1062 bp, Escherichia coli K12; identical to SEQ ID NO: 2732
  CDS (1)..(1062)

SEQ ID NO: 34831 - protein, 353 aa, Escherichia coli K12; identical to SEQ ID NO: 2733

SEQ ID NO: 34832 - DNA, 1444 bp, Pseudomonas fluorescens; identical to SEQ ID NO: 2734
  CDS (156)..(1214)

SEQ ID NO: 34833 - protein, 352 aa, Pseudomonas fluorescens; identical to SEQ ID NO: 2735

SEQ ID NO: 34834 - DNA, 1484 bp, Haemophilus influenzae; identical to SEQ ID NO: 2736
  CDS (278)..(1342)

SEQ ID NO: 34835 - protein, 354 aa, Haemophilus influenzae; identical to SEQ ID NO: 2737

SEQ ID NO: 34836 - DNA, 1131 bp, Thermus aquaticus; identical to SEQ ID NO: 2738
  CDS (62)..(1084)

SEQ ID NO: 34837 - protein, 340 aa, Thermus aquaticus; identical to SEQ ID NO: 2739

SEQ ID NO: 34838 - DNA, 1196 bp, Aquifex pyrophilus; identical to SEQ ID NO: 2740
  CDS (51)..(1097)

SEQ ID NO: 34839 - protein, 348 aa, Aquifex pyrophilus; identical to SEQ ID NO: 2741

SEQ ID NO: 34840 - DNA, 1023 bp, Rickettsia prowazekii; identical to SEQ ID NO: 2742
  CDS (1)..(1023)

SEQ ID NO: 34841 - protein, 340 aa, Rickettsia prowazekii; identical to SEQ ID NO: 2743

SEQ ID NO: 34842 - DNA, 1329 bp, Myxococcus xanthus; identical to SEQ ID NO: 2744
  CDS (201)..(1229)

SEQ ID NO: 34843 - protein, 342 aa, Myxococcus xanthus; identical to SEQ ID NO: 2745

SEQ ID NO: 34844 - DNA, 1394 bp, Legionella pneumophila; identical to SEQ ID NO: 2746
  CDS (166)..(1212)

SEQ ID NO: 34845 - protein, 348 aa, Legionella pneumophila; identical to SEQ ID NO: 2747

SEQ ID NO: 34846 - DNA, 1224 bp, Treponema pallidum subsp. pallidum (syphilis spirochete); identical to SEQ ID NO: 2748
  CDS (1)..(1224): k means g or t/u

SEQ ID NO: 34847 - protein, 407 aa, Treponema pallidum subsp. pallidum (syphilis spirochete); identical to SEQ ID NO: 2749
  misc_feature (375)..(375): Xaa can be Cys or Phe

SEQ ID NO: 34848 - DNA, 1050 bp, Clostridium acetobutylicum; identical to SEQ ID NO: 2750
  CDS (1)..(1050)

SEQ ID NO: 34849 - protein, 349 aa, Clostridium acetobutylicum; identical to SEQ ID NO: 2751

SEQ ID NO: 34850 - DNA, 1047 bp, Listeria innocua; identical to SEQ ID NO: 2752
  CDS (1)..(1047)

SEQ ID NO: 34851 - protein, 348 aa, Listeria innocua; identical to SEQ ID NO: 2753

SEQ ID NO: 34852 - DNA, 1137 bp, Brucella melitensis; identical to SEQ ID NO: 2754
  CDS (1)..(1137)

SEQ ID NO: 34853 - protein, 378 aa, Brucella melitensis; identical to SEQ ID NO: 2755

SEQ ID NO: 34854 - DNA, 1062 bp, Salmonella enterica subsp. enterica serovar Typhi; identical to SEQ ID NO: 2756
  CDS (1)..(1062)

SEQ ID NO: 34855 - protein, 353 aa, Salmonella enterica subsp. enterica serovar Typhi; identical to SEQ ID NO: 2757

SEQ ID NO: 34856 - DNA, 1074 bp, Nostoc sp. PCC 7120; identical to SEQ ID NO: 2758
  CDS (1)..(1074)

SEQ ID NO: 34857 - protein, 357 aa, Nostoc sp. PCC 7120; identical to SEQ ID NO: 2759

SEQ ID NO: 34858 - DNA, 1044 bp, Xylella fastidiosa; identical to SEQ ID NO: 2760
  CDS (1)..(1044)

SEQ ID NO: 34859 - protein, 347 aa, Xylella fastidiosa; identical to SEQ ID NO: 2761

SEQ ID NO: 34860 - DNA, 1164 bp, Lactococcus lactis subsp. lactis; identical to SEQ ID NO: 2762
  CDS (1)..(1164)

SEQ ID NO: 34861 - protein, 387 aa, Lactococcus lactis subsp. lactis; identical to SEQ ID NO: 2763

SEQ ID NO: 34862 - DNA, 2025 bp, Borrelia burgdorferi (Lyme disease spirochete); identical to SEQ ID NO: 2764
  CDS (25)..(1122)

SEQ ID NO: 34863 - protein, 365 aa, Borrelia burgdorferi (Lyme disease spirochete); identical to SEQ ID NO: 2765

SEQ ID NO: 34864 - DNA, 1728 bp, Deinococcus radiodurans; identical to SEQ ID NO: 2766
  CDS (399)..(1490)

SEQ ID NO: 34865 - protein, 363 aa, Deinococcus radiodurans; identical to SEQ ID NO: 2767

SEQ ID NO: 34866 - DNA, 1071 bp, Caulobacter crescentus; identical to SEQ ID NO: 2768
  CDS (1)..(1071)

SEQ ID NO: 34867 - protein, 356 aa, Caulobacter crescentus; identical to SEQ ID NO: 2769

SEQ ID NO: 34868 - DNA, 1199 bp, Thermotoga maritima; identical to SEQ ID NO: 2770
  CDS (67)..(1137)

SEQ ID NO: 34869 - protein, 356 aa, Thermotoga maritima; identical to SEQ ID NO: 2771

SEQ ID NO: 34870 - DNA, 1662 bp, Arabidopsis thaliana (mouse-ear cress); identical to SEQ ID NO: 2772
  CDS (368)..(1498)

SEQ ID NO: 34871 - protein, 376 aa, Arabidopsis thaliana (mouse-ear cress); identical to SEQ ID NO: 2773

SEQ ID NO: 34872 - DNA, 1038 bp, Aquifex aeolicus; identical to SEQ ID NO: 2774
  CDS (1)..(1038)

SEQ ID NO: 34873 - protein, 345 aa, Aquifex aeolicus; identical to SEQ ID NO: 2775

SEQ ID NO: 34874 - DNA, 1062 bp, Chlamydophila pneumoniae, Chlamydia pneumoniae; identical to SEQ ID NO: 2776
  CDS (1)..(1062)

SEQ ID NO: 34875 - protein, 353 aa, Chlamydophila pneumoniae, Chlamydia pneumoniae; identical to SEQ ID NO: 2777

SEQ ID NO: 34876 - DNA, 1047 bp, Neisseria meningitidis; identical to SEQ ID NO: 2778
  CDS (1)..(1047)

SEQ ID NO: 34877 - protein, 348 aa, Neisseria meningitidis; identical to SEQ ID NO: 2779

SEQ ID NO: 34878 - DNA, 1032 bp, Campylobacter jejuni; identical to SEQ ID NO: 2780
  CDS (1)..(1032)

SEQ ID NO: 34879 - protein, 343 aa, Campylobacter jejuni; identical to SEQ ID NO: 2781

SEQ ID NO: 34880 - DNA, 1065 bp, Chlamydia muridarum, Chlamydia trachomatis MoPn; identical to SEQ ID NO: 2782
  CDS (1)..(1065)

SEQ ID NO: 34881 - protein, 354 aa, Chlamydia muridarum, Chlamydia trachomatis MoPn; identical to SEQ ID NO: 2783

SEQ ID NO: 34882 - DNA, 1050 bp, Bacillus halodurans; identical to SEQ ID NO: 2784
  CDS (1)..(1050)

SEQ ID NO: 34883 - protein, 349 aa, Bacillus halodurans; identical to SEQ ID NO: 2785

SEQ ID NO: 34884 - DNA, 1229 bp, Streptococcus pneumoniae; identical to SEQ ID NO: 2786
  CDS (26)..(1192)

SEQ ID NO: 34885 - protein, 388 aa, Streptococcus pneumoniae; identical to SEQ ID NO: 2787

SEQ ID NO: 34886 - DNA, 1251 bp, Agrobacterium tumefaciens; identical to SEQ ID NO: 2788
  CDS (1)..(1251)

SEQ ID NO: 34887 - protein, 416 aa, Agrobacterium tumefaciens; identical to SEQ ID NO: 2789

SEQ ID NO: 34888 - DNA, 1044 bp, Staphylococcus aureus; identical to SEQ ID NO: 2790
  CDS (1)..(1044)

SEQ ID NO: 34889 - protein, 347 aa, Staphylococcus aureus; identical to SEQ ID NO: 2791

SEQ ID NO: 34890 - DNA, 1506 bp, Acinetobacter calcoaceticus; identical to SEQ ID NO: 2792
  CDS (403)..(1452)

SEQ ID NO: 34891 - protein, 349 aa, Acinetobacter calcoaceticus; identical to SEQ ID NO: 2793

SEQ ID NO: 34892 - DNA, 1479 bp, Brucella abortus; identical to SEQ ID NO: 2794
  CDS (316)..(1398)

SEQ ID NO: 34893 - protein, 360 aa, Brucella abortus; identical to SEQ ID NO: 2795

SEQ ID NO: 34894 - DNA, 981 bp, Streptococcus pyogenes; identical to SEQ ID NO: 2796
  CDS (1)..(981)

SEQ ID NO: 34895 - protein, 326 aa, Streptococcus pyogenes; identical to SEQ ID NO: 2797

SEQ ID NO: 34896 - DNA, 1349 bp, Leptospira biflexa; identical to SEQ ID NO: 2798
  CDS (107)..(1270)

SEQ ID NO: 34897 - protein, 387 aa, Leptospira biflexa; identical to SEQ ID NO: 2799

SEQ ID NO: 34898 - DNA, 1762 bp, Xanthomonas campestris pv. campestris; identical to SEQ ID NO: 2800
  CDS (159)..(1190)

SEQ ID NO: 34899 - protein, 343 aa, Xanthomonas campestris pv. campestris; identical to SEQ ID NO: 2801

SEQ ID NO: 34900 - DNA, 1212 bp, Aeromonas salmonicida; identical to SEQ ID NO: 2802
  CDS (151)..(1212)

SEQ ID NO: 34901 - protein, 353 aa, Aeromonas salmonicida; identical to SEQ ID NO: 2803

SEQ ID NO: 34902 - DNA, 1433 bp, Azotobacter vinelandii; identical to SEQ ID NO: 2804
  CDS (311)..(1360)

SEQ ID NO: 34903 - protein, 349 aa, Azotobacter vinelandii; identical to SEQ ID NO: 2805

SEQ ID NO: 34904 - DNA, 1108 bp, Acetobacter polyoxogenes; identical to SEQ ID NO: 2806
  CDS (35)..(1081)

SEQ ID NO: 34905 - protein, 348 aa, Acetobacter polyoxogenes; identical to SEQ ID NO: 2807

SEQ ID NO: 34906 - DNA, 1230 bp, Neisseria gonorrhoeae; identical to SEQ ID NO: 2808
  CDS (133)..(1179)

SEQ ID NO: 34907 - protein, 348 aa, Neisseria gonorrhoeae; identical to SEQ ID NO: 2809

SEQ ID NO: 34908 - DNA, 1649 bp, Bacteroides fragilis; identical to SEQ ID NO: 2810
  CDS (351)..(1307)

SEQ ID NO: 34909 - protein, 318 aa, Bacteroides fragilis; identical to SEQ ID NO: 2811

SEQ ID NO: 34910 - DNA, 1349 bp, Methylobacillus sp; identical to SEQ ID NO: 2812
  CDS (293)..(1327)

SEQ ID NO: 34911 - protein, 344 aa, Methylobacillus sp; identical to SEQ ID NO: 2813

SEQ ID NO: 34912 - DNA, 1320 bp, Vibrio anguillarum; identical to SEQ ID NO: 2814
  CDS (166)..(1212)

SEQ ID NO: 34913 - protein, 348 aa, Vibrio anguillarum; identical to SEQ ID NO: 2815

SEQ ID NO: 34914 - DNA, 1394 bp, Anabaena variabilis; identical to SEQ ID NO: 2816
  CDS (125)..(1201)

SEQ ID NO: 34915 - protein, 358 aa, Anabaena variabilis; identical to SEQ ID NO: 2817

SEQ ID NO: 34916 - DNA, 1334 bp, Bacillus subtilis; identical to SEQ ID NO: 2818
  CDS (215)..(1258)

SEQ ID NO: 34917 - protein, 347 aa, Bacillus subtilis; identical to SEQ ID NO: 2819

SEQ ID NO: 34918 - DNA, 1348 bp, Proteus mirabilis; identical to SEQ ID NO: 2820
  CDS (151)..(1218)

SEQ ID NO: 34919 - protein, 355 aa, Proteus mirabilis; identical to SEQ ID NO: 2821

SEQ ID NO: 34920 - DNA, 1384 bp, Pseudomonas aeruginosa; identical to SEQ ID NO: 2822
  CDS (145)..(1185)

SEQ ID NO: 34921 - protein, 346 aa, Pseudomonas aeruginosa; identical to SEQ ID NO: 2823

SEQ ID NO: 34922 - DNA, 1352 bp, Pseudomonas cepacia; identical to SEQ ID NO: 2824
  CDS (223)..(1266)

SEQ ID NO: 34923 - protein, 347 aa, Pseudomonas cepacia; identical to SEQ ID NO: 2825

SEQ ID NO: 34924 - DNA, 1047 bp, Synechococcus sp; identical to SEQ ID NO: 2826
  CDS (1)..(1047)

SEQ ID NO: 34925 - protein, 348 aa, Synechococcus sp; identical to SEQ ID NO: 2827

SEQ ID NO: 34926 - DNA, 1190 bp, Aquaspirillum magnetotacticum; identical to SEQ ID NO: 2828
  CDS (112)..(1146)

SEQ ID NO: 34927 - protein, 344 aa, Aquaspirillum magnetotacticum; identical to SEQ ID NO: 2829

SEQ ID NO: 34928 - DNA, 1841 bp, Rhizobium leguminosarum bv. viciae; identical to SEQ ID NO: 2830
  CDS (32)..(1087)

SEQ ID NO: 34929 - protein, 351 aa, Rhizobium leguminosarum bv. viciae; identical to SEQ ID NO: 2831

SEQ ID NO: 34930 - DNA, 1047 bp, Rhizobium meliloti; identical to SEQ ID NO: 2832
  CDS (1)..(1047)

SEQ ID NO: 34931 - protein, 348 aa, Rhizobium meliloti; identical to SEQ ID NO: 2833

SEQ ID NO: 34932 - DNA, 2762 bp, Mycobacterium tuberculosis; identical to SEQ ID NO: 2834
  CDS (311)..(2683)

SEQ ID NO: 34933 - protein, 790 aa, Mycobacterium tuberculosis; identical to SEQ ID NO: 2835

SEQ ID NO: 34934 - DNA, 1249 bp, Methylomonas clara; identical to SEQ ID NO: 2836
  CDS (123)..(1151)

SEQ ID NO: 34935 - protein, 342 aa, Methylomonas clara; identical to SEQ ID NO: 2837

SEQ ID NO: 34936 - DNA, 1065 bp, Enterobacter agglomerans; identical to SEQ ID NO: 2838
  CDS (1)..(1065)

SEQ ID NO: 34937 - protein, 354 aa, Enterobacter agglomerans; identical to SEQ ID NO: 2839

SEQ ID NO: 34938 - DNA, 1125 bp, Streptomyces lividans; identical to SEQ ID NO: 2840
  CDS (1)..(1125)

SEQ ID NO: 34939 - protein, 374 aa, Streptomyces lividans; identical to SEQ ID NO: 2841

SEQ ID NO: 34940 - DNA, 1347 bp, Rhodobacter sphaeroides; identical to SEQ ID NO: 2842
  CDS (220)..(1251)

SEQ ID NO: 34941 - protein, 343 aa, Rhodobacter sphaeroides; identical to SEQ ID NO: 2843

SEQ ID NO: 34942 - DNA, 1065 bp, Vibrio cholerae; identical to SEQ ID NO: 2844
  CDS (1)..(1065)

SEQ ID NO: 34943 - protein, 354 aa, Vibrio cholerae; identical to SEQ ID NO: 2845

SEQ ID NO: 34944 - DNA, 1068 bp, Rhodobacter capsulatus; identical to SEQ ID NO: 2846
  CDS (1)..(1068)

SEQ ID NO: 34945 - protein, 355 aa, Rhodobacter capsulatus; identical to SEQ ID NO: 2847

SEQ ID NO: 34946 - DNA, 1533 bp, Helicobacter pylori; identical to SEQ ID NO: 2848
  CDS (275)..(1318)

SEQ ID NO: 34947 - protein, 347 aa, Helicobacter pylori; identical to SEQ ID NO: 2849

SEQ ID NO: 34948 - DNA, 1065 bp, Synechocystis sp; identical to SEQ ID NO: 2850
  CDS (1)..(1065)

SEQ ID NO: 34949 - protein, 354 aa, Synechocystis sp; identical to SEQ ID NO: 2851

SEQ ID NO: 34950 - DNA, 1351 bp, Arabidopsis thaliana (mouse-ear cress); identical to SEQ ID NO: 2852
  CDS (1)..(1320)

SEQ ID NO: 34951 - protein, 439 aa, Arabidopsis thaliana (mouse-ear cress); identical to SEQ ID NO: 2853

SEQ ID NO: 34952 - DNA, 1392 bp, Pseudomonas putida; identical to SEQ ID NO: 2854
  CDS (111)..(1178)

SEQ ID NO: 34953 - protein, 355 aa, Pseudomonas putida; identical to SEQ ID NO: 2855

SEQ ID NO: 34954 - DNA, 1053 bp, Mycobacterium tuberculosis; identical to SEQ ID NO: 2856
  CDS (1)..(1053)

SEQ ID NO: 34955 - protein, 350 aa, Mycobacterium tuberculosis; identical to SEQ ID NO: 2857

SEQ ID NO: 34956 - DNA, 1053 bp, Wolinella succinogenes; identical to SEQ ID NO: 2858
  CDS (1)..(1053)

SEQ ID NO: 34957 - protein, 350 aa, Wolinella succinogenes; identical to SEQ ID NO: 2859

SEQ ID NO: 34958 - DNA, 1110 bp, Vibrio vulnificus; identical to SEQ ID NO: 2860
  CDS (1)..(1110)

SEQ ID NO: 34959 - protein, 369 aa, Vibrio vulnificus; identical to SEQ ID NO: 2861

SEQ ID NO: 34960 - DNA, 1068 bp, Photorhabdus luminescens; identical to SEQ ID NO: 2862
  CDS (1)..(1068)

SEQ ID NO: 34961 - protein, 355 aa, Photorhabdus luminescens; identical to SEQ ID NO: 2863

SEQ ID NO: 34962 - DNA, 1110 bp, Gloeobacter violaceus; identical to SEQ ID NO: 2864
  CDS (1)..(1110)

SEQ ID NO: 34963 - protein, 369 aa, Gloeobacter violaceus; identical to SEQ ID NO: 2865

SEQ ID NO: 34964 - DNA, 1053 bp, Chromobacterium violaceum; identical to SEQ ID NO: 2866
  CDS (1)..(1053)

SEQ ID NO: 34965 - protein, 350 aa, Chromobacterium violaceum; identical to SEQ ID NO: 2867

SEQ ID NO: 34966 - DNA, 1128 bp, Synechococcus sp; identical to SEQ ID NO: 2868
  CDS (1)..(1128)

SEQ ID NO: 34967 - protein, 375 aa, Synechococcus sp; identical to SEQ ID NO: 2869

SEQ ID NO: 34968 - DNA, 1128 bp, Rhodopirellula baltica; identical to SEQ ID NO: 2870
  CDS (1)..(1128)

SEQ ID NO: 34969 - protein, 375 aa, Rhodopirellula baltica; identical to SEQ ID NO: 2871

SEQ ID NO: 34970 - DNA, 1113 bp, Prochlorococcus marinus subsp; identical to SEQ ID NO: 2872
  CDS (1)..(1113)

SEQ ID NO: 34971 - protein, 370 aa, Prochlorococcus marinus subsp; identical to SEQ ID NO: 2873

SEQ ID NO: 34972 - DNA, 1140 bp, Prochlorococcus marinus; identical to SEQ ID NO: 2874
  CDS (1)..(1140)

SEQ ID NO: 34973 - protein, 379 aa, Prochlorococcus marinus; identical to SEQ ID NO: 2875

SEQ ID NO: 34974 - DNA, 1140 bp, Prochlorococcus marinus; identical to SEQ ID NO: 2876
  CDS (1)..(1140)

SEQ ID NO: 34975 - protein, 379 aa, Prochlorococcus marinus; identical to SEQ ID NO: 2877

SEQ ID NO: 34976 - DNA, 1038 bp, Helicobacter hepaticus; identical to SEQ ID NO: 2878
  CDS (1)..(1038)

SEQ ID NO: 34977 - protein, 345 aa, Helicobacter hepaticus; identical to SEQ ID NO: 2879

SEQ ID NO: 34978 - DNA, 1119 bp, Haemophilus ducreyi; identical to SEQ ID NO: 2880
  CDS (1)..(1119)

SEQ ID NO: 34979 - protein, 372 aa, Haemophilus ducreyi; identical to SEQ ID NO: 2881

SEQ ID NO: 34980 - DNA, 1048 bp, Campylobacter lari; identical to SEQ ID NO: 2882
  CDS (9)..(1043)

SEQ ID NO: 34981 - protein, 344 aa, Campylobacter lari; identical to SEQ ID NO: 2883

SEQ ID NO: 34982 - DNA, 1077 bp, Burkholderia fungorum; identical to SEQ ID NO: 2884
  CDS (1)..(1077)

SEQ ID NO: 34983 - protein, 358 aa, Burkholderia fungorum; identical to SEQ ID NO: 2885

SEQ ID NO: 34984 - DNA, 963 bp, Mycobacteriophage CJW1; identical to SEQ ID NO: 2886
  CDS (1)..(963)

SEQ ID NO: 34985 - protein, 320 aa, Mycobacteriophage CJW1; identical to SEQ ID NO: 2887

SEQ ID NO: 34986 - DNA, 1563 bp, Zymomonas mobilis; identical to SEQ ID NO: 2888
  CDS (231)..(1250)

SEQ ID NO: 34987 - protein, 339 aa, Zymomonas mobilis; identical to SEQ ID NO: 2889

SEQ ID NO: 34988 - DNA, 1038 bp, Bacillus megaterium; identical to SEQ ID NO: 2890
  CDS (1)..(1038)

SEQ ID NO: 34989 - protein, 345 aa, Bacillus megaterium; identical to SEQ ID NO: 2891

SEQ ID NO: 34990 - DNA, 1038 bp, Bacillus megaterium; identical to SEQ ID NO: 2892
  CDS (1)..(1038)

SEQ ID NO: 34991 - protein, 345 aa, Bacillus megaterium; identical to SEQ ID NO: 2893

SEQ ID NO: 34992 - DNA, 1044 bp, Bacillus amyloliquefaciens; identical to SEQ ID NO: 2894
  CDS (1)..(1044)

SEQ ID NO: 34993 - protein, 347 aa, Bacillus amyloliquefaciens; identical to SEQ ID NO: 2895

SEQ ID NO: 34994 - DNA, 1047 bp, Listeria monocytogenes; identical to SEQ ID NO: 2896
  CDS (1)..(1047): m means a or c

SEQ ID NO: 34995 - protein, 348 aa, Listeria monocytogenes; identical to SEQ ID NO: 2897
  misc_feature (228)..(228): Xaa can be Gln or Pro

SEQ ID NO: 34996 - DNA, 1035 bp, Oryza sativa; identical to SEQ ID NO: 2898
  CDS (1)..(1035)

SEQ ID NO: 34997 - protein, 344 aa, Oryza sativa; identical to SEQ ID NO: 2899

SEQ ID NO: 34998 - DNA, 1035 bp, Campylobacter lari; identical to SEQ ID NO: 2900
  CDS (1)..(1035)

SEQ ID NO: 34999 - protein, 344 aa, Campylobacter lari; identical to SEQ ID NO: 2901

SEQ ID NO: 35000 - DNA, 2035 bp, Borrelia hermsii; identical to SEQ ID NO: 2902
  CDS (256)..(1326)

SEQ ID NO: 35001 - protein, 356 aa, Borrelia hermsii; identical to SEQ ID NO: 2903

SEQ ID NO: 35002 - DNA, 1487 bp, Chlamydomonas reinhardtii; identical to SEQ ID NO: 2904
  CDS (121)..(1365)

SEQ ID NO: 35003 - protein, 414 aa, Chlamydomonas reinhardtii; identical to SEQ ID NO: 2905

SEQ ID NO: 35004 - DNA, 1669 bp, Streptococcus suis; identical to SEQ ID NO: 2906
  CDS (469)..(1500)

SEQ ID NO: 35005 - protein, 343 aa, Streptococcus suis; identical to SEQ ID NO: 2907

SEQ ID NO: 35006 - DNA, 1439 bp, Peanut witches; identical to SEQ ID NO: 2908
  CDS (218)..(1228)

SEQ ID NO: 35007 - protein, 336 aa, Peanut witches; identical to SEQ ID NO: 2909

SEQ ID NO: 35008 - DNA, 1377 bp, Myxococcus xanthus; identical to SEQ ID NO: 2910
  CDS (201)..(1277)

SEQ ID NO: 35009 - protein, 358 aa, Myxococcus xanthus; identical to SEQ ID NO: 2911

SEQ ID NO: 35010 - DNA, 1404 bp, Acidiphilium facilis; identical to SEQ ID NO: 2912
  CDS (187)..(1251)

SEQ ID NO: 35011 - protein, 354 aa, Acidiphilium facilis; identical to SEQ ID NO: 2913

SEQ ID NO: 35012 - DNA, 1059 bp, Actinobacillus actinomycetemcomitans; identical to SEQ ID NO: 2914
  CDS (1)..(1059)

SEQ ID NO: 35013 - protein, 352 aa, Actinobacillus actinomycetemcomitans; identical to SEQ ID NO: 2915

SEQ ID NO: 35014 - DNA, 1565 bp, Alcaligenes eutrophus; identical to SEQ ID NO: 2916
  CDS (194)..(1255)

SEQ ID NO: 35015 - protein, 353 aa, Alcaligenes eutrophus; identical to SEQ ID NO: 2917

SEQ ID NO: 35016 - DNA, 1047 bp, Amycolatopsis mediterranei; identical to SEQ ID NO: 2918
  CDS (1)..(1047)

SEQ ID NO: 35017 - protein, 348 aa, Amycolatopsis mediterranei; identical to SEQ ID NO: 2919

SEQ ID NO: 35018 - DNA, 1035 bp, Bacteroides thetaiotaomicron; identical to SEQ ID NO: 2920
  CDS (1)..(1035)

SEQ ID NO: 35019 - protein, 344 aa, Bacteroides thetaiotaomicron; identical to SEQ ID NO: 2921

SEQ ID NO: 35020 - DNA, 1194 bp, Bifidobacterium longum; identical to SEQ ID NO: 2922
  CDS (1)..(1194)

SEQ ID NO: 35021 - protein, 397 aa, Bifidobacterium longum; identical to SEQ ID NO: 2923

SEQ ID NO: 35022 - DNA, 1062 bp, Bordetella pertussis; identical to SEQ ID NO: 2924
  CDS (1)..(1062)

SEQ ID NO: 35023 - protein, 353 aa, Bordetella pertussis; identical to SEQ ID NO: 2925

SEQ ID NO: 35024 - DNA, 1089 bp, Bradyrhizobium japonicum; identical to SEQ ID NO: 2926
  CDS (1)..(1089)

SEQ ID NO: 35025 - protein, 362 aa, Bradyrhizobium japonicum; identical to SEQ ID NO: 2927

SEQ ID NO: 35026 - DNA, 2058 bp, Campylobacter fetus; identical to SEQ ID NO: 2928
  CDS (401)..(1438)

SEQ ID NO: 35027 - protein, 345 aa, Campylobacter fetus; identical to SEQ ID NO: 2929

SEQ ID NO: 35028 - DNA, 1458 bp, Chloroflexus aurantiacus; identical to SEQ ID NO: 2930
  CDS (116)..(1171)

SEQ ID NO: 35029 - protein, 351 aa, Chloroflexus aurantiacus; identical to SEQ ID NO: 2931

SEQ ID NO: 35030 - DNA, 1053 bp, Chlamydophila caviae; identical to SEQ ID NO: 2932
  CDS (1)..(1053)

SEQ ID NO: 35031 - protein, 350 aa, Chlamydophila caviae; identical to SEQ ID NO: 2933

SEQ ID NO: 35032 - DNA, 1087 bp, Chromatium vinosum; identical to SEQ ID NO: 2934
  CDS (1)..(1044)

SEQ ID NO: 35033 - protein, 347 aa, Chromatium vinosum; identical to SEQ ID NO: 2935

SEQ ID NO: 35034 - DNA, 1346 bp, Clostridium perfringens; identical to SEQ ID NO: 2936
  CDS (172)..(1230)

SEQ ID NO: 35035 - protein, 352 aa, Clostridium perfringens; identical to SEQ ID NO: 2937

SEQ ID NO: 35036 - DNA, 1053 bp, Clostridium tetani; identical to SEQ ID NO: 2938
  CDS (1)..(1053)

SEQ ID NO: 35037 - protein, 350 aa, Clostridium tetani; identical to SEQ ID NO: 2939

SEQ ID NO: 35038 - DNA, 1161 bp, Corynebacterium efficiens; identical to SEQ ID NO: 2940
  CDS (1)..(1161)

SEQ ID NO: 35039 - protein, 386 aa, Corynebacterium efficiens; identical to SEQ ID NO: 2941

SEQ ID NO: 35040 - DNA, 1402 bp, Corynebacterium glutamicum; identical to SEQ ID NO: 2942
  CDS (133)..(1263)

SEQ ID NO: 35041 - protein, 376 aa, Corynebacterium glutamicum; identical to SEQ ID NO: 2943

SEQ ID NO: 35042 - DNA, 1409 bp, Corynebacterium pseudotuberculosis; identical to SEQ ID NO: 2944
  CDS (223)..(1332)

SEQ ID NO: 35043 - protein, 369 aa, Corynebacterium pseudotuberculosis; identical to SEQ ID NO: 2945

SEQ ID NO: 35044 - DNA, 1032 bp, Coxiella burnetii; identical to SEQ ID NO: 2946
  CDS (1)..(1032)

SEQ ID NO: 35045 - protein, 343 aa, Coxiella burnetii; identical to SEQ ID NO: 2947

SEQ ID NO: 35046 - DNA, 1047 bp, Enterococcus faecalis; identical to SEQ ID NO: 2948
  CDS (1)..(1047)

SEQ ID NO: 35047 - protein, 348 aa, Enterococcus faecalis; identical to SEQ ID NO: 2949

SEQ ID NO: 35048 - DNA, 1072 bp, Erwinia carotovora; identical to SEQ ID NO: 2950
  CDS (1)..(1029)

SEQ ID NO: 35049 - protein, 342 aa, Erwinia carotovora; identical to SEQ ID NO: 2951

SEQ ID NO: 35050 - DNA, 1137 bp, Fusobacterium nucleatum; identical to SEQ ID NO: 2952
  CDS (1)..(1137)

SEQ ID NO: 35051 - protein, 378 aa, Fusobacterium nucleatum; identical to SEQ ID NO: 2953

SEQ ID NO: 35052 - DNA, 1613 bp, Herbaspirillum seropedicae; identical to SEQ ID NO: 2954
  CDS (199)..(1254)

SEQ ID NO: 35053 - protein, 351 aa, Herbaspirillum seropedicae; identical to SEQ ID NO: 2955

SEQ ID NO: 35054 - DNA, 1143 bp, Lactobacillus plantarum; identical to SEQ ID NO: 2956
  CDS (1)..(1143)

SEQ ID NO: 35055 - protein, 380 aa, Lactobacillus plantarum; identical to SEQ ID NO: 2957

SEQ ID NO: 35056 - DNA, 1101 bp, Leptospira interrogans; identical to SEQ ID NO: 2958
  CDS (1)..(1101)

SEQ ID NO: 35057 - protein, 366 aa, Leptospira interrogans; identical to SEQ ID NO: 2959

SEQ ID NO: 35058 - DNA, 1126 bp, Mycoplasma mycoides; identical to SEQ ID NO: 2960
  CDS (79)..(1116)

SEQ ID NO: 35059 - protein, 345 aa, Mycoplasma mycoides; identical to SEQ ID NO: 2961

SEQ ID NO: 35060 - DNA, 1050 bp, Mycobacterium smegmatis; identical to SEQ ID NO: 2962
  CDS (1)..(1050)

SEQ ID NO: 35061 - protein, 349 aa, Mycobacterium smegmatis; identical to SEQ ID NO: 2963

SEQ ID NO: 35062 - DNA, 1044 bp, Oceanobacillus iheyensis; identical to SEQ ID NO: 2964
  CDS (1)..(1044)

SEQ ID NO: 35063 - protein, 347 aa, Oceanobacillus iheyensis; identical to SEQ ID NO: 2965

SEQ ID NO: 35064 - DNA, 1071 bp, Paracoccus denitrificans; identical to SEQ ID NO: 2966
  CDS (1)..(1071)

SEQ ID NO: 35065 - protein, 356 aa, Paracoccus denitrificans; identical to SEQ ID NO: 2967

SEQ ID NO: 35066 - DNA, 1320 bp, Pasteurella haemolytica; identical to SEQ ID NO: 2968
  CDS (157)..(1263)

SEQ ID NO: 35067 - protein, 368 aa, Pasteurella haemolytica; identical to SEQ ID NO: 2969

SEQ ID NO: 35068 - DNA, 1500 bp, Pasteurella multocida; identical to SEQ ID NO: 2970
  CDS (175)..(1239)

SEQ ID NO: 35069 - protein, 354 aa, Pasteurella multocida; identical to SEQ ID NO: 2971

SEQ ID NO: 35070 - DNA, 1023 bp, Porphyromonas gingivalis; identical to SEQ ID NO: 2972
  CDS (1)..(1023)

SEQ ID NO: 35071 - protein, 340 aa, Porphyromonas gingivalis; identical to SEQ ID NO: 2973

SEQ ID NO: 35072 - DNA, 1824 bp, Prevotella ruminicola; identical to SEQ ID NO: 2974
  CDS (501)..(1523)

SEQ ID NO: 35073 - protein, 340 aa, Prevotella ruminicola; identical to SEQ ID NO: 2975

SEQ ID NO: 35074 - DNA, 978 bp, Proteus vulgaris; identical to SEQ ID NO: 2976
  CDS (1)..(978)

SEQ ID NO: 35075 - protein, 325 aa, Proteus vulgaris; identical to SEQ ID NO: 2977

SEQ ID NO: 35076 - DNA, 1047 bp, Pseudomonas oleovorans; identical to SEQ ID NO: 2978
  CDS (1)..(1047)

SEQ ID NO: 35077 - protein, 348 aa, Pseudomonas oleovorans; identical to SEQ ID NO: 2979

SEQ ID NO: 35078 - DNA, 1068 bp, Pseudomonas putida; identical to SEQ ID NO: 2980
  CDS (1)..(1068)

SEQ ID NO: 35079 - protein, 355 aa, Pseudomonas putida; identical to SEQ ID NO: 2981

SEQ ID NO: 35080 - DNA, 1110 bp, Pseudomonas syringae; identical to SEQ ID NO: 2982
  CDS (46)..(1110)

SEQ ID NO: 35081 - protein, 354 aa, Pseudomonas syringae; identical to SEQ ID NO: 2983

SEQ ID NO: 35082 - DNA, 1980 bp, Pseudomonas tolaasii; identical to SEQ ID NO: 2984
  CDS (414)..(1472)

SEQ ID NO: 35083 - protein, 352 aa, Pseudomonas tolaasii; identical to SEQ ID NO: 2985

SEQ ID NO: 35084 - DNA, 1501 bp, Rhizobium etli; identical to SEQ ID NO: 2986
  CDS (242)..(1327)

SEQ ID NO: 35085 - protein, 361 aa, Rhizobium etli; identical to SEQ ID NO: 2987

SEQ ID NO: 35086 - DNA, 1098 bp, Rhizobium loti; identical to SEQ ID NO: 2988
  CDS (1)..(1098)

SEQ ID NO: 35087 - protein, 365 aa, Rhizobium loti; identical to SEQ ID NO: 2989

SEQ ID NO: 35088 - DNA, 1092 bp, Rhodopseudomonas palustris; identical to SEQ ID NO: 2990
  CDS (1)..(1092)

SEQ ID NO: 35089 - protein, 363 aa, Rhodopseudomonas palustris; identical to SEQ ID NO: 2991

SEQ ID NO: 35090 - DNA, 1047 bp, Rhodopseudomonas viridis; identical to SEQ ID NO: 2992
  CDS (1)..(1047)

SEQ ID NO: 35091 - protein, 348 aa, Rhodopseudomonas viridis; identical to SEQ ID NO: 2993

SEQ ID NO: 35092 - DNA, 1074 bp, Shewanella oneidensis; identical to SEQ ID NO: 2994
  CDS (1)..(1074)

SEQ ID NO: 35093 - protein, 357 aa, Shewanella oneidensis; identical to SEQ ID NO: 2995

SEQ ID NO: 35094 - DNA, 1235 bp, Spirulina platensis; identical to SEQ ID NO: 2996
  CDS (54)..(1151)

SEQ ID NO: 35095 - protein, 365 aa, Spirulina platensis; identical to SEQ ID NO: 2997

SEQ ID NO: 35096 - DNA, 1074 bp, Staphylococcus epidermidis; identical to SEQ ID NO: 2998
  CDS (25)..(1074)

SEQ ID NO: 35097 - protein, 349 aa, Staphylococcus epidermidis; identical to SEQ ID NO: 2999

SEQ ID NO: 35098 - DNA, 1140 bp, Streptococcus agalactiae; identical to SEQ ID NO: 3000
  CDS (1)..(1140)

SEQ ID NO: 35099 - protein, 379 aa, Streptococcus agalactiae; identical to SEQ ID NO: 3001

SEQ ID NO: 35100 - DNA, 1119 bp, Streptomyces ambofaciens; identical to SEQ ID NO: 3002
  CDS (1)..(1119)

SEQ ID NO: 35101 - protein, 372 aa, Streptomyces ambofaciens; identical to SEQ ID NO: 3003

SEQ ID NO: 35102 - DNA, 1134 bp, Streptomyces avermitilis; identical to SEQ ID NO: 3004
  CDS (1)..(1134)

SEQ ID NO: 35103 - protein, 377 aa, Streptomyces avermitilis; identical to SEQ ID NO: 3005

SEQ ID NO: 35104 - DNA, 1152 bp, Streptococcus mutans; identical to SEQ ID NO: 3006
  CDS (1)..(1152)

SEQ ID NO: 35105 - protein, 383 aa, Streptococcus mutans; identical to SEQ ID NO: 3007

SEQ ID NO: 35106 - DNA, 1137 bp, Streptococcus pyogenes; identical to SEQ ID NO: 3008
  CDS (1)..(1137)

SEQ ID NO: 35107 - protein, 378 aa, Streptococcus pyogenes; identical to SEQ ID NO: 3009

SEQ ID NO: 35108 - DNA, 1356 bp, Streptococcus parasanguis; identical to SEQ ID NO: 3010
  CDS (118)..(1263)

SEQ ID NO: 35109 - protein, 381 aa, Streptococcus parasanguis; identical to SEQ ID NO: 3011

SEQ ID NO: 35110 - DNA, 1416 bp, Streptomyces rimosus; identical to SEQ ID NO: 3012
  CDS (229)..(1359)

SEQ ID NO: 35111 - protein, 376 aa, Streptomyces rimosus; identical to SEQ ID NO: 3013

SEQ ID NO: 35112 - DNA, 1916 bp, Streptococcus thermophilus; identical to SEQ ID NO: 3014
  CDS (555)..(1694)

SEQ ID NO: 35113 - protein, 379 aa, Streptococcus thermophilus; identical to SEQ ID NO: 3015

SEQ ID NO: 35114 - DNA, 1271 bp, Streptomyces violaceus; identical to SEQ ID NO: 3016
  CDS (75)..(1208)

SEQ ID NO: 35115 - protein, 377 aa, Streptomyces violaceus; identical to SEQ ID NO: 3017

SEQ ID NO: 35116 - DNA, 1068 bp, Synechococcus elongatus; identical to SEQ ID NO: 3018
  CDS (1)..(1068)

SEQ ID NO: 35117 - protein, 355 aa, Synechococcus elongatus; identical to SEQ ID NO: 3019

SEQ ID NO: 35118 - DNA, 1023 bp, Thermus thermophilus; identical to SEQ ID NO: 3020
  CDS (1)..(1023)

SEQ ID NO: 35119 - protein, 340 aa, Thermus thermophilus; identical to SEQ ID NO: 3021

SEQ ID NO: 35120 - DNA, 1405 bp, Thiobacillus ferrooxidans; identical to SEQ ID NO: 3022
  CDS (196)..(1236)

SEQ ID NO: 35121 - protein, 346 aa, Thiobacillus ferrooxidans; identical to SEQ ID NO: 3023

SEQ ID NO: 35122 - DNA, 1314 bp, Tropheryma whipplei; identical to SEQ ID NO: 3024
  CDS (1)..(1314)

SEQ ID NO: 35123 - protein, 437 aa, Tropheryma whipplei; identical to SEQ ID NO: 3025

SEQ ID NO: 35124 - DNA, 1411 bp, Vibrio cholerae; identical to SEQ ID NO: 3026
  CDS (183)..(1247)

SEQ ID NO: 35125 - protein, 354 aa, Vibrio cholerae; identical to SEQ ID NO: 3027

SEQ ID NO: 35126 - DNA, 1044 bp, Vibrio parahaemolyticus; identical to SEQ ID NO: 3028
  CDS (1)..(1044)

SEQ ID NO: 35127 - protein, 347 aa, Vibrio parahaemolyticus; identical to SEQ ID NO: 3029

SEQ ID NO: 35128 - DNA, 996 bp, Wigglesworthia glossinidia brevipalpis; identical to SEQ ID NO: 3030
  CDS (1)..(996)

SEQ ID NO: 35129 - protein, 331 aa, Wigglesworthia glossinidia brevipalpis; identical to SEQ ID NO: 3031

SEQ ID NO: 35130 - DNA, 1035 bp, Xanthomonas axonopodis; identical to SEQ ID NO: 3032
  CDS (1)..(1035)

SEQ ID NO: 35131 - protein, 344 aa, Xanthomonas axonopodis; identical to SEQ ID NO: 3033

SEQ ID NO: 35132 - DNA, 1594 bp, Xenorhabdus nematophilus; identical to SEQ ID NO: 3034
  CDS (142)..(1218)

SEQ ID NO: 35133 - protein, 358 aa, Xenorhabdus nematophilus; identical to SEQ ID NO: 3035

SEQ ID NO: 35134 - DNA, 1044 bp, Xylella fastidiosa; identical to SEQ ID NO: 3036
  CDS (1)..(1044)

SEQ ID NO: 35135 - protein, 347 aa, Xylella fastidiosa; identical to SEQ ID NO: 3037

SEQ ID NO: 35136 - DNA, 1020 bp, Zymomonas mobilis; identical to SEQ ID NO: 3038
  CDS (1)..(1020)

SEQ ID NO: 35137 - protein, 339 aa, Zymomonas mobilis; identical to SEQ ID NO: 3039

SEQ ID NO: 35138 - DNA, 1660 bp, primary endosymbiont of Sitophilus oryzae; identical to SEQ ID NO: 3040
  CDS (11)..(1078)

SEQ ID NO: 35139 - protein, 355 aa, primary endosymbiont of Sitophilus oryzae; identical to SEQ ID NO: 3041

SEQ ID NO: 35140 - DNA, 1110 bp, Azospirillum lipoferum; identical to SEQ ID NO: 3042
  CDS (1)..(1110)

SEQ ID NO: 35141 - protein, 369 aa, Azospirillum lipoferum; identical to SEQ ID NO: 3043

SEQ ID NO: 35142 - DNA, 1017 bp, Geobacter sulfurreducens; identical to SEQ ID NO: 3044
  CDS (1)..(1017)

SEQ ID NO: 35143 - protein, 338 aa, Geobacter sulfurreducens; identical to SEQ ID NO: 3045

SEQ ID NO: 35144 - DNA, 1230 bp, Mycobacterium paratuberculosis; identical to SEQ ID NO: 3046
  CDS (1)..(1230)

SEQ ID NO: 35145 - protein, 409 aa, Mycobacterium paratuberculosis; identical to SEQ ID NO: 3047

SEQ ID NO: 35146 - DNA, 1083 bp, Lactobacillus johnsonii; identical to SEQ ID NO: 3048
  CDS (1)..(1083)

SEQ ID NO: 35147 - protein, 360 aa, Lactobacillus johnsonii; identical to SEQ ID NO: 3049

SEQ ID NO: 35148 - DNA, 1245 bp, Treponema denticola; identical to SEQ ID NO: 3050
  CDS (1)..(1245)

SEQ ID NO: 35149 - protein, 414 aa, Treponema denticola; identical to SEQ ID NO: 3051

SEQ ID NO: 35150 - DNA, 1068 bp, Wolbachia pipientis wMel; identical to SEQ ID NO: 3052
  CDS (1)..(1068)

SEQ ID NO: 35151 - protein, 355 aa, Wolbachia pipientis wMel; identical to SEQ ID NO: 3053

SEQ ID NO: 35152 - DNA, 1074 bp, Desulfovibrio vulgaris; identical to SEQ ID NO: 3054
  CDS (1)..(1074)

SEQ ID NO: 35153 - protein, 357 aa, Desulfovibrio vulgaris; identical to SEQ ID NO: 3055

SEQ ID NO: 35154 - DNA, 1557 bp, Bacillus licheniformis; identical to SEQ ID NO: 3056
  CDS (369)..(1415)

SEQ ID NO: 35155 - protein, 348 aa, Bacillus licheniformis; identical to SEQ ID NO: 3057

SEQ ID NO: 35156 - DNA, 1119 bp, Corynebacterium diphtheriae; identical to SEQ ID NO: 3058
  CDS (1)..(1119)

SEQ ID NO: 35157 - protein, 372 aa, Corynebacterium diphtheriae; identical to SEQ ID NO: 3059

SEQ ID NO: 35158 - DNA, 1038 bp, Mycoplasma mycoides; identical to SEQ ID NO: 3060
  CDS (1)..(1038)

SEQ ID NO: 35159 - protein, 345 aa, Mycoplasma mycoides; identical to SEQ ID NO: 3061

SEQ ID NO: 35160 - DNA, 1134 bp, Bdellovibrio bacteriovorus; identical to SEQ ID NO: 3062
  CDS (1)..(1134)

SEQ ID NO: 35161 - protein, 377 aa, Bdellovibrio bacteriovorus; identical to SEQ ID NO: 3063

SEQ ID NO: 35162 - DNA, 1086 bp, Parachlamydia sp; identical to SEQ ID NO: 3064
  CDS (1)..(1086)

SEQ ID NO: 35163 - protein, 361 aa, Parachlamydia sp; identical to SEQ ID NO: 3065

SEQ ID NO: 35164 - DNA, 1071 bp, Photobacterium profundum; identical to SEQ ID NO: 3066
  CDS (1)..(1071)

SEQ ID NO: 35165 - protein, 356 aa, Photobacterium profundum; identical to SEQ ID NO: 3067

SEQ ID NO: 35166 - DNA, 24 bp, Primer
atggctatcgacgaaaacaaacag

SEQ ID NO: 35167 - DNA, 27 bp, Primer
ttaaaaatcttcgttagtttctgctac

SEQ ID NO: 35168 - protein, 323 aa, consensus; identical to SEQ ID NO: 5813
  MISC_FEATURE (1)..(323): consensus for the disclosure of xaa see table XV

SEQ ID NO: 35169 - protein, 33 aa, consensus; identical to SEQ ID NO: 4356
  MISC_FEATURE (1)..(33): consensus for the disclosure of xaa see table XV

SEQ ID NO: 35170 - protein, 36 aa, consensus; identical to SEQ ID NO: 4357
  MISC_FEATURE (1)..(36): consensus for the disclosure of xaa see table XV

SEQ ID NO: 35171 - protein, 39 aa, consensus; identical to SEQ ID NO: 4358
  MISC_FEATURE (1)..(39): consensus for the disclosure of xaa see table XV

SEQ ID NO: 35172 - DNA, 1344 bp, Escherichia coli K12; identical to SEQ ID NO: 25117
  CDS (1)..(1344)

SEQ ID NO: 35173 - protein, 447 aa, Escherichia coli K12; identical to SEQ ID NO: 25118

SEQ ID NO: 35174 - DNA, 1215 bp, Vibrio cholerae; identical to SEQ ID NO: 25119
  CDS (1)..(1215)

SEQ ID NO: 35175 - protein, 404 aa, Vibrio cholerae; identical to SEQ ID NO: 25120

SEQ ID NO: 35176 - DNA, 1215 bp, Listeria monocytogenes; identical to SEQ ID NO: 25121
  CDS (1)..(1215)

SEQ ID NO: 35177 - protein, 404 aa, Listeria monocytogenes; identical to SEQ ID NO: 25122

SEQ ID NO: 35178 - DNA, 1224 bp, Agrobacterium tumefaciens; identical to SEQ ID NO: 25123
  CDS (1)..(1224)

SEQ ID NO: 35179 - protein, 407 aa, Agrobacterium tumefaciens; identical to SEQ ID NO: 25124

SEQ ID NO: 35180 - DNA, 1410 bp, Salmonella enterica subsp. enterica serovar Typhi; identical to SEQ ID NO: 25125
  CDS (1)..(1410)

SEQ ID NO: 35181 - protein, 469 aa, Salmonella enterica subsp. enterica serovar Typhi; identical to SEQ ID NO: 25126

SEQ ID NO: 35182 - DNA, 1368 bp, Yersinia pestis; identical to SEQ ID NO: 25127
  CDS (1)..(1368)

SEQ ID NO: 35183 - protein, 455 aa, Yersinia pestis; identical to SEQ ID NO: 25128

SEQ ID NO: 35184 - DNA, 1203 bp, Nostoc sp. PCC 7120; identical to SEQ ID NO: 25129
  CDS (1)..(1203)

SEQ ID NO: 35185 - protein, 400 aa, Nostoc sp. PCC 7120; identical to SEQ ID NO: 25130

SEQ ID NO: 35186 - DNA, 1215 bp, Listeria innocua; identical to SEQ ID NO: 25131
  CDS (1)..(1215)

SEQ ID NO: 35187 - protein, 404 aa, Listeria innocua; identical to SEQ ID NO: 25132

SEQ ID NO: 35188 - DNA, 2317 bp, Saccharomyces cerevisiae; identical to SEQ ID NO: 25133
  CDS (762)..(2024)

SEQ ID NO: 35189 - protein, 420 aa, Saccharomyces cerevisiae; identical to SEQ ID NO: 25134

SEQ ID NO: 35190 - DNA, 1239 bp, Mus musculus (house mouse); identical to SEQ ID NO: 25135
  CDS (1)..(1239)

SEQ ID NO: 35191 - protein, 412 aa, Mus musculus (house mouse); identical to SEQ ID NO: 25136

SEQ ID NO: 35192 - DNA, 2098 bp, Methanococcus vannielii; identical to SEQ ID NO: 25137
  CDS (798)..(1991)

SEQ ID NO: 35193 - protein, 397 aa, Methanococcus vannielii; identical to SEQ ID NO: 25138

SEQ ID NO: 35194 - DNA, 2171 bp, Streptomyces coelicolor; identical to SEQ ID NO: 25139
  CDS (317)..(1780)

SEQ ID NO: 35195 - protein, 487 aa, Streptomyces coelicolor; identical to SEQ ID NO: 25140

SEQ ID NO: 35196 - DNA, 1212 bp, Bacillus subtilis; identical to SEQ ID NO: 25141
  CDS (1)..(1212)

SEQ ID NO: 35197 - protein, 403 aa, Bacillus subtilis; identical to SEQ ID NO: 25142

SEQ ID NO: 35198 - DNA, 1206 bp, Aquifex aeolicus; identical to SEQ ID NO: 25143
  CDS (1)..(1206)

SEQ ID NO: 35199 - protein, 401 aa, Aquifex aeolicus; identical to SEQ ID NO: 25144

SEQ ID NO: 35200 - DNA, 1206 bp, Staphylococcus aureus; identical to SEQ ID NO: 25145
  CDS (1)..(1206)

SEQ ID NO: 35201 - protein, 401 aa, Staphylococcus aureus; identical to SEQ ID NO: 25146

SEQ ID NO: 35202 - DNA, 1203 bp, Clostridium acetobutylicum; identical to SEQ ID NO: 25147
  CDS (1)..(1203)

SEQ ID NO: 35203 - protein, 400 aa, Clostridium acetobutylicum; identical to SEQ ID NO: 25148

SEQ ID NO: 35204 - DNA, 1221 bp, Campylobacter jejuni; identical to SEQ ID NO: 25149
  CDS (1)..(1221)

SEQ ID NO: 35205 - protein, 406 aa, Campylobacter jejuni; identical to SEQ ID NO: 25150

SEQ ID NO: 35206 - DNA, 1239 bp, Pseudomonas aeruginosa; identical to SEQ ID NO: 25151
  CDS (22)..(1239)

SEQ ID NO: 35207 - protein, 405 aa, Pseudomonas aeruginosa; identical to SEQ ID NO: 25152

SEQ ID NO: 35208 - DNA, 1230 bp, Bacillus halodurans; identical to SEQ ID NO: 25153
  CDS (1)..(1230)

SEQ ID NO: 35209 - protein, 409 aa, Bacillus halodurans; identical to SEQ ID NO: 25154

SEQ ID NO: 35210 - DNA, 1191 bp, Halobacterium sp. NRC-1; identical to SEQ ID NO: 25155
  CDS (1)..(1191)

SEQ ID NO: 35211 - protein, 396 aa, Halobacterium sp. NRC-1; identical to SEQ ID NO: 25156

SEQ ID NO: 35212 - DNA, 1221 bp, Sulfolobus solfataricus; identical to SEQ ID NO: 25157
  CDS (1)..(1221)

SEQ ID NO: 35213 - protein, 406 aa, Sulfolobus solfataricus; identical to SEQ ID NO: 25158

SEQ ID NO: 35214 - DNA, 1173 bp, Archaeoglobus fulgidus; identical to SEQ ID NO: 25159
  CDS (1)..(1173)

SEQ ID NO: 35215 - protein, 390 aa, Archaeoglobus fulgidus; identical to SEQ ID NO: 25160

SEQ ID NO: 35216 - DNA, 1209 bp, Deinococcus radiodurans; identical to SEQ ID NO: 25161
  CDS (1)..(1209)

SEQ ID NO: 35217 - protein, 402 aa, Deinococcus radiodurans; identical to SEQ ID NO: 25162

SEQ ID NO: 35218 - DNA, 1197 bp, Lactococcus lactis subsp. lactis; identical to SEQ ID NO: 25163
  CDS (1)..(1197)

SEQ ID NO: 35219 - protein, 398 aa, Lactococcus lactis subsp. lactis; identical to SEQ ID NO: 25164

SEQ ID NO: 35220 - DNA, 1188 bp, Methanococcus jannaschii; identical to SEQ ID NO: 25165
  CDS (1)..(1188)

SEQ ID NO: 35221 - protein, 395 aa, Methanococcus jannaschii; identical to SEQ ID NO: 25166

SEQ ID NO: 35222 - DNA, 1197 bp, Mycobacterium tuberculosis; identical to SEQ ID NO: 25167
  CDS (1)..(1197)

SEQ ID NO: 35223 - protein, 398 aa, Mycobacterium tuberculosis; identical to SEQ ID NO: 25168

SEQ ID NO: 35224 - DNA, 1335 bp, Haemophilus influenzae; identical to SEQ ID NO: 25169
  CDS (1)..(1335)

SEQ ID NO: 35225 - protein, 444 aa, Haemophilus influenzae; identical to SEQ ID NO: 25170

SEQ ID NO: 35226 - DNA, 1200 bp, Methanobacterium thermoautotrophicum; identical to SEQ ID NO: 25171
  CDS (1)..(1200)

SEQ ID NO: 35227 - protein, 399 aa, Methanobacterium thermoautotrophicum; identical to SEQ ID NO: 25172

SEQ ID NO: 35228 - DNA, 1344 bp, Neisseria meningitidis; identical to SEQ ID NO: 25173
  CDS (1)..(1344)

SEQ ID NO: 35229 - protein, 447 aa, Neisseria meningitidis; identical to SEQ ID NO: 25174

SEQ ID NO: 35230 - DNA, 1200 bp, Mycobacterium leprae; identical to SEQ ID NO: 25175
  CDS (1)..(1200)

SEQ ID NO: 35231 - protein, 399 aa, Mycobacterium leprae; identical to SEQ ID NO: 25176

SEQ ID NO: 35232 - DNA, 1248 bp, Streptococcus pneumoniae; identical to SEQ ID NO: 25177
  CDS (1)..(1248)

SEQ ID NO: 35233 - protein, 415 aa, Streptococcus pneumoniae; identical to SEQ ID NO: 25178

SEQ ID NO: 35234 - DNA, 1206 bp, Xylella fastidiosa; identical to SEQ ID NO: 25179
  CDS (1)..(1206)

SEQ ID NO: 35235 - protein, 401 aa, Xylella fastidiosa; identical to SEQ ID NO: 25180

SEQ ID NO: 35236 - DNA, 1230 bp, Thermotoga maritima; identical to SEQ ID NO: 25181
  CDS (1)..(1230)

SEQ ID NO: 35237 - protein, 409 aa, Thermotoga maritima; identical to SEQ ID NO: 25182

SEQ ID NO: 35238 - DNA, 1227 bp, Caulobacter crescentus; identical to SEQ ID NO: 25183
  CDS (1)..(1227)

SEQ ID NO: 35239 - protein, 408 aa, Caulobacter crescentus; identical to SEQ ID NO: 25184

SEQ ID NO: 35240 - DNA, 1194 bp, Streptomyces clavuligerus; identical to SEQ ID NO: 25185
  CDS (1)..(1194)

SEQ ID NO: 35241 - protein, 397 aa, Streptomyces clavuligerus; identical to SEQ ID NO: 25186

SEQ ID NO: 35242 - DNA, 2449 bp, Streptomyces lavendulae; identical to SEQ ID NO: 25187
  CDS (535)..(1983)

SEQ ID NO: 35243 - protein, 482 aa, Streptomyces lavendulae; identical to SEQ ID NO: 25188

SEQ ID NO: 35244 - DNA, 1203 bp, Synechocystis sp; identical to SEQ ID NO: 25189
  CDS (1)..(1203)

SEQ ID NO: 35245 - protein, 400 aa, Synechocystis sp; identical to SEQ ID NO: 25190

SEQ ID NO: 35246 - DNA, 1233 bp, Schizosaccharomyces pombe; identical to SEQ ID NO: 25191
  CDS (1)..(1233)

SEQ ID NO: 35247 - protein, 410 aa, Schizosaccharomyces pombe; identical to SEQ ID NO: 25192

SEQ ID NO: 35248 - DNA, 1245 bp, Ashbya gossypii; identical to SEQ ID NO: 25193
  CDS (1)..(1245)

SEQ ID NO: 35249 - protein, 414 aa, Ashbya gossypii; identical to SEQ ID NO: 25194

SEQ ID NO: 35250 - DNA, 1245 bp, Brachydanio rerio; identical to SEQ ID NO: 25195
  CDS (1)..(1245)

SEQ ID NO: 35251 - protein, 414 aa, Brachydanio rerio; identical to SEQ ID NO: 25196

SEQ ID NO: 35252 - DNA, 1206 bp, Symbiobacterium thermophilum; identical to SEQ ID NO: 25197
  CDS (1)..(1206)

SEQ ID NO: 35253 - protein, 401 aa, Symbiobacterium thermophilum; identical to SEQ ID NO: 25198

SEQ ID NO: 35254 - DNA, 1425 bp, Propionibacterium acnes; identical to SEQ ID NO: 25199
  CDS (1)..(1425)

SEQ ID NO: 35255 - protein, 474 aa, Propionibacterium acnes; identical to SEQ ID NO: 25200

SEQ ID NO: 35256 - DNA, 1437 bp, Leifsonia xyli; identical to SEQ ID NO: 25201
  CDS (1)..(1437)

SEQ ID NO: 35257 - protein, 478 aa, Leifsonia xyli; identical to SEQ ID NO: 25202

SEQ ID NO: 35258 - DNA, 1197 bp, Desulfotalea psychrophila; identical to SEQ ID NO: 25203
  CDS (1)..(1197)

SEQ ID NO: 35259 - protein, 398 aa, Desulfotalea psychrophila; identical to SEQ ID NO: 25204

SEQ ID NO: 35260 - DNA, 1251 bp, Debaryomyces hansenii CBS767; identical to SEQ ID NO: 25205
  CDS (1)..(1251)

SEQ ID NO: 35261 - protein, 416 aa, Debaryomyces hansenii CBS767; identical to SEQ ID NO: 25206

SEQ ID NO: 35262 - DNA, 1263 bp, Kluyveromyces lactis NRRL Y; identical to SEQ ID NO: 25207
  CDS (1)..(1263)

SEQ ID NO: 35263 - protein, 420 aa, Kluyveromyces lactis NRRL Y; identical to SEQ ID NO: 25208

SEQ ID NO: 35264 - DNA, 1347 bp, Erwinia carotovora; identical to SEQ ID NO: 25209
  CDS (1)..(1347)

SEQ ID NO: 35265 - protein, 448 aa, Erwinia carotovora; identical to SEQ ID NO: 25210

SEQ ID NO: 35266 - DNA, 1341 bp, Acinetobacter sp; identical to SEQ ID NO: 25211
  CDS (1)..(1341)

SEQ ID NO: 35267 - protein, 446 aa, Acinetobacter sp; identical to SEQ ID NO: 25212

SEQ ID NO: 35268 - DNA, 1263 bp, Candida glabrata CBS138; identical to SEQ ID NO: 25213
  CDS (1)..(1263)

SEQ ID NO: 35269 - protein, 420 aa, Candida glabrata CBS138; identical to SEQ ID NO: 25214

SEQ ID NO: 35270 - DNA, 1206 bp, Bacillus thuringiensis; identical to SEQ ID NO: 25215
  CDS (1)..(1206)

SEQ ID NO: 35271 - protein, 401 aa, Bacillus thuringiensis; identical to SEQ ID NO: 25216

SEQ ID NO: 35272 - DNA, 1188 bp, Picrophilus torridus; identical to SEQ ID NO: 25217
  CDS (1)..(1188)

SEQ ID NO: 35273 - protein, 395 aa, Picrophilus torridus; identical to SEQ ID NO: 25218

SEQ ID NO: 35274 - DNA, 1215 bp, Photobacterium profundum; identical to SEQ ID NO: 25219
  CDS (1)..(1215)

SEQ ID NO: 35275 - protein, 404 aa, Photobacterium profundum; identical to SEQ ID NO: 25220

SEQ ID NO: 35276 - DNA, 1338 bp, Rhodopseudomonas palustris; identical to SEQ ID NO: 25221
  CDS (1)..(1338)

SEQ ID NO: 35277 - protein, 445 aa, Rhodopseudomonas palustris; identical to SEQ ID NO: 25222

SEQ ID NO: 35278 - DNA, 1191 bp, Photorhabdus luminescens; identical to SEQ ID NO: 25223
  CDS (1)..(1191)

SEQ ID NO: 35279 - protein, 396 aa, Photorhabdus luminescens; identical to SEQ ID NO: 25224

SEQ ID NO: 35280 - DNA, 1227 bp, Neurospora crassa; identical to SEQ ID NO: 25225
  CDS (1)..(1227)

SEQ ID NO: 35281 - protein, 408 aa, Neurospora crassa; identical to SEQ ID NO: 25226

SEQ ID NO: 35282 - DNA, 1332 bp, Haemophilus ducreyi; identical to SEQ ID NO: 25227
  CDS (1)..(1332)

SEQ ID NO: 35283 - protein, 443 aa, Haemophilus ducreyi; identical to SEQ ID NO: 25228

SEQ ID NO: 35284 - DNA, 1733 bp, Xenopus laevis; identical to SEQ ID NO: 25229
  CDS (81)..(1316)

SEQ ID NO: 35285 - protein, 411 aa, Xenopus laevis; identical to SEQ ID NO: 25230

SEQ ID NO: 35286 - DNA, 1455 bp, Streptomyces avermitilis; identical to SEQ ID NO: 25231
  CDS (1)..(1455)

SEQ ID NO: 35287 - protein, 484 aa, Streptomyces avermitilis; identical to SEQ ID NO: 25232

SEQ ID NO: 35288 - DNA, 1209 bp, Bacteroides thetaiotaomicron; identical to SEQ ID NO: 25233
  CDS (1)..(1209)

SEQ ID NO: 35289 - protein, 402 aa, Bacteroides thetaiotaomicron; identical to SEQ ID NO: 25234

SEQ ID NO: 35290 - DNA, 1215 bp, Vibrio vulnificus; identical to SEQ ID NO: 25235
  CDS (1)..(1215)

SEQ ID NO: 35291 - protein, 404 aa, Vibrio vulnificus; identical to SEQ ID NO: 25236

SEQ ID NO: 35292 - DNA, 1516 bp, Arabidopsis thaliana; identical to SEQ ID NO: 25237
  CDS (1)..(1485)

SEQ ID NO: 35293 - protein, 494 aa, Arabidopsis thaliana; identical to SEQ ID NO: 25238

SEQ ID NO: 35294 - DNA, 1206 bp, Bacillus cereus; identical to SEQ ID NO: 25239
  CDS (1)..(1206)

SEQ ID NO: 35295 - protein, 401 aa, Bacillus cereus; identical to SEQ ID NO: 25240

SEQ ID NO: 35296 - DNA, 1239 bp, Bifidobacterium longum; identical to SEQ ID NO: 25241
  CDS (1)..(1239)

SEQ ID NO: 35297 - protein, 412 aa, Bifidobacterium longum; identical to SEQ ID NO: 25242

SEQ ID NO: 35298 - DNA, 1338 bp, Bordetella bronchiseptica; identical to SEQ ID NO: 25243
  CDS (1)..(1338)

SEQ ID NO: 35299 - protein, 445 aa, Bordetella bronchiseptica; identical to SEQ ID NO: 25244

SEQ ID NO: 35300 - DNA, 1338 bp, Bradyrhizobium japonicum; identical to SEQ ID NO: 25245
  CDS (1)..(1338)

SEQ ID NO: 35301 - protein, 445 aa, Bradyrhizobium japonicum; identical to SEQ ID NO: 25246

SEQ ID NO: 35302 - DNA, 1221 bp, Brucella suis; identical to SEQ ID NO: 25247
  CDS (1)..(1221)

SEQ ID NO: 35303 - protein, 406 aa, Brucella suis; identical to SEQ ID NO: 25248

SEQ ID NO: 35304 - DNA, 1206 bp, Buchnera aphidicola; identical to SEQ ID NO: 25249
  CDS (1)..(1206)

SEQ ID NO: 35305 - protein, 401 aa, Buchnera aphidicola; identical to SEQ ID NO: 25250

SEQ ID NO: 35306 - DNA, 1230 bp, Buchnera aphidicola; identical to SEQ ID NO: 25251
  CDS (1)..(1230)

SEQ ID NO: 35307 - protein, 409 aa, Buchnera aphidicola; identical to SEQ ID NO: 25252

SEQ ID NO: 35308 - DNA, 1338 bp, Burkholderia multivorans; identical to SEQ ID NO: 25253
  CDS (1)..(1338)

SEQ ID NO: 35309 - protein, 445 aa, Burkholderia multivorans; identical to SEQ ID NO: 25254

SEQ ID NO: 35310 - DNA, 1206 bp, Chlorobium tepidum; identical to SEQ ID NO: 25255
  CDS (1)..(1206)

SEQ ID NO: 35311 - protein, 401 aa, Chlorobium tepidum; identical to SEQ ID NO: 25256

SEQ ID NO: 35312 - DNA, 1227 bp, Chromobacterium violaceum; identical to SEQ ID NO: 25257
  CDS (1)..(1227)

SEQ ID NO: 35313 - protein, 408 aa, Chromobacterium violaceum; identical to SEQ ID NO: 25258

SEQ ID NO: 35314 - DNA, 1218 bp, Clostridium perfringens; identical to SEQ ID NO: 25259
  CDS (1)..(1218)

SEQ ID NO: 35315 - protein, 405 aa, Clostridium perfringens; identical to SEQ ID NO: 25260

SEQ ID NO: 35316 - DNA, 1197 bp, Clostridium tetani; identical to SEQ ID NO: 25261
  CDS (1)..(1197)

SEQ ID NO: 35317 - protein, 398 aa, Clostridium tetani; identical to SEQ ID NO: 25262

SEQ ID NO: 35318 - DNA, 1200 bp, Corynebacterium diphtheriae; identical to SEQ ID NO: 25263
  CDS (1)..(1200)

SEQ ID NO: 35319 - protein, 399 aa, Corynebacterium diphtheriae; identical to SEQ ID NO: 25264

SEQ ID NO: 35320 - DNA, 1206 bp, Corynebacterium efficiens; identical to SEQ ID NO: 25265
  CDS (1)..(1206)

SEQ ID NO: 35321 - protein, 401 aa, Corynebacterium efficiens; identical to SEQ ID NO: 25266

SEQ ID NO: 35322 - DNA, 1206 bp, Corynebacterium glutamicum; identical to SEQ ID NO: 25267
  CDS (1)..(1206)

SEQ ID NO: 35323 - protein, 401 aa, Corynebacterium glutamicum; identical to SEQ ID NO: 25268

SEQ ID NO: 35324 - DNA, 1191 bp, Desulfovibrio vulgaris; identical to SEQ ID NO: 25269
  CDS (1)..(1191)

SEQ ID NO: 35325 - protein, 396 aa, Desulfovibrio vulgaris; identical to SEQ ID NO: 25270

SEQ ID NO: 35326 - DNA, 1274 bp, Drosophila melanogaster; identical to SEQ ID NO: 25271
  CDS (15)..(1274)

SEQ ID NO: 35327 - protein, 419 aa, Drosophila melanogaster; identical to SEQ ID NO: 25272

SEQ ID NO: 35328 - DNA, 1221 bp, Geobacter sulfurreducens; identical to SEQ ID NO: 25273
  CDS (1)..(1221)

SEQ ID NO: 35329 - protein, 406 aa, Geobacter sulfurreducens; identical to SEQ ID NO: 25274

SEQ ID NO: 35330 - DNA, 1197 bp, Gloeobacter violaceus; identical to SEQ ID NO: 25275
  CDS (1)..(1197)

SEQ ID NO: 35331 - protein, 398 aa, Gloeobacter violaceus; identical to SEQ ID NO: 25276

SEQ ID NO: 35332 - DNA, 1215 bp, Helicobacter hepaticus; identical to SEQ ID NO: 25277
  CDS (1)..(1215)

SEQ ID NO: 35333 - protein, 404 aa, Helicobacter hepaticus; identical to SEQ ID NO: 25278

SEQ ID NO: 35334 - DNA, 1236 bp, Lactobacillus plantarum; identical to SEQ ID NO: 25279
  CDS (1)..(1236)

SEQ ID NO: 35335 - protein, 411 aa, Lactobacillus plantarum; identical to SEQ ID NO: 25280

SEQ ID NO: 35336 - DNA, 1212 bp, Leptospira interrogans; identical to SEQ ID NO: 25281
  CDS (1)..(1212)

SEQ ID NO: 35337 - protein, 403 aa, Leptospira interrogans; identical to SEQ ID NO: 25282

SEQ ID NO: 35338 - DNA, 1185 bp, Methanopyrus kandleri; identical to SEQ ID NO: 25283
  CDS (1)..(1185)

SEQ ID NO: 35339 - protein, 394 aa, Methanopyrus kandleri; identical to SEQ ID NO: 25284

SEQ ID NO: 35340 - DNA, 1185 bp, Methanosarcina mazei; identical to SEQ ID NO: 25285
  CDS (1)..(1185)

SEQ ID NO: 35341 - protein, 394 aa, Methanosarcina mazei; identical to SEQ ID NO: 25286

SEQ ID NO: 35342 - DNA, 1194 bp, Methanococcus maripaludis; identical to SEQ ID NO: 25287
  CDS (1)..(1194)

SEQ ID NO: 35343 - protein, 397 aa, Methanococcus maripaludis; identical to SEQ ID NO: 25288

SEQ ID NO: 35344 - DNA, 1215 bp, Moritella abyssi; identical to SEQ ID NO: 25289
  CDS (1)..(1215)

SEQ ID NO: 35345 - protein, 404 aa, Moritella abyssi; identical to SEQ ID NO: 25290

SEQ ID NO: 35346 - DNA, 1215 bp, Moritella profunda; identical to SEQ ID NO: 25291
  CDS (1)..(1215)

SEQ ID NO: 35347 - protein, 404 aa, Moritella profunda; identical to SEQ ID NO: 25292

SEQ ID NO: 35348 - DNA, 1197 bp, Mycobacterium paratuberculosis; identical to SEQ ID NO: 25293
  CDS (1)..(1197)

SEQ ID NO: 35349 - protein, 398 aa, Mycobacterium paratuberculosis; identical to SEQ ID NO: 25294

SEQ ID NO: 35350 - DNA, 1215 bp, Nitrosomonas europaea; identical to SEQ ID NO: 25295
  CDS (1)..(1215)

SEQ ID NO: 35351 - protein, 404 aa, Nitrosomonas europaea; identical to SEQ ID NO: 25296

SEQ ID NO: 35352 - DNA, 1254 bp, Oceanobacillus iheyensis; identical to SEQ ID NO: 25297
  CDS (1)..(1254)

SEQ ID NO: 35353 - protein, 417 aa, Oceanobacillus iheyensis; identical to SEQ ID NO: 25298

SEQ ID NO: 35354 - DNA, 1338 bp, Pasteurella multocida; identical to SEQ ID NO: 25299
  CDS (1)..(1338)

SEQ ID NO: 35355 - protein, 445 aa, Pasteurella multocida; identical to SEQ ID NO: 25300

SEQ ID NO: 35356 - DNA, 1215 bp, Photorhabdus luminescens; identical to SEQ ID NO: 25301
  CDS (1)..(1215)

SEQ ID NO: 35357 - protein, 404 aa, Photorhabdus luminescens; identical to SEQ ID NO: 25302

SEQ ID NO: 35358 - DNA, 1209 bp, Prochlorococcus marinus; identical to SEQ ID NO: 25303
  CDS (1)..(1209)

SEQ ID NO: 35359 - protein, 402 aa, Prochlorococcus marinus; identical to SEQ ID NO: 25304

SEQ ID NO: 35360 - DNA, 1206 bp, Prochlorococcus marinus; identical to SEQ ID NO: 25305
  CDS (1)..(1206)

SEQ ID NO: 35361 - protein, 401 aa, Prochlorococcus marinus; identical to SEQ ID NO: 25306

SEQ ID NO: 35362 - DNA, 1215 bp, Prochlorococcus marinus subsp; identical to SEQ ID NO: 25307
  CDS (1)..(1215)

SEQ ID NO: 35363 - protein, 404 aa, Prochlorococcus marinus subsp; identical to SEQ ID NO: 25308

SEQ ID NO: 35364 - DNA, 1218 bp, Pseudomonas putida; identical to SEQ ID NO: 25309
  CDS (1)..(1218)

SEQ ID NO: 35365 - protein, 405 aa, Pseudomonas putida; identical to SEQ ID NO: 25310

SEQ ID NO: 35366 - DNA, 1218 bp, Pseudomonas syringae; identical to SEQ ID NO: 25311
  CDS (1)..(1218)

SEQ ID NO: 35367 - protein, 405 aa, Pseudomonas syringae; identical to SEQ ID NO: 25312

SEQ ID NO: 35368 - DNA, 1233 bp, Pyrococcus furiosus; identical to SEQ ID NO: 25313
  CDS (1)..(1233)

SEQ ID NO: 35369 - protein, 410 aa, Pyrococcus furiosus; identical to SEQ ID NO: 25314

SEQ ID NO: 35370 - DNA, 1338 bp, Ralstonia solanacearum; identical to SEQ ID NO: 25315
  CDS (1)..(1338)

SEQ ID NO: 35371 - protein, 445 aa, Ralstonia solanacearum; identical to SEQ ID NO: 25316

SEQ ID NO: 35372 - DNA, 1224 bp, Rhizobium loti; identical to SEQ ID NO: 25317
  CDS (1)..(1224)

SEQ ID NO: 35373 - protein, 407 aa, Rhizobium loti; identical to SEQ ID NO: 25318

SEQ ID NO: 35374 - DNA, 1218 bp, Rhizobium meliloti; identical to SEQ ID NO: 25319
  CDS (1)..(1218)

SEQ ID NO: 35375 - protein, 405 aa, Rhizobium meliloti; identical to SEQ ID NO: 25320

SEQ ID NO: 35376 - DNA, 1215 bp, Rhodopirellula baltica; identical to SEQ ID NO: 25321
  CDS (1)..(1215)

SEQ ID NO: 35377 - protein, 404 aa, Rhodopirellula baltica; identical to SEQ ID NO: 25322

SEQ ID NO: 35378 - DNA, 1188 bp, Rhodococcus fascians; identical to SEQ ID NO: 25323
  CDS (1)..(1188)

SEQ ID NO: 35379 - protein, 395 aa, Rhodococcus fascians; identical to SEQ ID NO: 25324

SEQ ID NO: 35380 - DNA, 1224 bp, Shewanella oneidensis; identical to SEQ ID NO: 25325
  CDS (1)..(1224)

SEQ ID NO: 35381 - protein, 407 aa, Shewanella oneidensis; identical to SEQ ID NO: 25326

SEQ ID NO: 35382 - DNA, 1215 bp, Staphylococcus epidermidis; identical to SEQ ID NO: 25327
  CDS (10)..(1215)

SEQ ID NO: 35383 - protein, 401 aa, Staphylococcus epidermidis; identical to SEQ ID NO: 25328

SEQ ID NO: 35384 - DNA, 1215 bp, Streptomyces avermitilis; identical to SEQ ID NO: 25329
  CDS (1)..(1215)

SEQ ID NO: 35385 - protein, 404 aa, Streptomyces avermitilis; identical to SEQ ID NO: 25330

SEQ ID NO: 35386 - DNA, 1446 bp, Streptomyces coelicolor; identical to SEQ ID NO: 25331
  CDS (1)..(1446)

SEQ ID NO: 35387 - protein, 481 aa, Streptomyces coelicolor; identical to SEQ ID NO: 25332

SEQ ID NO: 35388 - DNA, 1191 bp, Streptococcus mutans; identical to SEQ ID NO: 25333
  CDS (1)..(1191)

SEQ ID NO: 35389 - protein, 396 aa, Streptococcus mutans; identical to SEQ ID NO: 25334

SEQ ID NO: 35390 - DNA, 1173 bp, Sulfolobus tokodaii; identical to SEQ ID NO: 25335
  CDS (1)..(1173)

SEQ ID NO: 35391 - protein, 390 aa, Sulfolobus tokodaii; identical to SEQ ID NO: 25336

SEQ ID NO: 35392 - DNA, 1206 bp, Synechococcus elongatus; identical to SEQ ID NO: 25337
  CDS (1)..(1206)

SEQ ID NO: 35393 - protein, 401 aa, Synechococcus elongatus; identical to SEQ ID NO: 25338

SEQ ID NO: 35394 - DNA, 1212 bp, Synechococcus sp; identical to SEQ ID NO: 25339
  CDS (1)..(1212)

SEQ ID NO: 35395 - protein, 403 aa, Synechococcus sp; identical to SEQ ID NO: 25340

SEQ ID NO: 35396 - DNA, 1218 bp, Thermoplasma acidophilum; identical to SEQ ID NO: 25341
  CDS (1)..(1218)

SEQ ID NO: 35397 - protein, 405 aa, Thermoplasma acidophilum; identical to SEQ ID NO: 25342

SEQ ID NO: 35398 - DNA, 1203 bp, Thermus thermophilus; identical to SEQ ID NO: 25343
  CDS (1)..(1203)

SEQ ID NO: 35399 - protein, 400 aa, Thermus thermophilus; identical to SEQ ID NO: 25344

SEQ ID NO: 35400 - DNA, 1233 bp, Thermoanaerobacter tengcongensis; identical to SEQ ID NO: 25345
  CDS (1)..(1233)

SEQ ID NO: 35401 - protein, 410 aa, Thermoanaerobacter tengcongensis; identical to SEQ ID NO: 25346

SEQ ID NO: 35402 - DNA, 1212 bp, Vibrio vulnificus; identical to SEQ ID NO: 25347
  CDS (1)..(1212)

SEQ ID NO: 35403 - protein, 403 aa, Vibrio vulnificus; identical to SEQ ID NO: 25348

SEQ ID NO: 35404 - DNA, 1215 bp, Wolinella succinogenes; identical to SEQ ID NO: 25349
  CDS (1)..(1215)

SEQ ID NO: 35405 - protein, 404 aa, Wolinella succinogenes; identical to SEQ ID NO: 25350

SEQ ID NO: 35406 - DNA, 1194 bp, Xanthomonas campestris; identical to SEQ ID NO: 25351
  CDS (1)..(1194)

SEQ ID NO: 35407 - protein, 397 aa, Xanthomonas campestris; identical to SEQ ID NO: 25352

SEQ ID NO: 35408 - DNA, 1206 bp, Xylella fastidiosa; identical to SEQ ID NO: 25353
  CDS (1)..(1206)

SEQ ID NO: 35409 - protein, 401 aa, Xylella fastidiosa; identical to SEQ ID NO: 25354

SEQ ID NO: 35410 - DNA, 24 bp, Primer
atgacgacgattctcaagcatctc

SEQ ID NO: 35411 - DNA, 25 bp, Primer
ttactggcctttgttttccagattc

SEQ ID NO: 35412 - protein, 409 aa, consensus; identical to SEQ ID NO: 25521
  MISC_FEATURE (1)..(409): consensus for the disclosure of xaa see table XV

SEQ ID NO: 35413 - protein, 36 aa, consensus; identical to SEQ ID NO: 25515
  MISC_FEATURE (1)..(36): consensus for the disclosure of xaa see table XV

SEQ ID NO: 35414 - protein, 42 aa, consensus; identical to SEQ ID NO: 25516
  MISC_FEATURE (1)..(42): consensus for the disclosure of xaa see table XV

SEQ ID NO: 35415 - protein, 18 aa, consensus
  MISC_FEATURE (1)..(18): consensus for the disclosure of xaa see table XV
XXXXXNXXXXXXXXXXXX

SEQ ID NO: 35416 - protein, 13 aa, consensus
  MISC_FEATURE (1)..(13): consensus for the disclosure of xaa see table XV
XXXXXXXGXXXXX

SEQ ID NO: 35417 - protein, 36 aa, consensus; identical to SEQ ID NO: 25519
  MISC_FEATURE (1)..(36): consensus for the disclosure of xaa see table XV

SEQ ID NO: 35418 - protein, 37 aa, consensus; identical to SEQ ID NO: 25520
  MISC_FEATURE (1)..(37): consensus for the disclosure of xaa see table XV

SEQ ID NO: 35419 - DNA, 1518 bp, Escherichia coli; identical to SEQ ID NO: 32416
  CDS (1)..(1518)

SEQ ID NO: 35420 - protein, 505 aa, Escherichia coli; identical to SEQ ID NO: 32417

SEQ ID NO: 35421 - DNA, 1536 bp, Streptococcus thermophilus CNRZ1066; identical to SEQ ID NO: 32418
  CDS (1)..(1536)

SEQ ID NO: 35422 - protein, 511 aa, Streptococcus thermophilus CNRZ1066; identical to SEQ ID NO: 32419

SEQ ID NO: 35423 - DNA, 1512 bp, Idiomarina loihiensis L2TR; identical to SEQ ID NO: 32420
  CDS (1)..(1512)

SEQ ID NO: 35424 - protein, 503 aa, Idiomarina loihiensis L2TR; identical to SEQ ID NO: 32421

SEQ ID NO: 35425 - DNA, 1731 bp, Francisella tularensis subsp. tularensis; identical to SEQ ID NO: 32422
  CDS (1)..(1731)

SEQ ID NO: 35426 - protein, 576 aa, Francisella tularensis subsp. tularensis; identical to SEQ ID NO: 32423

SEQ ID NO: 35427 - DNA, 1737 bp, Xenopus tropicalis; identical to SEQ ID NO: 32424
  CDS (1)..(1737)

SEQ ID NO: 35428 - protein, 578 aa, Xenopus tropicalis; identical to SEQ ID NO: 32425

SEQ ID NO: 35429 - DNA, 1809 bp, Danio rerio; identical to SEQ ID NO: 32426
  CDS (1)..(1809)

SEQ ID NO: 35430 - protein, 602 aa, Danio rerio; identical to SEQ ID NO: 32427

SEQ ID NO: 35431 - DNA, 1809 bp, Arabidopsis thaliana; identical to SEQ ID NO: 32428
  CDS (1)..(1809)

SEQ ID NO: 35432 - protein, 602 aa, Arabidopsis thaliana; identical to SEQ ID NO: 32429

SEQ ID NO: 35433 - DNA, 1539 bp, Vibrio cholerae O1 biovar eltor str. N16961; identical to SEQ ID NO: 32430
  CDS (1)..(1539)

SEQ ID NO: 35434 - protein, 512 aa, Vibrio cholerae O1 biovar eltor str. N16961; identical to SEQ ID NO: 32431

SEQ ID NO: 35435 - DNA, 1584 bp, Chlamydophila pneumoniae J138; identical to SEQ ID NO: 32432
  CDS (1)..(1584)

SEQ ID NO: 35436 - protein, 527 aa, Chlamydophila pneumoniae J138; identical to SEQ ID NO: 32433

SEQ ID NO: 35437 - DNA, 1335 bp, Sulfolobus tokodaii str. 7; identical to SEQ ID NO: 32434
  CDS (1)..(1335)

SEQ ID NO: 35438 - protein, 444 aa, Sulfolobus tokodaii str. 7; identical to SEQ ID NO: 32435

SEQ ID NO: 35439 - DNA, 1518 bp, Escherichia coli K12; identical to SEQ ID NO: 32436
  CDS (1)..(1518)

SEQ ID NO: 35440 - protein, 505 aa, Escherichia coli K12; identical to SEQ ID NO: 32437

SEQ ID NO: 35441 - DNA, 1518 bp, Salmonella typhimurium LT2; identical to SEQ ID NO: 32438
  CDS (1)..(1518)

SEQ ID NO: 35442 - protein, 505 aa, Salmonella typhimurium LT2; identical to SEQ ID NO: 32439

SEQ ID NO: 35443 - DNA, 1449 bp, Pyrobaculum aerophilum str. IM2; identical to SEQ ID NO: 32440
  CDS (1)..(1449)

SEQ ID NO: 35444 - protein, 482 aa, Pyrobaculum aerophilum str. IM2; identical to SEQ ID NO: 32441

SEQ ID NO: 35445 - DNA, 1725 bp, Drosophila melanogaster; identical to SEQ ID NO: 32442
  CDS (1)..(1725)

SEQ ID NO: 35446 - protein, 574 aa, Drosophila melanogaster; identical to SEQ ID NO: 32443

SEQ ID NO: 35447 - DNA, 1323 bp, Encephalitozoon cuniculi; identical to SEQ ID NO: 32444
  CDS (1)..(1323)

SEQ ID NO: 35448 - protein, 440 aa, Encephalitozoon cuniculi; identical to SEQ ID NO: 32445

SEQ ID NO: 35449 - DNA, 1596 bp, Schizosaccharomyces pombe; identical to SEQ ID NO: 32446
  CDS (1)..(1596)

SEQ ID NO: 35450 - protein, 531 aa, Schizosaccharomyces pombe; identical to SEQ ID NO: 32447

SEQ ID NO: 35451 - DNA, 1776 bp, Schizosaccharomyces pombe; identical to SEQ ID NO: 32448
  CDS (1)..(1776)

SEQ ID NO: 35452 - protein, 591 aa, Schizosaccharomyces pombe; identical to SEQ ID NO: 32449

SEQ ID NO: 35453 - DNA, 1581 bp, Corynebacterium glutamicum ATCC 13032; identical to SEQ ID NO: 32450
  CDS (1)..(1581)

SEQ ID NO: 35454 - protein, 526 aa, Corynebacterium glutamicum ATCC 13032; identical to SEQ ID NO: 32451

SEQ ID NO: 35455 - DNA, 1683 bp, Bifidobacterium longum NCC2705; identical to SEQ ID NO: 32452
  CDS (1)..(1683)

SEQ ID NO: 35456 - protein, 560 aa, Bifidobacterium longum NCC2705; identical to SEQ ID NO: 32453

SEQ ID NO: 35457 - DNA, 1752 bp, Plasmodium falciparum 3D7; identical to SEQ ID NO: 32454
  CDS (1)..(1752)

SEQ ID NO: 35458 - protein, 583 aa, Plasmodium falciparum 3D7; identical to SEQ ID NO: 32455

SEQ ID NO: 35459 - DNA, 1641 bp, Rhodopirellula baltica SH 1; identical to SEQ ID NO: 32456
  CDS (1)..(1641)

SEQ ID NO: 35460 - protein, 546 aa, Rhodopirellula baltica SH 1; identical to SEQ ID NO: 32457

SEQ ID NO: 35461 - DNA, 1563 bp, Corynebacterium diphtheriae NCTC 13129; identical to SEQ ID NO: 32458
  CDS (1)..(1563)

SEQ ID NO: 35462 - protein, 520 aa, Corynebacterium diphtheriae NCTC 13129; identical to SEQ ID NO: 32459

SEQ ID NO: 35463 - DNA, 1536 bp, Onion yellows phytoplasma OY-M; identical to SEQ ID NO: 32460
  CDS (1)..(1536)

SEQ ID NO: 35464 - protein, 511 aa, Onion yellows phytoplasma OY-M; identical to SEQ ID NO: 32461

SEQ ID NO: 35465 - DNA, 1542 bp, Lactobacillus johnsonii NCC 533; identical to SEQ ID NO: 32462
  CDS (1)..(1542)

SEQ ID NO: 35466 - protein, 513 aa, Lactobacillus johnsonii NCC 533; identical to SEQ ID NO: 32463

SEQ ID NO: 35467 - DNA, 1515 bp, Bdellovibrio bacteriovorus HD100; identical to SEQ ID NO: 32464
  CDS (1)..(1515)

SEQ ID NO: 35468 - protein, 504 aa, Bdellovibrio bacteriovorus HD100; identical to SEQ ID NO: 32465

SEQ ID NO: 35469 - DNA, 1503 bp, Mycoplasma mycoides subsp. mycoides SC str. PG1; identical to SEQ ID NO: 32466
  CDS (1)..(1503)

SEQ ID NO: 35470 - protein, 500 aa, Mycoplasma mycoides subsp. mycoides SC str. PG1; identical to SEQ ID NO: 32467

SEQ ID NO: 35471 - DNA, 1500 bp, Bacillus cereus ATCC 10987; identical to SEQ ID NO: 32468
  CDS (1)..(1500)

SEQ ID NO: 35472 - protein, 499 aa, Bacillus cereus ATCC 10987; identical to SEQ ID NO: 32469

SEQ ID NO: 35473 - DNA, 1578 bp, Eremothecium gossypii; identical to SEQ ID NO: 32470
  CDS (1)..(1578)

SEQ ID NO: 35474 - protein, 525 aa, Eremothecium gossypii; identical to SEQ ID NO: 32471

SEQ ID NO: 35475 - DNA, 1770 bp, Eremothecium gossypii; identical to SEQ ID NO: 32472
  CDS (1)..(1770)

SEQ ID NO: 35476 - protein, 589 aa, Eremothecium gossypii; identical to SEQ ID NO: 32473

SEQ ID NO: 35477 - DNA, 1917 bp, Magnaporthe grisea 70-15; identical to SEQ ID NO: 32474
  CDS (1)..(1917)

SEQ ID NO: 35478 - protein, 638 aa, Magnaporthe grisea 70-15; identical to SEQ ID NO: 32475

SEQ ID NO: 35479 - DNA, 1833 bp, Gibberella zeae PH-1; identical to SEQ ID NO: 32476
  CDS (1)..(1833)

SEQ ID NO: 35480 - protein, 610 aa, Gibberella zeae PH-1; identical to SEQ ID NO: 32477

SEQ ID NO: 35481 - DNA, 1821 bp, Aspergillus nidulans FGSC A4; identical to SEQ ID NO: 32478
  CDS (1)..(1821)

SEQ ID NO: 35482 - protein, 606 aa, Aspergillus nidulans FGSC A4; identical to SEQ ID NO: 32479

SEQ ID NO: 35483 - DNA, 1776 bp, Candida glabrata CBS138; identical to SEQ ID NO: 32480
  CDS (1)..(1776)

SEQ ID NO: 35484 - protein, 591 aa, Candida glabrata CBS138; identical to SEQ ID NO: 32481

SEQ ID NO: 35485 - DNA, 1782 bp, Debaryomyces hansenii CBS767; identical to SEQ ID NO: 32482
  CDS (1)..(1782)

SEQ ID NO: 35486 - protein, 593 aa, Debaryomyces hansenii CBS767; identical to SEQ ID NO: 32483

SEQ ID NO: 35487 - DNA, 1761 bp, Oryza sativa (japonica cultivar-group); identical to SEQ ID NO: 32484
  CDS (1)..(1761)

SEQ ID NO: 35488 - protein, 586 aa, Oryza sativa (japonica cultivar-group); identical to SEQ ID NO: 32485

SEQ ID NO: 35489 - DNA, 1749 bp, Yarrowia lipolytica CLIB99; identical to SEQ ID NO: 32486
  CDS (1)..(1749)

SEQ ID NO: 35490 - protein, 582 aa, Yarrowia lipolytica CLIB99; identical to SEQ ID NO: 32487

SEQ ID NO: 35491 - DNA, 1488 bp, Leptospira interrogans serovar Copenhageni str. Fiocruz L1-130; identical to SEQ ID NO: 32488
  CDS (1)..(1488)

SEQ ID NO: 35492 - protein, 495 aa, Leptospira interrogans serovar Copenhageni str. Fiocruz L1-130; identical to SEQ ID NO: 32489

SEQ ID NO: 35493 - DNA, 1590 bp, Parachlamydia sp. UWE25; identical to SEQ ID NO: 32490
  CDS (1)..(1590)

SEQ ID NO: 35494 - protein, 529 aa, Parachlamydia sp. UWE25; identical to SEQ ID NO: 32491

SEQ ID NO: 35495 - DNA, 1506 bp, Desulfovibrio vulgaris subsp. vulgaris str. Hildenborough; identical to SEQ ID NO: 32492
  CDS (1)..(1506)

SEQ ID NO: 35496 - protein, 501 aa, Desulfovibrio vulgaris subsp. vulgaris str. Hildenborough; identical to SEQ ID NO: 32493

SEQ ID NO: 35497 - DNA, 1518 bp, Erwinia carotovora subsp. atroseptica SCRI1043; identical to SEQ ID NO: 32494
  CDS (1)..(1518)

SEQ ID NO: 35498 - protein, 505 aa, Erwinia carotovora subsp. atroseptica SCRI1043; identical to SEQ ID NO: 32495

SEQ ID NO: 35499 - DNA, 1500 bp, Mesoplasma florum L1; identical to SEQ ID NO: 32496
  CDS (1)..(1500)

SEQ ID NO: 35500 - protein, 499 aa, Mesoplasma florum L1; identical to SEQ ID NO: 32497

SEQ ID NO: 35501 - DNA, 1533 bp, Propionibacterium acnes KPA171202; identical to SEQ ID NO: 32498
  CDS (1)..(1533)

SEQ ID NO: 35502 - protein, 510 aa, Propionibacterium acnes KPA171202; identical to SEQ ID NO: 32499

SEQ ID NO: 35503 - DNA, 1515 bp, Leifsonia xyli subsp. xyli str. CTCB07; identical to SEQ ID NO: 32500
  CDS (1)..(1515)

SEQ ID NO: 35504 - protein, 504 aa, Leifsonia xyli subsp. xyli str. CTCB07; identical to SEQ ID NO: 32501

SEQ ID NO: 35505 - DNA, 1512 bp, Desulfotalea psychrophila LSv54; identical to SEQ ID NO: 32502
  CDS (1)..(1512)

SEQ ID NO: 35506 - protein, 503 aa, Desulfotalea psychrophila LSv54; identical to SEQ ID NO: 32503

SEQ ID NO: 35507 - DNA, 1488 bp, Symbiobacterium thermophilum IAM 14863; identical to SEQ ID NO: 32504
  CDS (1)..(1488)

SEQ ID NO: 35508 - protein, 495 aa, Symbiobacterium thermophilum IAM 14863; identical to SEQ ID NO: 32505

SEQ ID NO: 35509 - DNA, 1512 bp, Mannheimia succiniciproducens MBEL55E; identical to SEQ ID NO: 32506
  CDS (1)..(1512)

SEQ ID NO: 35510 - protein, 503 aa, Mannheimia succiniciproducens MBEL55E; identical to SEQ ID NO: 32507

SEQ ID NO: 35511 - DNA, 1728 bp, Bacteroides fragilis YCH46; identical to SEQ ID NO: 32508
  CDS (1)..(1728)

SEQ ID NO: 35512 - protein, 575 aa, Bacteroides fragilis YCH46; identical to SEQ ID NO: 32509

SEQ ID NO: 35513 - DNA, 1491 bp, Methylococcus capsulatus str. Bath; identical to SEQ ID NO: 32510
  CDS (1)..(1491)

SEQ ID NO: 35514 - protein, 496 aa, Methylococcus capsulatus str. Bath; identical to SEQ ID NO: 32511

SEQ ID NO: 35515 - DNA, 1467 bp, Nocardia farcinica IFM 10152; identical to SEQ ID NO: 32512
  CDS (1)..(1467)

SEQ ID NO: 35516 - protein, 488 aa, Nocardia farcinica IFM 10152; identical to SEQ ID NO: 32513

SEQ ID NO: 35517 - DNA, 1491 bp, Legionella pneumophila str. Paris; identical to SEQ ID NO: 32514
  CDS (1)..(1491)

SEQ ID NO: 35518 - protein, 496 aa, Legionella pneumophila str. Paris; identical to SEQ ID NO: 32515

SEQ ID NO: 35519 - DNA, 1509 bp, Photobacterium profundum SS9; identical to SEQ ID NO: 32516
  CDS (1)..(1509)

SEQ ID NO: 35520 - protein, 502 aa, Photobacterium profundum SS9; identical to SEQ ID NO: 32517

SEQ ID NO: 35521 - DNA, 1488 bp, Leuconostoc mesenteroides subsp. mesenteroides ATCC 8293; identical to SEQ ID NO: 32518
  CDS (1)..(1488)

SEQ ID NO: 35522 - protein, 495 aa, Leuconostoc mesenteroides subsp. mesenteroides ATCC 8293; identical to SEQ ID NO: 32519

SEQ ID NO: 35523 - DNA, 1503 bp, Azotobacter vinelandii; identical to SEQ ID NO: 32520
  CDS (1)..(1503)

SEQ ID NO: 35524 - protein, 500 aa, Azotobacter vinelandii; identical to SEQ ID NO: 32521

SEQ ID NO: 35525 - DNA, 1686 bp, Nostoc punctiforme PCC 73102; identical to SEQ ID NO: 32522
  CDS (1)..(1686)

SEQ ID NO: 35526 - protein, 561 aa, Nostoc punctiforme PCC 73102; identical to SEQ ID NO: 32523

SEQ ID NO: 35527 - DNA, 1503 bp, Actinobacillus pleuropneumoniae serovar 1 str. 4074; identical to SEQ ID NO: 32524
  CDS (1)..(1503)

SEQ ID NO: 35528 - protein, 500 aa, Actinobacillus pleuropneumoniae serovar 1 str. 4074; identical to SEQ ID NO: 32525

SEQ ID NO: 35529 - DNA, 1482 bp, Fusobacterium nucleatum subsp. vincentii ATCC 49256; identical to SEQ ID NO: 32526
  CDS (1)..(1482)

SEQ ID NO: 35530 - protein, 493 aa, Fusobacterium nucleatum subsp. vincentii ATCC 49256; identical to SEQ ID NO: 32527

SEQ ID NO: 35531 - DNA, 1545 bp, Psychrobacter sp. 273-4; identical to SEQ ID NO: 32528
  CDS (1)..(1545)

SEQ ID NO: 35532 - protein, 514 aa, Psychrobacter sp. 273-4; identical to SEQ ID NO: 32529

SEQ ID NO: 35533 - DNA, 1506 bp, Dechloromonas aromatica RCB; identical to SEQ ID NO: 32530
  CDS (1)..(1506)

SEQ ID NO: 35534 - protein, 501 aa, Dechloromonas aromatica RCB; identical to SEQ ID NO: 32531

SEQ ID NO: 35535 - DNA, 1509 bp, Haemophilus influenzae R2866; identical to SEQ ID NO: 32532
  CDS (1)..(1509)

SEQ ID NO: 35536 - protein, 502 aa, Haemophilus influenzae R2866; identical to SEQ ID NO: 32533

SEQ ID NO: 35537 - DNA, 1686 bp, Anabaena variabilis ATCC 29413; identical to SEQ ID NO: 32534
  CDS (1)..(1686)

SEQ ID NO: 35538 - protein, 561 aa, Anabaena variabilis ATCC 29413; identical to SEQ ID NO: 32535

SEQ ID NO: 35539 - DNA, 1515 bp, Synechococcus elongatus PCC 7942; identical to SEQ ID NO: 32536
  CDS (1)..(1515)

SEQ ID NO: 35540 - protein, 504 aa, Synechococcus elongatus PCC 7942; identical to SEQ ID NO: 32537

SEQ ID NO: 35541 - DNA, 1551 bp, Ralstonia eutropha JMP134; identical to SEQ ID NO: 32538
  CDS (1)..(1551)

SEQ ID NO: 35542 - protein, 516 aa, Ralstonia eutropha JMP134; identical to SEQ ID NO: 32539

SEQ ID NO: 35543 - DNA, 1530 bp, Methylobacillus flagellatus KT; identical to SEQ ID NO: 32540
  CDS (1)..(1530)

SEQ ID NO: 35544 - protein, 509 aa, Methylobacillus flagellatus KT; identical to SEQ ID NO: 32541

SEQ ID NO: 35545 - DNA, 1722 bp, Crocosphaera watsonii WH 8501; identical to SEQ ID NO: 32542
  CDS (1)..(1722)

SEQ ID NO: 35546 - protein, 573 aa, Crocosphaera watsonii WH 8501; identical to SEQ ID NO: 32543

SEQ ID NO: 35547 - DNA, 1482 bp, Exiguobacterium sp. 255-15; identical to SEQ ID NO: 32544
  CDS (1)..(1482)

SEQ ID NO: 35548 - protein, 493 aa, Exiguobacterium sp. 255-15; identical to SEQ ID NO: 32545

SEQ ID NO: 35549 - DNA, 1527 bp, Burkholderia cepacia R1808; identical to SEQ ID NO: 32546
  CDS (1)..(1527)

SEQ ID NO: 35550 - protein, 508 aa, Burkholderia cepacia R1808; identical to SEQ ID NO: 32547

SEQ ID NO: 35551 - DNA, 1527 bp, Rubrivivax gelatinosus PM1; identical to SEQ ID NO: 32548
  CDS (1)..(1527)

SEQ ID NO: 35552 - protein, 508 aa, Rubrivivax gelatinosus PM1; identical to SEQ ID NO: 32549

SEQ ID NO: 35553 - DNA, 1506 bp, Magnetococcus sp. MC-1; identical to SEQ ID NO: 32550
  CDS (1)..(1506)

SEQ ID NO: 35554 - protein, 501 aa, Magnetococcus sp. MC-1; identical to SEQ ID NO: 32551

SEQ ID NO: 35555 - DNA, 1491 bp, Thermobifida fusca; identical to SEQ ID NO: 32552
  CDS (1)..(1491)

SEQ ID NO: 35556 - protein, 496 aa, Thermobifida fusca; identical to SEQ ID NO: 32553

SEQ ID NO: 35557 - DNA, 1548 bp, Methanosarcina barkeri str. fusaro; identical to SEQ ID NO: 32554
  CDS (1)..(1548)

SEQ ID NO: 35558 - protein, 515 aa, Methanosarcina barkeri str. fusaro; identical to SEQ ID NO: 32555

SEQ ID NO: 35559 - DNA, 1476 bp, Geobacter metallireducens GS-15; identical to SEQ ID NO: 32556
  CDS (1)..(1476)

SEQ ID NO: 35560 - protein, 491 aa, Geobacter metallireducens GS-15; identical to SEQ ID NO: 32557

SEQ ID NO: 35561 - DNA, 1755 bp, Cytophaga hutchinsonii; identical to SEQ ID NO: 32558
  CDS (1)..(1755)

SEQ ID NO: 35562 - protein, 584 aa, Cytophaga hutchinsonii; identical to SEQ ID NO: 32559

SEQ ID NO: 35563 - DNA, 1509 bp, Microbulbifer degradans 2-40; identical to SEQ ID NO: 32560
  CDS (1)..(1509)

SEQ ID NO: 35564 - protein, 502 aa, Microbulbifer degradans 2-40; identical to SEQ ID NO: 32561

SEQ ID NO: 35565 - DNA, 1497 bp, Pediococcus pentosaceus ATCC 25745; identical to SEQ ID NO: 32562
  CDS (1)..(1497)

SEQ ID NO: 35566 - protein, 498 aa, Pediococcus pentosaceus ATCC 25745; identical to SEQ ID NO: 32563

SEQ ID NO: 35567 - DNA, 1569 bp, Trichodesmium erythraeum IMS101; identical to SEQ ID NO: 32564
  CDS (1)..(1569)

SEQ ID NO: 35568 - protein, 522 aa, Trichodesmium erythraeum IMS101; identical to SEQ ID NO: 32565

SEQ ID NO: 35569 - DNA, 1491 bp, Streptococcus suis 89/1591; identical to SEQ ID NO: 32566
  CDS (1)..(1491)

SEQ ID NO: 35570 - protein, 496 aa, Streptococcus suis 89/1591; identical to SEQ ID NO: 32567

SEQ ID NO: 35571 - DNA, 1506 bp, Thiobacillus denitrificans ATCC 25259; identical to SEQ ID NO: 32568
  CDS (1)..(1506)

SEQ ID NO: 35572 - protein, 501 aa, Thiobacillus denitrificans ATCC 25259; identical to SEQ ID NO: 32569

SEQ ID NO: 35573 - DNA, 1551 bp, Polaromonas sp. JS666; identical to SEQ ID NO: 32570
  CDS (1)..(1551)

SEQ ID NO: 35574 - protein, 516 aa, Polaromonas sp. JS666; identical to SEQ ID NO: 32571

SEQ ID NO: 35575 - DNA, 1734 bp, Brachydanio rerio; identical to SEQ ID NO: 32572
  CDS (1)..(1734)

SEQ ID NO: 35576 - protein, 577 aa, Brachydanio rerio; identical to SEQ ID NO: 32573

SEQ ID NO: 35577 - DNA, 1506 bp, uncultured bacterium 577; identical to SEQ ID NO: 32574
  CDS (1)..(1506)

SEQ ID NO: 35578 - protein, 501 aa, uncultured bacterium 577; identical to SEQ ID NO: 32575

SEQ ID NO: 35579 - DNA, 1491 bp, Candidatus Portiera aleyrodidarum; identical to SEQ ID NO: 32576
  CDS (1)..(1491)

SEQ ID NO: 35580 - protein, 496 aa, Candidatus Portiera aleyrodidarum; identical to SEQ ID NO: 32577

SEQ ID NO: 35581 - DNA, 1518 bp, Citrobacter freundii; identical to SEQ ID NO: 32578
  CDS (1)..(1518)

SEQ ID NO: 35582 - protein, 505 aa, Citrobacter freundii; identical to SEQ ID NO: 32579

SEQ ID NO: 35583 - DNA, 1497 bp, Escherichia coli; identical to SEQ ID NO: 32580
  CDS (1)..(1497)

SEQ ID NO: 35584 - protein, 498 aa, Escherichia coli; identical to SEQ ID NO: 32581

SEQ ID NO: 35585 - DNA, 1788 bp, Mus musculus; identical to SEQ ID NO: 32582
  CDS (1)..(1788)

SEQ ID NO: 35586 - protein, 595 aa, Mus musculus; identical to SEQ ID NO: 32583

SEQ ID NO: 35587 - DNA, 1551 bp, Methanosarcina barkeri; identical to SEQ ID NO: 32584
  CDS (1)..(1551)

SEQ ID NO: 35588 - protein, 516 aa, Methanosarcina barkeri; identical to SEQ ID NO: 32585

SEQ ID NO: 35589 - DNA, 1878 bp, Homo sapiens; identical to SEQ ID NO: 32586
  CDS (1)..(1878)

SEQ ID NO: 35590 - protein, 625 aa, Homo sapiens [sequence omitted]

SEQ ID NO: 35591 - DNA, 1536 bp, Methanosarcina acetivorans; identical to SEQ ID NO: 32588
  CDS (1)..(1536)

SEQ ID NO: 35592 - protein, 511 aa, Methanosarcina acetivorans; identical to SEQ ID NO: 32589

SEQ ID NO: 35593 - DNA, 1536 bp, Methanosarcina mazei; identical to SEQ ID NO: 32590
  CDS (1)..(1536)

SEQ ID NO: 35594 - protein, 511 aa, Methanosarcina mazei; identical to SEQ ID NO: 32591

SEQ ID NO: 35595 - DNA, 1779 bp, Saccharomyces cerevisiae; identical to SEQ ID NO: 32592
  CDS (1)..(1779)

SEQ ID NO: 35596 - protein, 592 aa, Saccharomyces cerevisiae; identical to SEQ ID NO: 32593

SEQ ID NO: 35597 - DNA, 1731 bp, Saccharomyces cerevisiae; identical to SEQ ID NO: 32594
  CDS (1)..(1731)

SEQ ID NO: 35598 - protein, 576 aa, Saccharomyces cerevisiae; identical to SEQ ID NO: 32595

SEQ ID NO: 35599 - DNA, 1530 bp, Acinetobacter sp; identical to SEQ ID NO: 32596
  CDS (1)..(1530)

SEQ ID NO: 35600 - protein, 509 aa, Acinetobacter sp; identical to SEQ ID NO: 32597

SEQ ID NO: 35601 - DNA, 1500 bp, Agrobacterium tumefaciens; identical to SEQ ID NO: 32598
  CDS (1)..(1500)

SEQ ID NO: 35602 - protein, 499 aa, Agrobacterium tumefaciens; identical to SEQ ID NO: 32599

SEQ ID NO: 35603 - DNA, 1686 bp, Anabaena sp; identical to SEQ ID NO: 32600
  CDS (1)..(1686)

SEQ ID NO: 35604 - protein, 561 aa, Anabaena sp; identical to SEQ ID NO: 32601

SEQ ID NO: 35605 - DNA, 1794 bp, Aquifex aeolicus; identical to SEQ ID NO: 32602
  CDS (1)..(1794)

SEQ ID NO: 35606 - protein, 597 aa, Aquifex aeolicus; identical to SEQ ID NO: 32603

SEQ ID NO: 35607 - DNA, 1881 bp, Arabidopsis thaliana; identical to SEQ ID NO: 32604
  CDS (1)..(1881)

SEQ ID NO: 35608 - protein, 626 aa, Arabidopsis thaliana; identical to SEQ ID NO: 32605

SEQ ID NO: 35609 - DNA, 1485 bp, Bacillus stearothermophilus; identical to SEQ ID NO: 32606
  CDS (1)..(1485)

SEQ ID NO: 35610 - protein, 494 aa, Bacillus stearothermophilus; identical to SEQ ID NO: 32607

SEQ ID NO: 35611 - DNA, 1500 bp, Bacillus subtilis; identical to SEQ ID NO: 32608
  CDS (1)..(1500)

SEQ ID NO: 35612 - protein, 499 aa, Bacillus subtilis; identical to SEQ ID NO: 32609

SEQ ID NO: 35613 - DNA, 1731 bp, Bacteroides thetaiotaomicron; identical to SEQ ID NO: 32610
  CDS (1)..(1731)

SEQ ID NO: 35614 - protein, 576 aa, Bacteroides thetaiotaomicron; identical to SEQ ID NO: 32611

SEQ ID NO: 35615 - DNA, 1521 bp, Buchnera aphidicola; identical to SEQ ID NO: 32612
  CDS (1)..(1521)

SEQ ID NO: 35616 - protein, 506 aa, Buchnera aphidicola; identical to SEQ ID NO: 32613

SEQ ID NO: 35617 - DNA, 1512 bp, Buchnera aphidicola; identical to SEQ ID NO: 32614
  CDS (1)..(1512)

SEQ ID NO: 35618 - protein, 503 aa, Buchnera aphidicola; identical to SEQ ID NO: 32615

SEQ ID NO: 35619 - DNA, 1719 bp, Caenorhabditis elegans; identical to SEQ ID NO: 32616
  CDS (1)..(1719)

SEQ ID NO: 35620 - protein, 572 aa, Caenorhabditis elegans; identical to SEQ ID NO: 32617

SEQ ID NO: 35621 - DNA, 1506 bp, Campylobacter jejuni; identical to SEQ ID NO: 32618
  CDS (1)..(1506)

SEQ ID NO: 35622 - protein, 501 aa, Campylobacter jejuni; identical to SEQ ID NO: 32619

SEQ ID NO: 35623 - DNA, 1458 bp, Candidatus Blochmannia floridanus; identical to SEQ ID NO: 32620
  CDS (1)..(1458)

SEQ ID NO: 35624 - protein, 485 aa, Candidatus Blochmannia floridanus; identical to SEQ ID NO: 32621

SEQ ID NO: 35625 - DNA, 1578 bp, Chlamydophila caviae; identical to SEQ ID NO: 32622
  CDS (1)..(1578)

SEQ ID NO: 35626 - protein, 525 aa, Chlamydophila caviae; identical to SEQ ID NO: 32623

SEQ ID NO: 35627 - DNA, 1536 bp, Chlorobium tepidum; identical to SEQ ID NO: 32624
  CDS (1)..(1536)

SEQ ID NO: 35628 - protein, 511 aa, Chlorobium tepidum; identical to SEQ ID NO: 32625

SEQ ID NO: 35629 - DNA, 1581 bp, Chlamydia trachomatis; identical to SEQ ID NO: 32626
  CDS (1)..(1581)

SEQ ID NO: 35630 - protein, 526 aa, Chlamydia trachomatis; identical to SEQ ID NO: 32627

SEQ ID NO: 35631 - DNA, 1509 bp, Chromobacterium violaceum; identical to SEQ ID NO: 32628
  CDS (1)..(1509)

SEQ ID NO: 35632 - protein, 502 aa, Chromobacterium violaceum; identical to SEQ ID NO: 32629

SEQ ID NO: 35633 - DNA, 1506 bp, Clostridium perfringens; identical to SEQ ID NO: 32630
  CDS (1)..(1506)

SEQ ID NO: 35634 - protein, 501 aa, Clostridium perfringens; identical to SEQ ID NO: 32631

SEQ ID NO: 35635 - DNA, 1509 bp, Clostridium tetani; identical to SEQ ID NO: 32632
  CDS (1)..(1509)

SEQ ID NO: 35636 - protein, 502 aa, Clostridium tetani; identical to SEQ ID NO: 32633

SEQ ID NO: 35637 - DNA, 1497 bp, Coxiella burnetii; identical to SEQ ID NO: 32634
  CDS (1)..(1497)

SEQ ID NO: 35638 - protein, 498 aa, Coxiella burnetii; identical to SEQ ID NO: 32635

SEQ ID NO: 35639 - DNA, 1794 bp, Cricetulus longicaudatus; identical to SEQ ID NO: 32636
  CDS (1)..(1794)

SEQ ID NO: 35640 - protein, 597 aa, Cricetulus longicaudatus; identical to SEQ ID NO: 32637

SEQ ID NO: 35641 - DNA, 1578 bp, Deinococcus radiodurans; identical to SEQ ID NO: 32638
  CDS (1)..(1578)

SEQ ID NO: 35642 - protein, 525 aa, Deinococcus radiodurans; identical to SEQ ID NO: 32639

SEQ ID NO: 35643 - DNA, 1497 bp, Enterococcus faecalis; identical to SEQ ID NO: 32640
  CDS (1)..(1497)

SEQ ID NO: 35644 - protein, 498 aa, Enterococcus faecalis; identical to SEQ ID NO: 32641

SEQ ID NO: 35645 - DNA, 1482 bp, Fusobacterium nucleatum; identical to SEQ ID NO: 32642
  CDS (1)..(1482)

SEQ ID NO: 35646 - protein, 493 aa, Fusobacterium nucleatum; identical to SEQ ID NO: 32643

SEQ ID NO: 35647 - DNA, 1494 bp, Gloeobacter violaceus; identical to SEQ ID NO: 32644
  CDS (1)..(1494)

SEQ ID NO: 35648 - protein, 497 aa, Gloeobacter violaceus; identical to SEQ ID NO: 32645

SEQ ID NO: 35649 - DNA, 1497 bp, Haemophilus ducreyi; identical to SEQ ID NO: 32646
  CDS (1)..(1497)

SEQ ID NO: 35650 - protein, 498 aa, Haemophilus ducreyi; identical to SEQ ID NO: 32647

SEQ ID NO: 35651 - DNA, 1557 bp, Helicobacter hepaticus; identical to SEQ ID NO: 32648
  CDS (1)..(1557)

SEQ ID NO: 35652 - protein, 518 aa, Helicobacter hepaticus; identical to SEQ ID NO: 32649

SEQ ID NO: 35653 - DNA, 1485 bp, Lactococcus lactis; identical to SEQ ID NO: 32650
  CDS (1)..(1485)

SEQ ID NO: 35654 - protein, 494 aa, Lactococcus lactis; identical to SEQ ID NO: 32651

SEQ ID NO: 35655 - DNA, 1500 bp, Lactobacillus plantarum; identical to SEQ ID NO: 32652
  CDS (1)..(1500)

SEQ ID NO: 35656 - protein, 499 aa, Lactobacillus plantarum; identical to SEQ ID NO: 32653

SEQ ID NO: 35657 - DNA, 1497 bp, Listeria monocytogenes; identical to SEQ ID NO: 32654
  CDS (1)..(1497)

SEQ ID NO: 35658 - protein, 498 aa, Listeria monocytogenes; identical to SEQ ID NO: 32655

SEQ ID NO: 35659 - DNA, 1767 bp, Lycopersicon esculentum; identical to SEQ ID NO: 32656
  CDS (1)..(1767)

SEQ ID NO: 35660 - protein, 588 aa, Lycopersicon esculentum; identical to SEQ ID NO: 32657

SEQ ID NO: 35661 - DNA, 1512 bp, Neisseria meningitidis; identical to SEQ ID NO: 32658
  CDS (1)..(1512)

SEQ ID NO: 35662 - protein, 503 aa, Neisseria meningitidis; identical to SEQ ID NO: 32659

SEQ ID NO: 35663 - DNA, 1509 bp, Nitrosomonas europaea; identical to SEQ ID NO: 32660
  CDS (1)..(1509)

SEQ ID NO: 35664 - protein, 502 aa, Nitrosomonas europaea; identical to SEQ ID NO: 32661

SEQ ID NO: 35665 - DNA, 1482 bp, Oceanobacillus iheyensis; identical to SEQ ID NO: 32662
  CDS (1)..(1482)

SEQ ID NO: 35666 - protein, 493 aa, Oceanobacillus iheyensis; identical to SEQ ID NO: 32663

SEQ ID NO: 35667 - DNA, 1809 bp, Oryza sativa; identical to SEQ ID NO: 32664
  CDS (1)..(1809)

SEQ ID NO: 35668 - protein, 602 aa, Oryza sativa; identical to SEQ ID NO: 32665

SEQ ID NO: 35669 - DNA, 1506 bp, Pasteurella multocida; identical to SEQ ID NO: 32666
  CDS (1)..(1506)

SEQ ID NO: 35670 - protein, 501 aa, Pasteurella multocida; identical to SEQ ID NO: 32667

SEQ ID NO: 35671 - DNA, 1737 bp, Porphyromonas gingivalis; identical to SEQ ID NO: 32668
  CDS (1)..(1737)

SEQ ID NO: 35672 - protein, 578 aa, Porphyromonas gingivalis; identical to SEQ ID NO: 32669

SEQ ID NO: 35673 - DNA, 1506 bp, Pseudomonas aeruginosa; identical to SEQ ID NO: 32670
  CDS (1)..(1506)

SEQ ID NO: 35674 - protein, 501 aa, Pseudomonas aeruginosa; identical to SEQ ID NO: 32671

SEQ ID NO: 35675 - DNA, 1503 bp, Pseudomonas syringae; identical to SEQ ID NO: 32672
  CDS (1)..(1503)

SEQ ID NO: 35676 - protein, 500 aa, Pseudomonas syringae; identical to SEQ ID NO: 32673

SEQ ID NO: 35677 - DNA, 1533 bp, Ralstonia solanacearum; identical to SEQ ID NO: 32674
  CDS (1)..(1533)

SEQ ID NO: 35678 - protein, 510 aa, Ralstonia solanacearum; identical to SEQ ID NO: 32675

SEQ ID NO: 35679 - DNA, 1497 bp, Rhizobium meliloti; identical to SEQ ID NO: 32676
  CDS (1)..(1497)

SEQ ID NO: 35680 - protein, 498 aa, Rhizobium meliloti; identical to SEQ ID NO: 32677

SEQ ID NO: 35681 - DNA, 1503 bp, Shewanella oneidensis; identical to SEQ ID NO: 32678
  CDS (1)..(1503)

SEQ ID NO: 35682 - protein, 500 aa, Shewanella oneidensis; identical to SEQ ID NO: 32679

SEQ ID NO: 35683 - DNA, 1488 bp, Staphylococcus aureus; identical to SEQ ID NO: 32680
  CDS (1)..(1488)

SEQ ID NO: 35684 - protein, 495 aa, Staphylococcus aureus; identical to SEQ ID NO: 32681

SEQ ID NO: 35685 - DNA, 1485 bp, Sulfolobus solfataricus; identical to SEQ ID NO: 32682
  CDS (1)..(1485)

SEQ ID NO: 35686 - protein, 494 aa, Sulfolobus solfataricus; identical to SEQ ID NO: 32683

SEQ ID NO: 35687 - DNA, 1521 bp, Synechococcus elongatus; identical to SEQ ID NO: 32684
  CDS (1)..(1521)

SEQ ID NO: 35688 - protein, 506 aa, Synechococcus elongatus; identical to SEQ ID NO: 32685

SEQ ID NO: 35689 - DNA, 1509 bp, Synechococcus sp; identical to SEQ ID NO: 32686
  CDS (1)..(1509)

SEQ ID NO: 35690 - protein, 502 aa, Synechococcus sp; identical to SEQ ID NO: 32687

SEQ ID NO: 35691 - DNA, 1509 bp, Thermotoga maritima; identical to SEQ ID NO: 32688
  CDS (1)..(1509)

SEQ ID NO: 35692 - protein, 502 aa, Thermotoga maritima; identical to SEQ ID NO: 32689

SEQ ID NO: 35693 - DNA, 1479 bp, Thermus thermophilus; identical to SEQ ID NO: 32690
  CDS (1)..(1479)

SEQ ID NO: 35694 - protein, 492 aa, Thermus thermophilus; identical to SEQ ID NO: 32691

SEQ ID NO: 35695 - DNA, 1500 bp, Thermoanaerobacter tengcongensis; identical to SEQ ID NO: 32692
  CDS (1)..(1500)

SEQ ID NO: 35696 - protein, 499 aa, Thermoanaerobacter tengcongensis; identical to SEQ ID NO: 32693

SEQ ID NO: 35697 - DNA, 1482 bp, Ureaplasma parvum; identical to SEQ ID NO: 32694
  CDS (1)..(1482)

SEQ ID NO: 35698 - protein, 493 aa, Ureaplasma parvum; identical to SEQ ID NO: 32695

SEQ ID NO: 35699 - DNA, 1518 bp, Vibrio parahaemolyticus; identical to SEQ ID NO: 32696
  CDS (1)..(1518)

SEQ ID NO: 35700 - protein, 505 aa, Vibrio parahaemolyticus; identical to SEQ ID NO: 32697

SEQ ID NO: 35701 - DNA, 1533 bp, Vibrio vulnificus; identical to SEQ ID NO: 32698
  CDS (1)..(1533)

SEQ ID NO: 35702 - protein, 510 aa, Vibrio vulnificus; identical to SEQ ID NO: 32699

SEQ ID NO: 35703 - DNA, 1482 bp, Wigglesworthia glossinidia brevipalpis; identical to SEQ ID NO: 32700
  CDS (1)..(1482)

SEQ ID NO: 35704 - protein, 493 aa, Wigglesworthia glossinidia brevipalpis; identical to SEQ ID NO: 32701

SEQ ID NO: 35705 - DNA, 1524 bp, Wolinella succinogenes; identical to SEQ ID NO: 32702
  CDS (1)..(1524)

SEQ ID NO: 35706 - protein, 507 aa, Wolinella succinogenes; identical to SEQ ID NO: 32703

SEQ ID NO: 35707 - DNA, 1518 bp, Xanthomonas campestris; identical to SEQ ID NO: 32704
  CDS (1)..(1518)

SEQ ID NO: 35708 - protein, 505 aa, Xanthomonas campestris; identical to SEQ ID NO: 32705

SEQ ID NO: 35709 - DNA, 1521 bp, Xylella fastidiosa; identical to SEQ ID NO: 32706
  CDS (1)..(1521)

SEQ ID NO: 35710 - protein, 506 aa, Xylella fastidiosa; identical to SEQ ID NO: 32707

SEQ ID NO: 35711 - DNA, 1518 bp, Yersinia pestis; identical to SEQ ID NO: 32708
  CDS (1)..(1518)

SEQ ID NO: 35712 - protein, 505 aa, Yersinia pestis; identical to SEQ ID NO: 32709

SEQ ID NO: 35713 - DNA, 23 bp, Primer
atgtctgaacaagaaacacgggg

SEQ ID NO: 35714 - DNA, 22 bp, Primer
ttatttctgtgggcgcatcgcc

SEQ ID NO: 35715 - protein, 561 aa, consensus; identical to SEQ ID NO: 32712
  MISC_FEATURE (1)..(561): consensus for the disclosure of xaa see table XV

SEQ ID NO: 35716 - protein, 34 aa, consensus; identical to SEQ ID NO: 32713
  MISC_FEATURE (1)..(34): consensus for the disclosure of xaa see table XV

SEQ ID NO: 35717 - protein, 46 aa, consensus; identical to SEQ ID NO: 32714
  MISC_FEATURE (1)..(46): consensus for the disclosure of xaa see table XV

SEQ ID NO: 35718 - protein, 135 aa, consensus; identical to SEQ ID NO: 32715
  MISC_FEATURE (1)..(135): consensus for the disclosure of xaa see table XV

SEQ ID NO: 35719 - protein, 62 aa, consensus; identical to SEQ ID NO: 32716
  MISC_FEATURE (1)..(62): consensus for the disclosure of xaa see table XV

SEQ ID NO: 35720 - protein, 45 aa, consensus; identical to SEQ ID NO: 32717
  MISC_FEATURE (1)..(45): consensus for the disclosure of xaa see table XV

SEQ ID NO: 35721 - DNA, 300 bp, Saccharomyces cerevisiae; identical to SEQ ID NO: 5168
  CDS (1)..(300)

SEQ ID NO: 35722 - protein, 99 aa, Saccharomyces cerevisiae; identical to SEQ ID NO: 5169

SEQ ID NO: 35723 - DNA, 282 bp, Saccharomyces cerevisiae; identical to SEQ ID NO: 5170
  CDS (1)..(282)

SEQ ID NO: 35724 - protein, 93 aa, Saccharomyces cerevisiae; identical to SEQ ID NO: 5171

SEQ ID NO: 35725 - DNA, 995 bp, Gallus gallus (chicken); identical to SEQ ID NO: 5172
  CDS (100)..(723)

SEQ ID NO: 35726 - protein, 207 aa, Gallus gallus (chicken); identical to SEQ ID NO: 5173

SEQ ID NO: 35727 - DNA, 603 bp, Strongylocentrotus purpuratus (purple urchin); identical to SEQ ID NO: 5174
  CDS (1)..(603)

SEQ ID NO: 35728 - protein, 200 aa, Strongylocentrotus purpuratus (purple urchin); identical to SEQ ID NO: 5175

SEQ ID NO: 35729 - DNA, 401 bp, Babesia bovis; identical to SEQ ID NO: 5176
  CDS (69)..(362)

SEQ ID NO: 35730 - protein, 97 aa, Babesia bovis; identical to SEQ ID NO: 5177

SEQ ID NO: 35731 - DNA, 327 bp, Schizosaccharomyces pombe; identical to SEQ ID NO: 5178
  CDS (1)..(327)

SEQ ID NO: 35732 - protein, 108 aa, Schizosaccharomyces pombe; identical to SEQ ID NO: 5179

SEQ ID NO: 35733 - DNA, 1381 bp, Caenorhabditis elegans; identical to SEQ ID NO: 5180
  CDS (176)..(883)

SEQ ID NO: 35734 - protein, 235 aa, Caenorhabditis elegans; identical to SEQ ID NO: 5181

SEQ ID NO: 35735 - DNA, 1194 bp, Homo sapiens; identical to SEQ ID NO: 5182
  CDS (77)..(724)

SEQ ID NO: 35736 - protein, 215 aa, Homo sapiens [sequence omitted]

SEQ ID NO: 35737 - DNA, 392 bp, Plasmodium falciparum; identical to SEQ ID NO: 5184
  CDS (79)..(372)

SEQ ID NO: 35738 - protein, 97 aa, Plasmodium falciparum; identical to SEQ ID NO: 5185

SEQ ID NO: 35739 - DNA, 543 bp, Plasmodium yoelii yoelii; identical to SEQ ID NO: 5186
  CDS (72)..(389): n means a or g or c or t/u

SEQ ID NO: 35740 - protein, 105 aa, Plasmodium yoelii yoelii; identical to SEQ ID NO: 5187

SEQ ID NO: 35741 - DNA, 312 bp, Neurospora crassa; identical to SEQ ID NO: 5188
  CDS (1)..(312)

SEQ ID NO: 35742 - protein, 103 aa, Neurospora crassa; identical to SEQ ID NO: 5189

SEQ ID NO: 35743 - DNA, 618 bp, Brachydanio rerio; identical to SEQ ID NO: 5190
  CDS (1)..(618)

SEQ ID NO: 35744 - protein, 205 aa, Brachydanio rerio; identical to SEQ ID NO: 5191

SEQ ID NO: 35745 - DNA, 627 bp, Dermacentor variabilis; identical to SEQ ID NO: 5192
  CDS (1)..(627)

SEQ ID NO: 35746 - protein, 208 aa, Dermacentor variabilis; identical to SEQ ID NO: 5193

SEQ ID NO: 35747 - DNA, 648 bp, Mus musculus; identical to SEQ ID NO: 5194
  CDS (1)..(648)

SEQ ID NO: 35748 - protein, 215 aa, Mus musculus; identical to SEQ ID NO: 5195

SEQ ID NO: 35749 - DNA, 300 bp, Plasmodium falciparum; identical to SEQ ID NO: 5196
  CDS (1)..(300)

SEQ ID NO: 35750 - protein, 99 aa, Plasmodium falciparum; identical to SEQ ID NO: 5197

SEQ ID NO: 35751 - DNA, 699 bp, Homo sapiens
  CDS (83)..(670)
ccccgcgtccgctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaataagaagatgaagatgaggaggaagaggatga

SEQ ID NO: 35752 - protein, 195 aa, Homo sapiens; identical to SEQ ID NO: 5199

SEQ ID NO: 35753 - DNA, 915 bp, Gallus gallus; identical to SEQ ID NO: 5200
  CDS (183)..(830)

SEQ ID NO: 35754 - protein, 215 aa, Gallus gallus; identical to SEQ ID NO: 5201

SEQ ID NO: 35755 - DNA, 294 bp, Plasmodium falciparum; identical to SEQ ID NO: 5202
  CDS (1)..(294)

SEQ ID NO: 35756 - protein, 97 aa, Plasmodium falciparum; identical to SEQ ID NO: 5203

SEQ ID NO: 35757 - DNA, 279 bp, Candida albicans; identical to SEQ ID NO: 5204
  CDS (1)..(279)

SEQ ID NO: 35758 - protein, 92 aa, Candida albicans; identical to SEQ ID NO: 5205

SEQ ID NO: 35759 - DNA, 1266 bp, Mus musculus; identical to SEQ ID NO: 5206
  CDS (90)..(737)

SEQ ID NO: 35760 - protein, 215 aa, Mus musculus; identical to SEQ ID NO: 5195

SEQ ID NO: 35761 - DNA, 782 bp, Mus musculus; identical to SEQ ID NO: 5208
  CDS (60)..(692)

SEQ ID NO: 35762 - protein, 210 aa, Mus musculus; identical to SEQ ID NO: 5209

SEQ ID NO: 35763 - DNA, 1153 bp, Sus scrofa; identical to SEQ ID NO: 5210
  CDS (144)..(776)

SEQ ID NO: 35764 - protein, 210 aa, Sus scrofa; identical to SEQ ID NO: 5211

SEQ ID NO: 35765 - DNA, 285 bp, Ashbya gossypii; identical to SEQ ID NO: 5212
  CDS (1)..(285)

SEQ ID NO: 35766 - protein, 94 aa, Ashbya gossypii; identical to SEQ ID NO: 5213

SEQ ID NO: 35767 - DNA, 833 bp, Branchiostoma belcheri tsingtaunese; identical to SEQ ID NO: 5214
  CDS (61)..(729)

SEQ ID NO: 35768 - protein, 222 aa, Branchiostoma belcheri tsingtaunese; identical to SEQ ID NO: 5215

SEQ ID NO: 35769 - DNA, 24 bp, Primer
atggccgcaactaaagaagcaaag

SEQ ID NO: 35770 - DNA, 25 bp, Primer
tcaagcacgtgtagcattgtacaat

SEQ ID NO: 35771 - protein, 75 aa, consensus; identical to SEQ ID NO: 5300
  MISC_FEATURE (1)..(75): consensus for the disclosure of xaa see table XV

SEQ ID NO: 35772 - protein, 29 aa, consensus
  MISC_FEATURE (1)..(29): consensus for the disclosure of xaa see table XV
XDPXXPKXXXSXXXXXXXXXRXXXXXXXP

SEQ ID NO: 35773 - protein, 12 aa, consensus
  MISC_FEATURE (1)..(12): consensus for the disclosure of xaa see table XV
XXXXXXXXXXXW

SEQ ID NO: 35774 - protein, 22 aa, consensus
  MISC_FEATURE (1)..(22): consensus for the disclosure of xaa see table XV
XXXXXXXXXXXXXXYXXXXXXY

SEQ ID NO: 35775 - DNA, 1416 bp, Saccharomyces cerevisiae; identical to SEQ ID NO: 4140
  CDS (1)..(1416)

SEQ ID NO: 35776 - protein, 471 aa, Saccharomyces cerevisiae; identical to SEQ ID NO: 4141

SEQ ID NO: 35777 - DNA, 630 bp, Nostoc sp. PCC 7120; identical to SEQ ID NO: 4142
  CDS (1)..(630)

SEQ ID NO: 35778 - protein, 209 aa, Nostoc sp. PCC 7120; identical to SEQ ID NO: 4143

SEQ ID NO: 35779 - DNA, 603 bp, Pyrococcus abyssi; identical to SEQ ID NO: 4144
  CDS (1)..(603)

SEQ ID NO: 35780 - protein, 200 aa, Pyrococcus abyssi; identical to SEQ ID NO: 4145

SEQ ID NO: 35781 - DNA, 651 bp, Pseudomonas aeruginosa; identical to SEQ ID NO: 4146
  CDS (1)..(651)

SEQ ID NO: 35782 - protein, 216 aa, Pseudomonas aeruginosa; identical to SEQ ID NO: 4147

SEQ ID NO: 35783 - DNA, 786 bp, Archaeoglobus fulgidus; identical to SEQ ID NO: 4148
  CDS (1)..(786)

SEQ ID NO: 35784 - protein, 261 aa, Archaeoglobus fulgidus; identical to SEQ ID NO: 4149

SEQ ID NO: 35785 - DNA, 624 bp, Thermotoga maritima; identical to SEQ ID NO: 4150
  CDS (1)..(624)

SEQ ID NO: 35786 - protein, 207 aa, Thermotoga maritima; identical to SEQ ID NO: 4151

SEQ ID NO: 35787 - DNA, 645 bp, Caulobacter crescentus; identical to SEQ ID NO: 4152
  CDS (1)..(645)

SEQ ID NO: 35788 - protein, 214 aa, Caulobacter crescentus; identical to SEQ ID NO: 4153

SEQ ID NO: 35789 - DNA, 747 bp, Schizosaccharomyces pombe; identical to SEQ ID NO: 4154
  CDS (1)..(747)

SEQ ID NO: 35790 - protein, 248 aa, Schizosaccharomyces pombe; identical to SEQ ID NO: 4155

SEQ ID NO: 35791 - DNA, 915 bp, Plasmodium yoelii yoelii; identical to SEQ ID NO: 4156
  CDS (1)..(915)

SEQ ID NO: 35792 - protein, 304 aa, Plasmodium yoelii yoelii; identical to SEQ ID NO: 4157

SEQ ID NO: 35793 - DNA, 1440 bp, Neurospora crassa; identical to SEQ ID NO: 4158
  CDS (1)..(1440)

SEQ ID NO: 35794 - protein, 479 aa, Neurospora crassa; identical to SEQ ID NO: 4159

SEQ ID NO: 35795 - DNA, 609 bp, Methanosarcina mazei (Methanosarcina frisia); identical to SEQ ID NO: 4160
  CDS (1)..(609)

SEQ ID NO: 35796 - protein, 202 aa, Methanosarcina mazei (Methanosarcina frisia); identical to SEQ ID NO: 4161

SEQ ID NO: 35797 - DNA, 600 bp, Methanosarcina acetivorans; identical to SEQ ID NO: 4162
  CDS (1)..(600)

SEQ ID NO: 35798 - protein, 199 aa, Methanosarcina acetivorans; identical to SEQ ID NO: 4163

SEQ ID NO: 35799 - DNA, 546 bp, Pyrococcus furiosus; identical to SEQ ID NO: 4164
  CDS (1)..(546)

SEQ ID NO: 35800 - protein, 181 aa, Pyrococcus furiosus; identical to SEQ ID NO: 4165

SEQ ID NO: 35801 - DNA, 1056 bp, Plasmodium falciparum (isolate 3D7); identical to SEQ ID NO: 4166
  CDS (1)..(1056)

SEQ ID NO: 35802 - protein, 351 aa, Plasmodium falciparum (isolate 3D7); identical to SEQ ID NO: 4167

SEQ ID NO: 35803 - DNA, 25 bp, Primer
atgatcgtatttcgtcgctttccta

SEQ ID NO: 35804 - DNA, 26 bp, Primer
ttaacttttacttacaggaggtactg

SEQ ID NO: 35805 - protein, 245 aa, consensus
  MISC_FEATURE (1)..(245): consensus for the disclosure of xaa see table XV
GXVLEXGXGXGXNXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXFXXCXXXXXXXXLXXXXXVXXXXXGXXXXXEHXXXXXXXXXXXXXXXXXXXXXXXXXXXG

SEQ ID NO: 35806 - protein, 245 aa, consensus; identical to SEQ ID NO: 4390
  MISC_FEATURE (1)..(245): consensus for the disclosure of xaa see table XV

SEQ ID NO: 35807 - DNA, 3870 bp, Saccharomyces cerevisiae
  CDS (1)..(3870)
atgaatattcttaagcatttcccaagctatgttggcccatctaagattaggaccttagtgataccaattggccattggacgcgaaaagagtttaataatgcggtacagaaactttctgaattcaacgaaattcatctgtctgatgtaacccccattgacagccctatcttcacaccgcaaggctttccacatgggaagttatttttcgacttcttgaccatagatcatgacgatgcattggagttgtttctgtatgattttgagccatttcggaaaacatttgtcattattgggctggtaaacgattacagtgaccccttgaccaatttgaatttcatgaaggagaagtatccaactttgatttcaccgaatttggtgtacgcttcatctacacccactaaagagcttgagcaaaccatagatacgatggaaaatgtattcgcatcttctccagatatgcagaaaaacatagaaacgattatgtgcgacatagcaaggaactttttaaccgcattgaacagctattactcttcctataaacatgttactttgaggtcgccgggtgcgattggtgggaatgcggtattgaaaacaactctaataagacagaacagttacacatcttcgtcatccagcacacccatgtcagcggtacaatcttccgtctcaagttcatcgaaggcaggctcagttactactgcttctaagaggttatcttcctttgagatgactaccaatagtttaaagagatccgcttctctaaagctagctaccacgctttccacatctgagaataggtctcaacaaaaatcattgggcagacaaatgaaaattttgggcaatttccaattgctggcaggaaggtacgttgatgcgttgaacagctttgttgatgcgatcacaactttgtacaaagtgcgtgactacttatggttgggttctgctcttgacggtatttcgatctgctttttacttctatcttatctcggtttgtcataccagattccacaaattgtgagtctcatttgtcctgtggagaagctcaattttgaatctagctcaacggggatttcgcctgtagattccaatagtaaagccacagcaagcacgacggcgtcaagcacaccaaggaacagcatatctatagctgctatgcagtcacctagaaattccattatgtctttatctgccccagcattaaatattgatgtagaaaacatcaacctcccgttattaattaaatgcatatctgacaaagtcttgtattattatgatttaagtttgatgcacaatagtgaatatgctccgcaagtggtttattgcgagtttttactgaagactttaactttcatgacatcgtgttataagagttcagagttttcaaaggacgttctggacaatattgtgaaaaaccaacacagggccttgtcagatatccctaatagtccgatgttcccaaggtttgaagtttatttctatagcaataaattgttcgaattacaattgaaggaaatgcaagttgaggctcaaattaaaatatactctactatggcggaagtttatcgccttttgggatacaaaagaaagcaattattcgtgttaagattgctgatggttgctcttttggcgactccgaataagatagcatggcatcctgactacaggaccttgatagataccatcatagaactcctcaacatcaatgaaagcgaggccaaaatcaatgtagatgatccgtctcaatctacttggttgatcctacagaaaaagatcctacaactatgcattaaagtttcaagaaaaatcaatgacttcgaatatgtcgctaaatttagctcgatactaattacgaaatatacgcatctgttaaatcagtcggaacaagatgccttgtttaaagaatatattcaaccatcaattaccaacgagtctatcacaagttattgggatcccttcattctgagggaagttgttataaatagaatattggatagtgaccccacttcaaacgaaatcccattagagtcagatgttagcagccttgaaagcctagaaaatagacaaaagacacaggatattaatccgcaggaagttttcaaccctttcaaacgggttcaaccaacttcttttgtttctaataacagcaccaaagttcctattttagtatttttagttggcgataaggctgaattcacctgcagggttcaaaatcctttcaaatttgattttacgatcaatgatattcaactagatgaggaaatatctgaattttgtgagattgatagaaaagctgtaagttattcagggccatataatgttaaagccgagtcaataagatccatcacattgcctttgattattaaaaagccaacatacaaaaaaatctacgagatttcatgcctaaaaatctctatcctaaaactaccgcttcagaaattcgatattataaacgattctagaagatcgaatcctgttgaagaagaggcagaatacagtaaatgtatatacggaaaattaaaaattaaaatcctgcctgaacaaccacaattagaactattgagtacttccaagatgacaagaaactcatggatgatgctggatggtaccaaaactgattttcatataacggtgagaaataaatcactgagctgtgcaataaatcatattaagatcataccaatgaataatattgagcaaatgttgaaacctgattattggaaaaaaatgccaccagatgacttgtacatcatggaaaaacagctagattggctctctaagtcttgtgtacgtattattaaattaccaacggtaatcaagccaaatgaaaccatcacatttgatttggaattagataatactgctgttccatttaatttcaccggatttgacttattgatcgaatacggtatgagcgctactgatgaatcctgcatttatttaaaaaagttatcaataccatatgaagtaacattgagaagaacaattgaagtaccaagtatggacatcataccgctaaatgaactcttcagctcgcaagttgaaaatgttgattggattgagtatgtaatgagcaaaatacgtgcagaatctaacctccactctagagattttatattgttattattagacttcagaaattcttggattgacggaataaaattgaatgttcaatttgaagatttcactagtaatgagtatcatgtagaggcaagccatacctcgagaattattgttcctattaaaaaaattgattacaaaaagtataattttgagaatacacctataccaagaatctatccaggccgacaatttattcaaagtggtttaaacgaagaacagactatagaaatgagacaaaaattttggtgtcgcgaacatatcatttcaaagcttaaatgtaactggaaattaaccacagaccaatctgtaacaggttcggtggatttcaataagttcatagaaaagtttgatcacaagatggtctacacgatataccccgggagattattttacggagtgcagctattgcttgatgagccaaaagtcaaagtaggggaaataataaacttgaagataataacagagccgactagtacatgtagaagaaaacaaaattctactgtaaattttttggacatcgtgattttcgacagcaagacatcaaaaatattaccaagatcgaacagacgaattttgtataatggttcgttaactaaaccaatcagtacaaccaaagtttctgaaattaacttagaaattattccaattgaaaaaggccggtacgagtttagcgtttgcatctccaaatcaaacaaccaagatggaataatccagttcgactctgaaaacgttatcttgtctgttatttag

SEQ ID NO: 35808 - protein, 1289 aa, Saccharomyces cerevisiae
MNILKHFPSYVGPSKIRTLVIPIGHWTRKEFNNAVQKLSEFNEIHLSDVTPIDSPIFTPQGFPHGKLFFDFLTIDHDDALELFLYDFEPFRKTFVIIGLVNDYSDPLTNLNFMKEKYPTLISPNLVYASSTPTKELEQTIDTMENVFASSPDMQKNIETIMCDIARNFLTALNSYYSSYKHVTLRSPGAIGGNAVLKTTLIRQNSYTSSSSSTPMSAVQSSVSSSSKAGSVTTASKRLSSFEMTTNSLKRSASLKLATTLSTSENRSQQKSLGRQMKILGNFQLLAGRYVDALNSFVDAITTLYKVRDYLWLGSALDGISICFLLLSYLGLSYQIPQIVSLICPVEKLNFESSSTGISPVDSNSKATASTTASSTPRNSISIAAMQSPRNSIMSLSAPALNIDVENINLPLLIKCISDKVLYYYDLSLMHNSEYAPQVVYCEFLLKTLTFMTSCYKSSEFSKDVLDNIVKNQHRALSDIPNSPMFPRFEVYFYSNKLFELQLKEMQVEAQIKIYSTMAEVYRLLGYKRKQLFVLRLLMVALLATPNKIAWHPDYRTLIDTIIELLNINESEAKINVDDPSQSTWLILQKKILQLCIKVSRKINDFEYVAKFSSILITKYTHLLNQSEQDALFKEYIQPSITNESITSYWDPFILREVVINRILDSDPTSNEIPLESDVSSLESLENRQKTQDINPQEVFNPFKRVQPTSFVSNNSTKVPILVFLVGDKAEFTCRVQNPFKFDFTINDIQLDEEISEFCEIDRKAVSYSGPYNVKAESIRSITLPLIIKKPTYKKIYEISCLKISILKLPLQKFDIINDSRRSNPVEEEAEYSKCIYGKLKIKILPEQPQLELLSTSKMTRNSWMMLDGTKTDFHITVRNKSLSCAINHIKIIPMNNIEQMLKPDYWKKMPPDDLYIMEKQLDWLSKSCVRIIKLPTVIKPNETITFDLELDNTAVPFNFTGFDLLIEYGMSATDESCIYLKKLSIPYEVTLRRTIEVPSMDIIPLNELFSSQVENVDWIEYVMSKIRAESNLHSRDFILLLLDFRNSWIDGIKLNVQFEDFTSNEYHVEASHTSRIIVPIKKIDYKKYNFENTPIPRIYPGRQFIQSGLNEEQTIEMRQKFWCREHIISKLKCNWKLTTDQSVTGSVDFNKFIEKFDHKMVYTIYPGRLFYGVQLLLDEPKVKVGEIINLKIITEPTSTCRRKQNSTVNFLDIVIFDSKTSKILPRSNRRILYNGSLTKPISTTKVSEINLEIIPIEKGRYEFSVCISKSNNQDGIIQFDSENVILSVI

SEQ ID NO: 35809 - DNA, 3633 bp, Schizosaccharomyces pombe
  CDS (1)..(3633)
atggaatttgattttttttcgtttgttgctccttccagagttcaatcattagtccttccttttggtcgtgttagaagaaaaagtttctcgtcctacctacaattactccgcagagtaagtcatattcagttgagtgatgtccctgtagctactgctactagaaaatcgagttctttcaatcctttggcttttccgttgggcagattggtgtacaatttcctaaccagccttgatgatcaacaagctctactagaagaatttgaatattttcggcgcgttttcgttcttattggtattgtagatgggtcagaggaacaagaagttgagcaattatgttctaccttggatgtttggcggagaaggatacctcatgcgttagttgcaaaatgcatcgtatttaattgtccagaagacaaagagaatatatttaatgctcccaatatcataataggaccaaggtctgatttttcaataaactccgtaatgcggtctattttatgcgatatcactgctgagttgttagaaggatttagttcgctcgagttttctatacacgcgcgttccgtgatcctttctccaattactgacatgccacatttggctcccttgcaaaggaaaaattctaatgcgtcgattcactccttaggctcatcttctcgtcctactttgacgagaactccctcgatcacatcaagatctgtgaatagtgtaacggaacgatccaaaagtctctcaaaggggcgtattgagaaccaatttggccagctatacttgctggccggcagagttcccaatgcgttgaagcatttctcaacagccatagcgctttctaaagcaactggagactttctttggcaaggactttcgttggagttatttactgtttgtctggttataatggctcatttgcatgtggacgtccagattcctcctaatatattatccatgttcccttcttataatgatagattgaatgcctttggaccactcaaatttgatgcactattaaactttatcacagaaatgcgcaacgtagttgatcaattatatcaaaaatccactcttcaacctaatgatgctgtccccggcctctgtttttccgagagtatcctacggtatgctcatttactcacagttgtttatagttgtaaaggatttaacgacaacgctttggatcatattattgctcaagcccccataagacctgttaaaaaagctacaacgtatgtaccaaataaagcaactatttgtcaatggattatgagagcccaaggacagcatcttaactctctttcaattcgtgaacgttgtcgcatatacggggctatggcaaatatgcttggaagtataggattttctcggttaagggtcaagatgttgcgtgagttggttgcgagtttaacacctgtactattagaaacgcgtaggcaaaatgcttcaaaaaatggaatacatccggaggttattgcttcgcataccgcacaatcctttaaaagcactcattactgtaacatcttacctttgatatctgaaatatgtcaagaatatggcctattgaaaactgatggtagtcttctaaatccagaattaacaaaatggggttggtcaaatttacaatttgatgttcttaatgagcttatatccctttgtgattctctatctgactatcgcagtattcttcttttaatttctttgttttttctcacttctgttcaaactgcttcttcttcccaacaaatctctatgtttaaagcttttagaaaaacgtacctatttgctagcaatgctggtatacacattaacgctccatactgggacccatttatgataacggatttaaagttcattggttcgtccgagaatgccgaattaattcatcaacggttaagaaacgggttaccaaaatcaattgaaaaaggaccattcatctataatccatttaatagaagacaggaccaaaaccaatcgaaatcagtcctcgttgtcgatgaacaagttgcgttttcgatctattttcgtaaccctcttagtgtatcagttgaagtgcaagatgttcatttagaaacgaaaggggtttctgcaaaatgttcacattctacttttacgatgcggccactatctatagagcgtactacacttactgtaactcctacggaaaccggagaattacatattgttggttgtcgtgtaaaagtctttggctgtgagccaattctgcagtatgtttacgaagcaaaggataaacacaagtcattgcacgtttaccttgagaaaagtaaagacgtcaatgctgaacttcgttccttggataccatcgaccatttatggacttactttccgtttaaaaaggacttgaaaactaagtcatttgattgtatagttatagctagccagccgaaattatcgcttgcttttcaaaacctaacatctggaaagtttaactttgctgaatacgaaacgggtgaattggtgtatgtaattgaaaatacgtcttttgttgaggcatctcacatatctgttctttttgaggacagttcatccaaagcttttgagcaagctatagcggataaaagtatcacagcagatcgattatatgaactccaatttgaagaatttaacctcccaacatttactgtcgagagtagccaaccgttttcactttcaccaggtgagcgcagggaaattcatattaaaatccgggcaaagccaaattctcaagaaggattgatattatttgaaagtagtgtgcataagcctgaagacacagaattttatgttagacgtctaagaatcccggtttctttaaacataagtaaaagagtggatttgaaacaatggtctgcgtttatggatactgaaggagatcccagctactgcttggtgctattaaacttttataatcatttctctgagcctttatttgtcacggttaaaacagcaagtaccgatgagtcccgatcagttttaatcaaaccaaaagctgataatgtcatattattccgtttaaaaagatttattatgtcctctgaggaaatcaatcttgatattccaaacttatctacaaagcaattcgtactatctagcggatttaaaaaaagtatcgaggatagctatactatgaaaaagcgtttttggattaaggagtattttctaaaagaagttcaagcttcttggaaaaccgacgataatcttcaccatggagagatttacttgagaaatcatattttgtctgacgaaatggcaaataatctatctattctaccaattaggattcaggcttgggttagctatgattctgaaaaagtcaccacggtttgtccgcgagaaccattcaaacttgttcttgaatttttcggtcatgccgataccaatatgcgttataaaatatcgtggactcaattaaatactcaagctaacacttcttccttcaacggactaattttagatggcccagaagaggacattgtatgctttaacaattccaaatgtcatgtcgtgatcgagcgcaacatgtttgcatatacaacagggatgtacaatatatttgttcgtatttttaacgaagaactacaattgctatcgcagcctgttgacttggatgagcccatactactaattgttgatgcgaagtaa

SEQ ID NO: 35810 - protein, 1210 aa, Schizosaccharomyces pombe
MEFDFFSFVAPSRVQSLVLPFGRVRRKSFSSYLQLLRRVSHIQLSDVPVATATRKSSSFNPLAFPLGRLVYNFLTSLDDQQALLEEFEYFRRVFVLIGIVDGSEEQEVEQLCSTLDVWRRRIPHALVAKCIVFNCPEDKENIFNAPNIIIGPRSDFSINSVMRSILCDITAELLEGFSSLEFSIHARSVILSPITDMPHLAPLQRKNSNASIHSLGSSSRPTLTRTPSITSRSVNSVTERSKSLSKGRIENQFGQLYLLAGRVPNALKHFSTAIALSKATGDFLWQGLSLELFTVCLVIMAHLHVDVQIPPNILSMFPSYNDRLNAFGPLKFDALLNFITEMRNVVDQLYQKSTLQPNDAVPGLCFSESILRYAHLLTVVYSCKGFNDNALDHIIAQAPIRPVKKATTYVPNKATICQWIMRAQGQHLNSLSIRERCRIYGAMANMLGSIGFSRLRVKMLRELVASLTPVLLETRRQNASKNGIHPEVIASHTAQSFKSTHYCNILPLISEICQEYGLLKTDGSLLNPELTKWGWSNLQFDVLNELISLCDSLSDYRSILLLISLFFLTSVQTASSSQQISMFKAFRKTYLFASNAGIHINAPYWDPFMITDLKFIGSSENAELIHQRLRNGLPKSIEKGPFIYNPFNRRQDQNQSKSVLVVDEQVAFSIYFRNPLSVSVEVQDVHLETKGVSAKCSHSTFTMRPLSIERTTLTVTPTETGELHIVGCRVKVFGCEPILQYVYEAKDKHKSLHVYLEKSKDVNAELRSLDTIDHLWTYFPFKKDLKTKSFDCIVIASQPKLSLAFQNLTSGKFNFAEYETGELVYVIENTSFVEASHISVLFEDSSSKAFEQAIADKSITADRLYELQFEEFNLPTFTVESSQPFSLSPGERREIHIKIRAKPNSQEGLILFESSVHKPEDTEFYVRRLRIPVSLNISKRVDLKQWSAFMDTEGDPSYCLVLLNFYNHFSEPLFVTVKTASTDESRSVLIKPKADNVILFRLKRFIMSSEEINLDIPNLSTKQFVLSSGFKKSIEDSYTMKKRFWIKEYFLKEVQASWKTDDNLHHGEIYLRNHILSDEMANNLSILPIRIQAWVSYDSEKVTTVCPREPFKLVLEFFGHADTNMRYKISWTQLNTQANTSSFNGLILDGPEEDIVCFNNSKCHVVIERNMFAYTTGMYNIFVRIFNEELQLLSQPVDLDEPILLIVDAK

SEQ ID NO: 35811 - DNA, 3597 bp, Eremothecium gossypii
  CDS (1)..(3597)
atggaaggcgtatgcggcccggcacgggtgcgggtgctggtggtaccggcaagcgatgggtggcggcgcggggagtttctagggtacgttgagcggctgcgcgagagcccagaggtgcgactggtggacattacgccgatagcagactcgatgttcaacccgcaagggtttccgcagggcaaactgctgttcgagattgaggtggaggccaaggatgaaagctcgatgctgtttctgtacgacttcgagccctaccgcaagacgtttgtggtggtcgggctgtgccagggaacggcgggggcggaggcggccggacggctggcgaagctggaagcgaagttcccgcactgcattgggcactgcctgatctaccagactgcgggggcggcgaacgagcgggtgctggggttcggcgcgtcgtcggagacgctgatgtgcgacgtggggcggtgttttctgcgggcgctgcacacgtactacctgtcgtacaagcatgtgacgctgcgatcgccgggcgcggtggggggcaacgcggtgctgaagacgacgtttatgtgccggccggcggggccgaacgcgaagcggctgtccgcgacgctggagaacggcacgggcagcaagaaggggtcgctgaagggcgcgaaggtggcggcgccggaccggtcgcagcagcgtgcgaaggggcggcagctgaagatcctggccaacttccagctgttggccggacagtacatgagcgcgctggcgaacttctccgaggccgcacacacggcgcacaaggtgcgggaccacttgtggctgggcagcgcgctggagggcgtgttcatctcgatgatcctactatcgtacctggcggtgccgttccagatcccggctgtggtcgtgcagctgtgcccgccgaagtcatatgtagtcgcctccgcctcgtcgtcgcagcgcagctcgagctcgtcgatcagcggcagcccgaactccggggcaaacggcgcctttcagtcgccgcggccgtcgatgagcgggccgaacgcgccggtgctgcactcgaacgaggtgctgctgggtaatctgctgaagtgtctgaacgagcgtgttctacactattacgagctgtctctgacccagagcgttgagtacacgccgcaggtcgtctattgccagtcgctgctccgcatgctgcagttcatgtcggagtgtcacaagagcaactcgctgggtgagcctgccctgagatcaatggtgctcggggtcacacatgagcctgaggctcccgccgacaccatggagccgattcttttctcaaagatggagatttaccaactctccaatcgtttttttgagctgcagctgaaggacctcgatctcattacacaggttagattttacatcacactagcgtctgtttacggaaacctatcgctggagaggaagcgtgctttcgtactgcgcattttattcgtatctctgctcccgaacattgaagcacttccgtggcgtgatgagtacgataatttgatggaggagctgctgcggacctacggcatcgcgtcctgggagccagagaacaaaatacaagacgcactttcagttcattgggtcaccctgcagaaaaacgttctcatcttactcattaacatagtgaagaaggctggaagagcacggaaggtcctcaagttttcccggtgggcaatcactaggtacagccatattctcacgcataccgagcagactcgcttattcaaagacttcctactacctgctgcgcaacaacaccccgaagaatttgaatactgtgatcctttcctcctgcggaatatctcattgttgaagctcgagcaccataggcaggtacccacggtagaacacctcgaaattgcctctaattcagagaataaaggagaaatattcaaccctttcaaatacaatgatgttgcggcaccagaggcgtcgaatgatgatatagaaaactttatggtttccgaaagagcggaatttatatgctcattccaaaacccattcaactacgatctggacattacctccctttcgctatgtcaggaagacgtaaagtacttgagaatctgtggaaaccaagtttccagcgaagcgccattcattgttaaggcgcacagcatgcgggcgcttcatctcaccgtggaatttctgcaggataccccaggtcacaaactgcgggcgctgaatataggcttgttcaagctacctgccaggaaataccccatttgtaactcggaacaaaaatcggtgttcgcttctagcagagcagttttgggggaatgcaagctcgtgataatcgaagaccagcctcagctggatttcctctcctctgatcttccacgtgcatcgtgtatgctgctgacaggtgtgaagaaacgcttacaatgtaaagtgcacaatacgtcgctctccaagacagccaactactttcgcttctgcataaacacaaatgtaagctcgcagctgaaggatgactactggcgtacgatcgccgcggacgacctatacgatatggagttgcagttggagcagctaaaagaaaaatgcatcaaggtcacgaactttccagacgaaattaaacctaatgaagtggtcctattcgatctcgagatcgacagcacctgtgcgccgctgcacctagatcactttgatctagttatcaactatggtaacaaccacagcggaaacaacgccgtttatgtcagaaagttagtcatacctttcaacgttacccttaagaggagtgtggaggtcacaaacatggaaatagttcaaatacacgaagaattgcccagcacagtggatgttgattggattaactacatcagagcacagatgcgcgagcaacagctgtcattttctgcctttgcgctgatgctgctcgacattagaaattcttggaccagcaaggtcgttctagaactgggatacgacgatttcagtgcctctccacacgagattggctcctgtcagactatccgcatcatagtaccgatcaaaaagctccgcggcaactcggacctcagtgatcggccgatcccgtccatcgttcgcggccgccagttcgtccacagcgggctctctgacgaccaactgcacgacctccagacccacttctggtgccgtgagcacctcttgtcgaagcttcactgcacctggaagggaagttcgttcgccggtacggtcaacttccgtctattcatgccgaaactgtccaacaacgcgatcgctgtcatgtaccgtagcaaaaagacgccatacacgttggaattacgcacgtccgatccccatgtctctgtctgcgaagaggtcaccataacggcaactatagacgcatccctcgagcacgacagcacttcgactgtctttgtacagttccagtttttcgaacgacggaccggcaagcaaatacccaattcgaacaagcaactgctgtacaacggaacgctgatgaattcaatcgatctgcgcactcagcaggagctaactctcaaggtcctgcccattgaatccggggattacgagtttcatggctcgatcgtgggcactgacgctgcagcgtactcgcttgtccacgtgacctga

SEQ ID NO: 35812 - protein, 1198 aa, Eremothecium gossypii
MEGVCGPARVRVLVVPASDGWRRGEFLGYVERLRESPEVRLVDITPIADSMFNPQGFPQGKLLFEIEVEAKDESSMLFLYDFEPYRKTFVVVGLCQGTAGAEAAGRLAKLEAKFPHCIGHCLIYQTAGAANERVLGFGASSETLMCDVGRCFLRALHTYYLSYKHVTLRSPGAVGGNAVLKTTFMCRPAGPNAKRLSATLENGTGSKKGSLKGAKVAAPDRSQQRAKGRQLKILANFQLLAGQYMSALANFSEAAHTAHKVRDHLWLGSALEGVFISMILLSYLAVPFQIPAVVVQLCPPKSYVVASASSSQRSSSSSISGSPNSGANGAFQSPRPSMSGPNAPVLHSNEVLLGNLLKCLNERVLHYYELSLTQSVEYTPQVVYCQSLLRMLQFMSECHKSNSLGEPALRSMVLGVTHEPEAPADTMEPILFSKMEIYQLSNRFFELQLKDLDLITQVRFYITLASVYGNLSLERKRAFVLRILFVSLLPNIEALPWRDEYDNLMEELLRTYGIASWEPENKIQDALSVHWVTLQKNVLILLINIVKKAGRARKVLKFSRWAITRYSHILTHTEQTRLFKDFLLPAAQQHPEEFEYCDPFLLRNISLLKLEHHRQVPTVEHLEIASNSENKGEIFNPFKYNDVAAPEASNDDIENFMVSERAEFICSFQNPFNYDLDITSLSLCQEDVKYLRICGNQVSSEAPFIVKAHSMRALHLTVEFLQDTPGHKLRALNIGLFKLPARKYPICNSEQKSVFASSRAVLGECKLVIIEDQPQLDFLSSDLPRASCMLLTGVKKRLQCKVHNTSLSKTANYFRFCINTNVSSQLKDDYWRTIAADDLYDMELQLEQLKEKCIKVTNFPDEIKPNEVVLFDLEIDSTCAPLHLDHFDLVINYGNNHSGNNAVYVRKLVIPFNVTLKRSVEVTNMEIVQIHEELPSTVDVDWINYIRAQMREQQLSFSAFALMLLDIRNSWTSKVVLELGYDDFSASPHEIGSCQTIRIIVPIKKLRGNSDLSDRPIPSIVRGRQFVHSGLSDDQLHDLQTHFWCREHLLSKLHCTWKGSSFAGTVNFRLFMPKLSNNAIAVMYRSKKTPYTLELRTSDPHVSVCEEVTITATIDASLEHDSTSTVFVQFQFFERRTGKQIPNSNKQLLYNGTLMNSIDLRTQQELTLKVLPIESGDYEFHGSIVGTDAAAYSLVHVT

SEQ ID NO: 35813 - DNA, 4365 bp, Neurospora crassa
  CDS (1)..(4365)
atgactccggatcctttcctgcccgtcgcgccggcgagggtcaagactttggtgttgcccataggaaggattaagcgtgaccgctttgacacctttgtcaagagcttgacccccgagaatgtcgtccagctgcgcgacgtcaccgccgatggacgtccaaacagaaacatgttcaccccgctggccttccccgacggcgccatgttctatgatcttatgacacacgtgccacccccttcgcaccttgcgctggtgcccttcgacctgtatcgcgagccgctggccctgcttgccattgccgatggctccgagatcaataacgttgttcttagcaagaggcaatctggcggcaggaccgtcgccgaaacaaacatacgctcgttagatcaggagttggaagacctaagggaccgctaccccaggatacttgttcaccaggtactgctgttcgactatgtgccttccgaagagaacccaataccaatcccagaaggcatcgttaccatcccgccacccgagcagcataaaagaactaccatgaaaacggtcatgtgtgacatatcctcgttgattctcgccgagatgaccacccttgccaagtcatatgagggtatgacctttatcaactcgcccggtcacgcttcgaccgcggaacagatgtatgggggacaagggcctataggagacccttcgaggaggaattcccagtttacactgcccaccaaccgatcggtctcggcgagcggacttattgataggggccaccaggcgcgcatgtccatgcctcctgtccctttcaagggaggcacttttggttccaaccgagcagtttccggccaaccggcaacaccgccaaatgcaagaagcgggctatctaacccgcctacgaattttgacgacatcacgggagacgaatcagctagtcctgagaaggcactgcctccgcgtcccgacctcatggatgtcttcaggacccagagccaggatagggtgtcggtccagggatttggttcaggcggatcgaccgacaagaaattacataggggaaagagcaggttccagatcgtcttgggctcgctatatctccaggctggtcggtggattgatgcgctcagagagctgactgagggtgcagccggggccaaatcgactaatgatcacatttggcacggaaaggccttggagctttctctaatagcactgttgctgctgggttgggcaggcattgaatttgacgtgcaccccatcttactacccactgccgacaaagggacagcgctcgcgaaccagatcctggaggctgaacagaaagatccgaaccaaccgcgctggctacggagattacaggtgtacatcccagagctcctcgaccgtatcattagtctctactcgaggataactgccgaaaatctccaaccgctacccatgtctgagaccatcctccgtttttgcagaatactcacagctctgcatatcgcggatgggaagctcgacgaacggtctctggagatgatggtccttggtacaccgccaccaaagcggttgaccacgtctcctaggtttactatcgtcccaacaaggactcatatcctgtcgaatctaatgaaggcttacccgggttctgcttctgaactgttgactaccgctgatcggatagtactcctcagtggcattgcaaccgtcttgggactactaggtttccagaggaagaaggctatgatcgttagggatctggtgtcggttctgatcggcggcctagtggaagcgcgcaccaggggagccgcggatgttgggattcatcccgcagctggactcgtaggtcttaatgggctcggcggaaatggtcatgccggtgctctggatctaaccgagaatgatatcgagcagggcatcggtccctttctcggcctcctgctcaggacgtacggagtggtgaccgatgacccgggctcgacggcgtctttggaaggcccagccacaagggacgactccgacgaagcagtagttacaagaattttgaaacagtccgatttacggaatttcggcatgcgggacatcaagcttaacattctgaggacatgcgtcagcttctctgaagcgcttccagattttgctggcgtgttgaaatactcgagcgacctcctacggacggctggaagcggtaccgctcctgggctgaggcgcgaggacgcttacccggcaattcatagagaagaccagatacgcttcgccaccaacatctcgaaaacgtctaatcttgccaagcgtctgggtatgggtcatttggcggccgagtattgggacgagtttcttctcaggggcgttaagctcgaacccttggcgacgacgcgaacaccggtttcgcatgctcggagcgtgctgccaaatgccgtgacgacgacgaggacctcgcaagacgtcaatccgtttatttataacccttttctaaaacagccagacgcagcagccgtcgaaaaggttctggttgctggggaggcggcaacattcaaacttaccttccaaaacacatttgaaatggatctggagctggagagcatccgtctagatactgaaggggccgagttcgagtctgcagttgaaagcctcgtcatagggccttatcgtacccaagttctcaggatatcgggagtgccgaaggctgcagggaccttgaggattaagggtgctatcatcaaagtcaggggctgccgcgaaagaaggtttcctattttcattgagcaatgggctcctgagaaagaacaaaaggttaaaggcatcggtctcgcggcacttgatgtcccccccgcgaagcgtacacctccgacacagcgtcctaagccagaaagccttgagcttaacgtcattgccgaacaaccagttgtcgtcgtcaagtcttcaacgctcccccagtcatcggttatgatccttgaaggggagcgccaaaagttctcggtcacgctgcaaaacctatcaaccacgactccggttgatttcctgttgttttccttccaagattcgactcaggaaccattgcaagccgcaatggccagcagagatgccactcccgctgagctctatgaatatgagctcattcttgccaagaagcaggctcttcgtatacgcaaggaagggaaccagaagaggtacattcctcctggcggcacagcaacattcgactttgagattctcgggaaaccaggtcttacacacggcctcatccaggttgactatgcttgcttaggcgtgcctcctgacgagctagaagaggagaggttctttactcgtcaggtctcgctggcacttaccgttactgtcaatgccagtattgaaatagcccgcatggacgtcttcccactgcacggcagcatccctgagcccctctggctacgggcgggtagcaacaaggagagcacgtcggaactgaccgccgatacacattgtctgctgatgctggatttgcgcaatgcttggccaagtaatatggtgatacagctcgagtcagaggacggagccaggctcgaggagcatatccttcctggaaacgttaacagagtgatcttcccaatcaaaagggtctacctcgaggacccttatgcatccattcctgtgttgaacccctctcggcagaggcagttcattgtcagctcaaagcttacgcctgagatggaacgagccaaccgtgaggcgttctggtacagggagaaagtgctagactcgctcacgggaacgtggcggaccgggccaggagggggaaccattgccggcggcaggagcggaagcatcgagttgagggctatgaggttgacgagccgcatgattgaggcggtaaaggtggatgagatcgggatcgaaatctccgttctggatgcctccgcctcgccatcctcccctgaaaagcaaaagcacaaatcacacgcaatcgccaaggtcgagtcctttttgcagctccgcgtcgctgtcactaaccgcacaaatcagcccatctatccgctcgtccgcctcatgccctccctatgccaccgaccactcaacgtcgcgctcgacttcacccgcaagtttgcctggaacggcactctacagaaagcactacctctcttggcaggtggagagagtgccgaagttgttatgggcgtcacggcactgtgtagaggcgagtttgagatttctgcgagcgtggaagagacgatggtgtggaggccgagcgaggaggaagaagaggagaggcggaagaggaggagcgaggtggagaagatgcaagatgcggcgatggggatggagattgcgggcagtaaaagggagaggagggtgtggtgctctaggaggccggctagagttgttgtgatcagaaatgatatggatgattaa

SEQ ID NO: 35814 - protein, 1454 aa, Neurospora crassa
MTPDPFLPVAPARVKTLVLPIGRIKRDRFDTFVKSLTPENVVQLRDVTADGRPNRNMFTPLAFPDGAMFYDLMTHVPPPSHLALVPFDLYREPLALLAIADGSEINNVVLSKRQSGGRTVAETNIRSLDQELEDLRDRYPRILVHQVLLFDYVPSEENPIPIPEGIVTIPPPEQHKRTTMKTVMCDISSLILAEMTTLAKSYEGMTFINSPGHASTAEQMYGGQGPIGDPSRRNSQFTLPTNRSVSASGLIDRGHQARMSMPPVPFKGGTFGSNRAVSGQPATPPNARSGLSNPPTNFDDITGDESASPEKALPPRPDLMDVFRTQSQDRVSVQGFGSGGSTDKKLHRGKSRFQIVLGSLYLQAGRWIDALRELTEGAAGAKSTNDHIWHGKALELSLIALLLLGWAGIEFDVHPILLPTADKGTALANQILEAEQKDPNQPRWLRRLQVYIPELLDRIISLYSRITAENLQPLPMSETILRFCRILTALHIADGKLDERSLEMMVLGTPPPKRLTTSPRFTIVPTRTHILSNLMKAYPGSASELLTTADRIVLLSGIATVLGLLGFQRKKAMIVRDLVSVLIGGLVEARTRGAADVGIHPAAGLVGLNGLGGNGHAGALDLTENDIEQGIGPFLGLLLRTYGVVTDDPGSTASLEGPATRDDSDEAVVTRILKQSDLRNFGMRDIKLNILRTCVSFSEALPDFAGVLKYSSDLLRTAGSGTAPGLRREDAYPAIHREDQIRFATNISKTSNLAKRLGMGHLAAEYWDEFLLRGVKLEPLATTRTPVSHARSVLPNAVTTTRTSQDVNPFIYNPFLKQPDAAAVEKVLVAGEAATFKLTFQNTFEMDLELESIRLDTEGAEFESAVESLVIGPYRTQVLRISGVPKAAGTLRIKGAIIKVRGCRERRFPIFIEQWAPEKEQKVKGIGLAALDVPPAKRTPPTQRPKPESLELNVIAEQPVVVVKSSTLPQSSVMILEGERQKFSVTLQNLSTTTPVDFLLFSFQDSTQEPLQAAMASRDATPAELYEYELILAKKQALRIRKEGNQKRYIPPGGTATFDFEILGKPGLTHGLIQVDYACLGVPPDELEEERFFTRQVSLALTVTVNASIEIARMDVFPLHGSIPEPLWLRAGSNKESTSELTADTHCLLMLDLRNAWPSNMVIQLESEDGARLEEHILPGNVNRVIFPIKRVYLEDPYASIPVLNPSRQRQFIVSSKLTPEMERANREAFWYREKVLDSLTGTWRTGPGGGTIAGGRSGSIELRAMRLTSRMIEAVKVDEIGIEISVLDASASPSSPEKQKHKSHAIAKVESFLQLRVAVTNRTNQPIYPLVRLMPSLCHRPLNVALDFTRKFAWNGTLQKALPLLAGGESAEVVMGVTALCRGEFEISASVEETMVWRPSEEEEEERRKRRSEVEKMQDAAMGMEIAGSKRERRVWCSRRPARVVVIRNDMDD

SEQ ID NO: 35815 - DNA, 4317 bp, Magnaporthe grisea 70-15
  CDS (1)..(4317)
atgagcgcggatcctctgttacccatcgctccggcgagggtaaaggccctggtcctccccgtcggccaaatcagacgccagcgcttcgcctcctttctggataggctggccgccgaacaggtggttcagctgcgcgacatcagcccagatggccggccgaacaggaacatgttctcgcccctggcgttccccgacggtgccatgttctacgagctcacgacccactacccgcacccctcctacttgaccctcacgcctttcgacctctaccgcgagccctttgtcgtcattgctgttgctgacgcttccgagatcgaccgccatgccctcagcaagaggcagtcaggagggggtcggaccaccactgaaagaaacattaggggcttgtaccaggacctggaggacctacgcgaccagttcccaaaggtactcgtgcacaggctgttgctttttgactacgtggagaatcccgacgaacacgttccgatcccagaagacatcacgaccataccgccaccccaggactgcaagagaacaaccatgaggacggtcatgtgtgacatagcgtcacagctcctggccgagatgacctcaatggcaaagcaattcgaggcactctcttatgttgattccccaggccagatacccacaggacagccgaatggccaggaccctatgcacgccagacggaactcgcagttctcgttgcctggggggaccaacggtggacgttcgagctcagctgccgcaaacaaccgcatgtctatgcctgtgctaccaaaaggttcaggctttggatccgccggttcgacgccgatcaggccatctacgccggtaaagagcgggctctcaaatacgccgaatctggacgatggctcatcagagtttagctcgggccctccgacgccggagcaacccaatgcagtacggcctggtaccaatgagaactttaggacagtcagtcaggacaggatatcagtgcaagggtttgggtccggcgggctcaacgagaggtggagaagcaaaggcaaaggcagggtgaccatcatcctggggtcgttatacctgcaggcggggcgatggccagatgctctgaaccacctcaccgagggcgctaccgtggccaggtcgattaacgatcacgtttggcacggcaaggctctggagctgatcgtgatatgcttactgctactgggctgggctggtgttgagtttcaggtgccctcggtgctattggcgccgacctcggaaaagacttctgccagcgcagcagcggccatggccgcagatgagaagaacgcaagtccaacccagccgcggtggtttagaaacttgcaggtcatcctgcctgacctgctagaccgcataattgctctatattcaaggatatcagctgagcatctaccccccttgccaatggccgaggctatcatcagatgctccaggaccttgactgggcttcacctgactgatggctgtctcgaagccgacacacttgggctcttggttctggggcgggcgccgaccaaagtcttgagctcatcacctcggctgaccgtgactccgtcccgtacactcatcgtcaacatgatgttcaaggcattcccaaactcatcaaccgagatgctgagcgcggtcgatcgaatcgcgattttatcaggcatcgcatctgtccttggcatgctaggctatcagaggaaaaaggccatggtcatccgggagcttgtctcagtattgatagggggcctcgttgaagctaggacgcgtggtgcggctgaggtcggcattcaccctgctgcagggctcgctgcattgaatggcgtcagcggccacacgacaggagctgcagccctggaccttggagagggcgacattgaagaatcgatcgacgtttttctaggtctcttgctcagaacatatggcgtggtctcattcgaaatggatacactcgtatcaccaaccaaagatatggaaactgctcatactgacgacggcgcagtcgttaggatacaaaaacaggcagcggcaagattctttggtatacctgcgctcaagctcaatatcctcagagcctgcataaacttctctgaggcactgccagactttaacggggtgctgaagtattcgagtgatctgctgcggactgcaggcagcggtcttgcacctgggccgcggcgtgaggatgccgcgcccataatatctagggatgaacaggtgcgcctcataaccaacatactgaaaacatctagcctctcccagcgtcttggcatgggtgaaatgctggccgatttttgggacgaattcttccttaggggtgtcaagctcgagcctctgccccggacgcgggcaacgattgagcataaaaagagtgagcttgcaggtgcatcgacggcgcgcgaatcccaggacgttgatcctctaattcacaacccgttcctgaagccgcccgacaaggcagcagtagaaagtaccctggttgcgttcgagcccgcgactttcaaattgactttacaaaatccgtatgaaatcgaggttgaaattgaaagcgtgcggttagacacggaaggggtcgagtttgaatcctctgtcgacagcgccctcattggcccatatcgcacgcagatacttcgtctagtcggcataccgaaggctgcggggtctctaaagattaccggcgccatcatcaaagtcaggggttgccgagagaggaggtttcctatattcccgagcccttggtccccagaagaccaaccaaaagtcaaagctattgggctggcagctttggaacagcatgttttggagccggcatcccaagcccccaagactgaccacatctcgctcaacgtcatagatgagcagccagttgtggttgtcaagtcgacttcgttggcccagtcttcggttatgatcctagagggtgaaagtcaagtattctcagtcacactgcagaacctgtccaagacaaccgcggcggactttttgttgttttcgttccaggattcgacgcaggagcctttgcaagctgcattaagcaagaggaatgccacccctcaggagctatacgagtacgagctgatattggcgcgaaagcaagctttgcgtctcaagcccagagcggaccacaagaggtatattggtcccggagaagaggcgacgtttgatttccagatcctgggcaaaccggggcttaccggcggtattatacaagtggattatgcgcaccttggtgtaccaccggaggatgtacctgccaagtttcacacgcgccaggtggccttgcagcttaccattacggtcaacgcgagtgtcgagttgacgagggttgacgtactgcctcttcacgaaggtatccctcggccactgcttgagacggccttccgccgtggagatggtgccagttccctaaaggaaattcaagagaaagtctcgtcagacgattattgcctgctattacttgatctgagaaatgcatggcccagctacatgcaagtcgagctgagcactgaggacggcgctctaatagaagagacgatattgccagggtacacgtcgcgggtcatggtattactcaagcgggtttacttggaagatccacatgcagcagtcccaaccttgaacccagcacggcagcgtcaatttgttgtaagcacgacaatatcaccagaaacggaaagagccaaccgagaggcgttctggtacagagaggagttgctcaaccggatcaaggggtcatggcgggcgacttctggtaccaataggcacggcgccatcgaattgcgcagcatacggctgagcccgcgtatgatcgacgcggtcaagattgaggacgttgacattgacatctcagttgcgtcgcaaaatcccggcgacgatgagagcaagaacgtcttgtatgttgacgaattctcgcgcctcaacgtgcacatcatcaaccggtccgcgaagcccatttacccgacgctgcggctcatgccggccctctgccaccgaccgctcaacgtggcgctggactacacgagaaagtttggttggatcgggacactgcagaagtcgctgccgctattagaggcgcacggggagacgaacgtcgtcatgaccgtggccgcgctctgcagaggtcagtttgaggtcacggcatcggtggaggagacgcaactctggcgggacgagggagcgacggccaagggcagcgatgaaggcggcagaccaagatcagatacgcagacgctgatggacgcggttttgggggccagagagaggaggatctggcacactcgaaagcccttcactgtgacagctctggatagagacggatga

SEQ ID NO: 35816 - protein, 1438 aa, Magnaporthe grisea 70-15
MSADPLLPIAPARVKALVLPVGQIRRQRFASFLDRLAAEQVVQLRDISPDGRPNRNMFSPLAFPDGAMFYELTTHYPHPSYLTLTPFDLYREPFVVIAVADASEIDRHALSKRQSGGGRTTTERNIRGLYQDLEDLRDQFPKVLVHRLLLFDYVENPDEHVPIPEDITTIPPPQDCKRTTMRTVMCDIASQLLAEMTSMAKQFEALSYVDSPGQIPTGQPNGQDPMHARRNSQFSLPGGTNGGRSSSAAANNRMSMPVLPKGSGFGSAGSTPIRPSTPVKSGLSNTPNLDDGSSEFSSGPPTPEQPNAVRPGTNENFRTVSQDRISVQGFGSGGLNERWRSKGKGRVTIILGSLYLQAGRWPDALNHLTEGATVARSINDHVWHGKALELIVICLLLLGWAGVEFQVPSVLLAPTSEKTSASAAAAMAADEKNASPTQPRWFRNLQVILPDLLDRIIALYSRISAEHLPPLPMAEAIIRCSRTLTGLHLTDGCLEADTLGLLVLGRAPTKVLSSSPRLTVTPSRTLIVNMMFKAFPNSSTEMLSAVDRIAILSGIASVLGMLGYQRKKAMVIRELVSVLIGGLVEARTRGAAEVGIHPAAGLAALNGVSGHTTGAAALDLGEGDIEESIDVFLGLLLRTYGVVSFEMDTLVSPTKDMETAHTDDGAVVRIQKQAAARFFGIPALKLNILRACINFSEALPDFNGVLKYSSDLLRTAGSGLAPGPRREDAAPIISRDEQVRLITNILKTSSLSQRLGMGEMLADFWDEFFLRGVKLEPLPRTRATIEHKKSELAGASTARESQDVDPLIHNPFLKPPDKAAVESTLVAFEPATFKLTLQNPYEIEVEIESVRLDTEGVEFESSVDSALIGPYRTQILRLVGIPKAAGSLKITGAIIKVRGCRERRFPIFPSPWSPEDQPKVKAIGLAALEQHVLEPASQAPKTDHISLNVIDEQPVVVVKSTSLAQSSVMILEGESQVFSVTLQNLSKTTAADFLLFSFQDSTQEPLQAALSKRNATPQELYEYELILARKQALRLKPRADHKRYIGPGEEATFDFQILGKPGLTGGIIQVDYAHLGVPPEDVPAKFHTRQVALQLTITVNASVELTRVDVLPLHEGIPRPLLETAFRRGDGASSLKEIQEKVSSDDYCLLLLDLRNAWPSYMQVELSTEDGALIEETILPGYTSRVMVLLKRVYLEDPHAAVPTLNPARQRQFVVSTTISPETERANREAFWYREELLNRIKGSWRATSGTNRHGAIELRSIRLSPRMIDAVKIEDVDIDISVASQNPGDDESKNVLYVDEFSRLNVHIINRSAKPIYPTLRLMPALCHRPLNVALDYTRKFGWIGTLQKSLPLLEAHGETNVVMTVAALCRGQFEVTASVEETQLWRDEGATAKGSDEGGRPRSDTQTLMDAVLGARERRIWHTRKPFTVTALDRDG

SEQ ID NO: 35817 - DNA, 5343 bp, Gibberella zeae PH-1
  CDS (1)..(5343)
atggccgacgctgactcgaacccctctacagccacgcacaactcgccgcgaacatggcttctcacttcagctctgtcacccttagctgtccggctcatccgactccttctttcacatggcgactacgttgtcgcatgtctaccaccctacgagatcgatcatgaggatcgcagcgccgagtttcgtgagcttgtgaacgagtgtaagagctcgagaaaggaccgcgaagggtggaaggaccgcattcgcggcattcgatgtgacggcgcttccatgggaagttgtggtgctgctgtcgcagaagctgttcaggtttttggacggatcgacattttgttatgctgcaaatctgatgctgccacctgggctctcgaaggcttttgcgactcactcgcatatgagattgcgcccttcaacatcaaagtcacagttgttcagcccaataaggagattctgtccttaaccaatcgcctcacattcgcccctcaattgcctgcttacgaccagtaccaagagtctgccccgagtattcgcgacattctcgccaacgtcctcaacactcatccagacacggctttgccttaccccacatcaccagccgactatggaccttcgccaatgtccccaccaagtatatccatcgagccggatgtcgccccaggcgagatcctgcatcgctaccccaagctacctcccggcgcagcagataagctggtcatggagacagtccacgccttatcggcgattggaggacatgagaaccctccggcgcgccacattgttggttatgaagctgccgttgcagtaaaggaaaaactcaaaacagtcacggaagagttggaggacttcgtagaagcgagtttgtctgtggacacgtttgaaagtgagttgcaagccgaagcaagagagaggaagccgtcagaccaaagtccccaaggaccaccatcgtctacaagtgttaacgtagacttgctgccactgagacgctcaaagagtcgctctctacagaaacaccaaccacgttgcgcccgcggttatgttgagcaaacaccagatgctaggatgagcttagatcctttggcccccgtcgctcccgcgagggtaaagactcttctgttacctctggggcagataaaagcagaccgattcgctacctttgtcgagcgattaaaccagcaacatgtcgtccacctccgcgacatcagcgctgatggcagacctaacaggaatatgttctcgcctctggcttacccagatggcgctataatatacaacctcgtcactcacgttccgcctccctctcacctcgcccttactcccttcgacttataccgagaaccccttgccataatagctctggcggatggcaccgagctgcatcaaaagaacctaaataaacgacaatctatgaatggtacgggaccaacgacaacagagaagaacatcagggctctataccaggagctcgaggagctgcgcgatacctaccccaaagcccttgtgcaccacgttctgattttcgactatgtcaacccccacgacaccgagatcccaatgcccgagggccttattgatattcctccgcccgagaaatgcactgtgactaccatcaggacagtcatgtgcgacatctcctcgcttctactcgctgagatgacgacattggccaagtccttcgaagccatgaccaacatcgagtctcctgtaccttattcaacctcttcgaggcatactaatggtggctcatggggtggggaaggcggtataaatagtcttctgaaacggaattcgagcatcgtgtcttccaagcattctgcgcgttccaactcggcaggcgggattatggataaggcccaggctcgcatgtctatgccagtgaacagtcgaccaggtcttcattcgagtaactcgacgccagggttgtcatcgacgcctccaaagagtcatctatcgaacccacccatgtctacggatggtccaagtcctccggctagtgatcggtcgacaccagaaccatctgccccgccagagaccattgagagctctcgatcagctagtcgcgatcgcatatcaacccaaggctttggcgctggaggtgtgaatgaccgctggagacatagaactaagggacgagcggcagttgtcgttggttctatgtttttacaggctggtcgatggaccgattctatcaaggagctcagtgacggtgctatggctgctcggtctgtcaatgatcatttgtggcacggcaaggcgctggagctcatcttggtaaacctgttcctccttggctggtccaatatcgagtttcatgtacctacagtgcttatccagttcccggacaagccaacccataaacaaacaccggatcctacgcccgaggatcccaatcagccgaaacatcttagaaaccttcaagcactgctccctgaactgcttgaacgtatcattctcctctactccagggtgtcttcagacagccttccccccttaccactatccgaaacttatatccgattttcaaagatctaccaggctctccacctgtccaatggctaccttgatcgggaatctctaggcatgattgcgactggaatcgtccctgaccaaccccttgcggcgccaccgcgattcggtgtaacgccttcgcgacaacaaatcggagccatgctgttcaaggcattccccgcgggtgcttcggaacttcttacgactgtcgaccgagcgtccattctgagcggtatagcgactgttctggggcctttggggcttcaccgaaagaaggctatggtaataagagagcttgtatcagttcttatcggtggtctagtcgaggcaagaacccgaggcgctgccgatatgggcattcatcctgctgccggactaatgtcgttgacttctggtggcggtggttccagcagtggctcaatggccttagagattggagagtgcgatgtcgaacagggcatagaggccctgatgactctgctctgcaaatcttatggcatcgttgggtttgatttaacccgcaaggccggcgtcaagaacaacgaagcggttgatgattcggacgaggctgtgattgctaggatacgtggccagtctgcagctcgcttcttcgggttcccagacgtcaagcttaacattctaagagcttgcatcaacttttcagaagccttgccggattttgatggcgttctgcgattctcgagcgaccttttgcgtacatccggctcgggtgtagctccagggccacgacgagaggatgcgtcaccaatgattcttcgagatgagcaagtgcgactggctacgggaatatcaaggactgcgggcctggtacagaggttaggctataacgatatagcagctgagtactgggatgagttctttgtgagaggaatcaagcttgagccgtcactaactagcaaaacgccggttgctcactcaaaaagcatccttccgggtgccgccgccagtcgcgcttcacaggatgtcgatcctttcatctacaacccgtttctgaagaagcccgatgagacagtaactcagactcttgtggctgatgaatacgctaccttcaaaattacactgcagaacccctatgatatagaagtcgatgtcgagtccatctacctagctacagaaggcgttgaattcgacgctgttaaggaggcaacattagtaggaccttatcgaactcaagttatacggctcagaggtagagcaaaggaggcggggaccgtcaaggttaccggtgccatcatcaaagtccgcggatgtcgggagcgacgattccctgtcttctctatgccttgggtaccaaagcaagagctcaagattaaggccaagggtttggctgctctcgaggaggctgtgacagacatcaagccttttgccccaaagctcgaagctgaaagcatgacacttacggcaattcaagcacaaccgcttgttatagtcaagtccaccacgcttgcacagtcttcaatcatgattttggagggcgagaggcagatattctctgtgacaatgcagaatcttgcagcgacaccagtagactttatgctcttctcattcaaggactctacgcaagaacctttgcagagtgcgatcggcaatcgggatgcgacaccctctgaactttacgagtatgagcttgcactgatgaagaagcaagcattgcgacttcctaacagccagaagactcgtcatattgcgcccaatggagaggcgacgttcgaatttgaaatcctaggcaagcctgggcttacaactgcaacaatccaggtcgattacacgcatttgggatgcccacaagaagaaatgcctgaacagttttacacgagacaggtttccttggaccttaccgtaacagtcaatgctagcgttgagcttgcccgaatcgatgcgctaccagtacatggcgagattcctcagcctttatgggatcgcttgggcagttccttcacagccaagcgcgacgaatattgtctcttgtctgtcgatcttcgcaacgcctggccaagtcaaatgttggtgcaattagagagcaatgatggaatatccgttcaagaagacattcttccaggcaacacgagccgagtcatcctgcctgtcaagagggtgtacttggaggatcctcatgccacaataccaacgctcaatccatctcgaaaccgacagttcgtggtcagtgccagcaagatctcacctgagacggaacgagcaaaccgtgaaggtttctggtacagggaaagagttctcgattgcctcagagcgacatggaagacgacgtcgctacctaagagaggcggctcgattgacttgagaagcatcagactgaccacacgaatgattgaggctattaaaattgacgaggttgatattgaactatcaattgaagatgcggatggcaatgcagctgagaagggtgtggcgtatgtcgatgagtttatgcaactcaaggtgcgtgtcaccaaccgaacggctcagaaaatccaccccctcgtcagaatcctacctgcgctttgccatcggcctgcgaatgttggcctggagtttacacggaagctagcatggaacggtacattacaacagctcattccggtattggaaggacatggcagcgcagaggtttcagtgggcatgacagtgctctgtcgcggcgagttcgagatatcagcatctgtagaagaggtgcaggtctgggaaggacctagagttgcgcctacacgggcacgatcggagtcacagacgatgcaagatgctgctctgggtgtcaaggagagacgcatttggcatgcgagacagccttgtatgctgattacgagagatcgcaagtag

SEQ ID NO: 35818 - protein, 1780 aa, Gibberella zeae PH-1
MADADSNPSTATHNSPRTWLLTSALSPLAVRLIRLLLSHGDYVVACLPPYEIDHEDRSAEFRELVNECKSSRKDREGWKDRIRGIRCDGASMGSCGAAVAEAVQVFGRIDILLCCKSDAATWALEGFCDSLAYEIAPFNIKVTVVQPNKEILSLTNRLTFAPQLPAYDQYQESAPSIRDILANVLNTHPDTALPYPTSPADYGPSPMSPPSISIEPDVAPGEILHRYPKLPPGAADKLVMETVHALSAIGGHENPPARHIVGYEAAVAVKEKLKTVTEELEDFVEASLSVDTFESELQAEARERKPSDQSPQGPPSSTSVNVDLLPLRRSKSRSLQKHQPRCARGYVEQTPDARMSLDPLAPVAPARVKTLLLPLGQIKADRFATFVERLNQQHVVHLRDISADGRPNRNMFSPLAYPDGAIIYNLVTHVPPPSHLALTPFDLYREPLAIIALADGTELHQKNLNKRQSMNGTGPTTTEKNIRALYQELEELRDTYPKALVHHVLIFDYVNPHDTEIPMPEGLIDIPPPEKCTVTTIRTVMCDISSLLLAEMTTLAKSFEAMTNIESPVPYSTSSRHTNGGSWGGEGGINSLLKRNSSIVSSKHSARSNSAGGIMDKAQARMSMPVNSRPGLHSSNSTPGLSSTPPKSHLSNPPMSTDGPSPPASDRSTPEPSAPPETIESSRSASRDRISTQGFGAGGVNDRWRHRTKGRAAVVVGSMFLQAGRWTDSIKELSDGAMAARSVNDHLWHGKALELILVNLFLLGWSNIEFHVPTVLIQFPDKPTHKQTPDPTPEDPNQPKHLRNLQALLPELLERIILLYSRVSSDSLPPLPLSETYIRFSKIYQALHLSNGYLDRESLGMIATGIVPDQPLAAPPRFGVTPSRQQIGAMLFKAFPAGASELLTTVDRASILSGIATVLGPLGLHRKKAMVIRELVSVLIGGLVEARTRGAADMGIHPAAGLMSLTSGGGGSSSGSMALEIGECDVEQGIEALMTLLCKSYGIVGFDLTRKAGVKNNEAVDDSDEAVIARIRGQSAARFFGFPDVKLNILRACINFSEALPDFDGVLRFSSDLLRTSGSGVAPGPRREDASPMILRDEQVRLATGISRTAGLVQRLGYNDIAAEYWDEFFVRGIKLEPSLTSKTPVAHSKSILPGAAASRASQDVDPFIYNPFLKKPDETVTQTLVADEYATFKITLQNPYDIEVDVESIYLATEGVEFDAVKEATLVGPYRTQVIRLRGRAKEAGTVKVTGAIIKVRGCRERRFPVFSMPWVPKQELKIKAKGLAALEEAVTDIKPFAPKLEAESMTLTAIQAQPLVIVKSTTLAQSSIMILEGERQIFSVTMQNLAATPVDFMLFSFKDSTQEPLQSAIGNRDATPSELYEYELALMKKQALRLPNSQKTRHIAPNGEATFEFEILGKPGLTTATIQVDYTHLGCPQEEMPEQFYTRQVSLDLTVTVNASVELARIDALPVHGEIPQPLWDRLGSSFTAKRDEYCLLSVDLRNAWPSQMLVQLESNDGISVQEDILPGNTSRVILPVKRVYLEDPHATIPTLNPSRNRQFVVSASKISPETERANREGFWYRERVLDCLRATWKTTSLPKRGGSIDLRSIRLTTRMIEAIKIDEVDIELSIEDADGNAAEKGVAYVDEFMQLKVRVTNRTAQKIHPLVRILPALCHRPANVGLEFTRKLAWNGTLQQLIPVLEGHGSAEVSVGMTVLCRGEFEISASVEEVQVWEGPRVAPTRARSESQTMQDAALGVKERRIWHARQPCMLITRDRK

SEQ ID NO: 35819 - DNA, 4257 bp, Aspergillus nidulans FGSC A4
  CDS (1)..(4257)
atgttctctccgctagcgttcccgacgggcattatcctatatgacctttcgttctccatgccccctatatcgcacctagaactgtatccatttgaaatatttagagagccactggtggttcttgcaattgccgacgggacggagctcaccggcgatacaacccagacgggtcccgaatcgagtacagacaagccatcgaagccgaaaggactcgaacaacttgaacaggaactcgatctattaagagaaaagaatccaagggcactggtacatcagctcctcatatttgactacgaaggggtcagcaaggtctctaatggcccggataacatactatggattccgcccccgcaggtttccaaagctactacgatgaagactgtcctgtgcgatatcacgtctctcgtcctttctgaaatggacgaatttgcgaagacaattcaaagtataccaaccattgattccccgaaagcctcatcttgggggccacatcgcgggccagatttgcgccggcgtccgacagacaagctgtttcataggaagacaatgcctgcgcttgcaagcacaaacggcacttcggagactgctcaaggctcgacccaaagttcgccggcacctgaagatcatgagacgccgacaacattcgacgagatcactcgttccatacagctggctagtcggtccagcaccaccctagggaaaccaggatcactgccatcatccaaagaacacagtagggatcgcttgtcagtgagcggcttgagcgcaacagatcgaacaaaaaatcgaataaagggtcgctcgggtgtggtgatagggacactttttcttcaatctggccggtggccggatgcactgaaggaactagttgaggccgcatctaacgctagagcaagtagcgattatgtgtggcatgccaaagccctcgagtcaattctcctctgtttactgatgttcgcctgggctggcatggactttcaggttcctccaatctgttatcctgttgcggacaaatcttctaaggcatcggcagcaatcgttttcgatccaacctcgagtcaatcagccgggaatcgaatcatctctctccaaaatctttcaaaccttctaccggacctggcaaacaatattttgaatttatatacccgcgcagccaatatcacagatgagcctcttccccagctcgtcttctccgagacggttatccgtctttcaaggttattagtagccacacgcatccgcgacggggccttggatgacaacgctttgaagcatattgtaatgaatgagccgctagagcctctcgttcggccggagcgtcctcttggtctgacaattcttcggaagaacgaaattgcaaacttcctgttccgtgcgttgccgttttctgctggctcggatttgcctgcgacagatgccatacctatcctcataggcgttgtctctgtcttgaacgcgcttgacctgccacggaaaaaggcatttgttctgagggagctactttctatcctggttccagctctagtaacagcccgcaaaattggggctgcagaagtgggcattcatcctgcagcgggcttatcatctctcagtgatactgctttcgacataaatgcccttgatgttggcccggggaatatgaaccgtagcatgcgttcgcttctcgctacgataggagagatatacggcgtgcagtcttcatctcaaattgaactggggaagcgaacgtcggttggcggcaataattcccagagcccggactcaatcacagcaatcaccgaacgggccttccggcacattgtgctggatcgctacggtgatttgaatcttaaaattgatgttctcaagatgtgcatcaactcatgtgaagcgctcccagattttggtggtgtcctgcggtttactgtcgagctcctccagacgattcgcggggatctcatgctctctaaatcttcctacaccgcaccttgcctgcagcctgatgagcagatccgcctactgaacaatatcaagcgaactgttggtgctgccaaccggcttggtgtagcaggccttgaagccgaatattgggacgacttcttggttcggggggttgagttgttatctttatctgatcctaagaggcctgttcgtcgatctaagtcagagctcgatgctgtcactgcgacgagtgagaagtccaaaaaggatcccttcttatacaacccgttcacgaaatcagcgaataaagcttcggagcttctcatggttgctggagagcatgcagctttccaagtcactcttcagaacccttatgaatttgaagtcgagattgaacggatacgccttgagagcgagggtgtacccctggatgctgtggcggagtatatactgcttccaccattgtgtcttcaagatgtcacagtgtacggtatcgcacaagaagagggcacattaaaggtaactggttgctctgttaaagttcgatactgcagagagcgaagctttcctatatttaaagatttctggaagcccgatatagaagccaagttcaaacgcaccgggttagctgctaaaaagccttctgttgatcgtcctttatcctggagctcgacattctccaaggatggaaaaccaagcacaaagaaaggacctgaaacgttctcctgtgaggtgaaggttattcggccgcagccatcgctcgtggtcgagtcattgtcgttgtcccaatctgcagttatgattctcgagggggagaggtcatctttcaccattacattgcgtaatacatcatcttgcgacctggatttcatcttgttcacttttcaggactcaacgactaagcaaatacagacagcgctgagtaataaggacttgctgccaattgaagtgtacgagttggccttgaagctcacaaggccggccctgcaatggcgcagagagggattgaaccctagtgattactccatcccagcaggacagtgcgcaacgttcactatcgatgttgttggaaaccctgggcttcaggaagctaccgtgcagatcgactattgcagcattggagtatcttatgaggcactacctgacaccttttatactagacagctctttatcccccttaccgcaacggtaaacgcaagtctggagattgcccgttgtgatatattacctttcagtagcgattttgcatggtcgaacgacccgaattccgccagcgcgacgcttgattcttcagattccgccagcagcgatcacttctcaacagtgctctctaatcttgcccgaggaacatatggctccgaccactgcatactcctccttgaccttcggaacgcttggcccaatccgctctcggtggctttacacgttacggatgtacctcatgagtcacccgacagggctgccgcgcctactgacggagccggtcgatacactctccgtgagacccttcaacccggacaaacctctcgtttcgttctcgttgtaccgcgggtttacatccagaatcctcatgcatcaatcccctctctgaatacgggatcaaaaagacagtttgttgtcagcgcgcataagctcacgtttgatgctgaagcggcggcgcgggaggcattctggtatcgtgaagaacttctcaagagagtcagcggatcatggaaggaggctctgggcaatcgtgaagggacgattgatttaagaaacatgcgcttcactgcgcgcatggtggacgcattcaggctagaggacgtggagacgagcttctcattgaagccttcattctccggtagcgccaaaaatggcgtgtccgacctcgtaatccaaactgggaattcaagatacagagttggaaccgatgagatgttggatcttaccgttactgtccacaaccgctcctccagacctattcacccccttctgcgactccagcccagcctctgcaaccagccaagcaacgttgcgcttgacctccccagacgtcttgcttggacagggatgctgcagcaggtccttcccgtgctaaacagcggcgaaagcactagtactaccgtcggcgtcacgatcctctgccgaggtgagtacgaattcggcgccacagttgaggaactacgactgctacgtctcccatctgaaactgaggggaacaaaatcacctcggatgatgcgtctacacccataccgtacgaggaagggtttatcacggacacctttggcgcggacatggcgaagaaacgacggatctggcatgccagagatacgtgtgttatgactgctcatgattaa

SEQ ID NO: 35820 - protein, 1418 aa, Aspergillus nidulans FGSC A4
MFSPLAFPTGIILYDLSFSMPPISHLELYPFEIFREPLVVLAIADGTELTGDTTQTGPESSTDKPSKPKGLEQLEQELDLLREKNPRALVHQLLIFDYEGVSKVSNGPDNILWIPPPQVSKATTMKTVLCDITSLVLSEMDEFAKTIQSIPTIDSPKASSWGPHRGPDLRRRPTDKLFHRKTMPALASTNGTSETAQGSTQSSPAPEDHETPTTFDEITRSIQLASRSSTTLGKPGSLPSSKEHSRDRLSVSGLSATDRTKNRIKGRSGVVIGTLFLQSGRWPDALKELVEAASNARASSDYVWHAKALESILLCLLMFAWAGMDFQVPPICYPVADKSSKASAAIVFDPTSSQSAGNRIISLQNLSNLLPDLANNILNLYTRAANITDEPLPQLVFSETVIRLSRLLVATRIRDGALDDNALKHIVMNEPLEPLVRPERPLGLTILRKNEIANFLFRALPFSAGSDLPATDAIPILIGVVSVLNALDLPRKKAFVLRELLSILVPALVTARKIGAAEVGIHPAAGLSSLSDTAFDINALDVGPGNMNRSMRSLLATIGEIYGVQSSSQIELGKRTSVGGNNSQSPDSITAITERAFRHIVLDRYGDLNLKIDVLKMCINSCEALPDFGGVLRFTVELLQTIRGDLMLSKSSYTAPCLQPDEQIRLLNNIKRTVGAANRLGVAGLEAEYWDDFLVRGVELLSLSDPKRPVRRSKSELDAVTATSEKSKKDPFLYNPFTKSANKASELLMVAGEHAAFQVTLQNPYEFEVEIERIRLESEGVPLDAVAEYILLPPLCLQDVTVYGIAQEEGTLKVTGCSVKVRYCRERSFPIFKDFWKPDIEAKFKRTGLAAKKPSVDRPLSWSSTFSKDGKPSTKKGPETFSCEVKVIRPQPSLVVESLSLSQSAVMILEGERSSFTITLRNTSSCDLDFILFTFQDSTTKQIQTALSNKDLLPIEVYELALKLTRPALQWRREGLNPSDYSIPAGQCATFTIDVVGNPGLQEATVQIDYCSIGVSYEALPDTFYTRQLFIPLTATVNASLEIARCDILPFSSDFAWSNDPNSASATLDSSDSASSDHFSTVLSNLARGTYGSDHCILLLDLRNAWPNPLSVALHVTDVPHESPDRAAAPTDGAGRYTLRETLQPGQTSRFVLVVPRVYIQNPHASIPSLNTGSKRQFVVSAHKLTFDAEAAAREAFWYREELLKRVSGSWKEALGNREGTIDLRNMRFTARMVDAFRLEDVETSFSLKPSFSGSAKNGVSDLVIQTGNSRYRVGTDEMLDLTVTVHNRSSRPIHPLLRLQPSLCNQPSNVALDLPRRLAWTGMLQQVLPVLNSGESTSTTVGVTILCRGEYEFGATVEELRLLRLPSETEGNKITSDDASTPIPYEEGFITDTFGADMAKKRRIWHARDTCVMTAHD

SEQ ID NO: 35821 - DNA, 3777 bp, Candida glabrata CBS138
  CDS (1)..(3777)
atggacttcctttcaagcaatctaagctttgtaaatccatgcaaagttaggacgctggtggtacctataggcaaatggaagaaacgagactttctaaatcaatttgagacactcagggcaaataacgaggttcggttacttgacataactcctatcgattgtccattatttactccgcaggcttttccaaacggtagggtattctatgattttactatcagtcaacatgctgatgcattagatctttttctctatgacttcgaaccctttagaaagatatttgttataattggtctagtaaatgacaagagtgaccctgttgacaatatgaatatcttaaaagaacgttacccaactgtcatatctcacaaccttttgtacacggacaagagtttgatcaattcagatgtagaaaatcaagatataagtaatatctttcattacaactctgacaaactagaaaactacgagactattttatgtgatattacaagaaatttccttgtcgcgttaaatcattattactcatcttacaagcatgtcaccctcagatctccgggagcaattggaggaaacgcggtgcgtaagacgagtttattgatgtctgctttgcctggaaatcaatcaagaggatctggctctctttacaactcgaattcaactaatactaacaagaggttatcctcatttgaaatgaccaccaataatataaagagatcggcatctttaaaactgtctacatctctagcttcaacagataataaaatacaaacaagagcacagggaaggcaatacaaaattttaggtaatttccagttattagcaggaagggtgtcagatgcattgaattcatttaatgaagcagttatattgctatacagggttagagatctcttgtggcttggatcagctctcgatggagttgcaatatgtgctgttatattatcatacctacagatgccatttaaaataccgcatattgttgcactaatttgtccaatggaaagcccgaataatagtatcgaagctctcagccccaggaatagtttgactaatagtgtccagtctccaaggaattctttaactttagctacctccgaggctaatatcgatgtcgatatgtcaaacttgccagtactagtgaaagctattcttgacaaagctttgcattattacgatgaaagtctttcacataatagtgagtatgccccacaaattgtttattctcaatttctctcacgtactttgagttttatgttatgctgtaattcggcagttgtacagtcgcaaaatgtggcctcaagcataataaattgcaactactccaataagcctttaaaagactgcgagaatttatccttttctaattctgacgtttattctttttgtgggaaggtgttgctgctgaaaattgatgatatggaattagaggaacagtcaagtattttctcgctattgtcaaaagcttatgcatctctacaacttacaagaaaacaagcatttaccctacggttactcttggtttcaatttcttcacacgcagaaggcttaaaatggcagcatagctttcaaaattttctggacacagtgatgagattatatgatattcatgaatcagcagactctaatgaggtaaagagtaattcattggaatggcgagaacttcaaaaagacataatagagttatgcttacagattagtgtcagcatgaaagctgagtccaatatgagggattatgggttgttaatgctcaataaatacaatgatatgctgtctgaaactgaacagaaggaaattttgcaggtaattctcaagcctctgatacaaaatttgaagattaaagaatactgggacccttttatcctaagaggagttacaatctcgaggttagaaacagattcagcttcttatgatactcttagaatacccaatgaaaatagtattgctactgctcaaaaaatcaatccacatgaggtgtttaatccattcaaacaagccaactctctaaatctaaaaacttcaggaagctctgacagtaaaccaaaactatttctggtagatgatagggccgaatttagctgtaccatccagaacccttatggtttcgatattacaatatcagatatacatctaccagacgaaataaccgattattgtgaactagatacacgaagttcggttaaagataatccttatgttattggtgccaaatcagtacgaaacatcaccttacctattaagataaaaaaatcaacagccgatgattttctattcttgagatatttgagactttcagtcttagatctacccttgtcaagatttgatgtatatccaatgccgcaaaatgggggtattatttctccattaaatattaatttaaggacgacaccgcccttggaatcagaagcacttactttcaaaattctacccgaacaacccgaacttgaagtaatgaataatggaaaggtaacgggaaactcttggatgttacttgatggtaccaaatctcaattcacaattttgatacgaaataagtcattatccaagtcgatagatcagttgaatgtaactgctgttaccaatattgagcatgctttaaaggccgactactggaagaaaatgcaaccagatgatttaaatatactagaatcgaatataatgtggatgaaaaatgaatgtatcaagatattgaataagccagagcatgtacaaccaaatgaaattttcgaattgaagctggagattgatacagtgcgtgctccatttgagtttgaatcttttatagttgttgtcgagtatggtatgcaagaagaagacaaatcctgtttttatatgaaaaaactcaaaattccttatgaagtaaccttacgaagaagtattgaagtccctaatatggatttgattcctttaaaccatatgaattttactaatactagcgattccagttggattgcttatatacaatctttgtcaaacaaatctaatgatgcatttagctactctgctaaagattacatgctgcttttacttgatttcagaaattcatggattgatggcatacacatcgaggtgacatatgaagattttgtaagcaaaggccatttggtagagtcaaatcgaaatttgagaattattgtacctattaggaaaatcgatgttgaaaaaataaacttttcgaataaaccaattccccggatatttaaagagagacaatttctgcaaagtggaatggacgaaaacactgagataactatgcgtgaatgcttctggacaagagaatatatcctcgaaagactgtcttgtcgatgggagttgagtacagattccttaataagaggagaagttgactttaggaaatacatcgaaaagtttgacaacagaactgtggccaatttgtacaagggtaagcttcctttttcgattacactttctagtagttcaaaatcttcaactactggtgaattaaatagaatatcatgccagatttcacctcaaacagttcaaagacaacattctcgaattcagcagactgcattgttaaatttctttatatttgaacatttttcttcgaaactgctaccaaaatctaacaggaggttactttataatggatctctgtctcaaaaattttcaaccaatagtgagagtacagtgtgtttagatgtgattcctatagaaccgggatgttatgaaatttgcgtctgtatttcagaaactgaaagtgtagataaggtcttgcagtttaatcctgacagcattcttgtcgaagttaattag

SEQ ID NO: 35822 - protein, 1258 aa, Candida glabrata CBS138
MDFLSSNLSFVNPCKVRTLVVPIGKWKKRDFLNQFETLRANNEVRLLDITPIDCPLFTPQAFPNGRVFYDFTISQHADALDLFLYDFEPFRKIFVIIGLVNDKSDPVDNMNILKERYPTVISHNLLYTDKSLINSDVENQDISNIFHYNSDKLENYETILCDITRNFLVALNHYYSSYKHVTLRSPGAIGGNAVRKTSLLMSALPGNQSRGSGSLYNSNSTNTNKRLSSFEMTTNNIKRSASLKLSTSLASTDNKIQTRAQGRQYKILGNFQLLAGRVSDALNSFNEAVILLYRVRDLLWLGSALDGVAICAVILSYLQMPFKIPHIVALICPMESPNNSIEALSPRNSLTNSVQSPRNSLTLATSEANIDVDMSNLPVLVKAILDKALHYYDESLSHNSEYAPQIVYSQFLSRTLSFMLCCNSAVVQSQNVASSIINCNYSNKPLKDCENLSFSNSDVYSFCGKVLLLKIDDMELEEQSSIFSLLSKAYASLQLTRKQAFTLRLLLVSISSHAEGLKWQHSFQNFLDTVMRLYDIHESADSNEVKSNSLEWRELQKDIIELCLQISVSMKAESNMRDYGLLMLNKYNDMLSETEQKEILQVILKPLIQNLKIKEYWDPFILRGVTISRLETDSASYDTLRIPNENSIATAQKINPHEVFNPFKQANSLNLKTSGSSDSKPKLFLVDDRAEFSCTIQNPYGFDITISDIHLPDEITDYCELDTRSSVKDNPYVIGAKSVRNITLPIKIKKSTADDFLFLRYLRLSVLDLPLSRFDVYPMPQNGGIISPLNINLRTTPPLESEALTFKILPEQPELEVMNNGKVTGNSWMLLDGTKSQFTILIRNKSLSKSIDQLNVTAVTNIEHALKADYWKKMQPDDLNILESNIMWMKNECIKILNKPEHVQPNEIFELKLEIDTVRAPFEFESFIVVVEYGMQEEDKSCFYMKKLKIPYEVTLRRSIEVPNMDLIPLNHMNFTNTSDSSWIAYIQSLSNKSNDAFSYSAKDYMLLLLDFRNSWIDGIHIEVTYEDFVSKGHLVESNRNLRIIVPIRKIDVEKINFSNKPIPRIFKERQFLQSGMDENTEITMRECFWTREYILERLSCRWELSTDSLIRGEVDFRKYIEKFDNRTVANLYKGKLPFSITLSSSSKSSTTGELNRISCQISPQTVQRQHSRIQQTALLNFFIFEHFSSKLLPKSNRRLLYNGSLSQKFSTNSESTVCLDVIPIEPGCYEICVCISETESVDKVLQFNPDSILVEVN

SEQ ID NO: 35823 - DNA, 3633 bp, Kluyveromyces lactis NRRL Y-1140
  CDS (1)..(3633)
atggaaagcacaattgaaccttgtaaagtgcgaacgttagttgttcccgttggtacttggaagaaagatgcgtaccttgctgccgttgacgagttggaaagacacggtgaaatacgactagtggatgtgacacctttacctgattgtaccttcaacccacaactatttccacacggtagagttttatattccttcttgacgagagagcatgacagcaattcgatgatgttcttgcatgatttcgaaccgtacaggaagttatttgttgtgatagggctttgtaatgatggtttgatatctacagaggcatgtgttaatgagctgcgggaacgttatggtagtgccatatcttacgctgtgatatacaatgatagatctaaagttgtagaacaatcaacgaaatatggattctcgagatctgaagaacctttggaaacaattatgtgtgatattacaagaaatttcttggaatcattgcatgtgtattatagctcctataagcatgttacattgagatcccctggagccataggagggccatccgtgctaaaaactactttgactaaaaaatcacaaacaacagcaccaatcacaaatccgcgctctaaaaaaggtagttctctgtcaagcaaagatgattcttcctcttctagtttatccatatccgatgactcgatcaaggataaatctaaacgttactcgtcattgaatgctttgagtggtggtacatcagataaatctatgcaacggtcaaaagccaggcagttaaagctattggcaaatcttcagttactagcgggacagtatctgttgtctatgaataactttgcagaagctgcccgtatcttacacaagattcatgattatatttggcttggaagttcacttgaaggaatactaacatgtatcatattaatttcgtatcttcagctccctttccaagtcccaccaatcatacattcattatgttctttatctcaaaattctaatagcatactatcacccactacctcccgcagaagttccatgcaatccgtggcttctcccaggaattcagtgagcaccatcactgctgcttcgctcgaccacacaaatattgacataccaaagttggtcaaaaagatagcagataaagcattgtattattatgactattcactttcctactcagtggaattcactcctcaagttgtgtattgtaagagcatacttcgtacgctgacatttatgtccttatgctataaagcaaacggttttgatcagcgagcccttcaagaaatgatattttcggatatgtcatcatcagccgttcaaaaccaggattcgctacaagatgaatgtattttcacaaaatcggaaatttatcagtactcgacaaaaatcttcgagcttcagttgaaatcgatggacctgtcatctcagattcaaatatatttgacgctctgcatggtttatgacaatttgaatatgttcaggaagaaatcatttgttctgcgaatcttgtttatatcaatattatctcaacttaccaatgactatctctcagaaaattaccattctctgatagatgatttaatgaaaaattatagaatctcaggttgggagcctgaacacaaacttcaagatgcatctagttacaattgggtgactttacagaaaaacgttttgatgttaattataaaaattagcgctcatttcaagaattataaaaacgttgttgaacactcccagcttcttctcaaacggttttctcatactctgacgaaacttgaacagattgacttattgaatcaatacattcttccacatcaaaacgaatatcccgttgaatatatggacccatttttgatccgtgacatttgcttcagcaggactcggtcggaagagatgccaatgctaaaagtattgcgggacgaagagtccaggactttcaatgatccgcatcaaattttcaatcctttcgcgtcagtacatcacaaaacgaaagaaaacgaaacagagaattcaaattactttttggtcgctgagactgttcagatggtaataacgttccaaaacccatttaaattcgatgtcaggataaattccataaactttactgaggatgatgcacagttcatgaaaatagcagatcttgatctgacctcttgtacaataccagcctcctcaaagaaacagttttgcgttggagttactttcgtaaggtccaccctaactttgcatcagttaaaaggactttcagtttctgtactggggttgccttcaaagttctggggaatttgtaagcaacccggtaaattcaacactcaggaaagatgtaccctgtattccgtcccaatcaccattattgatcaacagcctacattgtgtttcttatcaaccaccttagtggataaccgtgtaatgcttttagatggtacggagactgagtttaaagtatttttgagaaactcttctctttctagtcccataaattattgtagtgttagctggatcactaacgttgaaactgaattgaaagagaattactggaccagtttagcaccagatgatctatatgacgttgattcgcagctaaaatggttgagagaaaatttcatctcaatatcctcgattccaaatgaagtaggtattaatgaatccttccacttcagtgttaatttggatgttacaaaggcgccattcactttgaaatgggcacgcattacgattcaatatggctataaaaagtctcctgaagatctagcagtttacgtgaagtcattaaccattccaattgagattactttacagagagtactagaagtatctaacgtcaattttattccaattccagaagcttttgaagcagcatcagacataggatggataaagtatctacggagtcatcagagtgttcaatcagattacgttttgatgctgattgacatgaggaattcctggttattacctgtatcgttttctttccactatgatgagtatgtttctgagagggaaagtttggattctaacgagacgagaagatttgtggtaccaattcgaaagatcgcaaactatgacgattctccaaattttaaggacaaacttatcccgagaattgatgaaagtaaacaatatctaacctctggactcactttaacccaagaaaatgagatgagagaaaagttctggtgcagagaacacatcctaaaccgcttaaagtgcacatgggatactgccttaaatgaacatactgaagggtctgttgaatttcgccagtttgtagaaaaactcgataaacaagtgatctcactggtgtacccaccatcaaatgtgtttgatatcaaagtaagtgcaagtgaaaccacagtaaaagtaggtacacctgtgcgtttgaacgtaactgtgaacacgacgttacatacagatcttgttcctatcagatactatatactggactatttcacaggtaaatctgtgcttagcgatcatccaaagtctatcgtattccagggccaaacgtcaacattagtgagaccgcggatcacgacagaattcaacatcttacctctaaaaaaagctaagtttcaaattgaaattgaagtgccgggaaacatcctgacaagggaaccaatcattataacagcaggatga

SEQ ID NO: 35824 - protein, 1210 aa, Kluyveromyces lactis NRRL Y-1140
MESTIEPCKVRTLVVPVGTWKKDAYLAAVDELERHGEIRLVDVTPLPDCTFNPQLFPHGRVLYSFLTREHDSNSMMFLHDFEPYRKLFVVIGLCNDGLISTEACVNELRERYGSAISYAVIYNDRSKVVEQSTKYGFSRSEEPLETIMCDITRNFLESLHVYYSSYKHVTLRSPGAIGGPSVLKTTLTKKSQTTAPITNPRSKKGSSLSSKDDSSSSSLSISDDSIKDKSKRYSSLNALSGGTSDKSMQRSKARQLKLLANLQLLAGQYLLSMNNFAEAARILHKIHDYIWLGSSLEGILTCIILISYLQLPFQVPPIIHSLCSLSQNSNSILSPTTSRRSSMQSVASPRNSVSTITAASLDHTNIDIPKLVKKIADKALYYYDYSLSYSVEFTPQVVYCKSILRTLTFMSLCYKANGFDQRALQEMIFSDMSSSAVQNQDSLQDECIFTKSEIYQYSTKIFELQLKSMDLSSQIQIYLTLCMVYDNLNMFRKKSFVLRILFISILSQLTNDYLSENYHSLIDDLMKNYRISGWEPEHKLQDASSYNWVTLQKNVLMLIIKISAHFKNYKNVVEHSQLLLKRFSHTLTKLEQIDLLNQYILPHQNEYPVEYMDPFLIRDICFSRTRSEEMPMLKVLRDEESRTFNDPHQIFNPFASVHHKTKENETENSNYFLVAETVQMVITFQNPFKFDVRINSINFTEDDAQFMKIADLDLTSCTIPASSKKQFCVGVTFVRSTLTLHQLKGLSVSVLGLPSKFWGICKQPGKFNTQERCTLYSVPITIIDQQPTLCFLSTTLVDNRVMLLDGTETEFKVFLRNSSLSSPINYCSVSWITNVETELKENYWTSLAPDDLYDVDSQLKWLRENFISISSIPNEVGINESFHFSVNLDVTKAPFTLKWARITIQYGYKKSPEDLAVYVKSLTIPIEITLQRVLEVSNVNFIPIPEAFEAASDIGWIKYLRSHQSVQSDYVLMLIDMRNSWLLPVSFSFHYDEYVSERESLDSNETRRFVVPIRKIANYDDSPNFKDKLIPRIDESKQYLTSGLTLTQENEMREKFWCREHILNRLKCTWDTALNEHTEGSVEFRQFVEKLDKQVISLVYPPSNVFDIKVSASETTVKVGTPVRLNVTVNTTLHTDLVPIRYYILDYFTGKSVLSDHPKSIVFQGQTSTLVRPRITTEFNILPLKKAKFQIEIEVPGNILTREPIIITAG

SEQ ID NO: 35825 - DNA, 4383 bp, Debaryomyces hansenii CBS767
  CDS (1)..(4383)
atggtggatagatatagatatataaatccttcgagagttaggacattggtggtcccaattaatggttgtacacaagcagactttgccagatatctcgaattggtacgatcaaatgctaatgaagttaggttgttagacgtaacacctatagctcaattacaatacttcaacccacagacgtttccacacgggaaagtgatgtttgactatgtgtcgcatgcgcccgaagcagattcgatctttttgcatgattttgagccgtttcgaaagacgtttattatacttggggttgggaagtacgacgagggagtaacgtcgaaggagaagcagacagaagtgcttggaagtttgaagaaatggcatcccagctcgatagtgcataatgttatttatttcgatacaccgggggacgtaattgacgatttaaacccatcaagcgatcattcgacaaaggaggtgttttaccatgaaggatcattacagcacaatattacggcattagaaacactcatgtgtgaggttactaggaattttttaacggcattggatagctacgcatcatcatatttaaacataacattgaggtctcccgtctctataagcgacagtcacaatttaaccaagaccataagtaaagcgcagaaaaggattagttctagttcaggatcttttaaggtttcattttcatcaacgtccagcacgaatggagcgacatcggcttcagacttgaaatcaaaatcccaacaacggcacaatggtagacggtccaaactcttgggtagtttctatttattagcaggtaaatactcagatgcattagagtattttactgattccatagcgaatttgaagaagtgtgacgactatttatggcttggtagtgccctagaaggtattggaaactccgttgtcatgttacacttcttaggtatatcatacaacttatcaagttctaccataatttcagtcttgcaaatctccaagagtaaatttaatgcaatagcatccgcagtatctgctacgagcgtggagagttcttctccaaaaaggatatcaactgattctttatcccataatagcacaacaaacggacatttatccgtgccacatcaaaccaattcgccaagaaactcaagcagtagtacgataaattttaattttgcaacttccaatatccctggctcaggtccagatttaaactctttacccattcctcaactaataaaattgatttcttcaaaggctttacaatattaccaacttagtaccagtgactacgagaatacggttcctgacttagtttatgtggagtcattgttaaggctaattaaatttatgatttgcatatatcttggtggaaatgagttgaattctacggtaatggaaagcattgtaaaatccatacccatcagtaacaaactaagcatttattcaagtaaagatgataaatcgtggtttctgaaacgagatatacttaaagagattgataaagtgttttctttacaattggttgatatgggattaattgaccaatgcagaatttactgttgtttagcaaccatgtacagcgatttggaactattcagaaaaagagcatttatccttcgaattttattagttagtttgctacctaaattggaattagcagcaaaggagaaagaaaataagattgattttgacactcagagaaatatttcaattatctcctttgagggtacatcttctaatggaagccaggtgtccagtattagacaaatatatgaatctttgtttgagatctataaaataaatgaggaaacagaaagttcattggattctgcttcacatcatgcccaaagtaactgggcttccttacaattatctcttttgaaattatgcttgaaaatctcagaaacaattaaagactacccttttttgatgaagttatgcacattactattaacccgttattcacattgtttacctgttgacgatcagtgcaaattgaaagaaaaaattgagtggctatcctatatgtctcataaaaataattcaaatatagtagcaccgtactgggatccatttttggttaggaaagtaaaatttataagtaacagaaacaaggatgaattgataccttttgctgaataccagaagacgtctaataatgttggattggttgatggactgccaagtcgtaatatttccggtccttctggtgcaaatcagccttttgtttttaatccatttaacaaagctaacaatacagcaatcaataaggacaagttgttaatcaaagatgaaatttatcaattgaaagtaagcttgcaaaaccctttttcgtttgaaattgagctcaatgatttgtctattgtaacggatggtacaatagcagttcaaactttaaaaagcttggtgaaatcaactagtaataataatgcctatcaggctccatcgcataatttgaattcgtataaccgaagtaggcctaacagcattaataataagatgcgatctgctccccatatcacagctaaccagaaacgttcccagtctgcgcttttcaataataaccaaggccaacaggagatatccccttctttgaatgtctttaacggtacaaacagtacgataacgattggtccaaagtcagttgaacatttattggtagcattcaaaccattagaatcaggagaactaaacataaaaggatttgaggtttctctttctaattgtcaacctcaatttttccatataatcgataaagaaatttacaagggattgctgaaagtgaagaagttttctaatattaatgaaaatgatcatgaaactggggataatattattgaaaatctaatcgagaacaaggttgagtctcgagctatcacaaagattttgactcttacagtagttcctccgcaaccaaatttatccctcacaagtattctgttaactaatggttggctaatgttgcttgaaggtgaaaagtacaaattttcaattagcttatcaaatcaatcaaatgagctaattaattacctttcattttcattttgggattcaacgatcgaacctttgaataagaagctaaattctattggggttaataataaccaaaatatgtcagcgtctgatattcatgaaattgaatggcttctcttaaaattcaagccgttcaaaatattgaacaaggatgaaatcagtagcttttataagaccattgagcctcgtggagatattaagatcgattatgaaatgactggaaagcgaggcatgaatgaactgaaaataattttggagtacgctaacaagcaatccaatgatgcattaaagagctttgtaaaacacgttcatgtgcctctatgtttatcagttgttccgtcgtttgacatggtaggcttcgatcttttgccacttttgtcttcttccctacaaggtcttgaagatagagagctgatggttcaagagggtgacatagttcaaagaaatcttgaagcagtactaaaatttataaccgatgtatcagaaaagcgatcagaaaaggtttccgattattgtttgcttgtcattgatttaagaaattcttggaacgagaagcttcaaagtaatctaacttatcaagttaactcgaaggataagtttagtgtgaaagaagatatatcttcgggaaaaactacgagattccttcttcctatcaaacgaatttcaagcaaagaagcagacttaaccaggctaattccatcgttacgtaacaaacaatacatcaagaattatctgattagtgaagaagaggacatggatatgagagaattgttttggttaagagaaagtattctagagaaacttacaggaacatgggaaactattccaaacaaaagcacaaggcgaagatacggcacgattgaattaagaagtcttaaattaacgccaaaaatggccaatgtacttatttattctaagatacaaatgcatcatcaactctttaatgaaaatgagccagacatttcgatcaaaagaaatggttcccagtttcgtttgcagactgaagaattttacacgctacgaacaacaatttgcaatgacacggatacgagtataactggtatgctcagacatttgccatatccattagcatggccagtccctccgtccagtattgtcaacagcttaacaacaaattttgcgaagaatcagatgaccattgacagacgaatcttgatcaacgggatactccaaactagcataggtgacgattccatgaggcccggtgagtctagacaacttgatttaagctttgtcgtattagaaaagggcgaatatgaatggggctcagttcttgacatatttaataaagaagggttgaagattgtcggacgcgaacccatttacatctctgcatcttag

SEQ ID NO: 35826 - protein, 1460 aa, Debaryomyces hansenii CBS767
MVDRYRYINPSRVRTLVVPINGCTQADFARYLELVRSNANEVRLLDVTPIAQLQYFNPQTFPHGKVMFDYVSHAPEADSIFLHDFEPFRKTFIILGVGKYDEGVTSKEKQTEVLGSLKKWHPSSIVHNVIYFDTPGDVIDDLNPSSDHSTKEVFYHEGSLQHNITALETLMCEVTRNFLTALDSYASSYLNITLRSPVSISDSHNLTKTISKAQKRISSSSGSFKVSFSSTSSTNGATSASDLKSKSQQRHNGRRSKLLGSFYLLAGKYSDALEYFTDSIANLKKCDDYLWLGSALEGIGNSVVMLHFLGISYNLSSSTIISVLQISKSKFNAIASAVSATSVESSSPKRISTDSLSHNSTTNGHLSVPHQTNSPRNSSSSTINFNFATSNIPGSGPDLNSLPIPQLIKLISSKALQYYQLSTSDYENTVPDLVYVESLLRLIKFMICIYLGGNELNSTVMESIVKSIPISNKLSIYSSKDDKSWFLKRDILKEIDKVFSLQLVDMGLIDQCRIYCCLATMYSDLELFRKRAFILRILLVSLLPKLELAAKEKENKIDFDTQRNISIISFEGTSSNGSQVSSIRQIYESLFEIYKINEETESSLDSASHHAQSNWASLQLSLLKLCLKISETIKDYPFLMKLCTLLLTRYSHCLPVDDQCKLKEKIEWLSYMSHKNNSNIVAPYWDPFLVRKVKFISNRNKDELIPFAEYQKTSNNVGLVDGLPSRNISGPSGANQPFVFNPFNKANNTAINKDKLLIKDEIYQLKVSLQNPFSFEIELNDLSIVTDGTIAVQTLKSLVKSTSNNNAYQAPSHNLNSYNRSRPNSINNKMRSAPHITANQKRSQSALFNNNQGQQEISPSLNVFNGTNSTITIGPKSVEHLLVAFKPLESGELNIKGFEVSLSNCQPQFFHIIDKEIYKGLLKVKKFSNINENDHETGDNIIENLIENKVESRAITKILTLTVVPPQPNLSLTSILLTNGWLMLLEGEKYKFSISLSNQSNELINYLSFSFWDSTIEPLNKKLNSIGVNNNQNMSASDIHEIEWLLLKFKPFKILNKDEISSFYKTIEPRGDIKIDYEMTGKRGMNELKIILEYANKQSNDALKSFVKHVHVPLCLSVVPSFDMVGFDLLPLLSSSLQGLEDRELMVQEGDIVQRNLEAVLKFITDVSEKRSEKVSDYCLLVIDLRNSWNEKLQSNLTYQVNSKDKFSVKEDISSGKTTRFLLPIKRISSKEADLTRLIPSLRNKQYIKNYLISEEEDMDMRELFWLRESILEKLTGTWETIPNKSTRRRYGTIELRSLKLTPKMANVLIYSKIQMHHQLFNENEPDISIKRNGSQFRLQTEEFYTLRTTICNDTDTSITGMLRHLPYPLAWPVPPSSIVNSLTTNFAKNQMTIDRRILINGILQTSIGDDSMRPGESRQLDLSFVVLEKGEYEWGSVLDIFNKEGLKIVGREPIYISAS

SEQ ID NO: 35827 - DNA, 3294 bp, Yarrowia lipolytica CLIB99
  CDS (1)..(3294)
atgacgtacgcctactcgtcgccaacgcatatccggacgtcagtagtaccgttaaactgcacgctggacgagttccacagtcacgtgacccagctcaagtctgtgggccacgtgaagccgcggcggcccgaaacgccaaccttttacagcgccgactcgctgctgcggtttgagtatcacgtgacgcgccaggaggatctgctcaagcgccatttcgacgatctggagatatggaagcgaacgctggtggtggttgcagttaccaacagtctcagtggagtttctgctgacagtcttcaggcgctgcgaaaagcccaccctaatgcgctggtgtacagaatcatcagtctgaacacagatggaggattggaggattccacagaggataagattgtgaccactgcgacagatacattgagtgacattctggaggaaattggaggcaatgttttacagcagcttgccacgttggagatgtcgtacttgcctgttggattgaagagtcccaatttcaagctgggaactctgagtgaggccgtcaaggtaaagggacattccagtgaccgaagaagtgtctcattgactcaagatttcactctgaaggatgaacgacctggtcaagtgtcccatacaaagaccaagtctgtaaacccggaggttgttaacaagggacggcatgcgaagctgcgaggacatctgtttttgttggcggggcagcccgcacgtgctctgaaggagttcacggattccatccacatcttgaaatctgctggcgactatctatggcttggctctgccactgaaggcgccgccatttcaatgacccagcttgactccgcaggagaatctttctctattccatctgacattgttgaaatggtaaaaagcagtttcaaacgggggaccccgcctctcgttgagataatgccttcgattactgagcaggttttgcatttctactcgctttctcagtcgtcgcaggatgatgccgtcccccaagttgtctactgtgagaccattatacgattcattcggtatcttgtggaccagaccaaaacccatgatggcctaattccccccattgcagttggaacatggggaaaccgactttattccacaaatctctcgaatttgggcgtttcagatcaattcaaactgctaggttcattggcagattcctatgagcaggttggaatgggtcgtaagcgatcattcattgtctaccagatggttgagcaggtgctccccaaactgcgaaacgactccaccgaatcaattacctcggcgatttcgtttttggactctctagtgtgcaattacggtaacaagaagctgtctccatcggggcaaggatggaacgagcttagaactcgtgtcttgcagctctgtgcacagacatgcgccacccttcctgactgggagggtgttgctcgatacaacagtctgttgctcagtactactgcggacactctccatcggcacgatcagatgcaggcgtatttggctgttaagaaggcgcatgatatttccaagatacatgtcgactactgggacttgaacttggtgcggtccgcatctattggtcacatgctctatcctcctgtcaaatttggtcgtgatgagcggcttaccagtggttctacagaagagaagggcatcctatacactcccttttcttactccaccacctcggctacagtttcccccctcgttaacaacgaggagtgtgagttcgtgattcgtctgcagaatccctacttgttccaggtacacatctcagagctgttcttgcttagtgatatggtcaccctctcgcgccctctgaccaacatcgtcttagctcccaattctgtgtcagagctcattcttgtgtcccctgtcgttgcaaaggagaagaccgacgagatcatcacttgcaagctcacgtctgttcgagcttctgtgcttggctgctcagccaaccaggagtacgagatcagcgaaagtggtagttcgttcactttgattcctcctcaacctgttttgagtgttacagatctgagtctcacagatgggtggctgctattgctggaaggtcagactctggagtgtaacatcacactccacaacatttcctctctcgtcgagtgcacgtctctgaacgtcaacttcagcgattctacgttcgagcctctccgacaggccatctcagaggcgcgcgacttgccagagtcggaaatctacgaactggagtactttttggaaaaacgccgacccctcaagtggctccaggaggatgacaaggtggtgattccccctagcaaaagctttactctggctctccagatccacggaaagcgaggcatgactgatgcaattgtcagggcccagtacggatgtggatctccttacagagagctgtcgatccccattaaggtaactgtcaacgcctctgttgagttggtttcttatgacgtgattccactcacggagaagagcaagcttgagtttttgcccgatatggacatttctgagtcactgaccgactattgtctgatcgtgattgatctgcgaaactcatggatccaccctctcaagattgagctgaagacaaaggagaacaatcctactcttgttattggacctggacgagtcagacggttcatcttgccgctgaagcgaatctcattgtctcgcgatgaaaccttgaagcccatcccgaacttgactaatcgtcaggtgttgcataactccaagatggatgctcaacagaccgagcagatgatctctgccttctggtacagagagacactattttctgagctaagcggagtgtggactgaaattgacggtgaccgtcacggccaggtggaactgagaggtatcagacttacgcgtaacatgctcaatgtgctcaagatgcagcatgtgagtgtttctatgagtgtgacggttgatggtgtggcgatcgccaccgactctctatgggatgaggtgtcgtgtgatcagaatgtcgactttcagattgttattaccaatcactctgatcacgcgattttcccactactcagaatcctgccgcagatcagaaatgttgcggccgactcagcaccagatccgattgaaggccgtgttctgtacaacggtgtgttgcagaagccgctgactcaaattggtgttggcgagtcccgcgaggtgtcgctgggcgcgattttcgtgtgccctggcgagtacgagtggaccgccatggttcaggatatgactgacaagcggtactatgtgcagcgagaccccttgtatgtaagggctgtataa

SEQ ID NO: 35828 - protein, 1097 aa, Yarrowia lipolytica CLIB99
MTYAYSSPTHIRTSVVPLNCTLDEFHSHVTQLKSVGHVKPRRPETPTFYSADSLLRFEYHVTRQEDLLKRHFDDLEIWKRTLVVVAVTNSLSGVSADSLQALRKAHPNALVYRIISLNTDGGLEDSTEDKIVTTATDTLSDILEEIGGNVLQQLATLEMSYLPVGLKSPNFKLGTLSEAVKVKGHSSDRRSVSLTQDFTLKDERPGQVSHTKTKSVNPEVVNKGRHAKLRGHLFLLAGQPARALKEFTDSIHILKSAGDYLWLGSATEGAAISMTQLDSAGESFSIPSDIVEMVKSSFKRGTPPLVEIMPSITEQVLHFYSLSQSSQDDAVPQVVYCETIIRFIRYLVDQTKTHDGLIPPIAVGTWGNRLYSTNLSNLGVSDQFKLLGSLADSYEQVGMGRKRSFIVYQMVEQVLPKLRNDSTESITSAISFLDSLVCNYGNKKLSPSGQGWNELRTRVLQLCAQTCATLPDWEGVARYNSLLLSTTADTLHRHDQMQAYLAVKKAHDISKIHVDYWDLNLVRSASIGHMLYPPVKFGRDERLTSGSTEEKGILYTPFSYSTTSATVSPLVNNEECEFVIRLQNPYLFQVHISELFLLSDMVTLSRPLTNIVLAPNSVSELILVSPVVAKEKTDEIITCKLTSVRASVLGCSANQEYEISESGSSFTLIPPQPVLSVTDLSLTDGWLLLLEGQTLECNITLHNISSLVECTSLNVNFSDSTFEPLRQAISEARDLPESEIYELEYFLEKRRPLKWLQEDDKVVIPPSKSFTLALQIHGKRGMTDAIVRAQYGCGSPYRELSIPIKVTVNASVELVSYDVIPLTEKSKLEFLPDMDISESLTDYCLIVIDLRNSWIHPLKIELKTKENNPTLVIGPGRVRRFILPLKRISLSRDETLKPIPNLTNRQVLHNSKMDAQQTEQMISAFWYRETLFSELSGVWTEIDGDRHGQVELRGIRLTRNMLNVLKMQHVSVSMSVTVDGVAIATDSLWDEVSCDQNVDFQIVITNHSDHAIFPLLRILPQIRNVAADSAPDPIEGRVLYNGVLQKPLTQIGVGESREVSLGAIFVCPGEYEWTAMVQDMTDKRYYVQRDPLYVRAV

SEQ ID NO: 35829 - DNA, 26 bp, Primer
atgaatattcttaagcatttcccaag

SEQ ID NO: 35830 - DNA, 27 bp, Primer
ctaaataacagacaagataacgttttc

SEQ ID NO: 35831 - protein, 1541 aa, consensus
  MISC_FEATURE (1)..(1541): consensus for the disclosure of xaa see table XV
PXXXXXXXXPXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXLXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRXXXXXGXXXLXAGXXXXALXXXXXXXXXXXXXXDXXWXGXALEXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXPXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXLXXXRKXXXXXRXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXLXXXXXXXXXXXXXXXXXXXXXXXXXXXXXXXXXXXXXXXXXXXXXXXXXXXXXXXXXXXXXXXXXXXXXXXXXXYWDXFXXRXXXXXXXXXXXXXXXXXXXXXXXXXXXXXXXXXXXXXXXXXXXXNPFXXXXXXXXXXXXXXXXXXXXXXXXEXXXFXXXXQNPXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQPXXXXXXXXXLXXXXXMXLXGXXXXXXXXXXNXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXTXXXXXEXXXXXXXPXXXXXXXXXXXXXXXXXXXXXXXXXXXXXXXXXXXXXXXXXXXXXXXXLXXXDXRNXWXXXXXXXXXXXXXXXXXXXXXXXXXXXXXXXXXXXXXXXXXXXRXXXXXXXXXXXXXXXXXXXXXXPXXXXXXXXXXXXXXXXXXXXXXXXFWXREXXLXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXLXXXXXXXXXXXXXXXXXXXXXXXXXXGXXE

SEQ ID NO: 35832 - protein, 70 aa, consensus
  MISC_FEATURE (1)..(70): consensus for the disclosure of xaa see table XV
XXXXXXXXRXXXXXXXXXLXXGXXXXXXXXXXXXXXXXXXXXDXXWXXXXXXXXXXXXXXXXXXXXXXXX

SEQ ID NO: 35833 - protein, 43 aa, consensus
  MISC_FEATURE (1)..(43): consensus for the disclosure of xaa see table XV
XXXXXXXXXXXXXXXXXXXXXXXXXXXXXXXXXXXXXXXXXXX

SEQ ID NO: 35834 - protein, 37 aa, consensus
  MISC_FEATURE (1)..(37): consensus for the disclosure of xaa see table XV
XXXXXXXXXXXXXXXXXXXXXXXRXXXXXXXXXXXXX

SEQ ID NO: 35835 - protein, 106 aa, consensus
  MISC_FEATURE (1)..(106): consensus for the disclosure of xaa see table XV
XXDXXXXXXXXXXXXXXXXXXXXXXXXXXXXXXXXXXXXXXXXXXXXXXXXXXPFXXXXXXXXXXXXXXXXXXXXXXXXXXXXXXXXXXNXXXXXXXXXXXXXXXX

SEQ ID NO: 35836 - protein, 39 aa, consensus
  MISC_FEATURE (1)..(39): consensus for the disclosure of xaa see table XV
XXXXQPXXXXXXXXXXXXXXXXXXXXXXXXXXXXXXNXX

SEQ ID NO: 35837 - protein, 31 aa, consensus
  MISC_FEATURE (1)..(31): consensus for the disclosure of xaa see table XV
XXXXXXXXXXXXXXXXXXXXXXXXXXXXXXX

SEQ ID NO: 35838 - protein, 18 aa, consensus
  MISC_FEATURE (1)..(18): consensus for the disclosure of xaa see table XV
XXXXXXXNXXXXXXXXXX

SEQ ID NO: 35839 - protein, 63 aa, consensus
  MISC_FEATURE (1)..(63): consensus for the disclosure of xaa see table XV
XXXXXXXXXXXXXXXXXXXXXXXXXXXXXXXXXXXXXXXXXXXXXXXXFWXXEXXXXXXXXXW

SEQ ID NO: 35840 - DNA, 432 bp, Saccharomyces cerevisiae; identical to SEQ ID NO: 6880
  CDS (1)..(432)

SEQ ID NO: 35841 - protein, 143 aa, Saccharomyces cerevisiae; identical to SEQ ID NO: 6881

SEQ ID NO: 35842 - DNA, 309 bp, Arabidopsis thaliana (mouse-ear cress); identical to SEQ ID NO: 6882
  CDS (1)..(309)

SEQ ID NO: 35843 - protein, 102 aa, Arabidopsis thaliana (mouse-ear cress); identical to SEQ ID NO: 6883

SEQ ID NO: 35844 - DNA, 501 bp, Brucella melitensis; identical to SEQ ID NO: 6884
  CDS (28)..(306)

SEQ ID NO: 35845 - protein, 92 aa, Brucella melitensis; identical to SEQ ID NO: 6885

SEQ ID NO: 35846 - DNA, 324 bp, Nostoc sp. PCC 7120; identical to SEQ ID NO: 6886
  CDS (1)..(324)

SEQ ID NO: 35847 - protein, 107 aa, Nostoc sp. PCC 7120; identical to SEQ ID NO: 6887

SEQ ID NO: 35848 - DNA, 309 bp, Arabidopsis thaliana (mouse-ear cress); identical to SEQ ID NO: 6888
  CDS (1)..(309)

SEQ ID NO: 35849 - protein, 102 aa, Arabidopsis thaliana (mouse-ear cress); identical to SEQ ID NO: 6889

SEQ ID NO: 35850 - DNA, 540 bp, Arabidopsis thaliana (mouse-ear cress); identical to SEQ ID NO: 6890
  CDS (1)..(540)

SEQ ID NO: 35851 - protein, 179 aa, Arabidopsis thaliana (mouse-ear cress); identical to SEQ ID NO: 6891

SEQ ID NO: 35852 - DNA, 327 bp, vaccinia virus; identical to SEQ ID NO: 6892
  CDS (1)..(327)

SEQ ID NO: 35853 - protein, 108 aa, vaccinia virus; identical to SEQ ID NO: 6893

SEQ ID NO: 35854 - DNA, 312 bp, Arabidopsis thaliana (mouse-ear cress); identical to SEQ ID NO: 6894
  CDS (1)..(312)

SEQ ID NO: 35855 - protein, 103 aa, Arabidopsis thaliana (mouse-ear cress); identical to SEQ ID NO: 6895

SEQ ID NO: 35856 - DNA, 309 bp, Arabidopsis thaliana (mouse-ear cress); identical to SEQ ID NO: 6896
  CDS (1)..(309)

SEQ ID NO: 35857 - protein, 102 aa, Arabidopsis thaliana (mouse-ear cress); identical to SEQ ID NO: 6897

SEQ ID NO: 35858 - DNA, 309 bp, Arabidopsis thaliana (mouse-ear cress); identical to SEQ ID NO: 6898
  CDS (1)..(309)

SEQ ID NO: 35859 - protein, 102 aa, Arabidopsis thaliana (mouse-ear cress); identical to SEQ ID NO: 6899

SEQ ID NO: 35860 - DNA, 393 bp, Arabidopsis thaliana (mouse-ear cress); identical to SEQ ID NO: 6900
  CDS (1)..(393)

SEQ ID NO: 35861 - protein, 130 aa, Arabidopsis thaliana (mouse-ear cress); identical to SEQ ID NO: 6901

SEQ ID NO: 35862 - DNA, 589 bp, Bos primigenius taurus (cattle); identical to SEQ ID NO: 6902
  CDS (36)..(356)

SEQ ID NO: 35863 - protein, 106 aa, Bos primigenius taurus (cattle); identical to SEQ ID NO: 6903

SEQ ID NO: 35864 - DNA, 309 bp, Arabidopsis thaliana (mouse-ear cress); identical to SEQ ID NO: 6904
  CDS (1)..(309)

SEQ ID NO: 35865 - protein, 102 aa, Arabidopsis thaliana (mouse-ear cress); identical to SEQ ID NO: 6905

SEQ ID NO: 35866 - DNA, 309 bp, Arabidopsis thaliana (mouse-ear cress); identical to SEQ ID NO: 6906
  CDS (1)..(309)

SEQ ID NO: 35867 - protein, 102 aa, Arabidopsis thaliana (mouse-ear cress); identical to SEQ ID NO: 6907

SEQ ID NO: 35868 - DNA, 575 bp, Oryza sativa (rice); identical to SEQ ID NO: 6908
  CDS (45)..(383)

SEQ ID NO: 35869 - protein, 112 aa, Oryza sativa (rice); identical to SEQ ID NO: 6909

SEQ ID NO: 35870 - DNA, 333 bp, Saccharomyces cerevisiae; identical to SEQ ID NO: 6910
  CDS (1)..(333)

SEQ ID NO: 35871 - protein, 110 aa, Saccharomyces cerevisiae; identical to SEQ ID NO: 6911

SEQ ID NO: 35872 - DNA, 612 bp, Saccharomyces cerevisiae; identical to SEQ ID NO: 6912
  CDS (1)..(612)

SEQ ID NO: 35873 - protein, 203 aa, Saccharomyces cerevisiae; identical to SEQ ID NO: 6913

SEQ ID NO: 35874 - DNA, 321 bp, Homo sapiens (man); identical to SEQ ID NO: 6914
  CDS (1)..(321)

SEQ ID NO: 35875 - protein, 106 aa, Homo sapiens (man); identical to SEQ ID NO: 6915

SEQ ID NO: 35876 - DNA, 583 bp, Ricinus communis (castor bean); identical to SEQ ID NO: 6916
  CDS (44)..(352)

SEQ ID NO: 35877 - protein, 102 aa, Ricinus communis (castor bean); identical to SEQ ID NO: 6917

SEQ ID NO: 35878 - DNA, 531 bp, Arabidopsis thaliana (mouse-ear cress); identical to SEQ ID NO: 6918
  CDS (1)..(531)

SEQ ID NO: 35879 - protein, 176 aa, Arabidopsis thaliana (mouse-ear cress); identical to SEQ ID NO: 6919

SEQ ID NO: 35880 - DNA, 698 bp, Mesembryanthemum crystallinum (common ice plant); identical to SEQ ID NO: 6920
  CDS (60)..(464)

SEQ ID NO: 35881 - protein, 134 aa, Mesembryanthemum crystallinum (common ice plant); identical to SEQ ID NO: 6921

SEQ ID NO: 35882 - DNA, 441 bp, Caenorhabditis elegans; identical to SEQ ID NO: 6922
  CDS (1)..(441)

SEQ ID NO: 35883 - protein, 146 aa, Caenorhabditis elegans; identical to SEQ ID NO: 6923

SEQ ID NO: 35884 - DNA, 361 bp, Schizosaccharomyces pombe; identical to SEQ ID NO: 6924
  CDS (24)..(329)

SEQ ID NO: 35885 - protein, 101 aa, Schizosaccharomyces pombe; identical to SEQ ID NO: 6925

SEQ ID NO: 35886 - DNA, 501 bp, Schizosaccharomyces pombe; identical to SEQ ID NO: 6926
  CDS (1)..(501)

SEQ ID NO: 35887 - protein, 166 aa, Schizosaccharomyces pombe; identical to SEQ ID NO: 6927

SEQ ID NO: 35888 - DNA, 309 bp, Arabidopsis thaliana (mouse-ear cress); identical to SEQ ID NO: 6928
  CDS (1)..(309)

SEQ ID NO: 35889 - protein, 102 aa, Arabidopsis thaliana (mouse-ear cress); identical to SEQ ID NO: 6929

SEQ ID NO: 35890 - DNA, 312 bp, Arabidopsis thaliana (mouse-ear cress); identical to SEQ ID NO: 6930
  CDS (1)..(312)

SEQ ID NO: 35891 - protein, 103 aa, Arabidopsis thaliana (mouse-ear cress); identical to SEQ ID NO: 6931

SEQ ID NO: 35892 - DNA, 391 bp, Arabidopsis thaliana (mouse-ear cress); identical to SEQ ID NO: 6932
  CDS (33)..(341)

SEQ ID NO: 35893 - protein, 102 aa, Arabidopsis thaliana (mouse-ear cress); identical to SEQ ID NO: 6933

SEQ ID NO: 35894 - DNA, 330 bp, Neurospora crassa; identical to SEQ ID NO: 6934
  CDS (1)..(330)

SEQ ID NO: 35895 - protein, 109 aa, Neurospora crassa; identical to SEQ ID NO: 6935

SEQ ID NO: 35896 - DNA, 533 bp, Fritillaria agrestis; identical to SEQ ID NO: 6936
  CDS (39)..(353)

SEQ ID NO: 35897 - protein, 104 aa, Fritillaria agrestis; identical to SEQ ID NO: 6937

SEQ ID NO: 35898 - DNA, 330 bp, Plasmodium yoelii yoelii; identical to SEQ ID NO: 6938
  CDS (1)..(330): m means a or c

SEQ ID NO: 35899 - protein, 109 aa, Plasmodium yoelii yoelii; identical to SEQ ID NO: 6939
  misc_feature (54)..(54): Xaa can be Asn or His

SEQ ID NO: 35900 - DNA, 294 bp, Bordetella bronchiseptica; identical to SEQ ID NO: 6940
  CDS (1)..(294)

SEQ ID NO: 35901 - protein, 97 aa, Bordetella bronchiseptica; identical to SEQ ID NO: 6941

SEQ ID NO: 35902 - DNA, 342 bp, Triticum aestivum; identical to SEQ ID NO: 6942
  CDS (1)..(342)

SEQ ID NO: 35903 - protein, 113 aa, Triticum aestivum; identical to SEQ ID NO: 6943

SEQ ID NO: 35904 - DNA, 324 bp, Aphelenchus avenae; identical to SEQ ID NO: 6944
  CDS (1)..(324)

SEQ ID NO: 35905 - protein, 107 aa, Aphelenchus avenae; identical to SEQ ID NO: 6945

SEQ ID NO: 35906 - DNA, 327 bp, Cowpox virus; identical to SEQ ID NO: 6946
  CDS (1)..(327)

SEQ ID NO: 35907 - protein, 108 aa, Cowpox virus; identical to SEQ ID NO: 6947

SEQ ID NO: 35908 - DNA, 495 bp, Oryza sativa; identical to SEQ ID NO: 6948
  CDS (1)..(495)

SEQ ID NO: 35909 - protein, 164 aa, Oryza sativa; identical to SEQ ID NO: 6949

SEQ ID NO: 35910 - DNA, 270 bp, Vibrio vulnificus; identical to SEQ ID NO: 6950
  CDS (1)..(270)

SEQ ID NO: 35911 - protein, 89 aa, Vibrio vulnificus; identical to SEQ ID NO: 6951

SEQ ID NO: 35912 - DNA, 525 bp, Arabidopsis thaliana; identical to SEQ ID NO: 6952
  CDS (1)..(525)

SEQ ID NO: 35913 - protein, 174 aa, Arabidopsis thaliana; identical to SEQ ID NO: 6953

SEQ ID NO: 35914 - DNA, 608 bp, Arabidopsis thaliana; identical to SEQ ID NO: 6954
  CDS (68)..(445)

SEQ ID NO: 35915 - protein, 125 aa, Arabidopsis thaliana; identical to SEQ ID NO: 6955

SEQ ID NO: 35916 - DNA, 340 bp, Arabidopsis thaliana; identical to SEQ ID NO: 6956
  CDS (1)..(309)

SEQ ID NO: 35917 - protein, 102 aa, Arabidopsis thaliana; identical to SEQ ID NO: 6957

SEQ ID NO: 35918 - DNA, 618 bp, Arabidopsis thaliana; identical to SEQ ID NO: 6958
  CDS (54)..(461)

SEQ ID NO: 35919 - protein, 135 aa, Arabidopsis thaliana; identical to SEQ ID NO: 6959

SEQ ID NO: 35920 - DNA, 420 bp, Populus tremula x Populus tremuloides; identical to SEQ ID NO: 6960
  CDS (1)..(420)

SEQ ID NO: 35921 - protein, 139 aa, Populus tremula x Populus tremuloides; identical to SEQ ID NO: 6961

SEQ ID NO: 35922 - DNA, 664 bp, Mus musculus; identical to SEQ ID NO: 6962
  CDS (37)..(507)

SEQ ID NO: 35923 - protein, 156 aa, Mus musculus; identical to SEQ ID NO: 6963

SEQ ID NO: 35924 - DNA, 508 bp, Tilia platyphyllos; identical to SEQ ID NO: 6964
  CDS (28)..(375)

SEQ ID NO: 35925 - protein, 115 aa, Tilia platyphyllos; identical to SEQ ID NO: 6965

SEQ ID NO: 35926 - DNA, 604 bp, Deschampsia antarctica; identical to SEQ ID NO: 6966
  CDS (85)..(426)

SEQ ID NO: 35927 - protein, 113 aa, Deschampsia antarctica; identical to SEQ ID NO: 6967

SEQ ID NO: 35928 - DNA, 327 bp, Plasmodium berghei; identical to SEQ ID NO: 6968
  CDS (1)..(327)

SEQ ID NO: 35929 - protein, 108 aa, Plasmodium berghei; identical to SEQ ID NO: 6969

SEQ ID NO: 35930 - DNA, 498 bp, Homo sapiens; identical to SEQ ID NO: 6970
  CDS (1)..(498)

SEQ ID NO: 35931 - protein, 165 aa, Homo sapiens; identical to SEQ ID NO: 6971

SEQ ID NO: 35932 - DNA, 456 bp, Theileria parva; identical to SEQ ID NO: 6972
  CDS (1)..(456)

SEQ ID NO: 35933 - protein, 151 aa, Theileria parva; identical to SEQ ID NO: 6973

SEQ ID NO: 35934 - DNA, 336 bp, Arabidopsis thaliana; identical to SEQ ID NO: 6974
  CDS (1)..(336)

SEQ ID NO: 35935 - protein, 111 aa, Arabidopsis thaliana; identical to SEQ ID NO: 6975

SEQ ID NO: 35936 - DNA, 383 bp, Mus musculus; identical to SEQ ID NO: 6976
  CDS (15)..(383)

SEQ ID NO: 35937 - protein, 122 aa, Mus musculus; identical to SEQ ID NO: 6977

SEQ ID NO: 35938 - DNA, 318 bp, Caenorhabditis elegans; identical to SEQ ID NO: 6978
  CDS (1)..(318)

SEQ ID NO: 35939 - protein, 105 aa, Caenorhabditis elegans; identical to SEQ ID NO: 6979

SEQ ID NO: 35940 - DNA, 324 bp, Trypanosoma brucei; identical to SEQ ID NO: 6980
  CDS (1)..(324)

SEQ ID NO: 35941 - protein, 107 aa, Trypanosoma brucei; identical to SEQ ID NO: 6981

SEQ ID NO: 35942 - DNA, 336 bp, Plasmodium falciparum; identical to SEQ ID NO: 6982
  CDS (1)..(336)

SEQ ID NO: 35943 - protein, 111 aa, Plasmodium falciparum; identical to SEQ ID NO: 6983

SEQ ID NO: 35944 - DNA, 654 bp, Homo sapiens; identical to SEQ ID NO: 6984
  CDS (11)..(505)

SEQ ID NO: 35945 - protein, 164 aa, Homo sapiens; identical to SEQ ID NO: 6985

SEQ ID NO: 35946 - DNA, 478 bp, Drosophila melanogaster; identical to SEQ ID NO: 6986
  CDS (48)..(392)

SEQ ID NO: 35947 - protein, 114 aa, Drosophila melanogaster; identical to SEQ ID NO: 6987

SEQ ID NO: 35948 - DNA, 351 bp, Drosophila melanogaster; identical to SEQ ID NO: 6988
  CDS (1)..(351)

SEQ ID NO: 35949 - protein, 116 aa, Drosophila melanogaster; identical to SEQ ID NO: 6989

SEQ ID NO: 35950 - DNA, 644 bp, Homo sapiens; identical to SEQ ID NO: 6990
  CDS (26)..(481)

SEQ ID NO: 35951 - protein, 151 aa, Homo sapiens; identical to SEQ ID NO: 6991

SEQ ID NO: 35952 - DNA, 572 bp, Gallus gallus; identical to SEQ ID NO: 6992
  CDS (47)..(352)

SEQ ID NO: 35953 - protein, 101 aa, Gallus gallus; identical to SEQ ID NO: 6993

SEQ ID NO: 35954 - DNA, 321 bp, Homo sapiens; identical to SEQ ID NO: 6994
  CDS (1)..(321)

SEQ ID NO: 35955 - protein, 106 aa, Homo sapiens; identical to SEQ ID NO: 6915

SEQ ID NO: 35956 - DNA, 531 bp, Lycopersicon esculentum; identical to SEQ ID NO: 6996
  CDS (45)..(371)

SEQ ID NO: 35957 - protein, 108 aa, Lycopersicon esculentum; identical to SEQ ID NO: 6997

SEQ ID NO: 35958 - DNA, 473 bp, Mus musculus; identical to SEQ ID NO: 6998
  CDS (9)..(332)

SEQ ID NO: 35959 - protein, 107 aa, Mus musculus; identical to SEQ ID NO: 6999

SEQ ID NO: 35960 - DNA, 575 bp, Sus scrofa; identical to SEQ ID NO: 7000
  CDS (24)..(344)

SEQ ID NO: 35961 - protein, 106 aa, Sus scrofa; identical to SEQ ID NO: 7001

SEQ ID NO: 35962 - DNA, 432 bp, Saccharomyces cerevisiae; identical to SEQ ID NO: 6880
  CDS (1)..(432)

SEQ ID NO: 35963 - protein, 143 aa, Saccharomyces cerevisiae; identical to SEQ ID NO: 6881

SEQ ID NO: 35964 - DNA, 441 bp, Caenorhabditis elegans; identical to SEQ ID NO: 6922
  CDS (1)..(441)

SEQ ID NO: 35965 - protein, 146 aa, Caenorhabditis elegans; identical to SEQ ID NO: 6923

SEQ ID NO: 35966 - DNA, 324 bp, Rattus norvegicus; identical to SEQ ID NO: 7006
  CDS (1)..(324)

SEQ ID NO: 35967 - protein, 107 aa, Rattus norvegicus; identical to SEQ ID NO: 7007

SEQ ID NO: 35968 - DNA, 378 bp, Arabidopsis thaliana; identical to SEQ ID NO: 7008
  CDS (1)..(378)

SEQ ID NO: 35969 - protein, 125 aa, Arabidopsis thaliana; identical to SEQ ID NO: 7009

SEQ ID NO: 35970 - DNA, 651 bp, Ashbya gossypii; identical to SEQ ID NO: 7010
  CDS (1)..(651)

SEQ ID NO: 35971 - protein, 216 aa, Ashbya gossypii; identical to SEQ ID NO: 7011

SEQ ID NO: 35972 - DNA, 336 bp, Ashbya gossypii; identical to SEQ ID NO: 7012
  CDS (1)..(336)

SEQ ID NO: 35973 - protein, 111 aa, Ashbya gossypii; identical to SEQ ID NO: 7013

SEQ ID NO: 35974 - DNA, 25 bp, Primer
atggagaccaatttttccttcgact

SEQ ID NO: 35975 - DNA, 26 bp, Primer
ctattgaaataccggcttcaatattt

SEQ ID NO: 35976 - protein, 80 aa, consensus; identical to SEQ ID NO: 7429
  MISC_FEATURE (1)..(80): consensus for the disclosure of xaa see table XV

SEQ ID NO: 35977 - protein, 11 aa, consensus
  MISC_FEATURE (1)..(11): consensus for the disclosure of xaa see table XV
XXXXXXXXXXX

SEQ ID NO: 35978 - protein, 14 aa, consensus
  MISC_FEATURE (1)..(14): consensus for the disclosure of xaa see table XV
XXPXXXXXXXXXGX

SEQ ID NO: 35979 - DNA, 3885 bp, Saccharomyces cerevisiae; identical to SEQ ID NO: 22040
  CDS (820)..(3459)

SEQ ID NO: 35980 - protein, 879 aa, Saccharomyces cerevisiae; identical to SEQ ID NO: 22041

SEQ ID NO: 35981 - DNA, 3228 bp, Saccharomyces cerevisiae; identical to SEQ ID NO: 22042
  CDS (1)..(3228)

SEQ ID NO: 35982 - protein, 1075 aa, Saccharomyces cerevisiae; identical to SEQ ID NO: 22043

SEQ ID NO: 35983 - DNA, 3656 bp, Saccharomyces cerevisiae; identical to SEQ ID NO: 22044
  CDS (706)..(3372)

SEQ ID NO: 35984 - protein, 888 aa, Saccharomyces cerevisiae; identical to SEQ ID NO: 22045

SEQ ID NO: 35985 - DNA, 2046 bp, Schizosaccharomyces pombe; identical to SEQ ID NO: 22046
  CDS (1)..(2046)

SEQ ID NO: 35986 - protein, 681 aa, Schizosaccharomyces pombe; identical to SEQ ID NO: 22047

SEQ ID NO: 35987 - DNA, 2112 bp, Caenorhabditis elegans; identical to SEQ ID NO: 22048
  CDS (1)..(2112)

SEQ ID NO: 35988 - protein, 703 aa, Caenorhabditis elegans; identical to SEQ ID NO: 22049

SEQ ID NO: 35989 - DNA, 2463 bp, Debaryomyces hansenii; identical to SEQ ID NO: 22050
  CDS (1)..(2463)

SEQ ID NO: 35990 - protein, 820 aa, Debaryomyces hansenii; identical to SEQ ID NO: 22051

SEQ ID NO: 35991 - DNA, 2793 bp, Kluyveromyces lactis; identical to SEQ ID NO: 22052
  CDS (1)..(2793)

SEQ ID NO: 35992 - protein, 930 aa, Kluyveromyces lactis; identical to SEQ ID NO: 22053

SEQ ID NO: 35993 - DNA, 3285 bp, Kluyveromyces lactis; identical to SEQ ID NO: 22054
  CDS (1)..(3285)

SEQ ID NO: 35994 - protein, 1094 aa, Kluyveromyces lactis; identical to SEQ ID NO: 22055

SEQ ID NO: 35995 - DNA, 2418 bp, Kluyveromyces lactis; identical to SEQ ID NO: 22056
  CDS (1)..(2418)

SEQ ID NO: 35996 - protein, 805 aa, Kluyveromyces lactis; identical to SEQ ID NO: 22057

SEQ ID NO: 35997 - DNA, 2736 bp, Candida glabrata; identical to SEQ ID NO: 22058
  CDS (1)..(2736)

SEQ ID NO: 35998 - protein, 911 aa, Candida glabrata; identical to SEQ ID NO: 22059

SEQ ID NO: 35999 - DNA, 2361 bp, Candida glabrata; identical to SEQ ID NO: 22060
  CDS (1)..(2361)

SEQ ID NO: 36000 - protein, 786 aa, Candida glabrata; identical to SEQ ID NO: 22061

SEQ ID NO: 36001 - DNA, 2364 bp, Ashbya gossypii; identical to SEQ ID NO: 22062
  CDS (1)..(2364)

SEQ ID NO: 36002 - protein, 787 aa, Ashbya gossypii; identical to SEQ ID NO: 22063

SEQ ID NO: 36003 - DNA, 6321 bp, Plasmodium falciparum; identical to SEQ ID NO: 22064
  CDS (515)..(6199)

SEQ ID NO: 36004 - protein, 1894 aa, Plasmodium falciparum; identical to SEQ ID NO: 22065

SEQ ID NO: 36005 - DNA, 2940 bp, Dictyostelium discoideum; identical to SEQ ID NO: 22066
  CDS (377)..(2764)

SEQ ID NO: 36006 - protein, 795 aa, Dictyostelium discoideum; identical to SEQ ID NO: 22067

SEQ ID NO: 36007 - DNA, 26 bp, Primer
atggaaatgaacatggatatggatat

SEQ ID NO: 36008 - DNA, 24 bp, Primer
tcacacctccgcattttcaaccaa

SEQ ID NO: 36009 - protein, 291 aa, consensus
  MISC_FEATURE (1)..(291): consensus for the disclosure of xaa see table XV
KDQXGXRXXQXXXXXXXXXXXXXXXXXXXXXXXXLXXDXFGNYXXQKXXEXXXXXXXXXXXXXXXXXXXXXXXXXXXXRXXQXXXXXXXXXXXXXXXXXXXXXXXXXXXXDXXGNHVIQKXXXXXXXXXXXFXXXXXXXXXXXXXXXXXXHXXGCXVXQRXXXXXXXXXXXXXXXXXXXXXXXLXXDXXGNYVXQXXXXXXXXXXXXXXXXXXXXXXXXXXXXXXXXXXXXXXKFXSNVXEKXXXXXXXXXXXXXXXXXXXXXXXXXXXXXXXXXXXXXXXXDXXXNYVXQ

SEQ ID NO: 36010 - protein, 113 aa, consensus; identical to SEQ ID NO: 22602
  MISC_FEATURE (1)..(113): consensus for the disclosure of xaa see table XV

SEQ ID NO: 36011 - protein, 179 aa, consensus; identical to SEQ ID NO: 22603
  MISC_FEATURE (1)..(179): consensus for the disclosure of xaa see table XV

SEQ ID NO: 36012 - DNA, 1425 bp, Escherichia coli K12; identical to SEQ ID NO: 28717
  CDS (1)..(1425)

SEQ ID NO: 36013 - protein, 474 aa, Escherichia coli K12; identical to SEQ ID NO: 28718

SEQ ID NO: 36014 - DNA, 1401 bp, Haemophilus influenzae; identical to SEQ ID NO: 28719
  CDS (1)..(1401)

SEQ ID NO: 36015 - protein, 466 aa, Haemophilus influenzae; identical to SEQ ID NO: 28720

SEQ ID NO: 36016 - DNA, 1350 bp, Bacillus subtilis; identical to SEQ ID NO: 28721
  CDS (1)..(1350)

SEQ ID NO: 36017 - protein, 449 aa, Bacillus subtilis; identical to SEQ ID NO: 28722

SEQ ID NO: 36018 - DNA, 1545 bp, Xylella fastidiosa; identical to SEQ ID NO: 28723
  CDS (1)..(1545)

SEQ ID NO: 36019 - protein, 514 aa, Xylella fastidiosa; identical to SEQ ID NO: 28724

SEQ ID NO: 36020 - DNA, 1251 bp, Nostoc sp. PCC 7120; identical to SEQ ID NO: 28725
  CDS (1)..(1251)

SEQ ID NO: 36021 - protein, 416 aa, Nostoc sp. PCC 7120; identical to SEQ ID NO: 28726

SEQ ID NO: 36022 - DNA, 1428 bp, Salmonella enterica subsp. enterica serovar Typhi; identical to SEQ ID NO: 28727
  CDS (1)..(1428)

SEQ ID NO: 36023 - protein, 475 aa, Salmonella enterica subsp. enterica serovar Typhi; identical to SEQ ID NO: 28728

SEQ ID NO: 36024 - DNA, 1290 bp, Nostoc sp. PCC 7120; identical to SEQ ID NO: 28729
  CDS (1)..(1290)

SEQ ID NO: 36025 - protein, 429 aa, Nostoc sp. PCC 7120; identical to SEQ ID NO: 28730

SEQ ID NO: 36026 - DNA, 1206 bp, Nostoc sp. PCC 7120; identical to SEQ ID NO: 28731
  CDS (1)..(1206)

SEQ ID NO: 36027 - protein, 401 aa, Nostoc sp. PCC 7120; identical to SEQ ID NO: 28732

SEQ ID NO: 36028 - DNA, 1545 bp, Agrobacterium tumefaciens; identical to SEQ ID NO: 28733
  CDS (1)..(1545)

SEQ ID NO: 36029 - protein, 514 aa, Agrobacterium tumefaciens; identical to SEQ ID NO: 28734

SEQ ID NO: 36030 - DNA, 1446 bp, Yersinia pestis; identical to SEQ ID NO: 28735
  CDS (1)..(1446)

SEQ ID NO: 36031 - protein, 481 aa, Yersinia pestis; identical to SEQ ID NO: 28736

SEQ ID NO: 36032 - DNA, 1572 bp, Agrobacterium tumefaciens; identical to SEQ ID NO: 28737
  CDS (1)..(1572)

SEQ ID NO: 36033 - protein, 523 aa, Agrobacterium tumefaciens; identical to SEQ ID NO: 28738

SEQ ID NO: 36034 - DNA, 1407 bp, Agrobacterium tumefaciens; identical to SEQ ID NO: 28739
  CDS (1)..(1407)

SEQ ID NO: 36035 - protein, 468 aa, Agrobacterium tumefaciens; identical to SEQ ID NO: 28740

SEQ ID NO: 36036 - DNA, 1425 bp, Brucella melitensis; identical to SEQ ID NO: 28741
  CDS (1)..(1425)

SEQ ID NO: 36037 - protein, 474 aa, Brucella melitensis; identical to SEQ ID NO: 28742

SEQ ID NO: 36038 - DNA, 1362 bp, Aquifex aeolicus; identical to SEQ ID NO: 28743
  CDS (1)..(1362)

SEQ ID NO: 36039 - protein, 453 aa, Aquifex aeolicus; identical to SEQ ID NO: 28744

SEQ ID NO: 36040 - DNA, 1500 bp, Neisseria meningitidis; identical to SEQ ID NO: 28745
  CDS (1)..(1500)

SEQ ID NO: 36041 - protein, 499 aa, Neisseria meningitidis; identical to SEQ ID NO: 28746

SEQ ID NO: 36042 - DNA, 1170 bp, Pseudomonas aeruginosa; identical to SEQ ID NO: 28747
  CDS (1)..(1170)

SEQ ID NO: 36043 - protein, 389 aa, Pseudomonas aeruginosa; identical to SEQ ID NO: 28748

SEQ ID NO: 36044 - DNA, 1407 bp, Sinorhizobium meliloti; identical to SEQ ID NO: 28749
  CDS (1)..(1407)

SEQ ID NO: 36045 - protein, 468 aa, Sinorhizobium meliloti; identical to SEQ ID NO: 28750

SEQ ID NO: 36046 - DNA, 1332 bp, Helicobacter pylori; identical to SEQ ID NO: 28751
  CDS (1)..(1332)

SEQ ID NO: 36047 - protein, 443 aa, Helicobacter pylori; identical to SEQ ID NO: 28752

SEQ ID NO: 36048 - DNA, 1419 bp, Caulobacter crescentus; identical to SEQ ID NO: 28753
  CDS (1)..(1419)

SEQ ID NO: 36049 - protein, 472 aa, Caulobacter crescentus; identical to SEQ ID NO: 28754

SEQ ID NO: 36050 - DNA, 1446 bp, Xylella fastidiosa; identical to SEQ ID NO: 28755
  CDS (1)..(1446)

SEQ ID NO: 36051 - protein, 481 aa, Xylella fastidiosa; identical to SEQ ID NO: 28756

SEQ ID NO: 36052 - DNA, 1458 bp, Treponema pallidum subsp. pallidum (syphilis spirochete); identical to SEQ ID NO: 28757
  CDS (1)..(1458)

SEQ ID NO: 36053 - protein, 485 aa, Treponema pallidum subsp. pallidum (syphilis spirochete); identical to SEQ ID NO: 28758

SEQ ID NO: 36054 - DNA, 1380 bp, Thermotoga maritima; identical to SEQ ID NO: 28759
  CDS (1)..(1380)

SEQ ID NO: 36055 - protein, 459 aa, Thermotoga maritima; identical to SEQ ID NO: 28760

SEQ ID NO: 36056 - DNA, 1371 bp, Vibrio cholerae; identical to SEQ ID NO: 28761
  CDS (1)..(1371)

SEQ ID NO: 36057 - protein, 456 aa, Vibrio cholerae; identical to SEQ ID NO: 28762

SEQ ID NO: 36058 - DNA, 1961 bp, Pseudomonas aeruginosa; identical to SEQ ID NO: 28763
  CDS (496)..(1920)

SEQ ID NO: 36059 - protein, 474 aa, Pseudomonas aeruginosa; identical to SEQ ID NO: 28764

SEQ ID NO: 36060 - DNA, 1593 bp, Caulobacter crescentus; identical to SEQ ID NO: 28765
  CDS (1)..(1593)

SEQ ID NO: 36061 - protein, 530 aa, Caulobacter crescentus; identical to SEQ ID NO: 28766

SEQ ID NO: 36062 - DNA, 1536 bp, Rickettsia conorii; identical to SEQ ID NO: 28767
  CDS (1)..(1536)

SEQ ID NO: 36063 - protein, 511 aa, Rickettsia conorii; identical to SEQ ID NO: 28768

SEQ ID NO: 36064 - DNA, 1452 bp, Borrelia burgdorferi (Lyme disease spirochete); identical to SEQ ID NO: 28769
  CDS (1)..(1452)

SEQ ID NO: 36065 - protein, 483 aa, Borrelia burgdorferi (Lyme disease spirochete); identical to SEQ ID NO: 28770

SEQ ID NO: 36066 - DNA, 1494 bp, Chlamydia trachomatis; identical to SEQ ID NO: 28771
  CDS (1)..(1494)

SEQ ID NO: 36067 - protein, 497 aa, Chlamydia trachomatis; identical to SEQ ID NO: 28772

SEQ ID NO: 36068 - DNA, 1431 bp, Helicobacter pylori; identical to SEQ ID NO: 28773
  CDS (1)..(1431)

SEQ ID NO: 36069 - protein, 476 aa, Helicobacter pylori; identical to SEQ ID NO: 28774

SEQ ID NO: 36070 - DNA, 1302 bp, Clostridium acetobutylicum; identical to SEQ ID NO: 28775
  CDS (1)..(1302)

SEQ ID NO: 36071 - protein, 433 aa, Clostridium acetobutylicum; identical to SEQ ID NO: 28776

SEQ ID NO: 36072 - DNA, 2009 bp, Brucella abortus; identical to SEQ ID NO: 28777
  CDS (275)..(1816)

SEQ ID NO: 36073 - protein, 513 aa, Brucella abortus; identical to SEQ ID NO: 28778

SEQ ID NO: 36074 - DNA, 1185 bp, Synechocystis sp; identical to SEQ ID NO: 28779
  CDS (1)..(1185)

SEQ ID NO: 36075 - protein, 394 aa, Synechocystis sp; identical to SEQ ID NO: 28780

SEQ ID NO: 36076 - DNA, 1251 bp, Synechocystis sp; identical to SEQ ID NO: 28781
  CDS (1)..(1251)

SEQ ID NO: 36077 - protein, 416 aa, Synechocystis sp; identical to SEQ ID NO: 28782

SEQ ID NO: 36078 - DNA, 1359 bp, Synechocystis sp; identical to SEQ ID NO: 28783
  CDS (1)..(1359)

SEQ ID NO: 36079 - protein, 452 aa, Synechocystis sp; identical to SEQ ID NO: 28784

SEQ ID NO: 36080 - DNA, 1740 bp, Lactococcus lactis; identical to SEQ ID NO: 28785
  CDS (230)..(1456)

SEQ ID NO: 36081 - protein, 408 aa, Lactococcus lactis; identical to SEQ ID NO: 28786

SEQ ID NO: 36082 - DNA, 1383 bp, Rhodobacter capsulatus; identical to SEQ ID NO: 28787
  CDS (1)..(1383)

SEQ ID NO: 36083 - protein, 460 aa, Rhodobacter capsulatus; identical to SEQ ID NO: 28788

SEQ ID NO: 36084 - DNA, 1392 bp, Haemophilus influenzae; identical to SEQ ID NO: 28789
  CDS (1)..(1392)

SEQ ID NO: 36085 - protein, 463 aa, Haemophilus influenzae; identical to SEQ ID NO: 28790

SEQ ID NO: 36086 - DNA, 1800 bp, Yersinia enterocolitica; identical to SEQ ID NO: 28791
  CDS (244)..(1680)

SEQ ID NO: 36087 - protein, 478 aa, Yersinia enterocolitica; identical to SEQ ID NO: 28792

SEQ ID NO: 36088 - DNA, 2027 bp, Azotobacter vinelandii; identical to SEQ ID NO: 28793
  CDS (483)..(1904)

SEQ ID NO: 36089 - protein, 473 aa, Azotobacter vinelandii; identical to SEQ ID NO: 28794

SEQ ID NO: 36090 - DNA, 1905 bp, Brucella abortus; identical to SEQ ID NO: 28795
  CDS (333)..(1835)

SEQ ID NO: 36091 - protein, 500 aa, Brucella abortus; identical to SEQ ID NO: 28796

SEQ ID NO: 36092 - DNA, 1466 bp, Campylobacter jejuni; identical to SEQ ID NO: 28797
  CDS (48)..(1466)

SEQ ID NO: 36093 - protein, 472 aa, Campylobacter jejuni; identical to SEQ ID NO: 28798

SEQ ID NO: 36094 - DNA, 1191 bp, Pseudomonas aeruginosa; identical to SEQ ID NO: 28799
  CDS (14)..(1183)

SEQ ID NO: 36095 - protein, 389 aa, Pseudomonas aeruginosa; identical to SEQ ID NO: 28800

SEQ ID NO: 36096 - DNA, 1488 bp, Burkholderia mallei ATCC 23344; identical to SEQ ID NO: 28801
  CDS (1)..(1488)

SEQ ID NO: 36097 - protein, 495 aa, Burkholderia mallei ATCC 23344; identical to SEQ ID NO: 28802

SEQ ID NO: 36098 - DNA, 1209 bp, Burkholderia pseudomallei K96243; identical to SEQ ID NO: 28803
  CDS (1)..(1209)

SEQ ID NO: 36099 - protein, 402 aa, Burkholderia pseudomallei K96243; identical to SEQ ID NO: 28804

SEQ ID NO: 36100 - DNA, 1458 bp, Burkholderia pseudomallei K96243; identical to SEQ ID NO: 28805
  CDS (1)..(1458)

SEQ ID NO: 36101 - protein, 485 aa, Burkholderia pseudomallei K96243; identical to SEQ ID NO: 28806

SEQ ID NO: 36102 - DNA, 1557 bp, Burkholderia pseudomallei K96243; identical to SEQ ID NO: 28807
  CDS (1)..(1557)

SEQ ID NO: 36103 - protein, 518 aa, Burkholderia pseudomallei K96243; identical to SEQ ID NO: 28808

SEQ ID NO: 36104 - DNA, 1419 bp, Burkholderia pseudomallei K96243; identical to SEQ ID NO: 28809
  CDS (1)..(1419)

SEQ ID NO: 36105 - protein, 472 aa, Burkholderia pseudomallei K96243; identical to SEQ ID NO: 28810

SEQ ID NO: 36106 - DNA, 1566 bp, Bacteroides fragilis; identical to SEQ ID NO: 28811
  CDS (19)..(1566)

SEQ ID NO: 36107 - protein, 515 aa, Bacteroides fragilis; identical to SEQ ID NO: 28812

SEQ ID NO: 36108 - DNA, 2358 bp, Bacillus licheniformis DSM 13; identical to SEQ ID NO: 28813
  CDS (501)..(1871)

SEQ ID NO: 36109 - protein, 456 aa, Bacillus licheniformis DSM 13; identical to SEQ ID NO: 28814

SEQ ID NO: 36110 - DNA, 1470 bp, Mannheimia succiniciproducens MBEL55E; identical to SEQ ID NO: 28815
  CDS (1)..(1470)

SEQ ID NO: 36111 - protein, 489 aa, Mannheimia succiniciproducens MBEL55E; identical to SEQ ID NO: 28816

SEQ ID NO: 36112 - DNA, 1425 bp, Borrelia garinii PBi; identical to SEQ ID NO: 28817
  CDS (1)..(1425)

SEQ ID NO: 36113 - protein, 474 aa, Borrelia garinii PBi; identical to SEQ ID NO: 28818

SEQ ID NO: 36114 - DNA, 1224 bp, Lactococcus lactis; identical to SEQ ID NO: 28819
  CDS (1)..(1224)

SEQ ID NO: 36115 - protein, 407 aa, Lactococcus lactis; identical to SEQ ID NO: 28820

SEQ ID NO: 36116 - DNA, 1557 bp, Rickettsia typhi; identical to SEQ ID NO: 28821
  CDS (1)..(1557)

SEQ ID NO: 36117 - protein, 518 aa, Rickettsia typhi; identical to SEQ ID NO: 28822

SEQ ID NO: 36118 - DNA, 1485 bp, Onchocerca volvulus endobacterium; identical to SEQ ID NO: 28823
  CDS (1)..(1485)

SEQ ID NO: 36119 - protein, 494 aa, Onchocerca volvulus endobacterium; identical to SEQ ID NO: 28824

SEQ ID NO: 36120 - DNA, 1455 bp, Desulfotalea psychrophila; identical to SEQ ID NO: 28825
  CDS (1)..(1455)

SEQ ID NO: 36121 - protein, 484 aa, Desulfotalea psychrophila; identical to SEQ ID NO: 28826

SEQ ID NO: 36122 - DNA, 1467 bp, Erwinia carotovora; identical to SEQ ID NO: 28827
  CDS (1)..(1467)

SEQ ID NO: 36123 - protein, 488 aa, Erwinia carotovora; identical to SEQ ID NO: 28828

SEQ ID NO: 36124 - DNA, 1371 bp, Erwinia carotovora; identical to SEQ ID NO: 28829
  CDS (1)..(1371)

SEQ ID NO: 36125 - protein, 456 aa, Erwinia carotovora; identical to SEQ ID NO: 28830

SEQ ID NO: 36126 - DNA, 1404 bp, Acinetobacter sp; identical to SEQ ID NO: 28831
  CDS (1)..(1404)

SEQ ID NO: 36127 - protein, 467 aa, Acinetobacter sp; identical to SEQ ID NO: 28832

SEQ ID NO: 36128 - DNA, 1518 bp, Bartonella quintana; identical to SEQ ID NO: 28833
  CDS (1)..(1518)

SEQ ID NO: 36129 - protein, 505 aa, Bartonella quintana; identical to SEQ ID NO: 28834

SEQ ID NO: 36130 - DNA, 1395 bp, Bartonella quintana; identical to SEQ ID NO: 28835
  CDS (1)..(1395)

SEQ ID NO: 36131 - protein, 464 aa, Bartonella quintana; identical to SEQ ID NO: 28836

SEQ ID NO: 36132 - DNA, 1512 bp, Bartonella quintana; identical to SEQ ID NO: 28837
  CDS (1)..(1512)

SEQ ID NO: 36133 - protein, 503 aa, Bartonella quintana; identical to SEQ ID NO: 28838

SEQ ID NO: 36134 - DNA, 1518 bp, Bartonella henselae; identical to SEQ ID NO: 28839
  CDS (1)..(1518)

SEQ ID NO: 36135 - protein, 505 aa, Bartonella henselae; identical to SEQ ID NO: 28840

SEQ ID NO: 36136 - DNA, 1392 bp, Bartonella henselae; identical to SEQ ID NO: 28841
  CDS (1)..(1392)

SEQ ID NO: 36137 - protein, 463 aa, Bartonella henselae; identical to SEQ ID NO: 28842

SEQ ID NO: 36138 - DNA, 1368 bp, Photobacterium profundum; identical to SEQ ID NO: 28843
  CDS (1)..(1368)

SEQ ID NO: 36139 - protein, 455 aa, Photobacterium profundum; identical to SEQ ID NO: 28844

SEQ ID NO: 36140 - DNA, 1455 bp, Parachlamydia sp; identical to SEQ ID NO: 28845
  CDS (1)..(1455)

SEQ ID NO: 36141 - protein, 484 aa, Parachlamydia sp; identical to SEQ ID NO: 28846

SEQ ID NO: 36142 - DNA, 1563 bp, Rhodopseudomonas palustris; identical to SEQ ID NO: 28847
  CDS (1)..(1563)

SEQ ID NO: 36143 - protein, 520 aa, Rhodopseudomonas palustris; identical to SEQ ID NO: 28848

SEQ ID NO: 36144 - DNA, 1506 bp, Rhodopseudomonas palustris; identical to SEQ ID NO: 28849
  CDS (1)..(1506)

SEQ ID NO: 36145 - protein, 501 aa, Rhodopseudomonas palustris; identical to SEQ ID NO: 28850

SEQ ID NO: 36146 - DNA, 1200 bp, Rhodopseudomonas palustris; identical to SEQ ID NO: 28851
  CDS (1)..(1200)

SEQ ID NO: 36147 - protein, 399 aa, Rhodopseudomonas palustris; identical to SEQ ID NO: 28852

SEQ ID NO: 36148 - DNA, 1392 bp, Rhodopseudomonas palustris; identical to SEQ ID NO: 28853
  CDS (1)..(1392)

SEQ ID NO: 36149 - protein, 463 aa, Rhodopseudomonas palustris; identical to SEQ ID NO: 28854

SEQ ID NO: 36150 - DNA, 1572 bp, Rhodopseudomonas palustris; identical to SEQ ID NO: 28855
  CDS (1)..(1572)

SEQ ID NO: 36151 - protein, 523 aa, Rhodopseudomonas palustris; identical to SEQ ID NO: 28856

SEQ ID NO: 36152 - DNA, 1401 bp, uncultured bacterium 580; identical to SEQ ID NO: 28857
  CDS (1)..(1401)

SEQ ID NO: 36153 - protein, 466 aa, uncultured bacterium 580; identical to SEQ ID NO: 28858

SEQ ID NO: 36154 - DNA, 1476 bp, uncultured bacterium 106; identical to SEQ ID NO: 28859
  CDS (1)..(1476)

SEQ ID NO: 36155 - protein, 491 aa, uncultured bacterium 106; identical to SEQ ID NO: 28860

SEQ ID NO: 36156 - DNA, 1143 bp, uncultured bacterium 105; identical to SEQ ID NO: 28861
  CDS (1)..(1143)

SEQ ID NO: 36157 - protein, 380 aa, uncultured bacterium 105; identical to SEQ ID NO: 28862

SEQ ID NO: 36158 - DNA, 1395 bp, Rhizobium sp; identical to SEQ ID NO: 28863
  CDS (1)..(1395)

SEQ ID NO: 36159 - protein, 464 aa, Rhizobium sp; identical to SEQ ID NO: 28864

SEQ ID NO: 36160 - DNA, 1449 bp, Desulfovibrio vulgaris; identical to SEQ ID NO: 28865
  CDS (1)..(1449)

SEQ ID NO: 36161 - protein, 482 aa, Desulfovibrio vulgaris; identical to SEQ ID NO: 28866

SEQ ID NO: 36162 - DNA, 1167 bp, Leptospira interrogans; identical to SEQ ID NO: 28867
  CDS (1)..(1167)

SEQ ID NO: 36163 - protein, 388 aa, Leptospira interrogans; identical to SEQ ID NO: 28868

SEQ ID NO: 36164 - DNA, 1494 bp, Wolbachia pipientis wMel; identical to SEQ ID NO: 28869
  CDS (1)..(1494)

SEQ ID NO: 36165 - protein, 497 aa, Wolbachia pipientis wMel; identical to SEQ ID NO: 28870

SEQ ID NO: 36166 - DNA, 1482 bp, Treponema denticola; identical to SEQ ID NO: 28871
  CDS (1)..(1482)

SEQ ID NO: 36167 - protein, 493 aa, Treponema denticola; identical to SEQ ID NO: 28872

SEQ ID NO: 36168 - DNA, 1395 bp, Geobacter sulfurreducens; identical to SEQ ID NO: 28873
  CDS (1)..(1395)

SEQ ID NO: 36169 - protein, 464 aa, Geobacter sulfurreducens; identical to SEQ ID NO: 28874

SEQ ID NO: 36170 - DNA, 1416 bp, Geobacter sulfurreducens; identical to SEQ ID NO: 28875
  CDS (1)..(1416)

SEQ ID NO: 36171 - protein, 471 aa, Geobacter sulfurreducens; identical to SEQ ID NO: 28876

SEQ ID NO: 36172 - DNA, 1221 bp, Lactobacillus johnsonii; identical to SEQ ID NO: 28877
  CDS (1)..(1221)

SEQ ID NO: 36173 - protein, 406 aa, Lactobacillus johnsonii; identical to SEQ ID NO: 28878

SEQ ID NO: 36174 - DNA, 1425 bp, Wolinella succinogenes; identical to SEQ ID NO: 28879
  CDS (1)..(1425)

SEQ ID NO: 36175 - protein, 474 aa, Wolinella succinogenes; identical to SEQ ID NO: 28880

SEQ ID NO: 36176 - DNA, 1368 bp, Vibrio vulnificus; identical to SEQ ID NO: 28881
  CDS (1)..(1368)

SEQ ID NO: 36177 - protein, 455 aa, Vibrio vulnificus; identical to SEQ ID NO: 28882

SEQ ID NO: 36178 - DNA, 1497 bp, Porphyromonas gingivalis; identical to SEQ ID NO: 28883
  CDS (1)..(1497)

SEQ ID NO: 36179 - protein, 498 aa, Porphyromonas gingivalis; identical to SEQ ID NO: 28884

SEQ ID NO: 36180 - DNA, 1320 bp, Gloeobacter violaceus; identical to SEQ ID NO: 28885
  CDS (1)..(1320)

SEQ ID NO: 36181 - protein, 439 aa, Gloeobacter violaceus; identical to SEQ ID NO: 28886

SEQ ID NO: 36182 - DNA, 1467 bp, Chromobacterium violaceum; identical to SEQ ID NO: 28887
  CDS (1)..(1467)

SEQ ID NO: 36183 - protein, 488 aa, Chromobacterium violaceum; identical to SEQ ID NO: 28888

SEQ ID NO: 36184 - DNA, 1413 bp, Chromobacterium violaceum; identical to SEQ ID NO: 28889
  CDS (1)..(1413)

SEQ ID NO: 36185 - protein, 470 aa, Chromobacterium violaceum; identical to SEQ ID NO: 28890

SEQ ID NO: 36186 - DNA, 1158 bp, Prochlorococcus marinus; identical to SEQ ID NO: 28891
  CDS (1)..(1158)

SEQ ID NO: 36187 - protein, 385 aa, Prochlorococcus marinus; identical to SEQ ID NO: 28892

SEQ ID NO: 36188 - DNA, 1125 bp, Synechococcus sp; identical to SEQ ID NO: 28893
  CDS (1)..(1125)

SEQ ID NO: 36189 - protein, 374 aa, Synechococcus sp; identical to SEQ ID NO: 28894

SEQ ID NO: 36190 - DNA, 1299 bp, Synechococcus sp; identical to SEQ ID NO: 28895
  CDS (1)..(1299)

SEQ ID NO: 36191 - protein, 432 aa, Synechococcus sp; identical to SEQ ID NO: 28896

SEQ ID NO: 36192 - DNA, 1527 bp, Rhodopirellula baltica; identical to SEQ ID NO: 28897
  CDS (1)..(1527)

SEQ ID NO: 36193 - protein, 508 aa, Rhodopirellula baltica; identical to SEQ ID NO: 28898

SEQ ID NO: 36194 - DNA, 1530 bp, Rhodopirellula baltica; identical to SEQ ID NO: 28899
  CDS (1)..(1530)

SEQ ID NO: 36195 - protein, 509 aa, Rhodopirellula baltica; identical to SEQ ID NO: 28900

SEQ ID NO: 36196 - DNA, 1890 bp, Rhodopirellula baltica; identical to SEQ ID NO: 28901
  CDS (1)..(1890)

SEQ ID NO: 36197 - protein, 629 aa, Rhodopirellula baltica; identical to SEQ ID NO: 28902

SEQ ID NO: 36198 - DNA, 1188 bp, Prochlorococcus marinus; identical to SEQ ID NO: 28903
  CDS (1)..(1188)

SEQ ID NO: 36199 - protein, 395 aa, Prochlorococcus marinus; identical to SEQ ID NO: 28904

SEQ ID NO: 36200 - DNA, 1176 bp, Prochlorococcus marinus; identical to SEQ ID NO: 28905
  CDS (1)..(1176)

SEQ ID NO: 36201 - protein, 391 aa, Prochlorococcus marinus; identical to SEQ ID NO: 28906

SEQ ID NO: 36202 - DNA, 1434 bp, Helicobacter hepaticus; identical to SEQ ID NO: 28907
  CDS (1)..(1434)

SEQ ID NO: 36203 - protein, 477 aa, Helicobacter hepaticus; identical to SEQ ID NO: 28908

SEQ ID NO: 36204 - DNA, 1419 bp, Haemophilus ducreyi; identical to SEQ ID NO: 28909
  CDS (1)..(1419)

SEQ ID NO: 36205 - protein, 472 aa, Haemophilus ducreyi; identical to SEQ ID NO: 28910

SEQ ID NO: 36206 - DNA, 1386 bp, Candidatus Blochmannia floridanus; identical to SEQ ID NO: 28911
  CDS (1)..(1386)

SEQ ID NO: 36207 - protein, 461 aa, Candidatus Blochmannia floridanus; identical to SEQ ID NO: 28912

SEQ ID NO: 36208 - DNA, 1137 bp, Bordetella pertussis; identical to SEQ ID NO: 28913
  CDS (1)..(1137)

SEQ ID NO: 36209 - protein, 378 aa, Bordetella pertussis; identical to SEQ ID NO: 28914

SEQ ID NO: 36210 - DNA, 1116 bp, Bordetella parapertussis; identical to SEQ ID NO: 28915
  CDS (1)..(1116)

SEQ ID NO: 36211 - protein, 371 aa, Bordetella parapertussis; identical to SEQ ID NO: 28916

SEQ ID NO: 36212 - DNA, 1488 bp, Bordetella parapertussis; identical to SEQ ID NO: 28917
  CDS (1)..(1488)

SEQ ID NO: 36213 - protein, 495 aa, Bordetella parapertussis; identical to SEQ ID NO: 28918

SEQ ID NO: 36214 - DNA, 1467 bp, Chlamydophila caviae; identical to SEQ ID NO: 28919
  CDS (1)..(1467)

SEQ ID NO: 36215 - protein, 488 aa, Chlamydophila caviae; identical to SEQ ID NO: 28920

SEQ ID NO: 36216 - DNA, 1419 bp, Streptomyces avermitilis; identical to SEQ ID NO: 28921
  CDS (1)..(1419)

SEQ ID NO: 36217 - protein, 472 aa, Streptomyces avermitilis; identical to SEQ ID NO: 28922

SEQ ID NO: 36218 - DNA, 1491 bp, Nitrosomonas europaea; identical to SEQ ID NO: 28923
  CDS (1)..(1491)

SEQ ID NO: 36219 - protein, 496 aa, Nitrosomonas europaea; identical to SEQ ID NO: 28924

SEQ ID NO: 36220 - DNA, 1323 bp, Enterococcus faecalis; identical to SEQ ID NO: 28925
  CDS (25)..(1323)

SEQ ID NO: 36221 - protein, 432 aa, Enterococcus faecalis; identical to SEQ ID NO: 28926

SEQ ID NO: 36222 - DNA, 1356 bp, Coxiella burnetii; identical to SEQ ID NO: 28927
  CDS (1)..(1356)

SEQ ID NO: 36223 - protein, 451 aa, Coxiella burnetii; identical to SEQ ID NO: 28928

SEQ ID NO: 36224 - DNA, 1368 bp, Enterobacter cloacae; identical to SEQ ID NO: 28929
  CDS (1)..(1368)

SEQ ID NO: 36225 - protein, 455 aa, Enterobacter cloacae; identical to SEQ ID NO: 28930

SEQ ID NO: 36226 - DNA, 1545 bp, Xylella fastidiosa; identical to SEQ ID NO: 28931
  CDS (1)..(1545)

SEQ ID NO: 36227 - protein, 514 aa, Xylella fastidiosa; identical to SEQ ID NO: 28932

SEQ ID NO: 36228 - DNA, 1377 bp, Xylella fastidiosa; identical to SEQ ID NO: 28933
  CDS (1)..(1377)

SEQ ID NO: 36229 - protein, 458 aa, Xylella fastidiosa; identical to SEQ ID NO: 28934

SEQ ID NO: 36230 - DNA, 1368 bp, Vibrio parahaemolyticus; identical to SEQ ID NO: 28935
  CDS (1)..(1368)

SEQ ID NO: 36231 - protein, 455 aa, Vibrio parahaemolyticus; identical to SEQ ID NO: 28936

SEQ ID NO: 36232 - DNA, 1161 bp, Pseudomonas syringae; identical to SEQ ID NO: 28937
  CDS (1)..(1161)

SEQ ID NO: 36233 - protein, 386 aa, Pseudomonas syringae; identical to SEQ ID NO: 28938

SEQ ID NO: 36234 - DNA, 1440 bp, Pseudomonas syringae; identical to SEQ ID NO: 28939
  CDS (1)..(1440)

SEQ ID NO: 36235 - protein, 479 aa, Pseudomonas syringae; identical to SEQ ID NO: 28940

SEQ ID NO: 36236 - DNA, 1479 bp, Pseudomonas putida; identical to SEQ ID NO: 28941
  CDS (1)..(1479)

SEQ ID NO: 36237 - protein, 492 aa, Pseudomonas putida; identical to SEQ ID NO: 28942

SEQ ID NO: 36238 - DNA, 1524 bp, Bradyrhizobium japonicum; identical to SEQ ID NO: 28943
  CDS (1)..(1524)

SEQ ID NO: 36239 - protein, 507 aa, Bradyrhizobium japonicum; identical to SEQ ID NO: 28944

SEQ ID NO: 36240 - DNA, 1272 bp, Bradyrhizobium japonicum; identical to SEQ ID NO: 28945
  CDS (1)..(1272)

SEQ ID NO: 36241 - protein, 423 aa, Bradyrhizobium japonicum; identical to SEQ ID NO: 28946

SEQ ID NO: 36242 - DNA, 1578 bp, Bradyrhizobium japonicum; identical to SEQ ID NO: 28947
  CDS (1)..(1578)

SEQ ID NO: 36243 - protein, 525 aa, Bradyrhizobium japonicum; identical to SEQ ID NO: 28948

SEQ ID NO: 36244 - DNA, 1587 bp, Bradyrhizobium japonicum; identical to SEQ ID NO: 28949
  CDS (1)..(1587)

SEQ ID NO: 36245 - protein, 528 aa, Bradyrhizobium japonicum; identical to SEQ ID NO: 28950

SEQ ID NO: 36246 - DNA, 1536 bp, Bacteroides thetaiotaomicron; identical to SEQ ID NO: 28951
  CDS (1)..(1536)

SEQ ID NO: 36247 - protein, 511 aa, Bacteroides thetaiotaomicron; identical to SEQ ID NO: 28952

SEQ ID NO: 36248 - DNA, 1410 bp, Escherichia coli O6; identical to SEQ ID NO: 28953
  CDS (1)..(1410)

SEQ ID NO: 36249 - protein, 469 aa, Escherichia coli O6; identical to SEQ ID NO: 28954

SEQ ID NO: 36250 - DNA, 1392 bp, Yersinia pestis; identical to SEQ ID NO: 28955
  CDS (1)..(1392)

SEQ ID NO: 36251 - protein, 463 aa, Yersinia pestis; identical to SEQ ID NO: 28956

SEQ ID NO: 36252 - DNA, 1374 bp, Wigglesworthia glossinidia brevipalpis; identical to SEQ ID NO: 28957
  CDS (1)..(1374)

SEQ ID NO: 36253 - protein, 457 aa, Wigglesworthia glossinidia brevipalpis; identical to SEQ ID NO: 28958

SEQ ID NO: 36254 - DNA, 1128 bp, Synechococcus elongatus; identical to SEQ ID NO: 28959
  CDS (1)..(1128)

SEQ ID NO: 36255 - protein, 375 aa, Synechococcus elongatus; identical to SEQ ID NO: 28960

SEQ ID NO: 36256 - DNA, 1170 bp, Synechococcus elongatus; identical to SEQ ID NO: 28961
  CDS (1)..(1170)

SEQ ID NO: 36257 - protein, 389 aa, Synechococcus elongatus; identical to SEQ ID NO: 28962

SEQ ID NO: 36258 - DNA, 1353 bp, Shewanella oneidensis; identical to SEQ ID NO: 28963
  CDS (1)..(1353)

SEQ ID NO: 36259 - protein, 450 aa, Shewanella oneidensis; identical to SEQ ID NO: 28964

SEQ ID NO: 36260 - DNA, 1518 bp, Chlorobium tepidum; identical to SEQ ID NO: 28965
  CDS (1)..(1518)

SEQ ID NO: 36261 - protein, 505 aa, Chlorobium tepidum; identical to SEQ ID NO: 28966

SEQ ID NO: 36262 - DNA, 1461 bp, Rhizobium etli; identical to SEQ ID NO: 28967
  CDS (1)..(1461)

SEQ ID NO: 36263 - protein, 486 aa, Rhizobium etli; identical to SEQ ID NO: 28968

SEQ ID NO: 36264 - DNA, 1368 bp, Pasteurella piscicida; identical to SEQ ID NO: 28969
  CDS (1)..(1368)

SEQ ID NO: 36265 - protein, 455 aa, Pasteurella piscicida; identical to SEQ ID NO: 28970

SEQ ID NO: 36266 - DNA, 1437 bp, Xanthomonas campestris; identical to SEQ ID NO: 28971
  CDS (1)..(1437)

SEQ ID NO: 36267 - protein, 478 aa, Xanthomonas campestris; identical to SEQ ID NO: 28972

SEQ ID NO: 36268 - DNA, 1437 bp, Xanthomonas axonopodis; identical to SEQ ID NO: 28973
  CDS (1)..(1437)

SEQ ID NO: 36269 - protein, 478 aa, Xanthomonas axonopodis; identical to SEQ ID NO: 28974

SEQ ID NO: 36270 - DNA, 1578 bp, Xanthomonas axonopodis; identical to SEQ ID NO: 28975
  CDS (1)..(1578)

SEQ ID NO: 36271 - protein, 525 aa, Xanthomonas axonopodis; identical to SEQ ID NO: 28976

SEQ ID NO: 36272 - DNA, 2077 bp, Klebsiella pneumoniae; identical to SEQ ID NO: 28977
  CDS (374)..(1807)

SEQ ID NO: 36273 - protein, 477 aa, Klebsiella pneumoniae; identical to SEQ ID NO: 28978

SEQ ID NO: 36274 - DNA, 1536 bp, Xanthomonas campestris; identical to SEQ ID NO: 28979
  CDS (1)..(1536)

SEQ ID NO: 36275 - protein, 511 aa, Xanthomonas campestris; identical to SEQ ID NO: 28980

SEQ ID NO: 36276 - DNA, 1473 bp, Ralstonia solanacearum; identical to SEQ ID NO: 28981
  CDS (1)..(1473)

SEQ ID NO: 36277 - protein, 490 aa, Ralstonia solanacearum; identical to SEQ ID NO: 28982

SEQ ID NO: 36278 - DNA, 1518 bp, Ralstonia solanacearum; identical to SEQ ID NO: 28983
  CDS (1)..(1518)

SEQ ID NO: 36279 - protein, 505 aa, Ralstonia solanacearum; identical to SEQ ID NO: 28984

SEQ ID NO: 36280 - DNA, 1368 bp, Salmonella typhimurium; identical to SEQ ID NO: 28985
  CDS (1)..(1368)

SEQ ID NO: 36281 - protein, 455 aa, Salmonella typhimurium; identical to SEQ ID NO: 28986

SEQ ID NO: 36282 - DNA, 1512 bp, Rhizobium meliloti; identical to SEQ ID NO: 28987
  CDS (1)..(1512)

SEQ ID NO: 36283 - protein, 503 aa, Rhizobium meliloti; identical to SEQ ID NO: 28988

SEQ ID NO: 36284 - DNA, 1398 bp, Rhizobium meliloti; identical to SEQ ID NO: 28989
  CDS (1)..(1398)

SEQ ID NO: 36285 - protein, 465 aa, Rhizobium meliloti; identical to SEQ ID NO: 28990

SEQ ID NO: 36286 - DNA, 1551 bp, Rhizobium loti; identical to SEQ ID NO: 28991
  CDS (1)..(1551)

SEQ ID NO: 36287 - protein, 516 aa, Rhizobium loti; identical to SEQ ID NO: 28992

SEQ ID NO: 36288 - DNA, 1542 bp, Rhizobium loti; identical to SEQ ID NO: 28993
  CDS (1)..(1542)

SEQ ID NO: 36289 - protein, 513 aa, Rhizobium loti; identical to SEQ ID NO: 28994

SEQ ID NO: 36290 - DNA, 1515 bp, Rhizobium loti; identical to SEQ ID NO: 28995
  CDS (1)..(1515)

SEQ ID NO: 36291 - protein, 504 aa, Rhizobium loti; identical to SEQ ID NO: 28996

SEQ ID NO: 36292 - DNA, 1287 bp, Rhizobium loti; identical to SEQ ID NO: 28997
  CDS (1)..(1287)

SEQ ID NO: 36293 - protein, 428 aa, Rhizobium loti; identical to SEQ ID NO: 28998

SEQ ID NO: 36294 - DNA, 1446 bp, Pseudomonas syringae; identical to SEQ ID NO: 28999
  CDS (1)..(1446)

SEQ ID NO: 36295 - protein, 481 aa, Pseudomonas syringae; identical to SEQ ID NO: 29000

SEQ ID NO: 36296 - DNA, 1380 bp, Pasteurella multocida; identical to SEQ ID NO: 29001
  CDS (1)..(1380)

SEQ ID NO: 36297 - protein, 459 aa, Pasteurella multocida; identical to SEQ ID NO: 29002

SEQ ID NO: 36298 - DNA, 1362 bp, Aeromonas hydrophila; identical to SEQ ID NO: 29003
  CDS (1)..(1362)

SEQ ID NO: 36299 - protein, 453 aa, Aeromonas hydrophila; identical to SEQ ID NO: 29004

SEQ ID NO: 36300 - DNA, 1503 bp, Myxococcus xanthus; identical to SEQ ID NO: 29005
  CDS (1)..(1503)

SEQ ID NO: 36301 - protein, 500 aa, Myxococcus xanthus; identical to SEQ ID NO: 29006

SEQ ID NO: 36302 - DNA, 1476 bp, Shigella sonnei; identical to SEQ ID NO: 29007
  CDS (1)..(1476)

SEQ ID NO: 36303 - protein, 491 aa, Shigella sonnei; identical to SEQ ID NO: 29008

SEQ ID NO: 36304 - DNA, 1512 bp, Bartonella henselae; identical to SEQ ID NO: 29009
  CDS (1)..(1512)

SEQ ID NO: 36305 - protein, 503 aa, Bartonella henselae; identical to SEQ ID NO: 29010

SEQ ID NO: 36306 - DNA, 1437 bp, Buchnera aphidicola; identical to SEQ ID NO: 29011
  CDS (1)..(1437)

SEQ ID NO: 36307 - protein, 478 aa, Buchnera aphidicola; identical to SEQ ID NO: 29012

SEQ ID NO: 36308 - DNA, 1515 bp, Rhizobium meliloti; identical to SEQ ID NO: 29013
  CDS (1)..(1515)

SEQ ID NO: 36309 - protein, 504 aa, Rhizobium meliloti; identical to SEQ ID NO: 29014

SEQ ID NO: 36310 - DNA, 1377 bp, Bacillus subtilis; identical to SEQ ID NO: 29015
  CDS (1)..(1377)

SEQ ID NO: 36311 - protein, 458 aa, Bacillus subtilis; identical to SEQ ID NO: 29016

SEQ ID NO: 36312 - DNA, 24 bp, Primer
atgaaaaaaaccacattagcactg

SEQ ID NO: 36313 - DNA, 25 bp, Primer
ttactgcattaacaggtagatggtg

SEQ ID NO: 36314 - protein, 406 aa, consensus; identical to SEQ ID NO: 29019
  MISC_FEATURE (1)..(406): consensus for the disclosure of xaa see table XV

SEQ ID NO: 36315 - protein, 66 aa, consensus; identical to SEQ ID NO: 29020
  MISC_FEATURE (1)..(66): consensus for the disclosure of xaa see table XV

SEQ ID NO: 36316 - protein, 37 aa, consensus; identical to SEQ ID NO: 29021
  MISC_FEATURE (1)..(37): consensus for the disclosure of xaa see table XV

SEQ ID NO: 36317 - protein, 30 aa, consensus; identical to SEQ ID NO: 29022
  MISC_FEATURE (1)..(30): consensus for the disclosure of xaa see table XV

SEQ ID NO: 36318 - protein, 34 aa, consensus; identical to SEQ ID NO: 29023
  MISC_FEATURE (1)..(34): consensus for the disclosure of xaa see table XV

SEQ ID NO: 36319 - protein, 68 aa, consensus; identical to SEQ ID NO: 29024
  MISC_FEATURE (1)..(68): consensus for the disclosure of xaa see table XV

SEQ ID NO: 36320 - DNA, 1293 bp, Escherichia coli
  CDS (1)..(1293)
atgatgaacacggaaggtaataacggtaacaaacctctcggtctatggaacgtcgtttccatcggcattggggcaatggtgggggcggggatcttcgcgctgctggggcaggctgcattgctaatggaagcctcgacctgggtcgcctttgcttttggcggtattgtggcgatgttttccggttatgcctatgcgcgtctgggggcgagctatcccagcaatggcggcattatcgacttctttcgtcgcggattaggcaacggcgtcttttcgctggcgctctcgttactgtacctgttgacgctggcggtgagcatcgccatggtcgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtctctgcgccccccagctccggtgcgttcttctcctgtattgggataactttccttgcctatgcgggctttggcatgatggcgaacgcggcggataaagtgaaagatccgcaggtcattatgccacgggcgtttctggtggcgattggcgttaccacgttgctttatatctcgctggcactggttttgcttagcgatgtatcggcattagagttagaaaaatatgccgataccgccgtagcgcaggctgcttctccgctgctcgggcatgtgggttatgtgatcgtcgtcatcggcgctttactggcgacggcttcagccattaacgcgaacctgttcgccgtgtttaacatcatggacaacatgggcagcgaacgcgaactgccgaagctaatgaataaatccctgtggcggcagagtacctggggcaacattattgtcgtggtgttgattatgctgatgacggcggcactgaatttaggctcactcgccagcgttgccagcgccacctttttgatttgctacctggcggtgtttgtggtggcgatccgcctgcgtcatgatattcacgcctcgttgccgattcttatcgttggtacgttggtgatgttgttggtgatcgttggctttatctacagtctgtggtcccagggtagccgtgcgttgatatggattattggctcactcttactcagccttattgtggcaatggtcatgaagcgcaataaaaccgtataa

SEQ ID NO: 36321 - protein, 430 aa, Escherichia coli
MMNTEGNNGNKPLGLWNVVSIGIGAMVGAGIFALLGQAALLMEASTWVAFAFGGIVAMFSGYAYARLGASYPSNGGIIDFFRRGLGNGVFSLALSLLYLLTLAVSIAMVARAFGAYAVQFLHEGSQEEHLILLYALGIIAVMTLFNSLSNHAVGRLEVILVGIKMMILLLLIIAGVWSLQPAHISVSAPPSSGAFFSCIGITFLAYAGFGMMANAADKVKDPQVIMPRAFLVAIGVTTLLYISLALVLLSDVSALELEKYADTAVAQAASPLLGHVGYVIVVIGALLATASAINANLFAVFNIMDNMGSERELPKLMNKSLWRQSTWGNIIVVVLIMLMTAALNLGSLASVASATFLICYLAVFVVAIRLRHDIHASLPILIVGTLVMLLVIVGFIYSLWSQGSRALIWIIGSLLLSLIVAMVMKRNKTV

SEQ ID NO: 36322 - DNA, 1524 bp, Anopheles gambiae str. PEST
  CDS (1)..(1524)
atggacggaacagcgcagctcaacgggactctcgggcgagggacgtccgaaacggcagagaccgactcatcagggaccggggggatgcgggacgcgttggaggggccgggctcagcgcagaacgacgctattcacctcaagagacgggtgggactcttcagtggggttgctttaattgtcggtaccatgattgggtccggaattttcgtgtcgccatctggtttactggtgcgaactggttccattggtgtgagctttatcatttggatggcctgtggattgctctcgttgttaggtgcattggcgtacgctgagttaggcacgatgaatacttcgtccggagcagaatgggcatactttatggacgcgttcggggcctggcccgccttcctgttctcgtgggtgtcgacgctggtgctgaagccgtcccagatggcgatcatctgcctgtcgttcgcgcagtacgcggtcgaggcgttcgtgtccgagtgcgatccgccgctgagcgtggtgaagatggttgcgatccttgcgatcgtgagcatcctgttcgtgaattgctacagcgtgaacctgggcatggccgtgcagaacgtgtttacgtcggcgaagctgatcgcggtgctgatcgtgatctgtggcggtgcgtacaagctgtgccagggcaacacgcagcatctgcagaatgcatttagcggcactacgccgtcgctgggtgcgatcgcgaccgctttctacaccggcctgtgggcgtacgacggttggaacaatctgaactacgtgacggaggagatccagaatccgagcaaaaatcttccccgctcgatcatcatcggcatcccgctggtgacgctgtgctacgcgctgatcaacgtctcctacctggccgccatgtcgccgacggagatgatcgagtcggaagcggtcgcggtcacgttcggcaaccgcatactgggcgtgatggcgtggctgatgccgctgagcgtcaccatcagtacgtttggcagtgcgaacggcacgctgtttgcggcgggacgactgtgctttgctgccagccgcgagggccacctgctggacatactgtcctacgtgcacgttcgtcgtctaacaccggcgcctgggctaatctttcactcgcttattgccggtgcgatggtgctgtacggtacgatcgattcgctgatcgacttcttcagcttcaccgcctggatcttctacggtggcgccatggtcgccctgatcgtgatgcgctacaccaaaccgaactacccccgaccctacaaagtcccacttatcattccaattttggttatggtcatttccggctaccttgtggcggctcccatcatcgagaagccgcaaatcgagtacctgtacgcagtgctgttcatactggctgggctgatcttctacgtacccttcgtgcactacggctaccatccaaagttcatggacaacgttaccctcttcttccaaatgctgtttgaggtggtgcccacgacgtcgatggcaatgtttgactag

SEQ ID NO: 36323 - protein, 507 aa, Anopheles gambiae str. PEST
MDGTAQLNGTLGRGTSETAETDSSGTGGMRDALEGPGSAQNDAIHLKRRVGLFSGVALIVGTMIGSGIFVSPSGLLVRTGSIGVSFIIWMACGLLSLLGALAYAELGTMNTSSGAEWAYFMDAFGAWPAFLFSWVSTLVLKPSQMAIICLSFAQYAVEAFVSECDPPLSVVKMVAILAIVSILFVNCYSVNLGMAVQNVFTSAKLIAVLIVICGGAYKLCQGNTQHLQNAFSGTTPSLGAIATAFYTGLWAYDGWNNLNYVTEEIQNPSKNLPRSIIIGIPLVTLCYALINVSYLAAMSPTEMIESEAVAVTFGNRILGVMAWLMPLSVTISTFGSANGTLFAAGRLCFAASREGHLLDILSYVHVRRLTPAPGLIFHSLIAGAMVLYGTIDSLIDFFSFTAWIFYGGAMVALIVMRYTKPNYPRPYKVPLIIPILVMVISGYLVAAPIIEKPQIEYLYAVLFILAGLIFYVPFVHYGYHPKFMDNVTLFFQMLFEVVPTTSMAMFD

SEQ ID NO: 36324 - DNA, 2106 bp, Anopheles gambiae str. PEST
  CDS (1)..(1392)
atggacatcgtgctcaagcccaaaatgacactcgtcaacgggatcacggtgatcgtcggttccattatcggttccggcattttcgtctcgccgaccggtgtcctcatcaacacgggcagcgtcaacatgtcgctgatcgtctggatcctctccgggctgttctcgatggttggtgcctactgctacgccgagctgggcacaatgatcaaaaagtcgggcgcagattatgcgtacattatggaaacgttcggcccgttcctggccttcatccgactctggatcgaatgcatgatagtgcgtccctgctcgcaggccatcgtggccctcacgttcagcgtgtacgtgctgaagccgttcttccccgaatgccaaccgcccgaggatgcggcccgcctgcttgccgtctgctgtatcctggtgctgacgttcatcaactgctgggacgtgaaatgggccacggcggtacaggacatcttcacctacgcgaagctgctcgccctgttcatcatcatcggtgccggtgcctactacctgttccaaggcaacacggaacacttcaccttcgataacacgaaaacggaggtaacatcgctcgcattgtccttctattcgggtttgtttgcctacaacggttggaactatttgaacttcatcatcgaggagctgaaggacccggtgaagaatttgccccgtgccatcgcaatttcctgcacgctggtgacggtcgtgtacgtgtttaccaacgtgtccttctacacgatcctgtcgccggaggaggtgctcggctcggaggcggtcgccgtcacgtttgccgatcgggtgttcggtatgtttgcgtggacgataccggtgtttgtcgccctgtcaacgtttggagcggtgaatggcattctgcttacctcgtcccgcctgttctacgccggcgcttgcgaaggtcagatgccggagattcttaccatgatccaaatacagcgcctcacaccgacgcccgccgtgctgattatggcgctcctttccatgctgtatctgacggtatcggacatctttgccctgattaactacgttgggttcgccacttggctaagtatcggtgcggccgtactgtgcctaccgtggttacggtggaagcaaccgaaactgaaccgcccgatcaaggtgaatctcatcttccccatcctgtatctgatcgccaccgtcttcgtcaccgtcgtcccgatgattgccagcccggtagagacgggctacgggtgtcttatgattctttccagcattcccgtctacttcatatttattgcgtggcgaaacaaacccaaatggttcaaccgctcgatgggtggaattacgcagagtttacaaaagttaatgatggtggtgcggccaaaacagaaataagcgcgaatagtgggtcttacacggttcctccaaaaaatgctcatggtcgtaggaaagaccaaaccagctcaggtttaaacaaacatgcatccatacgatcatacgaacacaccgttgccatcatttgctgtgtatgccgaccaaaacgaggatagagccattccagctctacattccagaacggcgcagaagtagtagtgcgaaaggattagagcgatctttatgttgttttaaaacttttttttttaatttgtgcttgtttgatcgtcccatcccttgctgaaggctgttaaaatgtattcgtttcttttaaagtaattattatattatgttctaacaatttgacgtcagttacaaattgatttcgttagaagggatgccacgaggcgaaaaaagaaaatgccgcggaaaaagtatcagtaagacagacgattgtgtgaaataattgcatttcaaagaaacattcccatcactgtttttcgttctgctcgaacaagcgcaatagttccttgagtagaagtcagtcaggcgcacatctcaaccatttatcaaacaactcaaagcaaaacaggtccacaagtcagggaaacagtgttcaggttttaaaaaagttcactcaacgtttatgttttctagctgaataattactgaatcggctctgcagaacagctactggcttttacttttttttattctatttcagtcaacgaaaag

SEQ ID NO: 36325 - protein, 463 aa, Anopheles gambiae str. PEST
MDIVLKPKMTLVNGITVIVGSIIGSGIFVSPTGVLINTGSVNMSLIVWILSGLFSMVGAYCYAELGTMIKKSGADYAYIMETFGPFLAFIRLWIECMIVRPCSQAIVALTFSVYVLKPFFPECQPPEDAARLLAVCCILVLTFINCWDVKWATAVQDIFTYAKLLALFIIIGAGAYYLFQGNTEHFTFDNTKTEVTSLALSFYSGLFAYNGWNYLNFIIEELKDPVKNLPRAIAISCTLVTVVYVFTNVSFYTILSPEEVLGSEAVAVTFADRVFGMFAWTIPVFVALSTFGAVNGILLTSSRLFYAGACEGQMPEILTMIQIQRLTPTPAVLIMALLSMLYLTVSDIFALINYVGFATWLSIGAAVLCLPWLRWKQPKLNRPIKVNLIFPILYLIATVFVTVVPMIASPVETGYGCLMILSSIPVYFIFIAWRNKPKWFNRSMGGITQSLQKLMMVVRPKQK

SEQ ID NO: 36326 - DNA, 2001 bp, Anopheles gambiae str. PEST
  CDS (1)..(2001)
atgcccagcgccagaagaatgatcctggggcacgtcatgtccggtctctgcaccaagatgaaccgcaccaagcagcttccggcggatctgatggaaactccgctgaatagatgtttaaacacattcgacatcacgctgctgggtatcggtcatatggtcggcgctggaatctatgtgctcaccggaaccgtggcacgcgagatggccggtccagcgatcgtgctttcgtttatcctggccgggctggtgtcgctgctggccgccctgtgctatgcggaatttggaacccgcgtcccgaaggctggctcggcctacgtctacacgtacgtttctattggcgagttttgggcgttcgtcatcggctggaatataatcctggagcatatgctgggggctgcctcggtggcccgtgcctggagcgggtacgttgactcgatgctgggcaacatcgtcgccaacatcacgatggaaattacgggcgagatgcacgagcagctgctggccaagtatcccgactttctagcgttcttcgtgtgcatcagctatgcggtcgcgctggcggccggcgttaaggcaacggccatgataaacagcatcctgacgacggtcaatgtggtcgtgatggcgctggttgtggtgttgggcttctggtatgcgtcgcccgacaactggtcactaccagagcagggcttcatgccgtatgggttcggcggtgtgctagccggtgcggccacctgtttctacgcgttcgtgggattcgacagtatcgcaacgtccggtgaggaggcgaaaaacccgagcttttccataccgctcgccaccatcctgtcgctgtgcgtggtgacggtcgggtacgtgctggtcagtgcggccctaacgctgatgattccctacaacgaaattaacccggcggcagcgctgccggatgcgttcggtatgcgcggcatcacgtgggccaagtatgcgatctccactggagccatctgcggtatgacgacgacgctgcttggatcgctctttgcgctgccccgctgcctgtacgcgatggcaagcgatggattgctgttttcctgcttcggcaaggtgaatacgaagacgcaggtaccgctgctgaatctcgccctgtctggtatctgtagtgcactgttggcgctgctgttcgatctggaaaagctggtagagtttatgtcgatcggtacgctgctggcctacacgattgtgtcggctagtgttatcgtactgcgctaccggccgatatcggtagaggaaaccgttcaccttgcgcccgatacacccggcacggatgaggaagacggtggtggcattgattcttcgtcccagtccagtaccatcgatccatcgtcgccaacgagtgagatgatcgagattgctctggccggacggttaaggccccagtttcgctggttagagcccgtgctgggtcgttgtgaaccgggcgtggcctgttccggtgcggtgttaatgttctgtgtgctaagcgtagcggtttgcttccagctggagaactcctgggatgagctgtacaacggaacctggtgggcattaggcctttatggttttctccttttctgtctcgttgcatgtgttgttgtaatttcggctcatcatcagaatactcgcggattgcagttcaaggtaccgttcgtaccgtacatcccagcattgagcatattctgcaacatcgagctgatggtgcatctgagcttcctgacctggttgcgctttttcatctggctgtccatcggtatgctggtgtacttcttgtacggtatccataacagcaaggagggtgagctcggcacgtcctactctatgctgatgtctaccagcgaagcgatccgtggctggggctccaccagcacggccctcggcggtggcactaaggtaacggttactaagataatcaagggcagaattagtcgaaagacggccggcgacaggcaggcgatcgtggatgatgacgatgatgaagattcttaa

SEQ ID NO: 36327 - protein, 666 aa, Anopheles gambiae str. PEST
MPSARRMILGHVMSGLCTKMNRTKQLPADLMETPLNRCLNTFDITLLGIGHMVGAGIYVLTGTVAREMAGPAIVLSFILAGLVSLLAALCYAEFGTRVPKAGSAYVYTYVSIGEFWAFVIGWNIILEHMLGAASVARAWSGYVDSMLGNIVANITMEITGEMHEQLLAKYPDFLAFFVCISYAVALAAGVKATAMINSILTTVNVVVMALVVVLGFWYASPDNWSLPEQGFMPYGFGGVLAGAATCFYAFVGFDSIATSGEEAKNPSFSIPLATILSLCVVTVGYVLVSAALTLMIPYNEINPAAALPDAFGMRGITWAKYAISTGAICGMTTTLLGSLFALPRCLYAMASDGLLFSCFGKVNTKTQVPLLNLALSGICSALLALLFDLEKLVEFMSIGTLLAYTIVSASVIVLRYRPISVEETVHLAPDTPGTDEEDGGGIDSSSQSSTIDPSSPTSEMIEIALAGRLRPQFRWLEPVLGRCEPGVACSGAVLMFCVLSVAVCFQLENSWDELYNGTWWALGLYGFLLFCLVACVVVISAHHQNTRGLQFKVPFVPYIPALSIFCNIELMVHLSFLTWLRFFIWLSIGMLVYFLYGIHNSKEGELGTSYSMLMSTSEAIRGWGSTSTALGGGTKVTVTKIIKGRISRKTAGDRQAIVDDDDDEDS

SEQ ID NO: 36328 - DNA, 2034 bp, Danio rerio
  CDS (1)..(2034)
atggcatcatgtgtttccggctgttctccagtgatgaggttctgtcagaagctgaacaggctaaaaaccctggacgacgatgtaatggcaacttcactgaaacgctgtctgaacacagtggaccttgctctgcttggtgtaggtggaatggtgggttcaggcctgtatgttctcacaggaactgttgcaaaagacacggcaggacccgctgtagtgatatctttccttatagctggagtagcatcactgatggcagcgctgtgctatgctgaatttggcgctcgtgtaccaaagacaggctctgcttacatgttcacatatgtttctgttggcgaaatctgggcattcctgattggctggaatgtcattttggagtatatgattggcggagcggcggtagctcgtgcatggagtggctatttggactctatctttaatcaccgcatccagaacttcacagaaagtcatgtgatgcgctgggaagtgccctttcttgctcattacccagacctcctagcggctgcaatccttctagtggcttcctttttcatttcatttggagttcgtgtctcgtcttggcttaaccacatattttcggccatcagtatggtggtcattgtgtttattttggtgtttggcttcatattggccgatcctgtcaattggagcgctcgggagggaggctttgccccgtttgggctttcgggtatcatggcgggaactgcaacatgcttctatgcttttgttggctttgacgtgatcgcagcttccagcgaggaggccagtaatcctcagagggccattcctgcagcaactgccatctcattgggtcttgcggccacagcttatgtccttgtgtccacagtgcttacattgatggttccatggcacacgcttgacccaaactcagctctctcggatgcgttcttcagacgaggttatagctgggctgggtttattgtggctgtgggatccatatgtgccatgaacactgtgttgctcagcaaccttttctctctcccgcggatcgtgtacgccatggcggaggatggcctcttcttctctgtgttttcccgtgtcaaccctgtaaccaaagtcccagtgatcgccattctcgtttttggcagccttatggcgatccttgccctcatctttgatctagaagctctggtccagttcctctctataggcactctgcttgcttacacttttgtagcagccagtgtcatagtgctccgcttccaaccggataaaagcaacgggagttcaggagcaggtggggtcaagaccgatgcttcatccacaccttcaggaaaccagtcagggcagcagatggatctatctgtggcagcaaatgaagcccagacatttgcgcaggatggtggagagctgaaggagtatgagtctttctctgataaacttcaattggtggagaggcaaaaggcagggaaggagaaacgggctcctgggatgctgaaggctcgctgggagccatatttaggtcgattgctgggcgactgtgagcctggtgaagtggtggcgttctctgtgctcgctctgatggtcagtggagtctctcttagtgctgtgttggtgtttgggattaaccagctgcatctgcctgtgtggagcttcaccctgcttctggtcatcttcagtgtcgtcttcctgctcagtctggctctcatctcggtccatgaacagcggcccaaccttaagacttttcaggttcctctggtgccatttattcctggcttcagcatccttctgaatgtattcctcatgttgaagttaagtcctctcacctggattcggttcaccgtctgggtcgctgcaggcctcctggtatatttcgggtacggcatctggcacagtaaggagggtttacgggaacagcaggggcaggacgtggcagcgcgttacgtggttcttcccagcggcagcctggtggagacagtccagaacgtccagcctgaaggacacactcacagcacacacacttcaaccgttgacaattcacctgccagcagatga

SEQ ID NO: 36329 - protein, 677 aa, Danio rerio
MASCVSGCSPVMRFCQKLNRLKTLDDDVMATSLKRCLNTVDLALLGVGGMVGSGLYVLTGTVAKDTAGPAVVISFLIAGVASLMAALCYAEFGARVPKTGSAYMFTYVSVGEIWAFLIGWNVILEYMIGGAAVARAWSGYLDSIFNHRIQNFTESHVMRWEVPFLAHYPDLLAAAILLVASFFISFGVRVSSWLNHIFSAISMVVIVFILVFGFILADPVNWSAREGGFAPFGLSGIMAGTATCFYAFVGFDVIAASSEEASNPQRAIPAATAISLGLAATAYVLVSTVLTLMVPWHTLDPNSALSDAFFRRGYSWAGFIVAVGSICAMNTVLLSNLFSLPRIVYAMAEDGLFFSVFSRVNPVTKVPVIAILVFGSLMAILALIFDLEALVQFLSIGTLLAYTFVAASVIVLRFQPDKSNGSSGAGGVKTDASSTPSGNQSGQQMDLSVAANEAQTFAQDGGELKEYESFSDKLQLVERQKAGKEKRAPGMLKARWEPYLGRLLGDCEPGEVVAFSVLALMVSGVSLSAVLVFGINQLHLPVWSFTLLLVIFSVVFLLSLALISVHEQRPNLKTFQVPLVPFIPGFSILLNVFLMLKLSPLTWIRFTVWVAAGLLVYFGYGIWHSKEGLREQQGQDVAARYVVLPSGSLVETVQNVQPEGHTHSTHTSTVDNSPASR

SEQ ID NO: 36330 - DNA, 1428 bp, Danio rerio
  CDS (1)..(1428)
atgagcagcggtggcacccgacgcaggactgcatcagtgccggactcggatcccgacggagaaccagcggttaccctaaagaaagagatcggacttctcagtgcatgtgggattgtcgtgggtaacatcattgggtctgggatttttgtcagtccgaagggtgttttggaaaactctggttcagtgggtctggctctcatagtgtggatcctcacaggcatcatcactgccatcggtgctctgtgctatgctgaactaggagtcacaatcccaaagtcaggtggagattattcctacgttaatgacatctttggagggcttgctgggtttctgagactgtggattgcagtgttggtcatctatccaactaaccaggctgtgattgccctcacatttgccaattacgcattgcagcccctcttcccgtcctgctttcctccggagagagctctgggtttactggccgctgtctgtctgttgctgttaacttggattaactgctccagtgtccgctgggcgacgcgtgttcaggatgttttcaccacaggcaagctcctcgccctcggtctcatcatcattatgggcatcgtgcaaatctgcaaaggtcatttttattggttggaaccggagcatgcatttcaccctctccagccatatgacatgggccgcattgcactcgctgttctgcagggatcctttgcttatgcaggctggaacttccttaattatgtaacagaggagctgatcgacccctacaggaaccttcctcgtgcgatcttcatctcaatccctctggtcacgttcgtctatgtatcagcaaatattgcatacgttacagcaatgagcccccaggagttactggcctccaatgctgtagctgtgacatttggtgaaaagctgctaggcgtgatgtcatggctcatgcccatctctgttgctctgtccaccttcggaggggtgaatggatcccttttcacatcatctaggttattctttgcaggtgcgagggagggtcatcttccccgtctgctggcaatgattcatgtgaaccgctgtacacccatcccagctttgctcatcacctgtatatctactctgctgatgctgtgtgtcagtgacatatacaccctcatcaactacgttggcttcatcaactacctgttttatggggtcactgttgccgggcagattgtgcttcgcatcagagagccagacatatatcggccaatcaaagtgagcttggcatggccggcagttttcctgattttctgggctttcctgctgatcttctctctgtactcggagcctgtggtgtgctgtattggtctggccatcatgctatctggggttcctgtgtatctgtttggcatctattgggaaaataagcccaagagcttcagttcttttgttggtatgaagaaatcttaa

SEQ ID NO: 36331 - protein, 475 aa, Danio rerio
MSSGGTRRRTASVPDSDPDGEPAVTLKKEIGLLSACGIVVGNIIGSGIFVSPKGVLENSGSVGLALIVWILTGIITAIGALCYAELGVTIPKSGGDYSYVNDIFGGLAGFLRLWIAVLVIYPTNQAVIALTFANYALQPLFPSCFPPERALGLLAAVCLLLLTWINCSSVRWATRVQDVFTTGKLLALGLIIIMGIVQICKGHFYWLEPEHAFHPLQPYDMGRIALAVLQGSFAYAGWNFLNYVTEELIDPYRNLPRAIFISIPLVTFVYVSANIAYVTAMSPQELLASNAVAVTFGEKLLGVMSWLMPISVALSTFGGVNGSLFTSSRLFFAGAREGHLPRLLAMIHVNRCTPIPALLITCISTLLMLCVSDIYTLINYVGFINYLFYGVTVAGQIVLRIREPDIYRPIKVSLAWPAVFLIFWAFLLIFSLYSEPVVCCIGLAIMLSGVPVYLFGIYWENKPKSFSSFVGMKKS

SEQ ID NO: 36332 - DNA, 1923 bp, Danio rerio
  CDS (1)..(1923)
atggcctctttcggacacatcctgctgcggcggcgggcgctagatttttcaggagaggagacgcggtttgctcggtgtttgtccacactggacctggtggctctcggcgtgggatcaacactgggtgctggagtttacgttctggctggagaagttgcaagagagaaggctggtcctgctatagtgttgtgcttcctcgtggccgctctttcctccatgctggctggattgtgctatgcagaattcggcgctcgagtcccgaagactggatctgcatacttgtatagctacgtaacagttggcgaaatctgggccttcatcactggttggaacctcatcctctcatatgttataggtacagctagcgtggctcgagcttggagctctacgtttgataacttgattgagcagaagatctccaacttcttcagggcatcgatggccatgaaagttcctgggaaagtccttgctgaatatccagacttgtttgccctcattctcatcttgctactgactggattgctcgctttcggtgtgagcgagtctgctctggtcaacaagatcttcaccgggatcaatctgatcgtgctgggcttcatcatcatctccggcttcgtcaaaggcaacacggcaaactggaacctgacctacgagtacttcatcaacgatacaaacatcaccgaaccagaacggatagaaagcacatttggaagtggaggctttgctccgttcggccttggcggcatcttatcaggcgcagccacctgtttctacgccttcgtgggctttgattgcattgctacgacaagtgaggaagccaaaaacccaatgcgctccatccctgtgggcatcgtggcctcgttgctcatttgcttctttgcttactttggtgtctcagctgctcttacgctcatgatgccctattacaagctcaacactcagagtcctctgcctgaggccttcagttacgtaggctgggcaccggcacgatatattgtagccgtgggttcactctgtgctctttccacaagtttgctgggctccatgttccctatgcctcgagtgatttacgccatggctgaggacgggctactctttcgttcactttccaggatgaacaagagaaccaaaactcctctgctggcgactattgcgtctggaatagtggcagctctcatggcgtttctatttgatctggctgcgttggttgacctcatgtccattgggacgttgcttgcgtactctcttgtggccgtttgcgttctcatcctcagatatcagccagggaacctgagctcctccagtcagactgagaagctggtggagctggttggtggggagaaggtggccgtttgtggagacagtggagatgaatatggcgtagagctggatgacagtcctcgcaaggagaaattcactgccaaactcctcctggttccctctaaagactcgccaacggaaatgtcaggaactatcgtctatggcacaactgcaattatctctgtgctgatcacggtgctgtgcgtggttttggctcagcgtctggagtccatcataaatctggagatcgtgtgggtgacggcgtgtgtcattctggtcctgctgtgtgtcctgtgtgtgattgtgatcttcaggcagccggagagtaaagaagctctcaccttcaaggtgcctctgttgccttggcttcctctgttcagcatcttcgtcaacatttatctgatgatgcagctggacgtggccacctggtgccgcttcaccgtgtggatggccatcggttttgccatctacttcggctacggcatttggcacagcactgaagccatgaatagctcggtccgaaaatacgagccggcccttcagaacaaaagccccatctatttaggcggtgaggagagtgaaattgagggcatttctccttga

SEQ ID NO: 36333 - protein, 640 aa, Danio rerio
MASFGHILLRRRALDFSGEETRFARCLSTLDLVALGVGSTLGAGVYVLAGEVAREKAGPAIVLCFLVAALSSMLAGLCYAEFGARVPKTGSAYLYSYVTVGEIWAFITGWNLILSYVIGTASVARAWSSTFDNLIEQKISNFFRASMAMKVPGKVLAEYPDLFALILILLLTGLLAFGVSESALVNKIFTGINLIVLGFIIISGFVKGNTANWNLTYEYFINDTNITEPERIESTFGSGGFAPFGLGGILSGAATCFYAFVGFDCIATTSEEAKNPMRSIPVGIVASLLICFFAYFGVSAALTLMMPYYKLNTQSPLPEAFSYVGWAPARYIVAVGSLCALSTSLLGSMFPMPRVIYAMAEDGLLFRSLSRMNKRTKTPLLATIASGIVAALMAFLFDLAALVDLMSIGTLLAYSLVAVCVLILRYQPGNLSSSSQTEKLVELVGGEKVAVCGDSGDEYGVELDDSPRKEKFTAKLLLVPSKDSPTEMSGTIVYGTTAIISVLITVLCVVLAQRLESIINLEIVWVTACVILVLLCVLCVIVIFRQPESKEALTFKVPLLPWLPLFSIFVNIYLMMQLDVATWCRFTVWMAIGFAIYFGYGIWHSTEAMNSSVRKYEPALQNKSPIYLGGEESEIEGISP

SEQ ID NO: 36334 - DNA, 2211 bp, Archaeoglobus fulgidus DSM 4304
  CDS (1)..(2211)
atgcaggttcaggtttcgctcagcagggacctctccttcttcgacataacaatgattggaatcgccggcatgattggtgctggcgttttcgctcttactggtatcgcagcgggtattgcagggcccgctatcattcttgcattctttctcaacggaataatcgcaactctcacgggcttggcctatgcggaacttggttcagcgatgcctcaggctggaggagggtatctgtggattaaggaggcgatgggggattatgctggcttcatggcgggctggattgactgggccgctcacaccatcgcctgtgccctttacgcggtgaccttcggagccttttttgcggagatgcttgttggctttgttggtttacctctacctcacgttttgaccgcgaagatttcgtcgctggcgatggtcagctttcttgcctatgttaactacaggggggctaaggagagcggatttctcggcagcctagtgacggttttgaaggttctcattcttctcgtatttgcagggtttggaatcatcaaaatgctgagctatcctgactggcaaagctctttcacacccttcttccccacaggcttcgcaggggtgcttgcggcaatggggctgaccttcattgccttcgagggctttgagataatcgtccagagcggtgaggaggttaaggaccccgagaagaacattcccaaagcaatagtcgtttcgctgtgggttgcagttgccatttacattctcattgccttctctcttctgggggctgttagggctgatgtgccgagctggatgtatctcggccagctggcggagctgagccttgtcaaggttgcggacagcatcatgccccttggcgggtggatgattctggcaggagggctgatttcaaccataagcgcaatgaacgccacaatttactcctcctcgagggtaatctttgctttaagccgctccggctacctacaccgctctctttcagcgataaacgagagaaccaaaaccccacactacgccatctttttcagctatattataatcgccgcagcttctctcgctccaattgaggcggtagcatctgcggcaagcctgatgttcataatcctctttctcgctgttaacgtcacgctcatcattctccgcctgaggaggccggacattcagagcgccttccgccttccgctcgtgccggtacttccagccattgccgcggctctgctcgcagtcgtctcatacttcctcataacgcaggttgaacacggagagggtgttttcctgatcacaattgcgtggatgttcctcggctccttcttctactttgcctactccgaaaaggagctggagaagagggaggaagaggaagtaatgacggtcttcaccgaaaaacctgtggagaaaatggagtacacgattctcgttcccgttgcaaatccggtaattgctaaaaagctcgttaggtttgctgagttaatagcgaggaagaagaagggggcggttgtcattctcaacaccgtgaggcttcctcagcaaactccaatatctgctccagctaaagatgtgaagaaggccaaggagcttgttgaaggacttatgaacctcagcgttccctcgggcggggtggtaaaggtgagccacagcgtttcggaagcgattctcagcaccgctgaagagtggaaggctaacatgatcgtcatgggatggagaggcagaaccttcaggagggacgtcgttcttggcagcaccatcgaccctgtgcttttgaaggcgaaatgcgatgttgtggtgatacgatttgaaccgggagagaagattcccgaattcagggacgttttgatttccacaattggcggaccgcacgccaagcttggttacgagattgcaagggctttggttgaggacaagagcggaaggattaagctgctttacgtcggaagctcggaaaaggagagggaaaaggcggagaaagtgtttgaagaggctatggagattttgaatgggcttaacgtggaaagggaatttgccatcagctcctccccctctgacgtcgtggcgagagaggcggagagctttgatttggtaatagtaggcgcatcggagagaaccttcctgaagaactttctcacaggactgtttccggagaaagtggttatgaaaacgtcgaagaccgttgctatgacaaggaagtgggtcgggctgctgaatcgctaa

SEQ ID NO: 36335 - protein, 736 aa, Archaeoglobus fulgidus DSM 4304
MQVQVSLSRDLSFFDITMIGIAGMIGAGVFALTGIAAGIAGPAIILAFFLNGIIATLTGLAYAELGSAMPQAGGGYLWIKEAMGDYAGFMAGWIDWAAHTIACALYAVTFGAFFAEMLVGFVGLPLPHVLTAKISSLAMVSFLAYVNYRGAKESGFLGSLVTVLKVLILLVFAGFGIIKMLSYPDWQSSFTPFFPTGFAGVLAAMGLTFIAFEGFEIIVQSGEEVKDPEKNIPKAIVVSLWVAVAIYILIAFSLLGAVRADVPSWMYLGQLAELSLVKVADSIMPLGGWMILAGGLISTISAMNATIYSSSRVIFALSRSGYLHRSLSAINERTKTPHYAIFFSYIIIAAASLAPIEAVASAASLMFIILFLAVNVTLIILRLRRPDIQSAFRLPLVPVLPAIAAALLAVVSYFLITQVEHGEGVFLITIAWMFLGSFFYFAYSEKELEKREEEEVMTVFTEKPVEKMEYTILVPVANPVIAKKLVRFAELIARKKKGAVVILNTVRLPQQTPISAPAKDVKKAKELVEGLMNLSVPSGGVVKVSHSVSEAILSTAEEWKANMIVMGWRGRTFRRDVVLGSTIDPVLLKAKCDVVVIRFEPGEKIPEFRDVLISTIGGPHAKLGYEIARALVEDKSGRIKLLYVGSSEKEREKAEKVFEEAMEILNGLNVEREFAISSSPSDVVAREAESFDLVIVGASERTFLKNFLTGLFPEKVVMKTSKTVAMTRKWVGLLNR

SEQ ID NO: 36336 - DNA, 1596 bp, Archaeoglobus fulgidus DSM 4304
  CDS (1)..(1596)
gtgcgggagaaaatcggcttctgggaagctgtcagcatcggcattggcggcatgattgggggaggaatttttgccgttctcggcctgagcgttcagcttgcgaagggctctgcccctatagcctttctcattgccggaattgttgcgctttttaccgcctactcctacgcaaagctcagcctgaggtttccgagcgagggcgggacgatagagttcctgatcaaggcttacggaacgggtttgcttgctggtgggttaaacatccttctcctcgttagctatgttgtcatgatagctctctactcctacgcctttggcagttacgccgccaacgccctcggaacccctattttgaagagcttccttatcgcattcgttgtaatcttttttacagttttaaactccctcggagcagttgtgagcggaagagcagaggatctgctcgttgcgttcaagcttgcggtgcttgttatcgttgccgcagcggggcttgccttcgtgaatcctgagaggctcatgccgtccaactgggctgatgcagtgagcataattgcaggcgggatgattatcttcctcgcctacgagggatttgagctgattgccaatgcgggcggagatgttgagcatccgaaggttcttgagaaggccttctacgtttcagttgttgtcgttatagcggtttacgttctaattgccataataactgtcggaacgctgccctacgagaagattatggaggccagagattacgctcttgccattgctgccgagccagcactcggacagcttggcttctggttcgtcacctttgcagccctcgcatcaacaagctcggcaatcaacgccactctgtacggaaccgcaagagcaagctacatggttgccaagtttggagagcttcccgagtttgttggaaagaagctgtggaggcaggcttacgaggggctggttgtgattcccattctctccataattctttccatcaccaccaaccttgaaacgatagccacagcaggcagcgggggattcctgcttatatttgctgctgtaaacctcgctgcggtaaagctcaggaggaaggttaaggtcaatccgctaatctcctcagctggggcgattatggccctcgcagccttcacaattcttgcattgagaatggcggaggaaaatctctacgctttggctgtgatgctttcccttatagcagcttccttcctctttgagtggacttacaggtggtatacaggaagggagattggaagatacgttgacaggaagctgatagagagggagaaaaacctcagaaactgggaggagtggattcctgcggttgtggatgagctaaggagaagatatagcgacagcgaggtttaccttgtcggcagccttgcaagaggtgaggctgagaaggcgggtgatgttgacctgctggttctgacggatgcggttgaaaatggagaaaaggaagggataacgagggacatcaagaaaaagcttgaattgggcccccagcactgccttgaccttcacttcgagaagaagagtttaagggatgaggcgttgaaaagggccgtgagttacaggaggttaaagtga

SEQ ID NO: 36337 - protein, 531 aa, Archaeoglobus fulgidus DSM 4304
MREKIGFWEAVSIGIGGMIGGGIFAVLGLSVQLAKGSAPIAFLIAGIVALFTAYSYAKLSLRFPSEGGTIEFLIKAYGTGLLAGGLNILLLVSYVVMIALYSYAFGSYAANALGTPILKSFLIAFVVIFFTVLNSLGAVVSGRAEDLLVAFKLAVLVIVAAAGLAFVNPERLMPSNWADAVSIIAGGMIIFLAYEGFELIANAGGDVEHPKVLEKAFYVSVVVVIAVYVLIAIITVGTLPYEKIMEARDYALAIAAEPALGQLGFWFVTFAALASTSSAINATLYGTARASYMVAKFGELPEFVGKKLWRQAYEGLVVIPILSIILSITTNLETIATAGSGGFLLIFAAVNLAAVKLRRKVKVNPLISSAGAIMALAAFTILALRMAEENLYALAVMLSLIAASFLFEWTYRWYTGREIGRYVDRKLIEREKNLRNWEEWIPAVVDELRRRYSDSEVYLVGSLARGEAEKAGDVDLLVLTDAVENGEKEGITRDIKKKLELGPQHCLDLHFEKKSLRDEALKRAVSYRRLK

SEQ ID NO: 36338 - DNA, 1692 bp, Thermoplasma volcanium GSS1
  CDS (1)..(1692)
atgggagatttaaatagtgcctcgactgatgctaacatatcctatagcgaaaatcaggacaggaagcttaggaaagctctgtcaacatgggacctccttatgctgagtgtaggaggcataatcggatcgggatggctgtttgcagcctatgcagcttcagttctgtcaggccctgcctccatactcgcatgggtgcttggcggaattatcgtcatctttatcgctttggtatacgcggaactaggtgcgatgattccaaggagcggtgcaatagtaaggtacggccacctctcacatgggagctttgcaggctttctattcggttgggcatatttcctcagcgccgtatcggtgccagcgatagaagctgaagctgtcgttacctatgctgctagttatgttacaaagccggctctaatcgccaatggcattatgacagtattcggaactcttatagcgatgctattgatgatagccttctttttcctgaactatgcaggaatacacttaatgggaaagacaaatcagggtataacctggataaaggttataatacctgtgataacagttatagtacttatagcagtacatttcaatccatcagagatagtaccgcctaatggcttcctgccatatggctgggctcctgtatttgcggctatatccagtacaggcatagtcttctcgtattttggtttcaggcaggctatagactatggcggggaggcaaagaatccgcagaggtctataccaatagcgactattggctcggtgctcattggaatactgctatatagtttgcttcaggtagtgttcgtgggtggaatagactggagcaaaatgggccttgaacctggacagtggactcttctcaacgcctatgcaaccgcagcacacgcgtctactgaacacccccttgcttaccagcttatgaatgcaccatttgctacaatagctctctccgctgggcttgtatggttgacatacacattgtatgcaagtgcttacatagctccttcgggaacccttaacgtatacctaggcacatctacgaggactctctatggaatggcagttaacggccatcttccaaagatattcgcaaaagttgctgataggaacaaaatacctgtcattccacttattactacactgctcgtaggtttcctgttcttccttccgtttccaagctggtacaaaatggtcggtttcatcagtggagcgacggttttcacctacatagttggcggtgccgcacttatgaacctaaggaagcaggccccagaactcaagaggccgttcaagctgtggtccgcaaacgttttggctccgatcgcattcatacttgcgtcagaggcagtttactggacaggctggcctactacgttgtacttagcaatagctatattcctaggcctagttctttatggagctcttgttgggctgcacaagattgaacaaaccttcgataagaagaacgtcaaggctggcctttgggtgcctgtctttatagttatactgactattctatcgtatctgggagaatatggcggcataaatgttctgcacttcccattggatctaatagttgttgctatagccagcgcaataatatacgtttgggcaataaaatctggaataaagacggaagagatagcagctatgatagcgaatgaggaccagtacgtttaa

SEQ ID NO: 36339 - protein, 563 aa, Thermoplasma volcanium GSS1
MGDLNSASTDANISYSENQDRKLRKALSTWDLLMLSVGGIIGSGWLFAAYAASVLSGPASILAWVLGGIIVIFIALVYAELGAMIPRSGAIVRYGHLSHGSFAGFLFGWAYFLSAVSVPAIEAEAVVTYAASYVTKPALIANGIMTVFGTLIAMLLMIAFFFLNYAGIHLMGKTNQGITWIKVIIPVITVIVLIAVHFNPSEIVPPNGFLPYGWAPVFAAISSTGIVFSYFGFRQAIDYGGEAKNPQRSIPIATIGSVLIGILLYSLLQVVFVGGIDWSKMGLEPGQWTLLNAYATAAHASTEHPLAYQLMNAPFATIALSAGLVWLTYTLYASAYIAPSGTLNVYLGTSTRTLYGMAVNGHLPKIFAKVADRNKIPVIPLITTLLVGFLFFLPFPSWYKMVGFISGATVFTYIVGGAALMNLRKQAPELKRPFKLWSANVLAPIAFILASEAVYWTGWPTTLYLAIAIFLGLVLYGALVGLHKIEQTFDKKNVKAGLWVPVFIVILTILSYLGEYGGINVLHFPLDLIVVAIASAIIYVWAIKSGIKTEEIAAMIANEDQYV

SEQ ID NO: 36340 - DNA, 1617 bp, Aeropyrum pernix K1
  CDS (1)..(1617)
gtgccaggtttgtcggcgagaaaaggtaccgagaaacttggtttctgggaggtcttcagtattggagtcggcggtatgattggagggggcatattcgcaaccctgggtctaagccttgaacttgctggagctgccgcacctctggctttcttactcgcaggttctgtagctctaataacctcttactcgtatgctaagctaagctctaggtatccaagcgagggaggcactatagaattcatagttagagcctacggtgacaacgttatcagcggaggattaaacatcatgctgctcgcatcctacattgtcatgatttcgctttatgcccacgctttcggcagctacggcgccagcatgattaactgctgtccgagggaggcttacattgccctcgtagtattcgttatagcagggcttacagtagttaacatgctgggtgctatcatgagcgggagagtcgagttaggactggtcatattcaaacttctcgttctcatactcgtagccgtcgtaagcatgccgctcgtagactggaacaggttgggagtgagagagtggccatcgatcctaagtatagttgcgggtggcatgataatatttcttgcatatgaaggttttgaactagtggcaaacactgcaaaggacgttagggacactacgacgttgagaaaagggctctacgcgagtgttgtcacagtcatcattgtatacgttttgatagctatagtagctgcaggcacgttagacccagatactgttcgaatcgccagagactatgccctagcagtactagtagaacccgtgttaggtaagataggcttcacactggttgtggctgccgccttggcttcgacaagcagcgcgattaacgcaaccttatacggctccgcacgcgtaagctatatcatagctaagtacggtgaggcaccccagctcctaggaaggcatatctggcgaggcgcctacgagggcctccttgttataagcatattgggccttctactagccctatatgcaagtctagagcagattagcacagcaggtagcggagggttcttaattatattcgcagcagtcaacctggcagcgtacaagctccgcagggagacgggtgcaaaccccctaatatcccttgttggttttatcctcaaccttacttctctagctatactagtttatcagatggcctctatgaacccgggtgaactagctatattagccgttctcatagctggtagcatggcagctgaagccctctataggagaattaaaggcaggaggctaccacaagtaatagacccctctctaaaggtcagggagtcactgattagtgggtggagaaacctgacggctagagcagcagaaattataaaaagagagataatgaatgcagaagtctacataacagggagtatagcgagaggagagtacgagaagtcgggtgatattgatctaattgtttccaccacaaagccactctcaccccatgaggtcaagtttatagaggagaggctagtgaaagaactgaacctaccaccttcccaccccttacatattcacacggtcactcgtgataagctagaaaactttaaacacaaggttaaaatagattag

SEQ ID NO: 36341 - protein, 538 aa, Aeropyrum pernix K1
MPGLSARKGTEKLGFWEVFSIGVGGMIGGGIFATLGLSLELAGAAAPLAFLLAGSVALITSYSYAKLSSRYPSEGGTIEFIVRAYGDNVISGGLNIMLLASYIVMISLYAHAFGSYGASMINCCPREAYIALVVFVIAGLTVVNMLGAIMSGRVELGLVIFKLLVLILVAVVSMPLVDWNRLGVREWPSILSIVAGGMIIFLAYEGFELVANTAKDVRDTTTLRKGLYASVVTVIIVYVLIAIVAAGTLDPDTVRIARDYALAVLVEPVLGKIGFTLVVAAALASTSSAINATLYGSARVSYIIAKYGEAPQLLGRHIWRGAYEGLLVISILGLLLALYASLEQISTAGSGGFLIIFAAVNLAAYKLRRETGANPLISLVGFILNLTSLAILVYQMASMNPGELAILAVLIAGSMAAEALYRRIKGRRLPQVIDPSLKVRESLISGWRNLTARAAEIIKREIMNAEVYITGSIARGEYEKSGDIDLIVSTTKPLSPHEVKFIEERLVKELNLPPSHPLHIHTVTRDKLENFKHKVKID

SEQ ID NO: 36342 - DNA, 1773 bp, Arabidopsis thaliana
  CDS (1)..(1773)
atgatccctgcttcaatggaggaagctcaccagctggagtcgagatccgatgacctaagtcaacggagaagctactggagatggaggaagcaggattttttcccggaattctcttttcagagcttctctacctacaaatcagctctctccgccacttgtccacgcctcgccgatcgtcttctctctcgctcttccgatgcgtacgagctcgatgcagcccgccgcgaaagcgagaaccctatgcgtcgttgtctcacttggtgggacttgctctggcttagctttggttctgttgttggttcgggtgtgttcgtgatcacgggtcaggaggctcgagttggagctggtcctgctgttgttctctcctacgctatctctggtgtctctgcattgctctcagttctctgttatgctgagtttggagttgagattcctgtcgctggaggttctttctcttatcttagggttgaattgggggattttattgcctttattgctgctgggaatattcttcttgaggctatggttggtgctgctggattagggaggtcatggtcttcgtatctagctagtttggtcaagaatgattctgattattttcggattaaagtcgattcctttgctaaagggtttgatcttttggatccggttgctgttgcagtgcttttagttgctaatggtattgccatgactggaacaaagaggacttcttggttgaatttgattacttccatggtcactgtttgtattattgtgtttatcgtcgttgtggggtttactcattcaaaaacctcaaatttggttccttttttcccttatggagcgaaaggtgtggtgcaatctgctgcagttgtctactggtcatacactggttttgatatggtggctaacatggctgaagaaaccgagaaaccttccagagatattccaattggtttggttggttcgatgtctatgatcactgtggtttactgtttgatggctctggccttgactatgatggtgaaatacactgaaattgatgcgaatgcagcttattctgttgcttttgctcagattgggatgaaatgggcgaagtacttggttggtatatgcgctttaaagggaatgaccacaagcctgcttgttggctctctaggccaagctcggtacaccactcagattgctcggtctcatatgattcctccatggtttgctttggttcatccaaaaacaggaacccctatttatgctactctccttgtaaccatactcagttcaataatatccttcttcaccagcttagaggttttatcaagcgttttctcctttgctaccctcttcattttcatgctcgtggcagtagcattgcttgtgagacgttactacgtgaaggatgtcactcctgaggccggtttgttgaagtttcttggttttctgtttttgataattgcttcctccattggagtatcagcgctttggaactcaggcgttaaaggttggatcgcttacacagtgactggagttatttggtttataggcactttagggttggcattgcttccgaaatatcgtgttcctaaggtatggggagtcccactagttccgtggttgccatcgttttcaatcgccatgaatctattccttatcggatcactcggttatgtagcattcttgagattcattatctgcaccatggtgatgcttttgtactacctattcgttggtcttcatgcaacctatgatgtagctcatcagcctttggaggaagcaaagtttgagggagagagataa

SEQ ID NO: 36343 - protein, 590 aa, Arabidopsis thaliana
MIPASMEEAHQLESRSDDLSQRRSYWRWRKQDFFPEFSFQSFSTYKSALSATCPRLADRLLSRSSDAYELDAARRESENPMRRCLTWWDLLWLSFGSVVGSGVFVITGQEARVGAGPAVVLSYAISGVSALLSVLCYAEFGVEIPVAGGSFSYLRVELGDFIAFIAAGNILLEAMVGAAGLGRSWSSYLASLVKNDSDYFRIKVDSFAKGFDLLDPVAVAVLLVANGIAMTGTKRTSWLNLITSMVTVCIIVFIVVVGFTHSKTSNLVPFFPYGAKGVVQSAAVVYWSYTGFDMVANMAEETEKPSRDIPIGLVGSMSMITVVYCLMALALTMMVKYTEIDANAAYSVAFAQIGMKWAKYLVGICALKGMTTSLLVGSLGQARYTTQIARSHMIPPWFALVHPKTGTPIYATLLVTILSSIISFFTSLEVLSSVFSFATLFIFMLVAVALLVRRYYVKDVTPEAGLLKFLGFLFLIIASSIGVSALWNSGVKGWIAYTVTGVIWFIGTLGLALLPKYRVPKVWGVPLVPWLPSFSIAMNLFLIGSLGYVAFLRFIICTMVMLLYYLFVGLHATYDVAHQPLEEAKFEGER

SEQ ID NO: 36344 - DNA, 1710 bp, Arabidopsis thaliana
  CDS (1)..(1710)
atggaaggtgaagagagaggatactggagatggagcaagagagatttctttcctgaggaatctttccagagctttggtagttacagagctgctctgtctcagacatgttccaggttcaagaacaggttggttagtaggtctgatgatgagaacgagcggtttgagctcaagaaacagagtgagcacgagatgaaacggtgtttgacatggtgggatttagtatggtttggattcgggtcggtgattggagctggaatctttgtcttgacaggtcaagaagctcatgagcaagcaggaccagctattgtcttgtcttatgttgtttcaggtctttctgctatgctctctgtcttctgctacacggaattcgctgtggaaatccctgtggctggtggttctttcgcctatctacggattgagcttggggattttgcggcgttcatcactgcagggaatatacttcttgagagtattgttggaactgcagctgttgctagagcctggacttcatattttgcaactcttctgaatcgtagcccgaacgctctacggatcaaaacagatctcagttccggttttaatctcttggacccaatagctgttgttgttatagccgcttcagctacaattgcatcgatcagcacaagaaagacttcattgctcaactggatagcttctgctatcaacactttagtgatattttttgttataatcgctggttttatccacgccgacacatcaaatttgactccattcttgccttttggacctgagggagtgttccgagcagctgcagttgtgtactttgcatatggaggatttgatagcatagcaacaatggctgaagaaaccaagaatccatcaagagacataccaatcgggttactcggttcaatgtcgataataacagtgatatactgcttgatggcattatccttgagtatgatgcagaagtatacagatatagatccaaatgcagcttactcagtagcgtttcagagcgttggaatgaaatggggaaagtacttggtggcacttggtgctctcaaagggatgaccacagttcttttagtaggagcattgggacaagcgagatacgttactcacatcgcacggacccacatgattccgcctatatttgcccttgtccatcccaaaacaggaacaccgataaacgctaacctcctagtagcaattccaagtgctctcattgctttcttttctggtttagatgttttggcaagcctcttatcgataagtactctcttcatcttcacaatgatgcctatcgcactactcgtgaggagatactacgtgagacaagatactccaagagttcatctcattaagctcatcacttgtctcttattcgtcgttgtttcttcaatgggtacttcggcgtattggggaatgcagcgcaagggatcatggatcggttacacagtaacagttcctttctggttcttgggaactttggggatcgtattctttgttcctcagcaacgaacaccgaaagtgtggggcgtaccgttagtgccatggctcccgtgcttatcaatagcaacaaacatctttctcatgggatctttgggagcaatggcttttgtaaggtttggtgtttgcactttagccatgttactatactatttcctgcttggtcttcatgcaacattcgatatggctcatcagcaaattgtgccaagaacataa

SEQ ID NO: 36345 - protein, 569 aa, Arabidopsis thaliana
MEGEERGYWRWSKRDFFPEESFQSFGSYRAALSQTCSRFKNRLVSRSDDENERFELKKQSEHEMKRCLTWWDLVWFGFGSVIGAGIFVLTGQEAHEQAGPAIVLSYVVSGLSAMLSVFCYTEFAVEIPVAGGSFAYLRIELGDFAAFITAGNILLESIVGTAAVARAWTSYFATLLNRSPNALRIKTDLSSGFNLLDPIAVVVIAASATIASISTRKTSLLNWIASAINTLVIFFVIIAGFIHADTSNLTPFLPFGPEGVFRAAAVVYFAYGGFDSIATMAEETKNPSRDIPIGLLGSMSIITVIYCLMALSLSMMQKYTDIDPNAAYSVAFQSVGMKWGKYLVALGALKGMTTVLLVGALGQARYVTHIARTHMIPPIFALVHPKTGTPINANLLVAIPSALIAFFSGLDVLASLLSISTLFIFTMMPIALLVRRYYVRQDTPRVHLIKLITCLLFVVVSSMGTSAYWGMQRKGSWIGYTVTVPFWFLGTLGIVFFVPQQRTPKVWGVPLVPWLPCLSIATNIFLMGSLGAMAFVRFGVCTLAMLLYYFLLGLHATFDMAHQQIVPRT

SEQ ID NO: 36346 - DNA, 1803 bp, Arabidopsis thaliana
  CDS (1)..(1803)
atgaacagtcttgtgagaagaaaacaagttgattctgttcatcttatcaaaaacgatggacctcatcagcttgccaagaaactatccgccgttgatcttgttgctattggagttgggacaacaattggagcaggagtgtatattcttgtgggaacggtagctagagagcacacaggacctgctcttgctgtatcattcttcattgctggagtagctgctgctctctctgcctgttgttatgctgagcttgcttctcgttgtccatctgctgggagtgcttatcattatgcgtacatttgtcttggagaagggattgcttggttggttggttgggcactggtgttggattatacaattggtggatcagccattgcccgtggcataactccaaatctggcatctttttttggtggtttggacaatcttcctgtgttcttagctcgacaaactatacccggggttggtattgtggttgatccatgtgctgcacttttgattatgattgtcacgatactactatgttttgggataaaggagagttcaacagtacaagcaattgtaacatcagtgaatgtttgcaccttggttttcatcatagtagttggtggatatttagcttgcaagactggatgggttggatatgatctccccagtgggtactttccttttggactaaatgggatacttgccggatctgctgtagtattcttctcatacattggatttgatactgtaactagtacggctgaggaggtgaaaaatcctcaaagggatcttccattgggaatcgggattgcattactgatatgctgcattttgtatatgcttttatcagtagttattgttggattggtcccatactattcattgaatcctgatactcctatctcctctgcatttggagacagtgggatgcaatgggcagcgtacatcttaaccactggggcaataactgctctatgtgcgagtttgttgggttcccttctggctcagccacgaatattcatggcaatggctagggatggattgttgccagctttcttttcagaaattagcccacgaactcaagtaccagtgaaaagcacaatagctattggtgttcttgccgctgcactcgcatttttcatggatgttgcacagttgtccgagatggttagtgtaggcactctaatggcattcactgccgttgcagtctgtgtgctagttcttagatatgtaccaccagatggagttcccctatcatcttcctcccaaactttgagtgataccgatgaaagtagagctgaaactgaaaattttcttgtggatgctatagaatcttctgattcccctctacttggaaatgaaactgctcgagatgaaaagtattttggaaagaggagaaaaattgctgcctggagtatagctcttgtgtgcataggtgtcctaggtcttgcttcagcagcttcagctgagcgtcttccaagttttcctcgtttcactatatgtggtgtcagtgcagtcatcttgcttggcagtttgattactcttggctacattgacgaggatgaagaaaggcacaactttggacacaaaggagggtttctctgcccattcgtcccataccttccagttctttgcattttgatcaacacctacttgatcatcaacattggagctgggacatggatcagggtcttgatatggctacttattggaagcatgatctatatcttctatggccgatctcacagcttactgaacaatgcggtttacgttcccacaatgacttgtacgagaaaaacaacagatcatcttgcttaa

SEQ ID NO: 36347 - protein, 600 aa, Arabidopsis thaliana
MNSLVRRKQVDSVHLIKNDGPHQLAKKLSAVDLVAIGVGTTIGAGVYILVGTVAREHTGPALAVSFFIAGVAAALSACCYAELASRCPSAGSAYHYAYICLGEGIAWLVGWALVLDYTIGGSAIARGITPNLASFFGGLDNLPVFLARQTIPGVGIVVDPCAALLIMIVTILLCFGIKESSTVQAIVTSVNVCTLVFIIVVGGYLACKTGWVGYDLPSGYFPFGLNGILAGSAVVFFSYIGFDTVTSTAEEVKNPQRDLPLGIGIALLICCILYMLLSVVIVGLVPYYSLNPDTPISSAFGDSGMQWAAYILTTGAITALCASLLGSLLAQPRIFMAMARDGLLPAFFSEISPRTQVPVKSTIAIGVLAAALAFFMDVAQLSEMVSVGTLMAFTAVAVCVLVLRYVPPDGVPLSSSSQTLSDTDESRAETENFLVDAIESSDSPLLGNETARDEKYFGKRRKIAAWSIALVCIGVLGLASAASAERLPSFPRFTICGVSAVILLGSLITLGYIDEDEERHNFGHKGGFLCPFVPYLPVLCILINTYLIINIGAGTWIRVLIWLLIGSMIYIFYGRSHSLLNNAVYVPTMTCTRKTTDHLA

SEQ ID NO: 36348 - DNA, 1755 bp, Arabidopsis thaliana
  CDS (1)..(1755)
atggaggcccaataccggaaccacgacggagacacctctttctctagcctccgtgtctacctcaactctctctccgacactccctcccgtttttcccgccgagccgtttccgtttccacctcttacgacgagatgagccgcgtccgcgccgtctccggcgagcagatgcgtcgtactctccgttggtacgatctcatcggactcggaatcggtggaatgatcggagccggagtcttcgtcaccaccggccgtgctagtcgtctctacgctggtccatcaatcgtcgtctcttacgcaatcgccggactctgtgctctactctccgccttctgttacaccgagttcgccgttcacctccccgtcgccggcggtgctttcagctacatccgtatcacattcggcgagtttccggcgtttataaccggagcaaatctgataatggactacgtactgtcaaacgccgccgtttcaagaggattcaccgcttatctcggatctgcattcggaatctcaacatcggagtggagattcatcgtctccggtctcccaaacggattcaacgaaatcgatcccatcgccgttatcgtcgtcctcgccgtcacgttcgtcatctgttacagtacgagagagagttcgaaggtgaatatggtattaacggcgttacacattgcatttatagtattcgtgatcgtcatgggtttctcgaaaggagacgtaaagaatttaacccgacccgataacccggaaaacccatccggattcttcccgtttggagtttcgggtgtgtttaacggagcagcaatggtttatctaagttacataggatacgacgccgtttcgacaatggctgaagaagtaaaagacccagtcaaagacataccaatgggaatctctggctcagtcgcaatcgtcattgtactttactgtttaatggctatctctatgtcaatgcttctcccgtacgatctgatagatgcggaggcaccgtattcggcggcgtttagtaaatcggaaggatgggaatgggtgacgagagtggttgggattggagcaagtttcgggatattaacgtcgttgatagtagccatgttgggtcaggctcggtacatgtgcgtcatcggacggtcaagagttgtccccatttggtttgctaaggttcatcccaagacatctactccagtcaacgcttccgcttttcttggaatcttcacggcggttctcgccctcttcaccgacctaaacgtcctcctaaacctagtctccatcggaacgctcttcgtcttctatatggtcgcaaacgctgttatatttcgccgttacgtaacggtcggatacacggagccatggccaacactctccttcctctgcctattctccataacctcaattttgtttaccttggtctggcaacttgcaccgtcgggcccacctaaatggttcatacttggagctagcacggtcacggctatagccatcgtccagatattccattgtgttgtacctcaagctaggatccctgagttttggggtgtaccgttgatgccgtggactccatgcgtttcgatatttttgaacattttcttgcttggatcattggatgctccttcgtatatcagattcgggttcttctcgggattagtggtgctcgtgtatgtgttttatagtgttcatgcaagctatgatgctgaaggagacgggtctcttgatttcaaagacgtggaaagccttgaaagaattaacagagtgttgagttaa

SEQ ID NO: 36349 - protein, 584 aa, Arabidopsis thaliana
MEAQYRNHDGDTSFSSLRVYLNSLSDTPSRFSRRAVSVSTSYDEMSRVRAVSGEQMRRTLRWYDLIGLGIGGMIGAGVFVTTGRASRLYAGPSIVVSYAIAGLCALLSAFCYTEFAVHLPVAGGAFSYIRITFGEFPAFITGANLIMDYVLSNAAVSRGFTAYLGSAFGISTSEWRFIVSGLPNGFNEIDPIAVIVVLAVTFVICYSTRESSKVNMVLTALHIAFIVFVIVMGFSKGDVKNLTRPDNPENPSGFFPFGVSGVFNGAAMVYLSYIGYDAVSTMAEEVKDPVKDIPMGISGSVAIVIVLYCLMAISMSMLLPYDLIDAEAPYSAAFSKSEGWEWVTRVVGIGASFGILTSLIVAMLGQARYMCVIGRSRVVPIWFAKVHPKTSTPVNASAFLGIFTAVLALFTDLNVLLNLVSIGTLFVFYMVANAVIFRRYVTVGYTEPWPTLSFLCLFSITSILFTLVWQLAPSGPPKWFILGASTVTAIAIVQIFHCVVPQARIPEFWGVPLMPWTPCVSIFLNIFLLGSLDAPSYIRFGFFSGLVVLVYVFYSVHASYDAEGDGSLDFKDVESLERINRVLS

SEQ ID NO: 36350 - DNA, 1752 bp, Arabidopsis thaliana
  CDS (1)..(1752)
atggaggtccaaagcagcagcaacaatggtggtcactcttctttctccagtctccgcgtctacctcaactctctttccgcgacgccttctcgcttatcccgccgcgctatttccgtctccacctcttccgacgagatgagtcgcgtccgcgccgtctccggcgaacagatgcgccgtactctccggtggtacgatctcattggactcggaatcgggggaatggtcggcgccggtgtctttgtcaccaccggccgtgctagtcgtctcgacgccggtccttcaattgtcgtctcttacgccatcgccgggctctgcgctctcctctccgctttctgttacaccgaattcgccgtccatctcccggtcgccggcggtgccttcagctacatccgtatcacattcggtgaatttccagcatttttcaccggagcaaatcttgtaatggattacgtaatgtcaaacgcggccgtttcgagaagcttcaccgcttatttaggaacagctttcgggatctcaacttccaagtggcgattcgtcgtctccggtttaccgaaaggattcaacgagattgatccagtcgcagttctcgtcgtcctcgtaatcacagtcatcatctgttgcagtacaagagagagttccaaagtgaacatgataatgactgcatttcacatcgcattcatattcttcgtgatcgtgatgggattcataaaaggagattcaaagaatctatcctcaccggcgaatccagagcacccctcgggattttttccgttcggcgcggcgggagttttcaacggagctgccatggtttacttaagctacataggatacgacgccgtttcaaccatggcggaagaagttgaaaatccggtcaaagatatccccgtcggtgtttccggctccgtcgcaatcgtcaccgttctttactgtctcatggcagtctctatgtcaatgcttctgccatacgatctgatagatccggaggcgccgttttccgcggcgttcagaggatcgaacggctgggaatgggtgacgaaagtggtggggataggagcaagctttgggatattaacatcacttttggtggcaatgttaggtcaggctcgctacatgtgtgtcatcggacggtccagagtggtccccttttggttcgctaagattcatcccaaaacatctacgccagtcaacgcctccacttttcttggcattttcacggcggctcttgcgcttttcaccgacctaaacgtcctcctaaacctcgtatccattggaacactatttgtcttctacatggtcgcaaacgctctcatcttcagacgttacgtcccggttggacccaccaagccgtggcccacactctgcttcctcacactattctccataacctctctcgtcttcaccctcatctggaaacttgtgccggaaggtaagcctaaagctttcatgctcggtgccagtgcggtggtggctatagccatcgtgctgagctttcagtgcgtggttccccaggctaggaaacctgagttgtggggagtcccgttcatgccgtggaccccgtgcgtgtcgatattcttgaacatttttttgcttggttcgttggacgcaccctcttacgtccggtttggattcttctccggtttgatcgtgctcgtgtatttgttttatggcgttcatgcgagttctgatgctgaagcgaatggatcttttggtgtgaaagatggacaagtcatgaaagagctaattgaagtgtga

SEQ ID NO: 36351 - protein, 583 aa, Arabidopsis thaliana
MEVQSSSNNGGHSSFSSLRVYLNSLSATPSRLSRRAISVSTSSDEMSRVRAVSGEQMRRTLRWYDLIGLGIGGMVGAGVFVTTGRASRLDAGPSIVVSYAIAGLCALLSAFCYTEFAVHLPVAGGAFSYIRITFGEFPAFFTGANLVMDYVMSNAAVSRSFTAYLGTAFGISTSKWRFVVSGLPKGFNEIDPVAVLVVLVITVIICCSTRESSKVNMIMTAFHIAFIFFVIVMGFIKGDSKNLSSPANPEHPSGFFPFGAAGVFNGAAMVYLSYIGYDAVSTMAEEVENPVKDIPVGVSGSVAIVTVLYCLMAVSMSMLLPYDLIDPEAPFSAAFRGSNGWEWVTKVVGIGASFGILTSLLVAMLGQARYMCVIGRSRVVPFWFAKIHPKTSTPVNASTFLGIFTAALALFTDLNVLLNLVSIGTLFVFYMVANALIFRRYVPVGPTKPWPTLCFLTLFSITSLVFTLIWKLVPEGKPKAFMLGASAVVAIAIVLSFQCVVPQARKPELWGVPFMPWTPCVSIFLNIFLLGSLDAPSYVRFGFFSGLIVLVYLFYGVHASSDAEANGSFGVKDGQVMKELIEV

SEQ ID NO: 36352 - DNA, 1830 bp, Arabidopsis thaliana
  CDS (1)..(1830)
atgggttgtttaagaagcttagtaagaaggaaacaattcgactcttcaaatggcaaagcagagactcatcatcatcaccaacagcttgcaaaagcgttgacctttcctcacttgattgccattggtgttggatcaacaattggagcaggggtttatattcttgtgggaacagtagctagagagcattcaggacctgctcttgctttatccttccttatagctggaatttctgctgccctttctgcgttttgttatgcggaactatctagtcgttttccctctgctgggagtgcctatcattattcttacatttgcattggtgaaggtgttgcgtggttgattggctgggcgctgattttggaatacacaattggtggttcaacagttgcccgcggcatatctccaaatctggcaatgattttcggtggtgaagattgtctgcctacaatattagctcgtcatcaaatcccaggccttgatattgttgttgacccgtgtgctgctgtgctagtgttcattgtaacaggactttgttgccttggagtaaaggagagcacatttgctcagggaattgtaacaacagcaaatgtctttgtcatgatatttgtcatagtagctggaagctatttgtgtttcaagacaggttgggttggttatgaacttccaacggggtattttccttacggggttgatggaatgcttactggatctgctactgtcttctttgcctacatcgggtttgatacagttgcaagtatggcagaggaggtgaaaaatccccggcgggatttaccgctcggtattgggatttcgctcctgctttgttgtttgctgtacatgatggtgtctgttgttattgttggtttagtgccgtattatgctatggaccctgacactccaatatcatccgcattttctagtcatggaattcaatgggctgcatatttgataaatttaggtgctgtcatggctctctgttctgcattaatgggctccattctccctcagccgcggattctgatggcaatggctagggatggtctcttgccttcatatttctcatatgtgaatcaacgcacgcaggttccaattaatggcaccataaccactggtgtttgtgcagcaatcttagctttctttatggatgtttcgcaactggcgggaatggtgagtgtcgggacacttgttgcatttacaatggttgcaatatcattgttgatagtcagatatgttgttcctccagatgaggtacctcttccctcatcacttcaagaaaactcatccagtcacgtcggaacttccatccgtagtaaacaacctttacttggcaaagtggatgattcagttgtcgataaggaaaatgctccaggaagttgggttctcaacaaaaaaaacagacggaaatttgctggttggagcattatgttcacttgtattggaaacttccttttaagctatgcagcgtcaagcttcctcttgccaggactcctccgatattctctatgtggtgttggtggattgttccttcttgtcggtttgattgttctgatttgcatagatcaggatgatgctagacacagttttgggcattctggaggcttcatttgcccgtttgttccgcttttgcctatagtttgcattcttatcaacatgtatctcttggtaaaccttggagctgcgacgtgggttcgtgtatcggtttggctgttcctcggagtggttgtttacattttctatgggagaagaaacagctctcttgtgaatgctgtttatgtctccactgctcatctccaggagattcgtcgcacttctggacattctttggcttaa

SEQ ID NO: 36353 - protein, 609 aa, Arabidopsis thaliana
MGCLRSLVRRKQFDSSNGKAETHHHHQQLAKALTFPHLIAIGVGSTIGAGVYILVGTVAREHSGPALALSFLIAGISAALSAFCYAELSSRFPSAGSAYHYSYICIGEGVAWLIGWALILEYTIGGSTVARGISPNLAMIFGGEDCLPTILARHQIPGLDIVVDPCAAVLVFIVTGLCCLGVKESTFAQGIVTTANVFVMIFVIVAGSYLCFKTGWVGYELPTGYFPYGVDGMLTGSATVFFAYIGFDTVASMAEEVKNPRRDLPLGIGISLLLCCLLYMMVSVVIVGLVPYYAMDPDTPISSAFSSHGIQWAAYLINLGAVMALCSALMGSILPQPRILMAMARDGLLPSYFSYVNQRTQVPINGTITTGVCAAILAFFMDVSQLAGMVSVGTLVAFTMVAISLLIVRYVVPPDEVPLPSSLQENSSSHVGTSIRSKQPLLGKVDDSVVDKENAPGSWVLNKKNRRKFAGWSIMFTCIGNFLLSYAASSFLLPGLLRYSLCGVGGLFLLVGLIVLICIDQDDARHSFGHSGGFICPFVPLLPIVCILINMYLLVNLGAATWVRVSVWLFLGVVVYIFYGRRNSSLVNAVYVSTAHLQEIRRTSGHSLA

SEQ ID NO: 36354 - DNA, 1434 bp, Pseudomonas aeruginosa PAO1
  CDS (1)..(1434)
atgaacgacacgccgaacgtgcgtgagccggccctgcgccgcgtgctcgggctgggaccgctgctggcggtggccatcggcctggtggtttcccagggcgtgatggtactgatgctgcaaggcgccgggacggccggcctcggcttcatcgtgccgctgggagtggcctacctgctggcgctgagctacgccttttccttttccgagctggccctgatgattccccgcgccggtagcctgagcagctacaccgaggtggccatcgggcatttcccggcgatcctggcgaccttttccggctacgtggtggtggcgatgttcgccctctcggcggaactgctgctgctcgacctgatcatcggcaaggtctaccccggcgcgctgccgccgatgctggtggcctacggcgtgctcggcctgttcaccctgctcaacctgctcggcatcgacatcttcgcgcgcctgcagagcgcgctggcgctgctgatgatgatcgtcctgctggtgctcggcctgggtgcggtgagcagcgaccacgcttccgcgcagaccgccctggcgagcggctggaacccgctcggggtaagcgccctggcgctcaccgcgatggccgtgtggggcttcgtcggcgccgagttcgtctgcccgctggtggaggagacgcggcgtccggagcgcaacatcccgcgttcgatgatcctcggcctgagcatcatcttcctgaccatcgccctctactgcttcggtgcgctgctgtgcatcccgcaggcggaactggccggcgacccgctgccacacttcctcttcgccaaccgcgtgttcggcgagtacggccagctgttcctggtgatcgccgcgatcaccgccacctgcagcaccctcaactcgtcgctggcggcgatcccgcggatgctctacgggatggcgcagaacggccaggccttcccgcaattcaagcagctcagccggcgggcgcgcacgccctgggtggcggtgctgttcgtcgccgcgatcaccggcctgccgatcctgatcctcggccaggacccggactcgatcaacctgctgctgctcgccgccgcgctggcctggctgctggcctacatcatcgcccacgtcgacgtgctggccctgcgccgtcgctatccgcacatcgcccgtccgttccgcacgccgttctacccgctgccgcaactgttcggcatcgccgggatgatctacgcggtggtccacgtctcgccgaccccggaaatgaccggacggatcttcgccagcgccggcgtggtgctcggcgtggtctcgctggtggcggtggtgtggatcaagggcgtgatgcgcaagcccctcttcgtacccgaaccgctcgagacggccggtgagactgcccagggcaagtccgtcgccctcgatcccctgcaatccccttcggcctga

SEQ ID NO: 36355 - protein, 477 aa, Pseudomonas aeruginosa PAO1
MNDTPNVREPALRRVLGLGPLLAVAIGLVVSQGVMVLMLQGAGTAGLGFIVPLGVAYLLALSYAFSFSELALMIPRAGSLSSYTEVAIGHFPAILATFSGYVVVAMFALSAELLLLDLIIGKVYPGALPPMLVAYGVLGLFTLLNLLGIDIFARLQSALALLMMIVLLVLGLGAVSSDHASAQTALASGWNPLGVSALALTAMAVWGFVGAEFVCPLVEETRRPERNIPRSMILGLSIIFLTIALYCFGALLCIPQAELAGDPLPHFLFANRVFGEYGQLFLVIAAITATCSTLNSSLAAIPRMLYGMAQNGQAFPQFKQLSRRARTPWVAVLFVAAITGLPILILGQDPDSINLLLLAAALAWLLAYIIAHVDVLALRRRYPHIARPFRTPFYPLPQLFGIAGMIYAVVHVSPTPEMTGRIFASAGVVLGVVSLVAVVWIKGVMRKPLFVPEPLETAGETAQGKSVALDPLQSPSA

SEQ ID NO: 36356 - DNA, 1356 bp, Pseudomonas aeruginosa PAO1
  CDS (1)..(1356)
atggcggggggagagaaggccggcaagcgcggcatggggttctggacctgcagcgcgctggtgatcggcaacatggtcggttcgggagtcttcctgcttccctccagcctggcggcgttcggcgggctcagcctgttcggctggctggtgtcgagcaccggcgcggtgctgctggcgctgaccttcgcccgcctggcgcgggtcaaccccggcgccggcggcccctacgcctatacccgcgacggtttcggcagcttcgccggctacctgtgcgcctggacctactggaaagccgcctggatcggcaacgcggcgatcgccgtgaccctggtcggctacctgcgggtattcatcccggcgctggcggatccgctgctgatggtcagcgtggccatcgccgcgatctggctgtgcaccctgatcaacctgcgaggcatcggcaccttcagcgtggtgcagaacctgctgaccatcctcaagctgctgccgttgttgctggtcggtatcctcggctggttccacttcaatcccgagcacctggcgatcccggcgcgcagcgagctgccgaacatgggctatgcccaggcgatcgccaccaccgcggcgctgaccctgtggtcgttcatcggcctggagtcggccaccgtgccggccgacgacgtcgaggatccgcgccgcaccattccccgtgcgaccctgttcggcacgctggccgcggcggccctctacatcctctcgatcactgcggtgcagggcctgatgccgccggaggtgctggcccgctccacctcgccgttcgccgacgcggcgcggatcctgatgggcgactggggctactacctggtggctgccggggcggtcatcgcctgcctgggcgcgctcaatggctgggtcctgttgcagggccagatcccggtggctccggcgcgcgacgggctgttcccggagtcgctcggccagctcaacaagaacggcgcgccggcccacggcctgctggcctcggggctgctggtgacggcgctggtgatggtcgacgggcatggcgacctggtcgatgtgttcaacgtgatcatcctgctcggcaccatgaccggggtggtcccctacgcgttctgcaccgccgcgctgttgcaactgctggcggtgcgaccggacgagttctcgccgcgttcacgccggcaattgctggtgatcggctcgctgggcttcgcctactcgctatgggcgctgtatggcaccggccagcaggcgatcttctggggcttcctggtgctgatggccggtatcccgatgtacacctggcggcaatggcgcaaccaggtcaacggagtgccgacgctcaaagccaatgactga

SEQ ID NO: 36357 - protein, 451 aa, Pseudomonas aeruginosa PAO1
MAGGEKAGKRGMGFWTCSALVIGNMVGSGVFLLPSSLAAFGGLSLFGWLVSSTGAVLLALTFARLARVNPGAGGPYAYTRDGFGSFAGYLCAWTYWKAAWIGNAAIAVTLVGYLRVFIPALADPLLMVSVAIAAIWLCTLINLRGIGTFSVVQNLLTILKLLPLLLVGILGWFHFNPEHLAIPARSELPNMGYAQAIATTAALTLWSFIGLESATVPADDVEDPRRTIPRATLFGTLAAAALYILSITAVQGLMPPEVLARSTSPFADAARILMGDWGYYLVAAGAVIACLGALNGWVLLQGQIPVAPARDGLFPESLGQLNKNGAPAHGLLASGLLVTALVMVDGHGDLVDVFNVIILLGTMTGVVPYAFCTAALLQLLAVRPDEFSPRSRRQLLVIGSLGFAYSLWALYGTGQQAIFWGFLVLMAGIPMYTWRQWRNQVNGVPTLKAND

SEQ ID NO: 36358 - DNA, 1410 bp, Lactococcus lactis subsp. lactis Il1403
  CDS (1)..(1410)
atgggatttatgagaaaagctgattttgagctttatcgagatgcagataaacactataatcaggtgttaaccacacgtgattttcttgcactaggtgttggaacaattatttcgacttctatttttactttaccaggtcaggtcgctgctcaatttgcaggcccaggtgttgtcttttcttacctgcttgctgcattggtcgctggttttgttgccttggcttatgctgaaatgtcaacagtgatgccatttgcgggttcagcctattcttggatttcagtcttatttggcgaaggttttggttggattgctggttgggctttgcttgcggaatattttattgccgttgcctttgttggttcaggcttctcagcaaatctgcaacaattgctagcgccactcggtttccatctaccaaaagtattggccaatccatttggtacagacggtggagttgtcgatattatttcacttttagtcattttactctcggcaattattgtctttcgtggggcatctgatgctggacgaatcagtcaaattcttgttgtgcttaaagtagcggctgtcattgctttcatcattgttgggattacggtcattaagccagcaaattaccatccatttattccaccacacaatcccaaaacaggttttggtggcttctcgggaatctggtctggggtatcaatgattttcttggcctatatcggttttgattcaattgcagccaattcagcggaagctaaaaaaccccaaaaaacaatgccacgtggaattattgggtcgcttctaattgctgttgttctatttgcagcagtaaccttggtacttgtagggatgcatccttactcagcctatgcaggaaatgcagcgccagttggttgggctcttcaacaatcaggttattctgttttatcagaagttgtaacagctattgcacttgccggaatgtttatcgcccttttgggaatggttcttgcaggttcacgtttgctttatgcttttggacgcgatggacttttacctaaaggtttgggtaaaatgaatgctcgaaatcttccagcaaatggtgtgtggaccttagccattgttgctattgtcatcggggcattcttcccctttgctttccttgctcaacttatttcagcaggaactttgattgctttcatgtttgttacacttggaatctattcacttcgtcgtcgtcaaggaaaagatttgccagaagcaacttacaaaatgcctttctatccagttttaccagctcttggttttattggttcattatttgtattttggggattggatgtgcaagcaaaactttattcaggaatttggttccttattggaattttgatttattttgcttatggaaatcgtcgaagcagaaaatcagaagaaaaataa

SEQ ID NO: 36359 - protein, 469 aa, Lactococcus lactis subsp. lactis Il1403
MGFMRKADFELYRDADKHYNQVLTTRDFLALGVGTIISTSIFTLPGQVAAQFAGPGVVFSYLLAALVAGFVALAYAEMSTVMPFAGSAYSWISVLFGEGFGWIAGWALLAEYFIAVAFVGSGFSANLQQLLAPLGFHLPKVLANPFGTDGGVVDIISLLVILLSAIIVFRGASDAGRISQILVVLKVAAVIAFIIVGITVIKPANYHPFIPPHNPKTGFGGFSGIWSGVSMIFLAYIGFDSIAANSAEAKKPQKTMPRGIIGSLLIAVVLFAAVTLVLVGMHPYSAYAGNAAPVGWALQQSGYSVLSEVVTAIALAGMFIALLGMVLAGSRLLYAFGRDGLLPKGLGKMNARNLPANGVWTLAIVAIVIGAFFPFAFLAQLISAGTLIAFMFVTLGIYSLRRRQGKDLPEATYKMPFYPVLPALGFIGSLFVFWGLDVQAKLYSGIWFLIGILIYFAYGNRRSRKSEEK

SEQ ID NO: 36360 - DNA, 1344 bp, Streptococcus pyogenes M1 GAS
  CDS (1)..(1344)
atggcgtcaaatcacatgaacgaacaagaaagagaacaggcaaagtttagcttgagcggtgccactctttacgggatcaatgccgttatcggctctggtatttttctcttacctagggccatttataagggccttggccctgcatccatcgctgttatgtttggaacagctattttgaccatcatgttggcagtttgttttgcagaagtctctggttattttgggaaaaacggcggagccttccaatattccaaacgagcttttggtgattttattggctttaacgttggcttccttggttggaccgttaccatcttcgcttgggcagccatggcagctgggtttgccagaatgtttatcattactttccctgcctttgaaggttggcacattccacttagtattgggttaatcatcttactatctttgatgaatatcgctggtttgaaaacctctaaaattgtcaccatcacagccaccattgctaagttaattccaatcgttgccttttgtgcctgtacccttttcttcatcaaaaacgggcttcctaactttaccccatttgttcagttggaaccagggactaacctcttaggggctatctccaatactgctgtttatatcttctatggctttatcggttttgaaaccctctctattgtcgctggggaaatgcgtgaccctgaaaaaaatgtaccgcgtgctcttttaggatcaatcagtatcgtctctgtcttatatatgctgattatcggtggaaccattgccatgcttggctctcaaatcatgatgaccaatgcacctgttcaagatgcctttgttaaaatgataggccctgctggcgcttggatggtctcaatcggtgctttaatttccattacaggtcttaacatgggagaatccatcatggtgccacgttacggtgctgccattgctgatgaagggctcttaccagctgctattgccaagcaaaatcaaaatggcgcgccactcgttgctatcttggtttcaggagcaattgccattgtactcctgcttactggctcatttgaaagcttagcaaaactcagtgttgttttccgcttcttccaatacattccaacagcactagccgttatgaaattacggaaggacgatcccgatgctaatgtgatcttccgagtaccatttggccctattatcccaattcttgcagttatcgttagtttagttatgatttggggtgacaacccaatgaactttgtttatggtgcagttggtgtcatcattgcaagtagtgtgtactaccttatgcacggacgtaaccaccaaatggaccaaatgccccctaaggaacaaatctag

SEQ ID NO: 36361 - protein, 447 aa, Streptococcus pyogenes M1 GAS
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCACTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMIGPAGAWMVSIGALISITGLNMGESIMVPRYGAAIADEGLLPAAIAKQNQNGAPLVAILVSGAIAIVLLLTGSFESLAKLSVVFRFFQYIPTALAVMKLRKDDPDANVIFRVPFGPIIPILAVIVSLVMIWGDNPMNFVYGAVGVIIASSVYYLMHGRNHQMDQMPPKEQI

SEQ ID NO: 36362 - DNA, 1275 bp, Methanothermobacter thermautotrophicus str. Delta H
  CDS (1)..(1275)
atgaaacccaatctgaggagggaactcggtctcttcgacgcggtgaacctggtggtggggaccatcgtgggggccgacatatacatagtggctgcctatggcgccggtagccttggcccggcatcgatactcgcctggctgctcgccggactcatggccctcataatcgcccttgtattctctgaggcctcagccatgctccccaggacagggggcccctacgtctatgcaggcgaggccctcgggaggttcacgggtttcatcaccggctggtccctctgggtctcatcatgggttgccatagctgttttcccccttgccttcatctactaccttgaatacttcatcccccttgacccccctgctgaggccgtgataaaggtcctcttcatcctctcactcaccatcataaacattgcaggggtcgggagggccggtaaggtcaacgatatcctcacaatcctaaaggtcgccccggtgctcctcttcgcggtcctgggcgccatacaccttgcactgaaccccgggctcctggtatcaaattacactccagctgcacccatgggcctcggggccctgggtactgtgactgtcctggtattctgggcctatgttggctttgagcttgtgacagtccccgcggatgaggtcagggaccctgagaggacaatacccctctccataacactggggatgatctttgtcaccctattctacatcctcaccaacgctgttatccttggccttgtaccctggagggtccttgcatcctcaaccgcgcccctcacggtggccggttacagcctcatggggggcatcggggccctcatactcacagcgggtgctgtgttctccattgccggttcagaggaggcaggtatgctcacaactgcaaggcttctctttgccatgtcagaggatgggttcctcccgggcttcctctccagggtccacaggaggttcggcaccccacacatgagcatcctggtccagaacctcacagccctcttagcggcacttacaggcaccgtttcgggcctcatcgagctctctgtggttaccctgctcctcccctacgctgtgacatgcatctcactggccatcctgaggaggagggatggttcaggcatcccccttaagagtgttctgggtgtactggtctgcatctacctcctcatgaacaccacaccatccaccactgcctggggactcctcctgatcctttcaggggcacccctctatctgatattcggatttaaaaggctgcgccgctga

SEQ ID NO: 36363 - protein, 424 aa, Methanothermobacter thermautotrophicus str. Delta H
MKPNLRRELGLFDAVNLVVGTIVGADIYIVAAYGAGSLGPASILAWLLAGLMALIIALVFSEASAMLPRTGGPYVYAGEALGRFTGFITGWSLWVSSWVAIAVFPLAFIYYLEYFIPLDPPAEAVIKVLFILSLTIINIAGVGRAGKVNDILTILKVAPVLLFAVLGAIHLALNPGLLVSNYTPAAPMGLGALGTVTVLVFWAYVGFELVTVPADEVRDPERTIPLSITLGMIFVTLFYILTNAVILGLVPWRVLASSTAPLTVAGYSLMGGIGALILTAGAVFSIAGSEEAGMLTTARLLFAMSEDGFLPGFLSRVHRRFGTPHMSILVQNLTALLAALTGTVSGLIELSVVTLLLPYAVTCISLAILRRRDGSGIPLKSVLGVLVCIYLLMNTTPSTTAWGLLLILSGAPLYLIFGFKRLRR

SEQ ID NO: 36364 - DNA, 2331 bp, Halobacterium salinarum NRC-1
  CDS (1)..(2331)
atgatcggggccggcatcttcgtgctcccgaagatcgccgccgaacaggccggccccgccagcatggtgtcgtttttcgtcggcggcatggtgtcgctgttcgccgcgctctcgttgtccgagctcgccaccggcatgccgaaagccggcggcagctactactacgtcaaccgcgcgctggggccgtttttcggcagcatcgtcggctgggggatgtgggccgggctgacgttcgcgtcggcgttctacatgatcgggttcggccaatacctcctgccgggactgggcgagtacgtcggcgtcctcgccggctggggggatctcgggatcaccgttgccgcgctcgcgatggccgcgcttctgaccgccgtcaactactacggcgtcaaagaaaccagcgcgctccagaacgtcatcgtgctcacgctggtcggactcgtgctcgcgttcctcgggctcggcgcggtcaccggcccgacgatcacggagttcaaccccaacggctggccggcggtcgccgcgaccatcggcaccgtctacgtgacgttcatcggcttcgaggtgatcgccaccagcgccgaggagatcaaaaaccccagccggaacctcccgctggcgatgatcgccgccgtcgtcacgcccaccctgatgtacgtcggcgtgatgttcgtctccaccggcacgatcgacatccccgtgctcgcgggctccgacgttccggtcgcgctggtcgcccgtgagatcttccagccgcttgccggcgcggtctcctggctcccgttcgtctccgttcagcccgccaccgccggctcggtcggcgcgctcgcaatgatcgtcggcgcggtgctcgcgaccgtctccagcgccaacgcgagcatcctgtcggcggcgcgcgtgaacttcgcgatggggcgggacaagatcctcgtcaactggctcaacgaagtccacgaccgattccgcacgccgtaccgcgcgatcgccgcgacgggcgtcatcacgctgctgttgatcgggatcggcgtcggcgtcggcacgctggccgaggtggcgagtttcatgtacctcgtcacgtacgccctcgtgcacgtctccgtggtcgtgttgcggcgcgcgaaccccgacacctacgacccggcgttccgcatccccgcggtgctgtacccggtggtgccggtgctcggcgcggcggcgtgcgtcgcggtcctcgtccagatgtccgtgacgttctcccccatgacgatcggggtggcgtccgtcgcggtcgtgctgccggtgacgccgacgccggtcggcgcgatcggcaccgtcctggtggcgttcgggatcgcgtggtactactgctatgcccgcgcccgcgcgccgagccagagcctcgtcggcgacgcactcgcgccgtcctcgtcgccggacacggacacacccgacacctacaccgtcgtggtgccggttgcgaacccggacacggaacacgacctcctgcgcatggcggccgcgagcgcgcacgctcacaccgacgcgcacgccgaagtcatcgcggtgaacgtcatcgaggtcccccgccagacgtcgctgtcccaggacctcgccttcgaagaggagcgcgtcgagcgccaacaggagctgctcgacgccgccagcgcggccgccgccgacctggacgtgcgcctgcggacgcgcgccgtcgccagccacgacaccggggccgccatcctcgacgtcatcgaggacacggccgccgatcacgtgttgctcggctgggggggcacgcgtcgccgcgaccacgtcctggggtcgaccatcgaccccgtggtcggccacgcgtcctgtgacgccacgctcgtgcgcctcgggccggccgccgccggcgacgccagcgacatcatggtgctcgccggggagggcccacacgcgccggttgccgcgcgccgcgcggccgaattcgtcgccgccgacgagacggacgcgtcgctgacgctgctgaacgtgcagccgcccgcggacgacgacgacgacgccgacgcgtcagccaccgaacgcggggcggcggtcatcgacgccctcgcggagcgcgctggcatcaaatatatgacctatgacaccgaagtagtcgtctcgacggacaccgaggccgccgtcatcgacgccgccgccgacttcgatatggtttacgccggcgcaacgcgctcggggccggtgtcccaggccgtcttcggctcgatcccggaggccgtcggtgcgggcgtcgatcaaaccgtcgtcatggcgcgcggcccggacaacacaccaatgtcagtacgtgacgcgatcacacgacggttcgggggatag

SEQ ID NO: 36365 - protein, 776 aa, Halobacterium salinarum NRC-1
MIGAGIFVLPKIAAEQAGPASMVSFFVGGMVSLFAALSLSELATGMPKAGGSYYYVNRALGPFFGSIVGWGMWAGLTFASAFYMIGFGQYLLPGLGEYVGVLAGWGDLGITVAALAMAALLTAVNYYGVKETSALQNVIVLTLVGLVLAFLGLGAVTGPTITEFNPNGWPAVAATIGTVYVTFIGFEVIATSAEEIKNPSRNLPLAMIAAVVTPTLMYVGVMFVSTGTIDIPVLAGSDVPVALVAREIFQPLAGAVSWLPFVSVQPATAGSVGALAMIVGAVLATVSSANASILSAARVNFAMGRDKILVNWLNEVHDRFRTPYRAIAATGVITLLLIGIGVGVGTLAEVASFMYLVTYALVHVSVVVLRRANPDTYDPAFRIPAVLYPVVPVLGAAACVAVLVQMSVTFSPMTIGVASVAVVLPVTPTPVGAIGTVLVAFGIAWYYCYARARAPSQSLVGDALAPSSSPDTDTPDTYTVVVPVANPDTEHDLLRMAAASAHAHTDAHAEVIAVNVIEVPRQTSLSQDLAFEEERVERQQELLDAASAAAADLDVRLRTRAVASHDTGAAILDVIEDTAADHVLLGWGGTRRRDHVLGSTIDPVVGHASCDATLVRLGPAAAGDASDIMVLAGEGPHAPVAARRAAEFVAADETDASLTLLNVQPPADDDDDADASATERGAAVIDALAERAGIKYMTYDTEVVVSTDTEAAVIDAAADFDMVYAGATRSGPVSQAVFGSIPEAVGAGVDQTVVMARGPDNTPMSVRDAITRRFGG

SEQ ID NO: 36366 - DNA, 1530 bp, Xylella fastidiosa 9a5c
  CDS (1)..(1530)
ttgaaacaaatttcaattttagtgagactctttattacgccatatgtgtcatatccgtgtggttttcttcactcatcgagacccgtaatgtcattcttgccatcgtttctaaagcgcaagtccattgatctaatcaccgtgcatgaagaaggacgacgcctggtccctacactgagctggccacatctgatcgcattgggcattggtgcaatcgttggcactgggatctacaccttaatcggagtcggggcagaaaaagcgggtccagcaatcctcctctcattcgtcatcgctggggtcatctgtgcctgcgcagcactggcatatgccgagatggcgacaatgatgccagtggcaggcagcacttatacgtacagctatgtggccctcggtgaggggattgcctggatcgtggggtggagtctcatcttagagtactcactggtggtcagcactgttgcggtgggatggtccgggtacatgagtgggtttctcaagagcgtaggggtcgatatgccgctggcgctcaccgccggaccgtatgctggcgggataatcaatcttccggcggtagtgatcacctgcgttgtggctggactgctgatcgtcggcacaaaagaaagcaccacactcaacgcggttctggtggtggttaagatcattgcgctctctgtgttcgtcgtgatcgcgctaccacattttgatatggctcatctgaaaccgttcatgccctatgggtttaccaagtcaatcgacaccggaggtgtggaacgcggggtgatggccgctgcagcaatcattttttttgctttctatggtttcgatgcaatctccaccgcagccgaggaaactaagaatccaagccgcgatctgtccatcggcatcatcggttcaatgatcggctgcaccttaatttacgtattagtggcactggctgcgatcggtgcaatgcactacaccgtgttcggtcccagtactgaaccgctggcgctgattctgcggcaacttgaccagggcaacaccgccaggctcatcggagcagctgcgattatcgcgctacccactgtactgttggcctttttatatggacaaagccgcattttgttcgtgatgtctcgggatgggctgctaccacgtggattgtcgacggtgaatgcacgcacaggaacaccgatcgccacgacactgttcactgcaattctcgtcgcaacggcagcagggttggtgccattgggcgagattgccgcgctggctaatgctggcacgctgactgcgttcatcgcagtggctttatgcctgctggtgctgcgggtgcgtgaaccacagcgcgtgcgtgcattccgtacaccactggcttgggtcgtcgggccaatcgcaattgctggttgtttgtatctgttctggagtctgccaaagatgacacagtccctttttctgctgtggaacgcactgggattgtgtgtgtatctggtctatgggcgccacaccagcctgctatcaaaggcggtaagcatcgacacgccaagataa

SEQ ID NO: 36367 - protein, 509 aa, Xylella fastidiosa 9a5c
MKQISILVRLFITPYVSYPCGFLHSSRPVMSFLPSFLKRKSIDLITVHEEGRRLVPTLSWPHLIALGIGAIVGTGIYTLIGVGAEKAGPAILLSFVIAGVICACAALAYAEMATMMPVAGSTYTYSYVALGEGIAWIVGWSLILEYSLVVSTVAVGWSGYMSGFLKSVGVDMPLALTAGPYAGGIINLPAVVITCVVAGLLIVGTKESTTLNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNARTGTPIATTLFTAILVATAAGLVPLGEIAALANAGTLTAFIAVALCLLVLRVREPQRVRAFRTPLAWVVGPIAIAGCLYLFWSLPKMTQSLFLLWNALGLCVYLVYGRHTSLLSKAVSIDTPR

SEQ ID NO: 36368 - DNA, 1434 bp, Xylella fastidiosa 9a5c
  CDS (1)..(1434)
atgttcaaacaactctgggccaccaaactctctcaacccagccaggacagtgccgaaggactcagcctgcaacgcgtccttggagtgtgggggttaactgcactgggtatcggtgcagtgatcggcggcggcatcttcgtcattactgggcaagccgcggccaatcacgccggaccagccattatgctgtcgttcgcactcgcggcgatctgctgtacgttctgtgcgctggcgtatgccgaattcgcagcgatggtgccggtctctgggagcgcctacacctatacctatgccactttcggtgagctagcagcctggttcatcggttggatgctggtattggaatatggggtttctgccgcggcggtcgcggtgagctggagcggctatttcctcagcttattacagcatctgggcatcgatctgcccgccgcactagtgaatgcgccattggacggcacgctgcacgccactggggccattgccaatctgccagcagccaccatcgtgctgctgctgacctggttgtgctacttcggcatccgtaagtcctcgaagatcaatatcgcgatggttgcactcaaaagcgggctgatcttgctgattattggcgtcggctggaaatacgtgaaccctgattactggcaaccgttcatccctcccaatcaagggccgggcaaatacggatgggatggtgtgttacatggcgcgtcaatggtgtttttcgcctacatcggttttgaagcggtgtcggtggccgcgcaggaatcacaccgtccacagcgcgaccttcctatcagcatgatgagtgcgttagcgatctgcaccgtgctgtacatcatgatggccgccgtcatgactggattagtcccttacacgcaactgggcacagacgagccagtcgtcaccgcagtcgccgcacacccccaactgggctggctgcgcgtcgtggtcgaaatcggtgcattggtcggactgtcttcggtcgtgttggtgatgctcatcggacaaccgcgcatctttatgatcatggccggtgatggcctgctgccaccgatattcagcacaatccactccaagcaccgcactccgcacatcaacacggtgatcaccggactaggtattgcgttgctcgcagcggtgttcccactggatgtactcggcgaactcacctcaatggggacgctgattgcctttgccgccgtctgtgccggcgtgctgattctgcgctgtactcggccagatctgccacgcccattccgcatgccggcagcatggttgttttgctccgctggtgtactcagttgcattaccttattgtcagcaatgaccaggcacaattggatgctgatgagcgtgtggactgttcttggttttgcactgtacttcggttacggatatcgccacagcaaactgcatcgagaaagcacctga

SEQ ID NO: 36369 - protein, 477 aa, Xylella fastidiosa 9a5c
MFKQLWATKLSQPSQDSAEGLSLQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIDLPAALVNAPLDGTLHATGAIANLPAATIVLLLTWLCYFGIRKSSKINIAMVALKSGLILLIIGVGWKYVNPDYWQPFIPPNQGPGKYGWDGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAAVFPLDVLGELTSMGTLIAFAAVCAGVLILRCTRPDLPRPFRMPAAWLFCSAGVLSCITLLSAMTRHNWMLMSVWTVLGFALYFGYGYRHSKLHREST

SEQ ID NO: 36370 - DNA, 1518 bp, Mycobacterium leprae TN
  CDS (1)..(1518)
atggccacactggctgagagccccgaaccaaaatccggcgcgtcgagagctggtgtcctcggcgaggaggctggttaccacaaggggctcaaacctcgacaactgcagatgatcgggatcggcggcgcgatcggtaccgggttgttcctcggcgccggcggccggctggccaaggccgggcccggattgttcctggtgtatgccgtctgcggggtgttcgtcttcctgatactgcgcgcactgggcgagctggtgctgcatcgtccttcatcgggatccttcgtgtcttacgcacgtgagttcttcggcgagaaagccgcctacgtcgtcggctggttgtacttcctggactgggcgatgacagcgatcgtggacaccactgccatcgccacctacctgcatcgctggacaatcttcacggcgttgccacaatggactcttgcgctgctcgccctggcggtggtgttggtaatgaacctgatctccgtggaatggttcggcgagctcgaattttgggccgcgctgatcaaggtttgcgcgctgatggcatttttggtcgtaggaactatcttcctcggcgggcgttacccggtcgacgggcacaacactgggttaagcctctggactagtcacggcggattgttccccaccggcgtagcgccgctaatagttgtcagctccggagtgatgttcgcctacgctgccgtcgaactggtcggcaccgcagcaggtgaaaccgtcgagccgaaaaaaatcatgccgcgagcgatcaactcggtaatcgctcgcatcgcgatcttctacgtcggatcggtgattctgctggcattgttgctgccctacagcgcattcaaggccagcgaaagcccgttcgtcacgttcttctccaaggttgggttctacggcgccggcgatctgatgaacatcgtagtgctcaccgccgcgctgtccagcctcaacgccggactgtacgcaaccggccgtgtcatgcactcgatcgcgataaatggtagcggaccgaagttcaccgcgcgaatgtcgaaaaatggtgtgccatatggcggaattcttttagccgccgtcatctgcctgtgcggtgtcgcactaaacgccttcaaccccggtcaagccttcgagatcgtgctcagcgtcgccgcactgggcatcatcgccgggtggggaacaatcgtactgtgccagcttcgactacacaagatggccaaagccgggatcatgcgccgaccccgctttcgcatgccgctggccccatacagtggctacctcactttggccttcttgttcgcggtactggttgtgatggcgttcgacaaaccgatcggcacctggacagtagcgtcactgatcgttatcgtcccagccttgattgcaggctggtactcaatacgcaagcgcgtgatgaccatcgcccgtgaaagaatgggctataccggacctttcccggcgatcgccaacccaccggtgcaaccatcagaacgatcccatagccagaatccgtag

SEQ ID NO: 36371 - protein, 505 aa, Mycobacterium leprae TN
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAPLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVQPSERSHSQNP

SEQ ID NO: 36372 - DNA, 1719 bp, Mycobacterium leprae TN
  CDS (1)..(1719)
gtgtttctaagcgctgacgtcagttgcattgagattgtggacatcaattgttccgagctgcgcaacgatcgacgcataccaccacagttagcactcttctgcacgaacgccgccaataaggcagaatcggctgtgacgagtcatggtcaactaccgattatggcaaaccgtcgctgggctccgcatactagaagacagagtggtcgcgctacctcaacttgctcgtcactcatgagattctcagcaagtgaatctagagcacattcaaggtttgagtgctacacccttgtgagatggtcgatccgcggacaaggaggacgtgcgattagcaagcttggtttctggagtgttgttatgcttggtatcaactcgataatcggagcgggtatcttcatgactcccggtgaagtgatcaagattgctggaccgttcgccccgatcgcatatactcttgcaggaattttcgcagccgtactggcaatcgtctttgcgacagcggccaagtatgtcaagacgaacggttcctcctatgcctacactacagctgcatttgggcaccgaatcggtatctatgtcggtgtcacccatgcaattaccgcctctatcgcatggggggttctggcttcctcgtttgtctcaacactgttgagagtggctttccccgaaaagatttgggccgataacgacgaacttatcagcgtgaagacactcacgttcctcgtctttatcgcagttttattagcaataaacatatttggaaacctcgtgatccggtgggccaacggaatctcagcgctgggaaagattttcgcgctatcagtcttcatcgccggaggattgtggacaatcataacacagcacgtgaacaactacgtgacgtcccgatcagcgtaccaacccacaacgtactcgttgctcggtgtcaccgagatcggtaagagcaccgcagcgagtatgacactcgcaacgatcgtcgcgttgtacgcattcactggtttcgaatctatcgctaacgccgcagaagagatgaacacaccggaccgcacccttcccaaagccataccactgacaatcctcactgtcggcgtcatctatatactcgccttagtcgtcgcaatgctgctgggatcggacaaaattgtcgctactaaccacaccgtgaaattggccgcggccgtcggaaacaatactttccgcaccatcatcgttgttggagctttagtatctatgtttggcatcaacgtagcggcatcgttcggtgctccccggctctggaccgcgttgtcggacggtagaattctgccaacaaggctgtcgagcaagaatcgattcggcgttcccatagttgcctttggaatcacggcgtttctaacgctcgccttcccactgtcgcttcgattcgacagcctgaacctcaccggtctggcagtgatcgctcgattcatccaattcataatcgtaccgatcgcgctcttcgcgttggcacgttcccggacaacgaattctgtatatgtgaagcgaaatgtgtttactgacaaggtgttgccgatcactgcagttgtggtctcggccgggctgatggtatcgtttgactaccggtccatttttctcacgcgcggaggccctaattacttttcgatttctttgattgcgattacgtttatcggcataccggcagtcgcctaccttcactattacagaaccagtggaattaagtga

SEQ ID NO: 36373 - protein, 572 aa, Mycobacterium leprae TN
MFLSADVSCIEIVDINCSELRNDRRIPPQLALFCTNAANKAESAVTSHGQLPIMANRRWAPHTRRQSGRATSTCSSLMRFSASESRAHSRFECYTLVRWSIRGQGGRAISKLGFWSVVMLGINSIIGAGIFMTPGEVIKIAGPFAPIAYTLAGIFAAVLAIVFATAAKYVKTNGSSYAYTTAAFGHRIGIYVGVTHAITASIAWGVLASSFVSTLLRVAFPEKIWADNDELISVKTLTFLVFIAVLLAINIFGNLVIRWANGISALGKIFALSVFIAGGLWTIITQHVNNYVTSRSAYQPTTYSLLGVTEIGKSTAASMTLATIVALYAFTGFESIANAAEEMNTPDRTLPKAIPLTILTVGVIYILALVVAMLLGSDKIVATNHTVKLAAAVGNNTFRTIIVVGALVSMFGINVAASFGAPRLWTALSDGRILPTRLSSKNRFGVPIVAFGITAFLTLAFPLSLRFDSLNLTGLAVIARFIQFIIVPIALFALARSRTTNSVYVKRNVFTDKVLPITAVVVSAGLMVSFDYRSIFLTRGGPNYFSISLIAITFIGIPAVAYLHYYRTSGIK

SEQ ID NO: 36374 - DNA, 1305 bp, Mycobacterium tuberculosis CDC1551; identical to SEQ ID NO: 9113
  CDS (1)..(1305)

SEQ ID NO: 36375 - protein, 434 aa, Mycobacterium tuberculosis CDC1551; identical to SEQ ID NO: 9114

SEQ ID NO: 36376 - DNA, 1416 bp, Mycobacterium tuberculosis CDC1551
  CDS (1)..(1416)
atgagccttcgagaactgatgctgcggcgccgcccggtgagcggcgccccggtcgcatccggggcatcggggaacctcaagcggagtttcggcaccttccagctgaccatgttcggggttggcgcgacgataggtaccggcatctttttcgtgcttgcccaggcagttccagaggccggcccgggcgtgattgtttcgttcatcatcgccggcatcgccgctgggctcgcggctatctgctacgcggaactggcttccgccgtgccgatttccgggtcggcgtactcctacgcgtacacgacgctgggcgaggcggtcgcgatggtggtggcggcctgcctactgctggaatacggggtagccaccgcagcggtcgcggtcggctggagtggctacgtgaacaagctgctgagtaatctgttcggatttcagatgccgcacgtattgtcggcggcgccgtgggacacccatcccggttgggtgaacctgcccgccgtcatcctgatcgggctatgcgcgctgctgttgattcgaggggccagcgagtcggcgagggtcaacgcgatcatggtgctgatcaagctcggcgtgctgggcatgttcatgatcatcgcgttcagcgcgtacagcgccgaccacctcaaggatttcgtcccattcggcgtcgccggcatcggctccgcggcgggcacgatcttcttctcatacatcggccttgacgcggtgtcgaccgccggcgacgaggtgaaggacccgcagaagaccatgccgcgtgcgctgatcgcagcgctggtggtcgtcaccggtgtctacgtgctggtcgcactggccgcgctgggcacccaaccgtggcaggacttcgcagagcaggaaaccgccgggctggccatcatcttggacaacgtcacgcatggcgaatgggccagcacgattctggccgccggtgcggtggtctcgattttcaccgtcacgctggtcaccatgtacggccagacccggatcctgttcgcgatggggcgcgacgggctgctgccggcgcggttcgcgaaggtgaatccgcgcaccatgacgccggtgcacaacacggtgatcgtcgcgatcttcgcatcgacgctggccgccttcataccgctggatagcttggcggacatggtgtccatcggcacgctcaccgcgttcagcgtggtggctgtgggtgtgatcgttctacgggtgcgcgagcccgacttaccccgagggttcaaggtacccggttaccctgtgacgcctgttctttcggtgctggcctgcgggtatatcctggccagcttgcactggtacacctggctggcgttcagcggatgggtggcggtggcagtgatcttttacctgatgtggggtcggcaccacagtgcgctcaacgaggaagtgccgtga

SEQ ID NO: 36377 - protein, 471 aa, Mycobacterium tuberculosis CDC1551
MSLRELMLRRRPVSGAPVASGASGNLKRSFGTFQLTMFGVGATIGTGIFFVLAQAVPEAGPGVIVSFIIAGIAAGLAAICYAELASAVPISGSAYSYAYTTLGEAVAMVVAACLLLEYGVATAAVAVGWSGYVNKLLSNLFGFQMPHVLSAAPWDTHPGWVNLPAVILIGLCALLLIRGASESARVNAIMVLIKLGVLGMFMIIAFSAYSADHLKDFVPFGVAGIGSAAGTIFFSYIGLDAVSTAGDEVKDPQKTMPRALIAALVVVTGVYVLVALAALGTQPWQDFAEQETAGLAIILDNVTHGEWASTILAAGAVVSIFTVTLVTMYGQTRILFAMGRDGLLPARFAKVNPRTMTPVHNTVIVAIFASTLAAFIPLDSLADMVSIGTLTAFSVVAVGVIVLRVREPDLPRGFKVPGYPVTPVLSVLACGYILASLHWYTWLAFSGWVAVAVIFYLMWGRHHSALNEEVP

SEQ ID NO: 36378 - DNA, 1488 bp, Mycobacterium tuberculosis CDC1551
  CDS (1)..(1488)
atggccggtcgacggcgcatgaagtcggtagaacagtcaatcgccgacaccgacgagcccaccactcggctgcgcaaggacctcacctggtgggacctggttgttttcggcgtctcggtggtgattggcgccggaatattcacggttaccgcgtcgaccgctggcgatatcaccggcccggccatctggatatcgtttctgatcgcggcggcgacctgtgcgctggccgcgctgtgctacgccgagttcgcctcgacgctgccggtggccggcagcgcctataccttctcttatgccaccttcggggagttcttggcctgggtgatcggctggaatctggtgctggaactggcgatgggtgcggccgtggtcgccaaaggctggtccagctacttgggcaccgtgttcggattcggtaatggcacaggccatctcggatcgctgcagctcgactggggtgcgctcgtgatcgtcacgttggtggcgaccctgatcgcgttgggcaccaaattgtcgtcgagattttccgcggtggtcaccgcaatcaaggtgtcggtggtcgtcttggtggtggtcgtcggtgccttctacatcagggccgccaactactcgccgttcattcccgagcccgaagtccagcaccacggcggcgggctcgatcaatccgtcttctcgttgctgaccggagcccaaggcagccactacggatggtacggcgtgctggccggggcatcgatcgtgttcttcgcgtttatcgggtttgacatcgtggccaccatggccgaggagaccaagcgtcctcaacgagacgtccctcgagggattctcgcgtcgctgggggtcgtgacccttctctacgtcgcggtatcggtggtgctgtcgggcatggttccatacacccaactgcggaccgtaccgggccgcgggccggcaaatctggccaccgcgttccaggccaacggggtgtactgggccagcggcatcatctccgtcggcgcgctggccgggcttaccacggtggtgatggtgttgatgctcgggcaatgccgcgtgctgttcgccatggcgcgcgacggcttggtgccgcggcaattggccaagaccggttcgcgcggcaccccggtccgggtcacggtgctggtcgcggtgttggtggccacgacggcgtcggtgtttccgatcaccaagcttgaggagatggtcaacgtcgggacactgttcgcgttcatcctcgtctcggccggagtggtcgtgctgcgccggacccgacccgaccttcagcgggggttcacagctccgtgggtgccgttacttccgatcgccgcagtgtgcgcgtgcctgtggctgatgctgaacctcaccgcgttgacttggatccggttcgggatctggctggtggccggaaccgcgatttatgtcggctacgggcgccggcactcggcgcagggccttcggcaagctcgagagagcgcgacccggaggtgttga

SEQ ID NO: 36379 - protein, 495 aa, Mycobacterium tuberculosis CDC1551
MAGRRRMKSVEQSIADTDEPTTRLRKDLTWWDLVVFGVSVVIGAGIFTVTASTAGDITGPAIWISFLIAAATCALAALCYAEFASTLPVAGSAYTFSYATFGEFLAWVIGWNLVLELAMGAAVVAKGWSSYLGTVFGFGNGTGHLGSLQLDWGALVIVTLVATLIALGTKLSSRFSAVVTAIKVSVVVLVVVVGAFYIRAANYSPFIPEPEVQHHGGGLDQSVFSLLTGAQGSHYGWYGVLAGASIVFFAFIGFDIVATMAEETKRPQRDVPRGILASLGVVTLLYVAVSVVLSGMVPYTQLRTVPGRGPANLATAFQANGVYWASGIISVGALAGLTTVVMVLMLGQCRVLFAMARDGLVPRQLAKTGSRGTPVRVTVLVAVLVATTASVFPITKLEEMVNVGTLFAFILVSAGVVVLRRTRPDLQRGFTAPWVPLLPIAAVCACLWLMLNLTALTWIRFGIWLVAGTAIYVGYGRRHSAQGLRQARESATRRC

SEQ ID NO: 36380 - DNA, 1254 bp, Sulfolobus solfataricus P2
  CDS (1)..(1254)
atgagtgaaaagaaactactgaccttttggcaagctttattcattggtttaggaaacataataggagctggtatattcgttatggcgggttcgacgataagcgtcgctgggcctggagcaataatagcctttatatttactgcaattttcgcaatgtcaattggattaaatagtgcagaattatcctcgattttcactgacgttgaaggaggagtttacagttttaccttaaagaccttaggggaaatgtccggattcctagtgggttggtttagggtaatatcatatgtaattggcggagctgcaactgctctaggcttttcgggctatctcctactatttggtctacccaaaacgctttactacactttagctgtgatactcatcgtaatcttactggttttggactatttcgggatagggacagttgctgaagtcgatacgatatttgtgataataaacatttcaagtctaatactcttctcattaacaatccccattatagtagggataaaagtacataatttcgtaccgttgtttccccatggaatacaaggagtattgacaacgtcgaatttggcctttttctcctattccggctttaacacaattgtcacactaacgccatcaactaaaaacggtgaaaaggtaatcccaagggcgattgtgatgtcgttaataataacctcaataatctatatctcagttatattctccatggttgacgcaatgccttggtactattacggtcaaacttcagcccctctctccttagccctatcccaaattcacgctcccacatggttgttcctaattacttcaatatcagcaatcctagcaactattagcgtaaccttatccatcattgttgccagtgaaaggactttaaggcaattgtcaagggatttccaattaccagtaaaacacgagctattagttgtaggtgggataatgttagcatcgctactattagggaacgtggaggcaatagcgttagccagtaatttcgggatcatattttcctatatgcttactggtctggaagtcataattgtcagaaggaaaggtctaaggggaagtttcagatctcccgcttttccagtaatccaagttttcgcaataatactttcagcactattcatgatttcactcggcttaaactctttggaaataggtgttgttacgctatttataggaattttagtgtatgaaacgttaagggaagtgaaagcacatgagaataggaaaaagtga

SEQ ID NO: 36381 - protein, 417 aa, Sulfolobus solfataricus P2
MSEKKLLTFWQALFIGLGNIIGAGIFVMAGSTISVAGPGAIIAFIFTAIFAMSIGLNSAELSSIFTDVEGGVYSFTLKTLGEMSGFLVGWFRVISYVIGGAATALGFSGYLLLFGLPKTLYYTLAVILIVILLVLDYFGIGTVAEVDTIFVIINISSLILFSLTIPIIVGIKVHNFVPLFPHGIQGVLTTSNLAFFSYSGFNTIVTLTPSTKNGEKVIPRAIVMSLIITSIIYISVIFSMVDAMPWYYYGQTSAPLSLALSQIHAPTWLFLITSISAILATISVTLSIIVASERTLRQLSRDFQLPVKHELLVVGGIMLASLLLGNVEAIALASNFGIIFSYMLTGLEVIIVRRKGLRGSFRSPAFPVIQVFAIILSALFMISLGLNSLEIGVVTLFIGILVYETLREVKAHENRKK

SEQ ID NO: 36382 - DNA, 1401 bp, Clostridium acetobutylicum ATCC 824
  CDS (1)..(1401)
atggagatttttagaaagaagactgctgaggattttcaagatgaagccagcagtagtaatcttaaaaggggacttacaagttttgatcttgcggcgatagggataggcgctgtagttggaacaggaattttcgtatccactggacaaggagcaaaattagcaggtccatctgtagtgatttcatttttagtagcagctgtaacctgtggattatgttctcttacgtattgtgaactttcatctatgttttctgtatcaggaagcacatattcgtattcatatattgcttttggagaaattatagcatggataataggttgggatttaatgcttgagtatttggtagcggcttcagcaatttcttcaggatggtccagcacgcttattggtatagtaaaaaactatggagtaaatgtgccagatgctcttacaaaatcacctttatcaggtggaattgtagatttaccagcaatttttataactttggtaataacgtttctattatacagaggagttacagaaagtgctaagataaataatgtaatagttggagtgaagatatgtataatagctctctttgtatttttaggaattactcatgttaaggttacaaattatcatccttttgtaccatatggtgttaatggaataatgtcagcggctgcaataatatttttctcatttatagggtttgatgccatagcaacaactgctgaggaaacaaaagatcctaaaaaggatgtgcccaaaggacttcttatatgttttggagtagttgttgtgttatatatgtcagtagctataatactcacaggaatagttccttatactaaaattgatataaataacgcattaccaggagccttatctagcataggtataacatggggatcagcgcttgttggagttggtgcagtattaggtatgatttcaactttattagttataatgtatggtcagataagaatatttatggttatgtcaagagatgggctccttccaaaggtattctcaagcgtaaacaagaagcacagtactccgggattatgcacggtaataacaggagtgttggtatccataatagcaggtttcttgcctctaaaaatgataatggagctttgtaatataggaactttatttgcgttcatacttgtatcttttggggtaatagttttaagatatactatgcctaatgttgaaagaaagtttaaatgtccaggagttccatttactcctttagtaacagcattcttctgcttttacatgatgattcatcttccgctgtttacatggttaagattcggtgcatggcttcttatagggtttgtaatttattttgtttatggttctaagcatagtaaaatgacagctagggatagaggtaaagaagaagtaagctga

SEQ ID NO: 36383 - protein, 466 aa, Clostridium acetobutylicum ATCC 824
MEIFRKKTAEDFQDEASSSNLKRGLTSFDLAAIGIGAVVGTGIFVSTGQGAKLAGPSVVISFLVAAVTCGLCSLTYCELSSMFSVSGSTYSYSYIAFGEIIAWIIGWDLMLEYLVAASAISSGWSSTLIGIVKNYGVNVPDALTKSPLSGGIVDLPAIFITLVITFLLYRGVTESAKINNVIVGVKICIIALFVFLGITHVKVTNYHPFVPYGVNGIMSAAAIIFFSFIGFDAIATTAEETKDPKKDVPKGLLICFGVVVVLYMSVAIILTGIVPYTKIDINNALPGALSSIGITWGSALVGVGAVLGMISTLLVIMYGQIRIFMVMSRDGLLPKVFSSVNKKHSTPGLCTVITGVLVSIIAGFLPLKMIMELCNIGTLFAFILVSFGVIVLRYTMPNVERKFKCPGVPFTPLVTAFFCFYMMIHLPLFTWLRFGAWLLIGFVIYFVYGSKHSKMTARDRGKEEVS

SEQ ID NO: 36384 - DNA, 1404 bp, Streptococcus pneumoniae R6
  CDS (1)..(1404)
ttggagtcaaagatgaatatatttagaacaaagaatgttagtttagataaaacagagatgcataggcatttgaagttatgggatttgattttgctgggtattggagccatggtagggacaggtgtttttacaatcacaggtactgcagctgctacacttgctggtccagcactagtgatttcaatcgttatttctgccttgtgtgtgggattatcagccctcttttttgcagaatttgcctcgcgagtacccgctacaggaggtgcctatagttacctctatgctatcttaggagaattccctgcctggttggctggttggttaaccatgatggagttcatgacagccatatcaggcgtagcttcgggttgggcagcttattttaaaggcttgctctctcaatacgggatagcccttcctcaggctttaaatggtacctttaatcctcaagcagggacatttgttgatttattgcctattcttgtcttggtcttggtgacttcgcttgttttactaaatgccaaggcagccttacgctttaattcgattctagttattttgaaattttccgctttagctctctttgttttagtaggaatttggaatattaagtttgataattggagcaattttgctccttacggttttggacaaatctatggagctagtactggtattatggctggtgcgtccttgatgttcttcggttttttgggatttgaatccatctctatggctgtagatgaagtcaagactcctcaaaaaaatattcctagagggattgtcttatcgctttctatcgtaaccattctctatgccttggtgacccttgttttgactggtgtggttcactatagtcatttaaatgtcgatgatgccgttgcctttgcccttcgtagtgttgggattagttgggcagccaactatgtgtcattagtggctatcttgaccttgattacagtttgtatttcgatgacctatgccctatcgcgtatgatttacagtttagcacgtgacggcttagtgcctgctgcctttaaggaactgacgaagactagcaaggtaccaaagaatgctactatcttgacaggtctagcttcagcagtagcagcaggaatgttcccactagccagtattgcagcctttttaaatatttgtaccttagcctacttgatcctgctggcttatggtctgattcgcttacggaaagaaaaaggaatgcccaaagctggggaatttaaaacaccattggtacctctgttaccaattttatcgatcatcatttgtttatccttcatgttacagtataatgtgaacacctggattgctttcctagttgcgttgttagtaggaagtattatttacttcacttatggctataagcattctaccatagaagaataa

SEQ ID NO: 36385 - protein, 467 aa, Streptococcus pneumoniae R6
MESKMNIFRTKNVSLDKTEMHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIALPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKVPKNATILTGLASAVAAGMFPLASIAAFLNICTLAYLILLAYGLIRLRKEKGMPKAGEFKTPLVPLLPILSIIICLSFMLQYNVNTWIAFLVALLVGSIIYFTYGYKHSTIEE

SEQ ID NO: 36386 - DNA, 1398 bp, Rickettsia conorii str. Malish 7
  CDS (1)..(1398)
atgagttttttaaggaagaaaagttttgaatcagtaaaagagataggcagttcaagtggtcttagcaagacacttggagcattcgatttaatattactgggtcttggtgcgatgatcggcacaggcgtattcgtcgttaccggtataattgctgctaaatattcaggacctgcagtaatgttatcttatgcgattgcaggtattacctgtatctttgtagcgcttgtttatactgaacttgctgcaatgcttccgacatcaggaagtatttacacttattcctatgtagcatttggcgaagtatttgcttggatgatcggtagtgttataatattagaacttggtgttgctgcaggaatagtagctgcaggctggtcgggctacgtacaaggaatactagcagcaggtggaatcaatttaccgaaagaattaactactgtaccgacaaacggcggtataataaatttaccggcatttttaatctcgggatttattggatttattttatatttaggtactaaagatagtaagagactaaatgcaattttagttttcataaaaatgactgcaatatttgtatttatactcgctgctgcccctcattttgatgctactaactggagtaattttatgcctttcggttttagtaatgttttagtaggtgcgtctattttattcttagcttttacgggttttggaacgattgcaaccgcagctgaggagtgtaaaaacccaaaacgcgatataatgatcggtattattggctcacttgttctaactactatagtttatgtaacaatggcagggcttgttaccggtattgcaccttttgatcagttaaataacgatcaaccgcttgcttatgctttaactatcaataatagcaagatcggctctgctattgttgcaaccggagcagtttgcggtatgatgacggtgttgatgatgaatatttacggtacttctcgtattttttatgctattgcacgtgacggtttactaccgaaaagttttgcaaagctgcacccaaaatatgatagtccgtatattacgattataatatttgcttctttagccgctatccttggaggattttgttctacggaattattaacgcaattaacttcaatgggagctcttattgattatataaccgttacaataatagtggtattatttagggtcacgctacctgatgctcaaagaccttttagatgtcctttagtatttattatcgtaccgtttattttaattgcttgtgcatatttactatttattcaaatatatgacggtgaatttaatctattaaccgcaggtcgtgcattaatatattggtttattacaatatttgttttatatattataagatcgttttttatgcaaaaagagcagaattaa

SEQ ID NO: 36387 - protein, 465 aa, Rickettsia conorii str. Malish 7
MSFLRKKSFESVKEIGSSSGLSKTLGAFDLILLGLGAMIGTGVFVVTGIIAAKYSGPAVMLSYAIAGITCIFVALVYTELAAMLPTSGSIYTYSYVAFGEVFAWMIGSVIILELGVAAGIVAAGWSGYVQGILAAGGINLPKELTTVPTNGGIINLPAFLISGFIGFILYLGTKDSKRLNAILVFIKMTAIFVFILAAAPHFDATNWSNFMPFGFSNVLVGASILFLAFTGFGTIATAAEECKNPKRDIMIGIIGSLVLTTIVYVTMAGLVTGIAPFDQLNNDQPLAYALTINNSKIGSAIVATGAVCGMMTVLMMNIYGTSRIFYAIARDGLLPKSFAKLHPKYDSPYITIIIFASLAAILGGFCSTELLTQLTSMGALIDYITVTIIVVLFRVTLPDAQRPFRCPLVFIIVPFILIACAYLLFIQIYDGEFNLLTAGRALIYWFITIFVLYIIRSFFMQKEQN

SEQ ID NO: 36388 - DNA, 1638 bp, Staphylococcus aureus subsp. aureus Mu50
  CDS (1)..(1638)
atgaataaagacaagcaattgcacaacgacaaaatcaatctatcccaattagtcttattagggttaggctctttaataggatctggttggctatttggtgcgtgggaagcatcatcaatagctggaccagtagcaatcatatcatgggttcttggattcctagtcattggaaccattgcctataactacattgaaatcggcacaatgtttcctcaatcaggtggcatgagtaactatgcccagtatacacatggctcattattaggctttattgctgcttgggcgaattgggtgtctttggtgacaataatacctatcgaagctgtgtcagctgttcaatatatgagttcttggccgtggcattgggcgaaaccaatgagatatttaatggaaaatggctctattagcacatacggattgctagctgtatatctcatcattgttattttttcattattaaactattggtccgtaaaacttttaacatcatttacgagtttaatttctgtatttaaattaggcgtacccatgttaaccatcatcatgttgatgttatcaggattcgacacttcaaattacggccattcggcaagcacatttatgccttacggaagtgcaccgatttttgctgcaacaacagcatcagggattattttttcattcaattcattccagacaattattaatatgggttcagaaattaaaaatcctgaaaaaaatatcgcaagaggcatcgctatttcactgtcaatcagtgcagtgttgtacatcattttacaaagtacgtttatcacttctatgcctcaatcaatgttacaacatagtggatggaatggcatcaacttcaattcaccatttgcagatttagctatcttattaggaattaattggctcgcaattttactatatattgaagcttttgtatcaccattcggtactggcgtgtcatttgtcgccgttacaggtcgagttttacgagcaatggagaaaaatggacatatccctaaatttcttgggaagatgaatgaaaaatatcatatcccacgtgtagcaatcatctttaatgccatcattagtatgattatggttacattatttagagattggggtacgctagcagcagttatttctactgcaactttagtagcctatttaactggcccaacgacagtgattgcattaagaaaaatgggaccaacaatgactcgtccatttagagcaaaaattttaaaagtaatggcaccattatcatttgtattagcttcattagctatatattgggcaatgtggccaacaacggctgaagttattttaatcattatacttggattaccaatctacttcttctatgaataccgtatgaattggcgtaatacaaagaaacaaattggtggtagcttatggattattgtatatttaatcgtgctatcaatactgtcatttataggaagcaaagaatttaaaggcttaaatatgattcactatccatttgactttatcgttattattgttgtggcgcttatattctattacatcggtacaacgagttcatttgaaagcgtctatttccgtcgcgcaacacgaatcaatacaaagatgcgcgagtcactaaataatgaatcaaagtcatctcattaa

SEQ ID NO: 36389 - protein, 545 aa, Staphylococcus aureus subsp. aureus Mu50
MNKDKQLHNDKINLSQLVLLGLGSLIGSGWLFGAWEASSIAGPVAIISWVLGFLVIGTIAYNYIEIGTMFPQSGGMSNYAQYTHGSLLGFIAAWANWVSLVTIIPIEAVSAVQYMSSWPWHWAKPMRYLMENGSISTYGLLAVYLIIVIFSLLNYWSVKLLTSFTSLISVFKLGVPMLTIIMLMLSGFDTSNYGHSASTFMPYGSAPIFAATTASGIIFSFNSFQTIINMGSEIKNPEKNIARGIAISLSISAVLYIILQSTFITSMPQSMLQHSGWNGINFNSPFADLAILLGINWLAILLYIEAFVSPFGTGVSFVAVTGRVLRAMEKNGHIPKFLGKMNEKYHIPRVAIIFNAIISMIMVTLFRDWGTLAAVISTATLVAYLTGPTTVIALRKMGPTMTRPFRAKILKVMAPLSFVLASLAIYWAMWPTTAEVILIIILGLPIYFFYEYRMNWRNTKKQIGGSLWIIVYLIVLSILSFIGSKEFKGLNMIHYPFDFIVIIVVALIFYYIGTTSSFESVYFRRATRINTKMRESLNNESKSSH

SEQ ID NO: 36390 - DNA, 1449 bp, Staphylococcus aureus subsp. aureus Mu50
  CDS (1)..(1449)
atgggaagttttttcaataaaatagcacgaaaagaggatccggctatctatcaaaataaagatggtcatttaaagcgtacacttcgggtgcgtgatttcttagctttaggtgtaggaacaattgtatcgacatctatctttacgctacctggcattgttgctgcagaacatgcaggaccggccgttgcgttatcattcttactcgctgctattgttgctggtttagttgcatttacttatgcagaaatggctgccgctatgccatttgcaggttcagcctattcttgggtcaatgtattatttggtgaattttttggatgggttgccggttgggctctattagctgaatattttatcgccgtagcctttgttgcatcaggattctcagcgaatttacgcggacttgtgaaaccaattggcatcgaattacctgcagcattatcaaatccatttggtacgaatggcggttttatcgatattattgctgctatcgttattttattaactgcattattactatcacgtggtatgtcagaagcagcacgtatggaaaacattttagttattttaaaagtattagctattattttatttgtcatcgtaggtttaacagcaataaatgttagtaactatgtgccatttattccagaacacaaagtaactgctacaggtgactttggtggatggcaaggcatatatgctggtgtttcaatgattttcttagcgtatatcggtttcgattctatcgcagcaaactcagcagaagcacttgaccctcaaaagacaatgcctagaggtattcttggttctttaagtgttgctatcgtattatttattgctgtagcacttgtgttagttggtatgttccattactcacaatacgcaaacaatgctgaacctgttggttgggctttacgtcaaagtggtcatggtgttgtagcagctattgttcaagctatctctgttatcggtatgtttacagcattaattggtatgatgttagcaggctcacgtttactttattcatttggacgtgacggcttattaccttcatggttaagccatttaaacgacaaacatttacctaatcgcgcactagttatacttactattattggtgttttaattggttctatgttcccattcgcatttttagcacaattaatttcagcaggtacacttgttgcatttatgttcgtttcattagcaatgtatcgtttgagaaagcgtgaaggtaaagatctaccaattcctgcatttaaattacctttatatcctgtgttaccagcaattacatttgttttagtattgctagtattctggggattaggattcgaagcgaaattatacactttaatttggtttattgttggtatcattctatatttaagttatggacttagacattctaagaaaaatgatgtagctgaataccacccaccaaaataa

SEQ ID NO: 36391 - protein, 482 aa, Staphylococcus aureus subsp. aureus Mu50
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSVAIVLFIAVALVLVGMFHYSQYANNAEPVGWALRQSGHGVVAAIVQAISVIGMFTALIGMMLAGSRLLYSFGRDGLLPSWLSHLNDKHLPNRALVILTIIGVLIGSMFPFAFLAQLISAGTLVAFMFVSLAMYRLRKREGKDLPIPAFKLPLYPVLPAITFVLVLLVFWGLGFEAKLYTLIWFIVGIILYLSYGLRHSKKNDVAEYHPPK

SEQ ID NO: 36392 - DNA, 1278 bp, Sulfolobus tokodaii str. 7
  CDS (1)..(1278)
atggaggagaaaaaactttctctttctcaagcattagcattaggtttaggtaatattatcggtgctgggatttttgttatggccggtgttagtataactgcagcaggtccagctgccttacttgcgtttttaattactgcagtttatgcaatgagtgttggattaaataatgcagagctggcttctgtttttcctaaagttgaaggaggagtatatagttttgctttactctctttaggagaaactattggatttttagttggctggttcagagttattggctatgcaataagtggtggagctactgccttaggtttttctgggtatctaattactacattctctctcccatcttttctttatttcctcttagcaatcttactcataattgttttgattataattgattatctcggattaaaattagctgcagaaattgaaagtatattagtagttttgaacattttaggtttagtaatcttttctataacagcattagttattagcggtataagattacaaaacttttcgcctttccttcctcatggaataactggagttctgacggcttcaaacatagcattctttgcctattctggatttaacacaattgcaacgttaactccctctgttaaagagggagaaagaacggtacctaaagctatagtcctttcattgctaattagtgccttcttatatatgttagtaactttctccatggttgatgctataggttataaaaacttcaaaactaattccgcccctctacaactagttttaagcacaatccatgctccgttttatgtttatttttttgttaatttaactgcaattttggctacgattacagtcacgctttcaactattatagctacagagagaacaatggttcaaatggaattggataatcttttacccaaagtaaaaggtggaaaactctctatcttgttaatcatcggattagttatgatcgcttccttaggtttaggaaatgtagaggtaatagctttagtatcaaattttggtattgtcttttcttatatgttatctggtatcgaagttgctgtagttagacataggggtttaagaggagtatttaagtctccaggatttccgtttgttcaaataatctccgttattctctctggtgttttcatttattcattaggttttcagtcgttacttataggttttgttacccttcttattggtttagtgattcactcaatacataaggagataatgaagaaggaaggcatattttctaggaagaaataa

SEQ ID NO: 36393 - protein, 425 aa, Sulfolobus tokodaii str. 7
MEEKKLSLSQALALGLGNIIGAGIFVMAGVSITAAGPAALLAFLITAVYAMSVGLNNAELASVFPKVEGGVYSFALLSLGETIGFLVGWFRVIGYAISGGATALGFSGYLITTFSLPSFLYFLLAILLIIVLIIIDYLGLKLAAEIESILVVLNILGLVIFSITALVISGIRLQNFSPFLPHGITGVLTASNIAFFAYSGFNTIATLTPSVKEGERTVPKAIVLSLLISAFLYMLVTFSMVDAIGYKNFKTNSAPLQLVLSTIHAPFYVYFFVNLTAILATITVTLSTIIATERTMVQMELDNLLPKVKGGKLSILLIIGLVMIASLGLGNVEVIALVSNFGIVFSYMLSGIEVAVVRHRGLRGVFKSPGFPFVQIISVILSGVFIYSLGFQSLLIGFVTLLIGLVIHSIHKEIMKKEGIFSRKK

SEQ ID NO: 36394 - DNA, 1386 bp, Bacillus subtilis subsp. subtilis str. 168
  CDS (1)..(1386)
atgagttcattatttagaaaaaaaccgcttgaaacattgagtgcgcagagcaagtcaaaaagccttgcccgtacgttaagcgcatttgatttaaccttgctcggtatcggttgtgtcatcggtacagggatttttgtcattacaggaacagtggcagcgaccggtgcaggtcccgccctcatcatatcgtttattttagcggggctcgcctgtgcgctggctgctttctgttatgctgagttttcgtcttccattccgatttcgggaagcgtgtactcatactcatacgtgacacttggagagctgctcgcctttttgatcggatgggatctcatgcttgaatatgtcattgcactgtcggcggttgccaccggctggtcttcatactttcaatcactgcttgccggcttcaatcttcatattccggctgcactgacaggagcgccgggaagcatggcgggcgccgtatttaaccttccggctgcggtgatcattctcctcatcactgcgattgtcagcagaggcgtcaaggaaagcacacgctttaacaacgtcatcgtactgatgaaaatcgcgatcatattattgttcattattgtcggcatcggctatgtgaaaccggataactggtctccttttatgccattcgggatgaaaggcgtcatacttagcgctgccactgtattcttcgcgtaccttgggtttgacgcggtttctaacgcatcagaggaagtgaaaaatccgcaaaaaaacatgcccgtcggcattatttcagctctagccgtctgtacggttctgtacatcgcggtatcgcttgtgctgacaggcatgatgccttatgccaaattgaatgtcggagatcctgtatcctttgcgctgaaattcgtcggacaggacgctgttgccggaattatttctgtcggtgcgattatcgggattacgacggtgatgctcgctttgctgtacgcacaggtccgcttgacatttgccatgagcagagacggccttctgcctggattgttcgcaaaggttcatccgtcatttaaaaccccgttccgcaacacatggctgacagggatcgttgcagcgggaatcgccggctttattaacctcggaacgctggcccatctggtgaacatgggaacacttgccgcgtttacggtcatttccattgctgtcattgtgttaagaaagaaacatcctgaaatcaaagcgtccttcagagtgccattcgttccggttgtgccgattatcagcgcaggcatctgcctttggttcatgtacagccttcccggcgtcacatggctttcatttgtcatctggatcgctgtcggaacgctggtttacttcctatattcgagaaaacacagcttattaaacaaataa

SEQ ID NO: 36395 - protein, 461 aa, Bacillus subtilis subsp. subtilis str. 168
MSSLFRKKPLETLSAQSKSKSLARTLSAFDLTLLGIGCVIGTGIFVITGTVAATGAGPALIISFILAGLACALAAFCYAEFSSSIPISGSVYSYSYVTLGELLAFLIGWDLMLEYVIALSAVATGWSSYFQSLLAGFNLHIPAALTGAPGSMAGAVFNLPAAVIILLITAIVSRGVKESTRFNNVIVLMKIAIILLFIIVGIGYVKPDNWSPFMPFGMKGVILSAATVFFAYLGFDAVSNASEEVKNPQKNMPVGIISALAVCTVLYIAVSLVLTGMMPYAKLNVGDPVSFALKFVGQDAVAGIISVGAIIGITTVMLALLYAQVRLTFAMSRDGLLPGLFAKVHPSFKTPFRNTWLTGIVAAGIAGFINLGTLAHLVNMGTLAAFTVISIAVIVLRKKHPEIKASFRVPFVPVVPIISAGICLWFMYSLPGVTWLSFVIWIAVGTLVYFLYSRKHSLLNK

SEQ ID NO: 36396 - DNA, 1464 bp, Halobacterium salinarum NRC-1
  CDS (1)..(1464)
atgagcagcagccaaacgcgatcccccgacgccgaactcggattgctcgacgccacgatgatcggcatgggggcgatgatcggtgccgggatcttcgttttgaccggcctcgcggccgaaatcgctgggccggccgctatcctcgtgttcgcgctgaacggcgtcgtcaccgcgttcaccggactctcgtacgccgaactcgcggcctcgatcccgaaaagcggcggcggctacgcgttcgtgcgcgagatcttcggcgatttctcctcgttcatcatggggtggatgctgtggttcgcgtacatgatcgcgggcgcgctgtacgcactcgggttcgcgcccaacttcctcgaactgctgcacgtctacggcctggtggccccaccggaccaggtcggcgcgatcgccgtcccgctgctcgacgcctcagtgcccgccgcgttcgtgctggcgttcatcgcagtgctcggactggtggcgcttaacgccgtgtccacagcggcaagcgggagcgctgaaaccatcttcacgatcatcaaagtgagcatcctggtggtgttcgtggcgttcggcgcgacgtccccgctgttctccggggccgaattccagccgctgttcggagtgggtggcggcccggcggcgatcctgcccgccatgggactgacgttcatcgccttcgagggctacgacctcatcaccaccgtcacggaggaagtcaaaaacccccgcgagaacatcccgaaggcgatcttcgtgagcctgatcgcgaccgtgatcgtctacctggcagtcgtcaccgtcgccgtcggcacgctcggcgctgacggcctggcggcggccggcgaagcgggcatcgcggaggcagccacgtcgttcatgcccaccggactgccgatcatccagaacggcggcgcactcatcgtcttcggcgcggtgttctcgacgctcacggcgctgaacgcggtcgtgatcgcgtcctcacgggtcgcattctcgatgggccgtgaggggcaactgctcccgtcgttcggccagatccaccaccgctacgggacgccgttcgtcgcgatcatcgccagcgcggtggtgatgttggcgtcggtcgcgttgcccacgcagagcgccggcaacatgtccagtctgttcttcctgctgtcgttcatcatcgtcaacgtcgccgtcatcagactgcgccgcgagcgccccgacatgaaccggccttacgagatgccgttctatcctgcgccgccactcatcggcatcgcgctcaatctcgtgttgtccgtcgtgctggtcgactacctcgtgcgcacggatccgcttgcgttggcgctcagcgcggcctggatcgttctggggacggctgcctactacgcacacgccagccggcagtcggccgccggcgacgacgaggacaccacgactatttcggcggacgccgaacacacgccacatgaccactaa

SEQ ID NO: 36397 - protein, 487 aa, Halobacterium salinarum NRC-1
MSSSQTRSPDAELGLLDATMIGMGAMIGAGIFVLTGLAAEIAGPAAILVFALNGVVTAFTGLSYAELAASIPKSGGGYAFVREIFGDFSSFIMGWMLWFAYMIAGALYALGFAPNFLELLHVYGLVAPPDQVGAIAVPLLDASVPAAFVLAFIAVLGLVALNAVSTAASGSAETIFTIIKVSILVVFVAFGATSPLFSGAEFQPLFGVGGGPAAILPAMGLTFIAFEGYDLITTVTEEVKNPRENIPKAIFVSLIATVIVYLAVVTVAVGTLGADGLAAAGEAGIAEAATSFMPTGLPIIQNGGALIVFGAVFSTLTALNAVVIASSRVAFSMGREGQLLPSFGQIHHRYGTPFVAIIASAVVMLASVALPTQSAGNMSSLFFLLSFIIVNVAVIRLRRERPDMNRPYEMPFYPAPPLIGIALNLVLSVVLVDYLVRTDPLALALSAAWIVLGTAAYYAHASRQSAAGDDEDTTTISADAEHTPHDH

SEQ ID NO: 36398 - DNA, 1527 bp, Yersinia pestis CO92
  CDS (1)..(1527)
atgtcaggaaaacactctgcggagacccatcacgccgcgaaaaaacgctggttagattctcatgatacgggttaccacaaaagtatgggcctacgtcatatacaaatgatagccattggcggatccatcggaacaggactgtttttaggtacaggtgcccgcttacaaatggctgggccagcattagcactggtttatctggtttgtggaattttttcatttttcattctccgggccttgggggaactggtcttacatcgccctaccagcggcagctttgtttcttacgcccgtgaatttctcggagaaaaagcatcctatgtcgcgggctggatgtacttccttaactgggcgatgacaggcatcgtcgatatcaccgcagtggcgctttatatgcattattgggggacattttctgatgttccgcaatggctgtttgccctaggcgcactctcgattgtcgctaccatgaatatgattggagtaagatggttcgccgaaatggagttttggtttgcactgattaaagtcgccgctattgccctgtttttgattgtcggtgtgatcttcctcggtacgggtcaaagcgtcgcgggtcatacaactggtattcatttgattaccgacaacggcggtttctttcctcacggcctcttacctgccctgataatggtacaaggcgttatattcgccttcgccggtattgaattaattggcactgcggctggtgaatgtaaagaccccgaaaaaatgctgcccaaagccattaatagcgtgatatggcgtataggtttgttttacgttggctccgtcgtcctactggtctgcttgctaccctggcatgcttatcaagcgggtcaaagcccattcgtgacattcttcagtaacttgggggtcccttacattggcactattatgaatatagtggtgctatccgccgcactctccagtttgaactccgggctttactcgaccgggcgaatcctccgttcactgtcaatggggggatcggcacctaaatttatgtccaagatgagcccgcaatccgtgccctatgcagggattttggtcactgtgggcatttatgtcttgggggtactactcaactacctcgttccctctcaagtttttgaaattgtcctgaatatagcctccttggggatcattagttcatgggcatttattatcatttgtcagatgaaattacgtcaggcaataaaaagaggaatggcaaaacctgtctccttcaaaatgcccggtgcgccagtgacatcttggctgacattgatctttttggcgggcgttttggtgatgatggcctttgactatccaaatggcacctggaccatcgctagcatacccgtgctcacactgctactgatcgccggatggttcagtctgcgtaaacgcgccaatgaggtagcggccgcaccgatagatgtctggtcacaagaaatattgttcgaagaacctgatgctcaaaatgtatcgcctaaagagttatatgagcaaaaatcagtaggttaa

SEQ ID NO: 36399 - protein, 508 aa, Yersinia pestis CO92
MSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 36400 - DNA, 1392 bp, Yersinia pestis CO92; identical to SEQ ID NO: 9051
  CDS (1)..(1392)

SEQ ID NO: 36401 - protein, 463 aa, Yersinia pestis CO92; identical to SEQ ID NO: 9052

SEQ ID NO: 36402 - DNA, 1551 bp, Escherichia coli K12
  CDS (1)..(1551)
ttgttcatggcaacttatatgactttttcattaaagcaatcagggagagcaatgagtaaacacgacaccgacacttcagatcaacacgccgcgaaacgccgctggcttaatgcccacgaagaggggtatcacaaagcgatgggcaatcgccaggtgcagatgatcgccattggcggcgcgattggcaccggcttgtttttaggtgcaggagcccgactgcaaatggcggggcccgcactggcactggtttatttaatttgtggcttgttttcgttttttattctgcgtgcattgggtgagctggtgctacaccgcccttccagtggcagttttgtttcttatgcccgtgagtttttgggtgagaaagccgcttatgttgctggctggatgtacttcatcaactgggcgatgacggggattgttgatattaccgccgtcgctctgtatatgcattactggggtgcgtttggcggcgtgccgcagtgggtctttgcgctcgctgcacttaccatcgttggcaccatgaatatgatcggtgtgaaatggtttgcggagatggagttctggtttgcgcttattaaagtgctcgccattgtgacctttttggtcgtgggtacagtgttcctcggtagtggtcagccgctggatggcaacaccactggctttcatttaatcaccgataatggcggcttcttcccccacggtttgctgcctgcgctggtgttgattcagggcgtagtgtttgcttttgcctccattgaaatggtgggtacagctgccggagaatgtaaagatccgcagaccatggtgcctaaagccattaacagtgtgatttggcgtattggcctgttttacgtcggctccgtggtgttgctggttatgttattgccgtggagcgcgtatcaggcggggcaaagtccgttcgtgacgtttttctctaaactgggtgtgccatatatcggcagcattatgaacattgtggtgctgaccgctgccctctccagcctgaattcaggtctgtactgcaccggacgtattctgcgctcaatggcgatgggcggttccgcaccgagttttatggcgaaaatgagtcgtcagcatgtgccgtatgccgggattctggcgacactagttgtgtatgtcgtcggcgtattcctcaactatctggtgccgtcgcgcgtatttgagattgtgttgaacttcgcgtcgctgggaatcatcgcttcatgggcgtttatcatcgtgtgccagatgcgcctgcgtaaagcgattaaagaaggcaaagcagcggatgtcagttttaaactgcctggcgcgcccttcacttcctggctgacattactgtttttactgagtgtccttgtgctgatggcgttcgattacccgaacgggacttatactatcgcggcgctgccgattatcggtattttgctggttataggctggtttggtgtgcgcaaacgcgttgctgaaattcacagcactgcgccagtcgtcgaggaagatgaagaaaaacaggaaattgtgtttaagcctgaaacggcgagttaa

SEQ ID NO: 36403 - protein, 516 aa, Escherichia coli K12
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 36404 - DNA, 1389 bp, Escherichia coli K12
  CDS (1)..(1389)
atgactgcaaactctcccctacaacgtattggacaagaaaaaggtatcgctatgggaagccaggaactccaacgcaagctcggattttgggccgttcttgcaatcgccgtcgggacaaccgtcggctccggtatttttgtatctgtgggtgaagtggcaaaagcagcgggcacgccgtggcttacggtgctcgcgtttgtcattggcgggttaattgtgatcccgcaaatgtgcgtctatgcggaactatccaccgcttatccggaaaatggcgcagattatgtttatctgaaaaatgccggaagccgaccgctggctttcctctccggctgggccagcttctgggccaacgatgcgccgtcattgtcgattatggcgctggcgattgtcagcaatcttggctttttaacgcctatcgatccgttgctcggtaaatttatcgccgccggattaattatcgcctttatgttgctacacctgcgctccgttgaaggcggcgcagcgtttcagacgctaattaccatcgccaaaattatcccgttcactatcgtcattggccttgggatcttctggtttaaagcggagaattttgccgcccctaccaccactgcgattggcgcaacgggcagctttatggcgctgctggcggggatctctgccaccagttggtcgtataccggcatggcctctatctgttatatgaccggcgaaattaaaaaccccggaaaaaccatgccacgagcgctgattggttcctgtctgctggttctggtgctctacaccctgctggcgctggtgatttccggcctgatgcccttcgacaaactcgccaattctgaaacgccgatttccgacgccctgacctggatccccgcactcggcagcaccgctgggatctttgttgccatcacggcgatgatcgtcattcttggttcgctttccagctgcgtgatgtaccagccgcggctggaatacgcgatggcgaaagacaacctgttctttaaatgcttcggccatgtgcatccgaaatacaacacgccggatgtctccatcatcctgcaaggggcgctggggatcttcttcatcttcgtttccgatctcaccagcctgctgggttatttcaccctggtgatgtgtttcaaaaataccctcaccttcggctccatcatctggtgtcgtaaacgcgacgattacaaaccgctgtggcgtactccggctttcgggctgatgaccaccctcgccattgcgtcaagcctcattctggtcgcctcaacctttgtctgggcaccgattcccggccttatctgcgccgtcatcgttattgctactggtctgcctgcttacgccttctgggcgaagcgtagccgccagctcaacgctttgtcgtaa

SEQ ID NO: 36405 - protein, 462 aa, Escherichia coli K12
MTANSPLQRIGQEKGIAMGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPTTTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTTLAIASSLILVASTFVWAPIPGLICAVIVIATGLPAYAFWAKRSRQLNALS

SEQ ID NO: 36406 - DNA, 1503 bp, Caulobacter crescentus CB15
  CDS (1)..(1503)
ttgcagagcatggcggacgccgaaaccgctgacactttcggctgccatgctctggtcggagggacccccaaagtgagcttctggacgcgccgcaaggccatcgacaccatcaccgctggccatgcggacagccaccaactgaagaagaccctgagctggccgcatctggtggccctgggcgtcggggccattgtcggcaccggcatctacaccctgaccggggtcggggcgggtctggccgggccgggcgtgatcctgtcgttcctgatcgccggcgccgtctgcgcctgcgcggcgctctgctacgccgagctttcgacgatgatcccggcctcgggcagcgcctacacctacagctatgcggcgatgggcgagccggtcgcctggttcgtcggctggagcctgatcctggaatacaccctggtctgcgcggcggtggccgtcggctggtcggctcacgcccatggcctgttcaagatgatcggcttccccgacgccctgctggcgggccctcaccagggcgggctgatcaacatgccggccgtcttcatctcgatggcggtggcgggccttctggccctgggcacccgcgagagcgccacggtcaacatggtgctggtcttcgtgaagatcatcgccctgatcgtctttgtcgtgctctgcctgcccgcgttcaacctggcccacttcacccccttcatgcccaacggcttccaggcccacgtgccggagggcgcggccgccgacgccgccaaggtcggggtgatggcagcggccagcctgatcttcttcgccttctacggcttcgacgcggtttcgaccgccgccgaggagaccaagaaccccaagcgggacctgaccatcggcatcgtcggctcgatggccgtctgcacggcgatctacatgatcgtcgccgccgtctcgatcggcgcctcgcgcaccgaggtcttctccaagagcgaggccccgctggtcttcatcctggagagcctgaaccacggcaagatcgcccagctggtcgccctggccgccgtcatcgccctgccgaccgtgatcctggccttcatgtacggccagagccggatcttcttcgtgatggcccgcgacggcctgctgccccgcgccctgtcgaaggtgaacgccaagaccggtacgccggtgatgatgaccctgctgaccggcgtcctggcggcggtgatctcgggcctcttgtcgctgaaggacatcgcagagctggccaacgccggcacgctgtgggccttcatcgccgtcggcgcctcggtgatcctgctgcggctgcgcgagccgaaccgtccgcgggtgttctccaccccgctgtggccgatcgtggccccggccggcatcctgggctgcctctatctcttcctcagcctgcccgggaagacccagctctacttcctctacgcccacctgatcggggcggtggtctatctggcctatggcatgcgcaagagcgtgctggcccagcaggagcgggcgtaa

SEQ ID NO: 36407 - protein, 500 aa, Caulobacter crescentus CB15
MQSMADAETADTFGCHALVGGTPKVSFWTRRKAIDTITAGHADSHQLKKTLSWPHLVALGVGAIVGTGIYTLTGVGAGLAGPGVILSFLIAGAVCACAALCYAELSTMIPASGSAYTYSYAAMGEPVAWFVGWSLILEYTLVCAAVAVGWSAHAHGLFKMIGFPDALLAGPHQGGLINMPAVFISMAVAGLLALGTRESATVNMVLVFVKIIALIVFVVLCLPAFNLAHFTPFMPNGFQAHVPEGAAADAAKVGVMAAASLIFFAFYGFDAVSTAAEETKNPKRDLTIGIVGSMAVCTAIYMIVAAVSIGASRTEVFSKSEAPLVFILESLNHGKIAQLVALAAVIALPTVILAFMYGQSRIFFVMARDGLLPRALSKVNAKTGTPVMMTLLTGVLAAVISGLLSLKDIAELANAGTLWAFIAVGASVILLRLREPNRPRVFSTPLWPIVAPAGILGCLYLFLSLPGKTQLYFLYAHLIGAVVYLAYGMRKSVLAQQERA

SEQ ID NO: 36408 - DNA, 1641 bp, Caulobacter crescentus CB15
  CDS (1)..(1641)
atgcctgaccggcggaggttcgctggtcgttggggaaacgcacacatggccggaaacaggctatttttgaaaaagtcgatcgcgagcatccagaaggaggccgcgcatagccagcttaagcgtacgctgggtcccatcaatctgatgagcctgggcgtcggcgccatcatcggcgccggcatcttcgtgctgacgggtcaggtggcctcggccaacgccggccccgccatcatgctgtcgttcatcgtcgcgggcatcgcctgcgccctggccggcctgtgctacgctgaactggcctcgaccatgccggtttcgggctccgcctacacctacgcctacggcaccctgggcgaggttttcgcctggatcatgggctggctgctcgtgctcgagtacggcgtggccgcctcgaccgtggcggtcggctggtcgggctatgtggtcagcaccctgcacgccctggggatcaacttcccgatgatccaggtcgccggcgctgacgccccgatgtgggcgacgccgctgatccaagccgtggccgcgcccggcggtggcacgatgttcgccatgaccggcacgctgaacctggtggccgccatcggcatcgccatggtctcggccctgctggtggtcggcgtcagcgagtccgccaacgtcaacaacgccatcgtggtcatcaaggtgatcgtgctggtcacgttcatcgcggtcggcgcgcagtacatcaatccggccaactggcaccccttcatccccgagccgaccggtcagcccggcgagttcggcatcggcggcatcttccgcggcgccgccatcatcttcttcgcctatgtcggcttcgaagccgtttcgaccgccgccgccgaggccaagaacccctcgcgcgacgtgccgatcggcatcctgggcgccctgatcatctgtacgctgatctacatggccgtggccgccgtcatgactggcgtcgtccccttccgtgaactggccagcccggccccgatcgccgtcgctatcgaccgcatgggtctggaatgggccgacatcccgtacgccgcggctgagggcggcaagctgaacctgctcagcttcgccatcaagatcggcgccatcacgggtctgtcgtcggttatgctggtgctgtgctacggccagacccgcatcttctacaccatggcccgcgacggcctgctgccgaaggtgttcgccgagatccaccccaagttccgcaccccctggctgggcaccatcctgctgggcgtggtgatcgccatcgccgcctcgttcctgccgatcagcctgctgggcgatctggtgtcgctgggcaccgccgtggccttctcgatcgtctgcctgtcggtgatctatctgcgcatcaagcaccccgacctgccgcgtccgttcaaggtgccgggcggcatcttcacggcggcggccggcatcgcggcctgcttgttcctgccctatcagaacttccagccgatgatcgttcacgcgatgaacgacaatccgctgccgctgatgatcctgggcggttacgccgccgtcggcgcaatcatctatatcgcctacggctactggcactcgaagctggccaagggtatcgacatcaccgaagagaccgacccgaactcgcccgcctag

SEQ ID NO: 36409 - protein, 546 aa, Caulobacter crescentus CB15
MPDRRRFAGRWGNAHMAGNRLFLKKSIASIQKEAAHSQLKRTLGPINLMSLGVGAIIGAGIFVLTGQVASANAGPAIMLSFIVAGIACALAGLCYAELASTMPVSGSAYTYAYGTLGEVFAWIMGWLLVLEYGVAASTVAVGWSGYVVSTLHALGINFPMIQVAGADAPMWATPLIQAVAAPGGGTMFAMTGTLNLVAAIGIAMVSALLVVGVSESANVNNAIVVIKVIVLVTFIAVGAQYINPANWHPFIPEPTGQPGEFGIGGIFRGAAIIFFAYVGFEAVSTAAAEAKNPSRDVPIGILGALIICTLIYMAVAAVMTGVVPFRELASPAPIAVAIDRMGLEWADIPYAAAEGGKLNLLSFAIKIGAITGLSSVMLVLCYGQTRIFYTMARDGLLPKVFAEIHPKFRTPWLGTILLGVVIAIAASFLPISLLGDLVSLGTAVAFSIVCLSVIYLRIKHPDLPRPFKVPGGIFTAAAGIAACLFLPYQNFQPMIVHAMNDNPLPLMILGGYAAVGAIIYIAYGYWHSKLAKGIDITEETDPNSPA

SEQ ID NO: 36410 - DNA, 1302 bp, Caulobacter crescentus CB15
  CDS (1)..(1302)
atgacggcggtaaggtccaagcctttgggcgtatggatgtgcgcggccctggtcgtcggcaacatgatcggctcgggcgtgttcatgctgccggcgtccctggcgccgtacggctggaacgccgtcatcgcgtggatactgaccatcggcggttcgctgtgcctggcctatgtcttcgccaagctggcgggggcgtttccgcgcgcgggaggaccgttcgcctataccgaggaggctttcggccgcgcgccggggttcctcgtggcctggtcgtactggatctctgtgtgggtcgccaacgcggccatcgccatcgccgcgatcagctatctgagcgtctttctgccggtgatcgccaaggtcccggcgctgccggccctgctcaccgtcgcggtggtctggacggcgaccgcgatcaactgcgccggggcgcgctcggccggctggacccaggtggtgaccacggtgctgaagctggttcccctgatcgcggtggcgggtctggccgtcagcgtcctgcttcggaaagggcccgcggcgatcaccccgttcgagccctcggcgctttccggggcgtccatcaccgccgccgcggcgctgaccctgtgggccctgctgggggtggagacggcgaccattcccgccgacaaggtcaaggacccggcccggacgatcccgcgcgcaaccctggccggcaccgccttcgcgggtctggtctatctcgtggtctcgtcgggcgtgctgctgctgacgccgaccgccgtgctgcaaggctccaacgcgccgtttgtcgacttcgtcagctatcatggcggcggggatttccgcctggcgctggcggccttcgcaacgatcagcgcgctgggcgccctgaacggctggtcgctgatccagggcgagttgccggccgccatggcgcgcgagggcgtgttccccgcctggttcgccaagacctcggccaacggcacgcccgtgcgcgcgcacttggtgtcgagcgtcctggtgacgatcctggtgctgatgaactacgccaagtcgatggccgacgccttcaccttcatggccctgttgtcgacgacctcgaccctgttcgcctacctgttctgctctctggcggtgctgcgattgcaggggcagggacgcatggaccgctccaaggccctgaccctcgtcgcagcgttgggggcgctctattcggtgtggaccttctccggcgcgggatggtcggtcaccctgtggggcctggtgctgctggctgtcggcgcgccgatctactggctgatgcggagagccgcccgatga

SEQ ID NO: 36411 - protein, 433 aa, Caulobacter crescentus CB15
MTAVRSKPLGVWMCAALVVGNMIGSGVFMLPASLAPYGWNAVIAWILTIGGSLCLAYVFAKLAGAFPRAGGPFAYTEEAFGRAPGFLVAWSYWISVWVANAAIAIAAISYLSVFLPVIAKVPALPALLTVAVVWTATAINCAGARSAGWTQVVTTVLKLVPLIAVAGLAVSVLLRKGPAAITPFEPSALSGASITAAAALTLWALLGVETATIPADKVKDPARTIPRATLAGTAFAGLVYLVVSSGVLLLTPTAVLQGSNAPFVDFVSYHGGGDFRLALAAFATISALGALNGWSLIQGELPAAMAREGVFPAWFAKTSANGTPVRAHLVSSVLVTILVLMNYAKSMADAFTFMALLSTTSTLFAYLFCSLAVLRLQGQGRMDRSKALTLVAALGALYSVWTFSGAGWSVTLWGLVLLAVGAPIYWLMRRAAR

SEQ ID NO: 36412 - DNA, 1326 bp, Sinorhizobium meliloti 1021
  CDS (1)..(1326)
atgtcagcaccgtcaagtggcaaaagcctgggtctggccgcctgtaccgccatcgtcgtcggtaacatggttggctccggcttctacctctcgccggcggcagttgctccctacggcaatctcgctatcgtgatttggatcgtgatgggagcgggtgcgatctgtctcgggctgacgttcgcacggctcgcaaagctctctccggcagtcggcgggccttatgcatatacgcgccttgcctatggagactttccgggctttcttatcgcttggggatattggatttccatctgggcgtccctgcccgttatcgccgtggcgttcgccggcgtggtcatcgatttttttccgttcctccgcgggcgcggaacggcgacgctgctcacgttgagcgtgatctggcttgtcgtgctcgtcaacttacgcggcgtccacgcggccgggctcttttcggaaatcaccacctacgctaagatgatcccgttcggggccgtcgcgctgctgggcctgttttacatcgacttctctcactttgccgacttcaatccaagcggccagccgctccttcaggcgagcgctgcgttggcgccgcttaccatgttcgcctatctggggcttgaatctgccacggtgcccgctggcgatgtgcgcgacgccgaacgtacgatcccgcgttcaacggtgcttggaatcgccattgctgtaacgctgtacgttctgggcaccattgtcgttatggggttggtgccgagagaggagctcgtccactcggtggcgccgttctccgaggcagccaggagaatgtggggaccggccggtgagctagcgatttctctcgcagttgtcctgtcatcaatcggagcgctgaacggctggacattgctgatggggcaggtgccaatggcggcggcgcgagacggattgtttccaccgctgttcagccggctctcggcgcgacatgtgccggccacggggattgtcgtttcggcgactctggcgacgattctcgttctcgttcaggcagccggttccgagggcttctcatccatttatcgtctattcgtcggcttgagcacaatgaccgccgttataccttatgcgttctgcgctcttgccagcagtctcgtctccgctcgtgttagcggaggtactctaataccgcgtgtaacccttatcgagcttgttggtttcacttttgcaattttcacgctttacggctgtggtgcggagcctgttctctatggactagtgctgttgttgctgagcatccccgtttatatatggcagcgacggcggagcttcgtaccgggtgatttcggccaatga

SEQ ID NO: 36413 - protein, 441 aa, Sinorhizobium meliloti 1021
MSAPSSGKSLGLAACTAIVVGNMVGSGFYLSPAAVAPYGNLAIVIWIVMGAGAICLGLTFARLAKLSPAVGGPYAYTRLAYGDFPGFLIAWGYWISIWASLPVIAVAFAGVVIDFFPFLRGRGTATLLTLSVIWLVVLVNLRGVHAAGLFSEITTYAKMIPFGAVALLGLFYIDFSHFADFNPSGQPLLQASAALAPLTMFAYLGLESATVPAGDVRDAERTIPRSTVLGIAIAVTLYVLGTIVVMGLVPREELVHSVAPFSEAARRMWGPAGELAISLAVVLSSIGALNGWTLLMGQVPMAAARDGLFPPLFSRLSARHVPATGIVVSATLATILVLVQAAGSEGFSSIYRLFVGLSTMTAVIPYAFCALASSLVSARVSGGTLIPRVTLIELVGFTFAIFTLYGCGAEPVLYGLVLLLLSIPVYIWQRRRSFVPGDFGQ

SEQ ID NO: 36414 - DNA, 1392 bp, Listeria monocytogenes EGD-e
  CDS (1)..(1392)
atgaattcattatttagaagaaaaccgatagaagatttaatgcataataaaagtggtagcacgcatttaaagcaaactctcggaccacttgatttaactttacttggggtcggagcaattgttggaacagggatttttattttaccagggacagtagctgcgaaaaatgcgggaccggcgattattttttccttcgtgattgcagcgattgtttgtgcgattgcagcaatgtgctactcagagtttgcatctagtgttccggttgcagggagcgcctatacgtatggttatgtggtttttggtgagttaattggatggttgcttggttgggcacttattttggaatacgggcttgcagtggcttctgtggcaagtggatggtcttcttatttaaatgcgttactttcaggttttcatatttccatcccggaagcaatctctgggccttttaatccagaagtaggtacatttattaatttaccggcgattattattgttcttgtgattgcctttttattaacgcttgggataaaagaatcaacgcgcgtgaataccattatggtagtaattaaagtcggtgttattttacttttcttagtagttggcgtattttatgtcaaaccggataattggcaaccgtttatgccgtttggaattagtggagttatgaatggcgcggcgctagttttctttgcttatttaggttttgatgccgtttcctccgcggcggaagaagtgaaagatccgcaacggacgatgccgattggaattattgggtcgctacttatttgtacggtgttatatgttgctgtatccgctgttttaactggaatggtgccgtacacagatttaaacgtaactgatcctgtggcttatgccttgcaagtgattaaccaagattgggtagctggcattgtatcacttggcgcagttgttgggatgattacggttattttagtgatgagctacggggctactagactgatttttgcaatgggacgtgatggtttattgccgaaagtacttgcggaaatcaatcaaaaataccaaacacctgttaaaaatacttggattttcgcagtgattgttgcaattattagtgggcttgtgccattggatcgattggctgagttggttaatattggaacactcttggcgtttatgatggtgtctatcgggattatctttttacgtaaaaataaagatattcaagcgagaggatttaaagtaccactttacccagtacttcctattgtttcgttcctattatgtgcgtttttaattagccgtttgtctgttcatacgtggattctttgcggaatttggtttgttattggtttaattgtttactttgcttatggtagaaaacatagtgaattacttaaaaaataa

SEQ ID NO: 36415 - protein, 463 aa, Listeria monocytogenes EGD-e
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIVSLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQARGFKVPLYPVLPIVSFLLCAFLISRLSVHTWILCGIWFVIGLIVYFAYGRKHSELLKK

SEQ ID NO: 36416 - DNA, 1368 bp, Nostoc sp. PCC 7120
  CDS (1)..(1368)
gtgagtagacatacagattacagttcgctagagcaaatacagacgactggtgcagatgcacccaagccattattaacactatcagacgcagttgctctaattgtcgggattgtcattggtgtaggtatttttcaaacccctgcgctggtagctagtcaagctggaagtgatactgcggtactgttgttttggttagctggtggcatagtctctattattggtgcattgtgctacgcagagttggcgacaacttatcctaatgttggtggagcctactattatctaaagcgagcatttggccaaaatactgcctttttatttgcctgggcaaggttgacagtgattcagactggttctattgccttggcggcatttgtttttggtgattatgcgtctgagatttggcggctgggtacattttcatcatcaatgtatgccgcagtgataattgctttattaacgatattaaacatactgggtttacaccagggaaaatggacacaaaatttactgacggcggcgcaagtcttgggtttattgctggtagtcctttttggactagctagcactgctaatagtgctaatagtgctgtatcgccggaaccttcatcctcaggtagttggggactagcaatggtgtttgtactgctgtcatacggtggttggaatgaagccgcgtatatttcggcagagataaaaaacaggcaaagaaatatcttgcgatcgctcatgtggagtattggtattatcacagcaatttacctgctgatcaacctagcttttttgcgaggcttaggattagcaaatatggcaaactcatcagcagttgccgcagacttgatgcgtgctgtctggggtacgccaggtgttgtatttatcagcctcttgattgcgatttgtgctttagggacaatcaatgcctccatttttactggcgcacgtactaactatgccttagggcaagattttaacctgtttggcttcatgggaagttggagacaaatccccagtactcctgcgactgccttattagtccaaggtgcgatcgctcttgccttggttgtattaggcacattcacccgcaagggatttgaaacaatggtggattacaccgcacccgtgttttggttcttctttctactttctggcatatcactattaatattgcgccagaaagaaccacacataccgcgtccgtttcgtgtgcctttttatcctattaccccattactcttttgtgctgtttgtggctacttactatactccagcgtagtttatacaaacgtgggcgctgttgtcggtgttttggtggtgatagcaggtgtcccgttattgttctggaatcgctaccgccaaggtaaggcttag

SEQ ID NO: 36417 - protein, 455 aa, Nostoc sp. PCC 7120
MSRHTDYSSLEQIQTTGADAPKPLLTLSDAVALIVGIVIGVGIFQTPALVASQAGSDTAVLLFWLAGGIVSIIGALCYAELATTYPNVGGAYYYLKRAFGQNTAFLFAWARLTVIQTGSIALAAFVFGDYASEIWRLGTFSSSMYAAVIIALLTILNILGLHQGKWTQNLLTAAQVLGLLLVVLFGLASTANSANSAVSPEPSSSGSWGLAMVFVLLSYGGWNEAAYISAEIKNRQRNILRSLMWSIGIITAIYLLINLAFLRGLGLANMANSSAVAADLMRAVWGTPGVVFISLLIAICALGTINASIFTGARTNYALGQDFNLFGFMGSWRQIPSTPATALLVQGAIALALVVLGTFTRKGFETMVDYTAPVFWFFFLLSGISLLILRQKEPHIPRPFRVPFYPITPLLFCAVCGYLLYSSVVYTNVGAVVGVLVVIAGVPLLFWNRYRQGKA

SEQ ID NO: 36418 - DNA, 1626 bp, Caenorhabditis elegans
  CDS (1)..(1626)
atgtcatcaatagaagatctcccaacagtgggagatgtagccgcaacacgacatcaaatgggattatggtcatgtatgagctatgttatcgcaaacatcatcggcgctggaattttcatcacacctggaacagttctcaaattagccctaacaaatggcatggcacttgtcgtgtggctcggctgtggtctgatctccctgattggcggaatttgttatattgagctaggcacgtcgattcgagatcccggatgtgattttgcatataatgtttacgtcggctgggaaggaatcgcgttctcgttcatgtgggtcggcgtcatcatgtcatttccagcgtcggcggcagttcaagctcaaacttttggacaatatattgtagccggattgtcccccatctggcacctcggttctccatatgacgtcattcttgaaagaggactcggatttgcacttattattattctcaccgttctcaacctctatgcaattgacaagtacgcgtcgaaatttcaaatttttgtcacaattgcgaagctattgtcacttgctattattattgtcaccggattttggtatttaatagtgaagggagaaaccgagcattttaaagacgcattcacacctcttcccaacgaaaaatatgatattggacaaatttccttggcattttacggagcactctggagttttgccggatgggatattctcaactatggaacaccggaaattaagaatccgagaagaacgatgccaatcgccctgctcggcggtatttcggcggtcactctcgtgtatatggcgatgaatgtctcctatatgaccgtcttggatactgaaacactcaaaaatagctcagctgtggccgccgatttcgcccggatcacgctcggcgacttttcctacgcaattccgtttatgatttcgattttgctcattggaactcttaatagcaatattttttgcggttctagatttacacacgcagcagcccgtgaaggacatttgcccacatttctctcgtgtattaatgcagaatcgaatagtccacgtgccgcactacttttccaactgatttgcacaatcgccgtcacttttgtcgatactgagagcctaatcacctacgtaacatttgtaatgttcggccaacgcgtgttcacaatggcggcactattgtggatcagatatcgaaatattcccgtacatcccgacgcaatccgggttccactcatcttttcgattctttttttcatgattaccatcgctcttgtcgtcaccccgtttatcgaggattttacgaccacaatcgtcggcgtcggactggttttgatgggtttcctgttgtatatgatttttatgaaaccgaagcagcttcccggatttctttacagatttaatgacggtataacacgtgtcacgtgtaaaatcctattcacaacgcccgacttgaagcacgcatcggaaattgaaacgctgaaatccgacggtgagcttaaccgtggagagactctttcatcacgatttcataatgaatctgtcgtttcaaacgacgaacgtacaacactctcgacatcacaaatcgacactgccgccgccggcaccgccgagccaatgactcgtctgtaa

SEQ ID NO: 36419 - protein, 541 aa, Caenorhabditis elegans
MSSIEDLPTVGDVAATRHQMGLWSCMSYVIANIIGAGIFITPGTVLKLALTNGMALVVWLGCGLISLIGGICYIELGTSIRDPGCDFAYNVYVGWEGIAFSFMWVGVIMSFPASAAVQAQTFGQYIVAGLSPIWHLGSPYDVILERGLGFALIIILTVLNLYAIDKYASKFQIFVTIAKLLSLAIIIVTGFWYLIVKGETEHFKDAFTPLPNEKYDIGQISLAFYGALWSFAGWDILNYGTPEIKNPRRTMPIALLGGISAVTLVYMAMNVSYMTVLDTETLKNSSAVAADFARITLGDFSYAIPFMISILLIGTLNSNIFCGSRFTHAAAREGHLPTFLSCINAESNSPRAALLFQLICTIAVTFVDTESLITYVTFVMFGQRVFTMAALLWIRYRNIPVHPDAIRVPLIFSILFFMITIALVVTPFIEDFTTTIVGVGLVLMGFLLYMIFMKPKQLPGFLYRFNDGITRVTCKILFTTPDLKHASEIETLKSDGELNRGETLSSRFHNESVVSNDERTTLSTSQIDTAAAGTAEPMTRL

SEQ ID NO: 36420 - DNA, 1752 bp, Caenorhabditis elegans
  CDS (1)..(1752)
atgaaggtacatcaaatagccgatgtcttgtttcgtaaaaagacatttgacggaggatcacatcttgaatcacaaatgaaacgatgtttaacaattcttgacgtaatgttcattgcgattggacacatgattggagctggaatatacgtactcacgggatccgttgttcgaaatcaagcaggaccagcaattatactatcttttattttctctggctttgctgcacttttgtcagctttcagctatgctgaatttggagcaaggtttccccgagctggaagtgcatacacatacagttatgtaggaatgggtgaaatttgggcattcattgtcggatggacagtaccactagagtacatgattggaaacgccgctgtcgctcgttcgtggtctgcttatttcgacaatcttgtatctaaaagtgtgtccaactggacattggatactgttggacgattgagtgatggaaaaggattttttgcactgtaccctgactttttagcgttcttcctattgtttcttgtagcagtggcggttgcaatgggatcaaagttctctgccaacgtgaatactagttttgtatttttaaatctggcggttttggcgtttgtgattatttgtggactaacctatgcagacttttcactctggtcaggaacataccaggatggtcgttcaaaatttttcccgtatggaatacaaggagctatttctggcgcttccacatgctttttcgcatttatcggatttgaagctttagccactgctggagaagaagctaaaaacccacatagaacaatcccactggctactttcacttctttggcaattataagtgtcatatatgtacttatgggcgcctcattgacgctgatgataccatacgacttagttgatcctgatgccgcgtttgctgctgcattcgaaatgaaaggagcaactgttgccaagattataatgagtgttggtgcactagcgggtatgttgaacaatctagttactggatcattcgctcttccacgagctgtatatgcaatggctgatgatggtcttatcttcgggtggtttggggtgataaactcaaaaacaaaaacccctctcaatgcaactattgtgtttactataataaacgcaattttggcactggtcttcgatctgcaggcgcttgtcgactttttgtcaattggaactctgttggcttattcaatggtctcaatctgtgttattattttgcggcatcaatcccatcttgtagatggtagtgcaactgattatgataatggcggatgcctgaagtcgtgggtaccatttcaaggtgtttgggaaaatttctcagaggggatttcaattcgcgtagctgtcgcaggattaatttttggttatatttgcctggcaattccattcagaacaggaatatttagcaatgctggtggtattattttattgacagtcggtgctgccttttcactgttatcattcgtttttattttgggccatgaacagaataagtcaacatctacgtataaggtgccacttgttccattcattccatgccttggtctactcatcaatgtcttcatgatggtgtatctaaactcaatgacttggattcgtctttttgtatggttggcgattggcattgtaatctacatttgttatggtatccgtcacagcaaagaaggtcaaaaattgagtaagattgatgtacataatgagattatgtcgagaacctctgatactaaagttcactga

SEQ ID NO: 36421 - protein, 583 aa, Caenorhabditis elegans
MKVHQIADVLFRKKTFDGGSHLESQMKRCLTILDVMFIAIGHMIGAGIYVLTGSVVRNQAGPAIILSFIFSGFAALLSAFSYAEFGARFPRAGSAYTYSYVGMGEIWAFIVGWTVPLEYMIGNAAVARSWSAYFDNLVSKSVSNWTLDTVGRLSDGKGFFALYPDFLAFFLLFLVAVAVAMGSKFSANVNTSFVFLNLAVLAFVIICGLTYADFSLWSGTYQDGRSKFFPYGIQGAISGASTCFFAFIGFEALATAGEEAKNPHRTIPLATFTSLAIISVIYVLMGASLTLMIPYDLVDPDAAFAAAFEMKGATVAKIIMSVGALAGMLNNLVTGSFALPRAVYAMADDGLIFGWFGVINSKTKTPLNATIVFTIINAILALVFDLQALVDFLSIGTLLAYSMVSICVIILRHQSHLVDGSATDYDNGGCLKSWVPFQGVWENFSEGISIRVAVAGLIFGYICLAIPFRTGIFSNAGGIILLTVGAAFSLLSFVFILGHEQNKSTSTYKVPLVPFIPCLGLLINVFMMVYLNSMTWIRLFVWLAIGIVIYICYGIRHSKEGQKLSKIDVHNEIMSRTSDTKVH

SEQ ID NO: 36422 - DNA, 1770 bp, Caenorhabditis elegans
  CDS (1)..(1770)
atgtgcttctcggcgcttcgagaacgtgtatttcgtctgaaaaacttgccggctggtgagatagcaaccccacttcgaagatgtctgagtacttttgacattactcttcttggagttggccatatgattggcgctggaatttatgtattgactgggtcggttgtcagaaacactgcgggaccatcaattattctgtcttttttgctagcaggttttgcatctcttctctctgctttgtgttatgccgagtttggagctaggttcccaaaagctggaagtgcatacacatacacttatgttggagttggagagctatgggcttttgttattggatggaacattatactagagcacatgcttggagctgctgctgtcgctagatcatggtctggatacttggattcattactgggaaatgttatttcaaattcaacaattgctcgcactgggcacttgcatgaagcttcatcatttttcggcgattaccctgatcttctcgcttttctactcatcgttcttgtggcattttttgttgctcttggttcaaaagtgtccactaacttcaactctttcctaacaattctcaatattggaattgttgtcatagtcgtgttctatggtataacgtttgctgatttctctctatggagtggagtagatgagaaagggaattcgagattctttccgtatggagtatctggaatgtttgctggagctgcatcttgcttttttgcatacattggatttgacggacttgcaactgctggagaagaagctaaagatcctgcacgatcaattccaattgccacattctcctctatgacaattgtcacactctcctatgttctgatgtcagcttccctgacattgatgattccatacaatatggttcatccaactgcagcattttctgatgcattcacgatgcgtggagcagaatttgcaagctatgcggtctcggtcggtgctctttttggaatgacaactagtttggttggaggaatgtttgctcttccgagatgtgtattctcaatggctgatgatggacttttgttcagctccttggcatccgtaaacccaaaaactcaagttccaactcaagctcttcttatttttggattcctcactgcaatcattgcattgcttttcgatattaccactttggttgaattcttatcaattggaactcttcttgcgtattctattgtttctgcctgtgtaatcgtacttcgctaccaaccagcatataatgttgatgagggccaattcgacaatggaggaaaacttcgattcagcattccattctgtggcttccttgataaacttcagccaggacactcgatttattatgggatgagcgtaatgattgcttcaatgttcttctcaggccttggattcagttctggatatttatatggaactgttctctgccaaatattcttgctagtcaatattgctctgataattctctcattcctctttatctgcgctcattaccccaataatactccactggatttcaaggtacctctcgttcctcttattcctgccctttcactcttaatcaacactttgatgatggttcatcttgcttggatcacatggctccggttagttgtttggatgagcattggttttgttatctattttggatatggaattcatcatagtaaagaagaagtacaagacgctgaaaagttctcgaagagctccacgtatgagtccgtggtgtctggagtagtggctggagctggaacgacgtctccgtga

SEQ ID NO: 36423 - protein, 589 aa, Caenorhabditis elegans
MCFSALRERVFRLKNLPAGEIATPLRRCLSTFDITLLGVGHMIGAGIYVLTGSVVRNTAGPSIILSFLLAGFASLLSALCYAEFGARFPKAGSAYTYTYVGVGELWAFVIGWNIILEHMLGAAAVARSWSGYLDSLLGNVISNSTIARTGHLHEASSFFGDYPDLLAFLLIVLVAFFVALGSKVSTNFNSFLTILNIGIVVIVVFYGITFADFSLWSGVDEKGNSRFFPYGVSGMFAGAASCFFAYIGFDGLATAGEEAKDPARSIPIATFSSMTIVTLSYVLMSASLTLMIPYNMVHPTAAFSDAFTMRGAEFASYAVSVGALFGMTTSLVGGMFALPRCVFSMADDGLLFSSLASVNPKTQVPTQALLIFGFLTAIIALLFDITTLVEFLSIGTLLAYSIVSACVIVLRYQPAYNVDEGQFDNGGKLRFSIPFCGFLDKLQPGHSIYYGMSVMIASMFFSGLGFSSGYLYGTVLCQIFLLVNIALIILSFLFICAHYPNNTPLDFKVPLVPLIPALSLLINTLMMVHLAWITWLRLVVWMSIGFVIYFGYGIHHSKEEVQDAEKFSKSSTYESVVSGVVAGAGTTSP

SEQ ID NO: 36424 - DNA, 1482 bp, Caenorhabditis elegans
  CDS (1)..(1482)
atgacagctgaaaaggagccgttaaaatcgagagaaggagatgaggcaccacaaaatgaaacagaaggaaaaggaaaaggtcttgaaaagagtttgacactattcaatggagtttcaatgattgttggatgcattattggatctggcatttttgtatcaccaactggagtgcaagaacaagccggatcagttggactctctcttattgtttggctcatctccggtattttcacagcaattggcgcatattgttatgcagaactgggaactcttatcaagaaatcaggaggagattatgcatatattatggaagcatttggaccatttgttgcatttattcgtctttggattgaggctatcgtagtccgaccatgtactgtgactattgttgcactcactttcgccatttacggactgcgaccatttttccctgattgtgccccaccagatgtagtcgctgagcttctcgcgattttgttaattgttctgatgactgcaatcaactgtatttctgttcggttggcaacaattgttcaggattggtttactattgcaaaggttgttgctctgtgtcttatcattttaaccggacttggtctccttttctttggtgaatctcagtacaaggactcattcgagaatatttttgagaatacatctcaagattttacaaaagtttcacttgctttctactctggattattcgcttattctggatggaatttcttgaatttcatcgtcgaggagttgcagaacccaaaacgaaaccttccactcgcaattgccatctctatcacatcctgtaccgtaatctacgtgctaactaatgtggctctctacacagcaatttcaccagatgaaatgctcgaatccccggctgtagcggtacttttcgccaataaactctatggaaaattcgcatttattatgccactctgtgttgcatgttccacaattggatcagctaatggagttattttcacttcagcgagacttttttattccggtgctcgtgaaggacaaatgccagctgtattgacaatgattaataaaaaaacgaaaacaccgattcccgctgttattcttaccggagctctttctattgcttacttgttggcatcaaaggatgtgtatcaattgattaattatattcaaatcagttactggcttgcaatcggaacagccattgccgcactcttctggcttcgtagaaccatgccagatgcatcaagaccaattaaagttccactcatttggccagctattttccttgctggatgtatcgctcttgttcttattccaatggtagctgctccaagagatacgggaattggtctacttatcatgctttccgctgtccccgtctacggaattttcatcggatggaaaaacaagccaaaatggttcaatgaattcattgacagctcaactgttttcattcaaaagctattcatggttgtcgacgaggataaggaggattag

SEQ ID NO: 36425 - protein, 493 aa, Caenorhabditis elegans
MTAEKEPLKSREGDEAPQNETEGKGKGLEKSLTLFNGVSMIVGCIIGSGIFVSPTGVQEQAGSVGLSLIVWLISGIFTAIGAYCYAELGTLIKKSGGDYAYIMEAFGPFVAFIRLWIEAIVVRPCTVTIVALTFAIYGLRPFFPDCAPPDVVAELLAILLIVLMTAINCISVRLATIVQDWFTIAKVVALCLIILTGLGLLFFGESQYKDSFENIFENTSQDFTKVSLAFYSGLFAYSGWNFLNFIVEELQNPKRNLPLAIAISITSCTVIYVLTNVALYTAISPDEMLESPAVAVLFANKLYGKFAFIMPLCVACSTIGSANGVIFTSARLFYSGAREGQMPAVLTMINKKTKTPIPAVILTGALSIAYLLASKDVYQLINYIQISYWLAIGTAIAALFWLRRTMPDASRPIKVPLIWPAIFLAGCIALVLIPMVAAPRDTGIGLLIMLSAVPVYGIFIGWKNKPKWFNEFIDSSTVFIQKLFMVVDEDKED

SEQ ID NO: 36426 - DNA, 1431 bp, Ralstonia solanacearum GMI1000
  CDS (1)..(1431)
atgagtttgttccgtaccaagaacctggatcacatgatccgcaccggccagggcgataccggcctgaagaaagtcttcggaccgctggacctgaccttcctgggggtcggcgccatcatcggcaccggcatcttcgtgctgaccggcaccggtgcgctgaccgcggggcccgcgctgacgctgtcgttcgtcgttgcggcgctggcatgcgggtttgcggcgctgtgctacgccgaatttgcctcgaccattcccgtgtcgggctcgatctatacctatgcctatgccacgctgggtgaactggtggcctggatcatcggctgggacctgatgctcgaatacggcctggcgacctcggccgtgtcggtgggctggtcgggctatttccagtcgctgatggcgggtttcggcctgcatctgccggcggcgctgatggccgcaccgggggcgattccgggcgtgcagacgctgttcaacctgccggcgctgctgatcatgctgatcatcacggcggtgctgtcgctcggcgtgcgcgagtcggcgcggttcaacaacatcatggtggcgatcaaggtggcggtggtggtgctgttcatcgtcgtcggcgcgcggcacgtgcagccggccaactggcagccgttcatgccgttcggcatgtcgggcgtgttcggtgccgcggccctcgtgttctttgccttcatcggcttcgacgcggtgactgccgccgcggaggaggtgcgcaaccccgagcgcgacctgccgatcggcatcatcggctcgctgggcgtctgcacgatcctctacgtggtggtggccgccatcatgaccggcatcgtgccgtacaccaagttcgccggcgttgaccacccggtgtcgctggcgctgcagatgggcggcgagacgtgggtggccgggtttgtggacctgggcgccatcatcggcatgacgacggtgatcctggtgatgggctatgggcagacccgcgtcatctttgcgatgtcgcgcgacggcctgctgcccaagcgcctgtcgcgggtccacccgcgctatgcgacgccgttcttcaatacctggctggtcggcatcgtgtttgcgctgatcgccgcctttgtgccgctgaacgtgctggccgagctcattaacatcggcacgctggccgcgttttcgctgatcgcgatcgccgtgctggtcctgcgccgcaagcgcccggacttgccgcgcggcttccgctgcccgggcgtgccgttcgtgccggcggcggccgtcgtgctgtgcgtgttcctgatgagccagctgcaggccctgacctggatcgccttcgtggtctggatggtgatcggcctgctggtgtatttcggctatgcgcgcagccggtcgctgctgcatgcgccggaccgtgcggcggtgccgggctccgaagcggcgcactga

SEQ ID NO: 36427 - protein, 476 aa, Ralstonia solanacearum GMI1000
MSLFRTKNLDHMIRTGQGDTGLKKVFGPLDLTFLGVGAIIGTGIFVLTGTGALTAGPALTLSFVVAALACGFAALCYAEFASTIPVSGSIYTYAYATLGELVAWIIGWDLMLEYGLATSAVSVGWSGYFQSLMAGFGLHLPAALMAAPGAIPGVQTLFNLPALLIMLIITAVLSLGVRESARFNNIMVAIKVAVVVLFIVVGARHVQPANWQPFMPFGMSGVFGAAALVFFAFIGFDAVTAAAEEVRNPERDLPIGIIGSLGVCTILYVVVAAIMTGIVPYTKFAGVDHPVSLALQMGGETWVAGFVDLGAIIGMTTVILVMGYGQTRVIFAMSRDGLLPKRLSRVHPRYATPFFNTWLVGIVFALIAAFVPLNVLAELINIGTLAAFSLIAIAVLVLRRKRPDLPRGFRCPGVPFVPAAAVVLCVFLMSQLQALTWIAFVVWMVIGLLVYFGYARSRSLLHAPDRAAVPGSEAAH

SEQ ID NO: 36428 - DNA, 1458 bp, Agrobacterium tumefaciens str. C58; identical to SEQ ID NO: 9087
  CDS (1)..(1458)

SEQ ID NO: 36429 - protein, 485 aa, Agrobacterium tumefaciens str. C58; identical to SEQ ID NO: 9088

SEQ ID NO: 36430 - DNA, 1323 bp, Clostridium perfringens str. 13
  CDS (1)..(1323)
atgggaaaacctaaattaaaaaaggaaataggattgtttactgctacagctttagtagttggtaacatgatgggatctgggatatttatgcttccagccagtttagccagtgtatctggtccaggttcaactataatggcgtggttattaacgggattaggttctttggttttggcattaacgttcgctaacttaggttcaaagattccaaagacaggaggaacttatgaatattctagactagcttacggaaactttatgggattcatgactgcatggctctattggaatggatcttggattggaaatgctactatttttatagttattactacttatttaggtgaagttataacaagtttaactaattcaccaataataggcttcttattctgttcgtctatcttatggatttgtacatatataaatataagaggaacaaagttagcaggtagagtagcttcagtaataactgtttttaaagttttattatttatattcttcatagttgttggattaatttactttgatccgtcaaacctaacaccaatgtttccagacggaaagggtgtttcaactattcctgtagcagcatctttaactttatgggcatttatgggcttagaaactgcatctgtagcaggaggagaaataaaagatcctgaaaaaaatgttaagagaagtactatattaggtatgttaattagtactgttttatatatattaataagtgttgtagctatgggagctatgagtcaaagtgaattagcttcaagtactgctcctatttctgatataatagttaaagttttaaatttaaagagcttaaatttcttaaatatagctatagctattagtattttaggaacagctatgggatggctattatcaactgctagagtaggatatgctgctggagaggatggaattttccctagtgtatttgctaaggtacatcctaagtataatacgccacatgtagccttaataataggtagtatatttatcaatattatattcctaatgaactttactaaggggttagcaggagcatatagctttatagttgtattagctactttaagttacttaccaatatatgcaatttctactattgcagaaataatacttatggttaaagaggagaaaaaacctacatttaaaaaacatttaggtttaataataagatgtttaataggttttgcttttgcaatttgggcaatatatgcttcaggagctgaaatagtaatgtatggatttattttaatattactaggagttccgatttatggatatatgagcataaaaaaacacttccgataa

SEQ ID NO: 36431 - protein, 440 aa, Clostridium perfringens str. 13
MGKPKLKKEIGLFTATALVVGNMMGSGIFMLPASLASVSGPGSTIMAWLLTGLGSLVLALTFANLGSKIPKTGGTYEYSRLAYGNFMGFMTAWLYWNGSWIGNATIFIVITTYLGEVITSLTNSPIIGFLFCSSILWICTYINIRGTKLAGRVASVITVFKVLLFIFFIVVGLIYFDPSNLTPMFPDGKGVSTIPVAASLTLWAFMGLETASVAGGEIKDPEKNVKRSTILGMLISTVLYILISVVAMGAMSQSELASSTAPISDIIVKVLNLKSLNFLNIAIAISILGTAMGWLLSTARVGYAAGEDGIFPSVFAKVHPKYNTPHVALIIGSIFINIIFLMNFTKGLAGAYSFIVVLATLSYLPIYAISTIAEIILMVKEEKKPTFKKHLGLIIRCLIGFAFAIWAIYASGAEIVMYGFILILLGVPIYGYMSIKKHFR

SEQ ID NO: 36432 - DNA, 1383 bp, Clostridium perfringens str. 13
  CDS (1)..(1383)
atggagatttttaaaaagcaaagcttaaaaagaatacttagcgaagcaaatgaaaataaggaaagaaccctaagtgctttggatttaacactgatgagtgttgggtcagtaattggtactggagttatggttttaactgggattgttgcagctaaacagtctggaccagctacctccatagcatttattggaggaggaattgcggcggctataatagttttatgctatgcagaatttagttcaagtattccaagtgctggagggtcttattcatttacttatgtctccttaggtgagattattgcatatatatcaggattatgcattgttattggatataccttatctacagccacagtagcatcgggatggggagcttatcttttaagtcttttagatattctaggaataaaattaccaaagacatttacagctattccaagtgaagggggaatagtaaatctaccagcaatgatatcaattttatttatagtttttgtaatatctttaggtactaaagaaagtaagaaggttaatgatattatggtatttataaagattgtagttattgctttattcataggagttggagcttttcatgtaaacactagtaattggcatccatttgctccctttggagttaagggcatagtcactggaacagcttctttattctttgcttattgtggatttgatgcaacggcctcagctgctgaagaggttaaaaatccacaaaaatctttaccattaggtcttataagttctttagtaatatgtacaattatatacatagctgtctccttagtcttaacaggagtaacctcatatactaatttaaatgttggtgatgcattatcctatgctttaaaattagtaggacaaaggggagttgcctttgtagtatccttaggaactgtaataggaatccttgccgtaatatttgcaggtaactttacaacatcacacatacttttagccatgagtagagatggattattaccaaaattctttagtaaagttgataaaaaagatgtgccatatacagcattatggactgttggtataataggtgccttattagcaggattttttaatctaggacagttagctaactttgctaatatagcctttttattaacatatactttagtttgtatatctttaatagcctttagaaaaaaatatcctcatgtaaaaagaggctttaaaaccccattggtgccatttattcctttactaggggcatttagttgcttatttttaatgagtaatttatcagaagaaacatggaaaatatttattgtggttttagttttattaatcacaagttacttagtttatggaagaaagcattcattaatcaataaaaacaatgataattaa

SEQ ID NO: 36433 - protein, 460 aa, Clostridium perfringens str. 13
MEIFKKQSLKRILSEANENKERTLSALDLTLMSVGSVIGTGVMVLTGIVAAKQSGPATSIAFIGGGIAAAIIVLCYAEFSSSIPSAGGSYSFTYVSLGEIIAYISGLCIVIGYTLSTATVASGWGAYLLSLLDILGIKLPKTFTAIPSEGGIVNLPAMISILFIVFVISLGTKESKKVNDIMVFIKIVVIALFIGVGAFHVNTSNWHPFAPFGVKGIVTGTASLFFAYCGFDATASAAEEVKNPQKSLPLGLISSLVICTIIYIAVSLVLTGVTSYTNLNVGDALSYALKLVGQRGVAFVVSLGTVIGILAVIFAGNFTTSHILLAMSRDGLLPKFFSKVDKKDVPYTALWTVGIIGALLAGFFNLGQLANFANIAFLLTYTLVCISLIAFRKKYPHVKRGFKTPLVPFIPLLGAFSCLFLMSNLSEETWKIFIVVLVLLITSYLVYGRKHSLINKNNDN

SEQ ID NO: 36434 - DNA, 1710 bp, Arabidopsis thaliana
  CDS (1)..(1710)
atgggaggccacgaaggtttcagcaaccaacgcctctcctccgccacatggttctctcatttccgtgcttcagctctccgatctaaatcactgccccctccgtcctcgcagactgccgttcgctccacctctggcgactctctggttcgtcgcctcggccttttcgacctcatactgttgggcgtcggcgcttccatcggcgccggtgtcttcgtcgtcaccggaaccgtcgctcgcgatgctggacctggagtcacaatcagcttcttgctagctggagcatcgtgtgtgttgaacgctctctgttatgctgaactttcatctcgtttccctgctgttgttggtggagcttacatgtactcttactcagctttcaatgagatcacagcttttcttgttttcgttcaactcatgcttgactatcatattggcgccgctagtatctcccgtagcttggccagctatgctgttgctcttcttgagctttttccagccctcaagggctctattcctctctggatgggaagcggcaaagagctcttgggagggcttctctctttgaatattttggctcccattttacttgctctcttgacccttgttctatgccaaggtgtgcgagaatcttccgctgtcaactccgttatgactgctactaaggtcgtgatcgttctcgttgtgatttgtgccggtgcttttgaaattgatgtagcaaattggtctccttttgcgcctaatggttttaaagcagttctcactggagctactgttgtcttcttttcatatgttggatttgatgcagttgctaattctgctgaagaatcgaagaaccctcagcgcgatttgccaatcggaattatggggagccttctggtttgtatctcgctgtatattggcgtatgtttggtgctcaccgggatggtcccttttagcctcctcagcgaagatgctcctttagctgaagccttttcatcaaagggtatgaagttcgtctcaatcttaatcagtattggtgctgttgctggactcacaactactctgcttgttggtctttatgttcagtccaggttatatctgggacttggaagggatggtctattgccttcaatcttttccagaatacacccaactcttcatacacctcttcattctcaaatctggtgcggcattgtagctggcgttttagctggcatatttaatgtacatagtctttcccatattctgtctgttggtacattgactgggtattcagttgttgcggcttgtgttgtggcattgagactgaatgataaaaaagatagagagtcgtccaatagatggacatcaagttggcaggaaggcgtcatttgccttgttataattgcatgcagtggttttggtgctggcgtattttaccgtttcagtgcttcagttatatttattctcctctcagttggtgtggcagttgttgcttcagcagttcttcattatcgccaagcttatgctctgcctctaggttctgggtttagctgtcctggtgtacccattgtgccatccgtttgcattttcttcaacatcttcttatttgctcagttgcattatgaagcatggataagatttgttgttgtcagtgtgcttgcaactgccgtttatgccttgtatgggcagtaccacgcagatccgagcatgttggattatcagagggcacctgaaactgaaagcgacgcttag

SEQ ID NO: 36435 - protein, 569 aa, Arabidopsis thaliana
MGGHEGFSNQRLSSATWFSHFRASALRSKSLPPPSSQTAVRSTSGDSLVRRLGLFDLILLGVGASIGAGVFVVTGTVARDAGPGVTISFLLAGASCVLNALCYAELSSRFPAVVGGAYMYSYSAFNEITAFLVFVQLMLDYHIGAASISRSLASYAVALLELFPALKGSIPLWMGSGKELLGGLLSLNILAPILLALLTLVLCQGVRESSAVNSVMTATKVVIVLVVICAGAFEIDVANWSPFAPNGFKAVLTGATVVFFSYVGFDAVANSAEESKNPQRDLPIGIMGSLLVCISLYIGVCLVLTGMVPFSLLSEDAPLAEAFSSKGMKFVSILISIGAVAGLTTTLLVGLYVQSRLYLGLGRDGLLPSIFSRIHPTLHTPLHSQIWCGIVAGVLAGIFNVHSLSHILSVGTLTGYSVVAACVVALRLNDKKDRESSNRWTSSWQEGVICLVIIACSGFGAGVFYRFSASVIFILLSVGVAVVASAVLHYRQAYALPLGSGFSCPGVPIVPSVCIFFNIFLFAQLHYEAWIRFVVVSVLATAVYALYGQYHADPSMLDYQRAPETESDA

SEQ ID NO: 36436 - DNA, 1503 bp, Drosophila melanogaster
  CDS (1)..(1503)
atgacggaccgatatgccaatggagtgaccaccagcctggtcgagcccacaaatggatgcgccgcgccgggtaatccaaatcccgctgatggcgaggagaagattgtcctcaagcggaagctaacactcatcaatggagtggccatcatagtgggcaccatcattggatcgggcatcttcattgctcccacgggagtctttatttacaccgaatccgtgggaagctcccttttgatttggctgacttgcggcattttatcgacgatcggagctctgtgctacgcggaactgggcacatgcatcacaagatctggcggggattacgcctacctgctggtgtcctttggaccgctggtgggattccttcgcctctggatcgcactgctcatcatccggccaaccacgcagaccattgtggctctatcttttgcccattatgcggtcaagccattctttccggaatgcgatcccccacagaatgcggtgaaactgctggctgccatatgtctaactctgctcaccacaatcaattgcctgtcggtgaaggtgtccatgaaagtgcaggatgtgttcacggtgggcaagctgctggccctcatcatgattatcctgtccggactgtactacatggccactggcgagctggagaacttcagaaatccgtgggagggtatctacacggcccgcaacattggctacgccttctactccggtctgtttgcctttggtggctggaactacttaaactttgtgacggaggagctacaggatccatacaagaatctgccgcgcgccatttggatagccatgcccctggtcacgagcatctatgttctggtcaacttggcctatttcgccgtggtaaacaagccggagatgctcagttcgctggccgtggcggtgacctttggaaaccgagtgttcggaccgctggccttcatggtgcccattttcgtggcgctaagcacatttggtggcgtcaacggggtgctcttcacatcggcgcgccttttcgctactggggctcaggaggggcatttgcccaagtttttccagctgttccacgtgaaacaacagacgcccattccctccctgattttcacgtgtcttatgtcgctgctcatgctgctcacggataacgtgtaccagttgatcaactacttcagctcggtgctctggctctcagtggtggccagcatagccggaatgttgtggctccggcataagaggcccgacttgccccgacccattaaagtccatcttgcgctgcccatcaccttcatggtaagctgcgtgacactcgtactgctgcccaatttggaggagccacaaaatctgctcattggcatcggcataaccctggctggcattccgttctactacgccttcatcgcccgaaaaaagaagcccaagtgctacggccgattgtccaattccgtagtggagatttgccgggccatcttcaataccaccattatcgaatcgaatgaggctattaactag

SEQ ID NO: 36437 - protein, 500 aa, Drosophila melanogaster
MTDRYANGVTTSLVEPTNGCAAPGNPNPADGEEKIVLKRKLTLINGVAIIVGTIIGSGIFIAPTGVFIYTESVGSSLLIWLTCGILSTIGALCYAELGTCITRSGGDYAYLLVSFGPLVGFLRLWIALLIIRPTTQTIVALSFAHYAVKPFFPECDPPQNAVKLLAAICLTLLTTINCLSVKVSMKVQDVFTVGKLLALIMIILSGLYYMATGELENFRNPWEGIYTARNIGYAFYSGLFAFGGWNYLNFVTEELQDPYKNLPRAIWIAMPLVTSIYVLVNLAYFAVVNKPEMLSSLAVAVTFGNRVFGPLAFMVPIFVALSTFGGVNGVLFTSARLFATGAQEGHLPKFFQLFHVKQQTPIPSLIFTCLMSLLMLLTDNVYQLINYFSSVLWLSVVASIAGMLWLRHKRPDLPRPIKVHLALPITFMVSCVTLVLLPNLEEPQNLLIGIGITLAGIPFYYAFIARKKKPKCYGRLSNSVVEICRAIFNTTIIESNEAIN

SEQ ID NO: 36438 - DNA, 1320 bp, Methanosarcina acetivorans C2A
  CDS (1)..(1320)
atgagaatttggacggagccagaaatgaatagatatgaatcaaatagtctaacacttactggtgccgtatctttgggcaccggtgttatgattggtgcaggtatttttgcactactgggacagatcgccgaactggctggaatgttatttccaataatatttcttataggtgcggttgtaaccgcttttagcgcatattcttatgttaaattttccaacacttatccttcagccggaggaattgccatgtacctggaaaaagcatacggaaaaggggtaatgaccggttttggtgcgttactgatggctttttccatggtgatcaatgaaagtcttgttgcgcgtacttttgggacttatacaatacaactctttaatatggatgagggcagtttccttgtaccgcttttaggtgttgggttactggtctttgcttttgcagttaatatctctggcaaccgtgtgattgaaaaattttctttctttatggctttaataaaaataaccggtattgctatctttggaattgttggcttatggcttgcagacttttcttttacttacacgtctacggatgcgatggcaactacaacggaagaatatttagcagccgtagcactggccgtacttgcttacaagggttttacaacaatcactaacagtggctcggagattgttgatcctcatcaaaatgtgagtaaagcaatagttatttccatagcaatctgtacaattatttattttttagtatctctggcagtggcaggcagtcttactctacctgaaatcattgaggcaaagaatttcgcactggcagaggcagcaagaccggtttttgggaattacggtttgtggtttaccgtagcattagcgattattgcaacaatttccggtataattgccagtgtctttgcagtgtcccgcatgcttgccatgttaacggacatggatttaataccccacaggcattttggcatgccgggtgatatccagaagcatacccttgtttacacgattgtcgtcgctatattgttaacaatcttttttgatctgagcaggattgcctctcttggagcaattttttatttagttatggatattatgatacactgggggcttttacgtaatatgcgtgaaaaaattaaaataagatcttatatagtcattacggcaatcattcttgatgctgctgtgctcagcgctcttctgttgacaaaagcatctaccgatactttattggtagtcatatccctgataatgatgttacttatttttgctggagaaaaactgtttttacgttcacacccgaatcaggaatga

SEQ ID NO: 36439 - protein, 439 aa, Methanosarcina acetivorans C2A
MRIWTEPEMNRYESNSLTLTGAVSLGTGVMIGAGIFALLGQIAELAGMLFPIIFLIGAVVTAFSAYSYVKFSNTYPSAGGIAMYLEKAYGKGVMTGFGALLMAFSMVINESLVARTFGTYTIQLFNMDEGSFLVPLLGVGLLVFAFAVNISGNRVIEKFSFFMALIKITGIAIFGIVGLWLADFSFTYTSTDAMATTTEEYLAAVALAVLAYKGFTTITNSGSEIVDPHQNVSKAIVISIAICTIIYFLVSLAVAGSLTLPEIIEAKNFALAEAARPVFGNYGLWFTVALAIIATISGIIASVFAVSRMLAMLTDMDLIPHRHFGMPGDIQKHTLVYTIVVAILLTIFFDLSRIASLGAIFYLVMDIMIHWGLLRNMREKIKIRSYIVITAIILDAAVLSALLLTKASTDTLLVVISLIMMLLIFAGEKLFLRSHPNQE

SEQ ID NO: 36440 - DNA, 1293 bp, Methanosarcina acetivorans C2A
  CDS (1)..(1293)
atggcagagacaaaatcaatggggttatgggcttcagcttccataggagttggagcaatggttggagccggaatcttttcaatcttcggaacggctgcccagatttccggaaacgcggtctacgtttcttttattattgcagggatgatcgcacttttaaacacctattcctatgcaaagatgggggtcaggtacccttcggcaggcggccccgtagagttcatgcttaaagggtttggagatggaattttaagcgggggactgaacctcctgctctgggtgggttatgttttcgggctcgccctctatgcaaaaggtttttcttactatgcgataacctttctccctgcaggttcggctcctgtgtggaccagtttctttgccacggctatcatccttgcctttacagccatcaatttcagaggggcaaaaaccgtggggaaatcggagctctttattgtttccataaaagttgggatcctcctgctttttgctgctgcagggatgttttatgttactccaggaaacctttcaatttcagcctggccggctcccaaaaatctctttttcggggccggaatggtttttctcgcataccagggcttcggactgataaccaatgctgcagaagacatgaaaaacccggaaaaaaaccttccaagagccctttatctgagtgtcgtgctcgtcatcatcatctatgtatccgtcagccttgctgtgataggaaacctttccgtccctgagatccaaaatgcacaggactatgcccttgcggctgctgcaaagcctttcctcggggatataggttttaaaataatggcttttgctgcccttttttcgacctcttccgcaatcaatgcctccctttacggaggtgcaaatgtaagctacattctggcaaaagatggagaattgcccgaaatttttgagaggaaagtctggcaccgaagtcccgaagggctctttatcacctcaagcctggttattctctgcgcaaactttctccagcttgaaggaataggtatgcttgccagtacttgccttctcatggtttacgtggcagttaatatttcccaccttcgcctgttaaaggaaaccggggcaaaatcctatattatctgggcttcacttttaagcagcctgaccttcttttgcgtgcttttgtactacgaattcatgcattcgaagacaactctcggactacttggatttacggttttttgttgctttgctgccgaatggacctacagaaaatactccggtaggcttataaaggaaaggacaggctga

SEQ ID NO: 36441 - protein, 430 aa, Methanosarcina acetivorans C2A
MAETKSMGLWASASIGVGAMVGAGIFSIFGTAAQISGNAVYVSFIIAGMIALLNTYSYAKMGVRYPSAGGPVEFMLKGFGDGILSGGLNLLLWVGYVFGLALYAKGFSYYAITFLPAGSAPVWTSFFATAIILAFTAINFRGAKTVGKSELFIVSIKVGILLLFAAAGMFYVTPGNLSISAWPAPKNLFFGAGMVFLAYQGFGLITNAAEDMKNPEKNLPRALYLSVVLVIIIYVSVSLAVIGNLSVPEIQNAQDYALAAAAKPFLGDIGFKIMAFAALFSTSSAINASLYGGANVSYILAKDGELPEIFERKVWHRSPEGLFITSSLVILCANFLQLEGIGMLASTCLLMVYVAVNISHLRLLKETGAKSYIIWASLLSSLTFFCVLLYYEFMHSKTTLGLLGFTVFCCFAAEWTYRKYSGRLIKERTG

SEQ ID NO: 36442 - DNA, 1320 bp, Methanosarcina acetivorans C2A
  CDS (1)..(1320)
atgtttgaagttaaatataactcaggcaattatatgggaagggaatcggaactaaaaagggacctgagtttactcgaaattactctggtcggaattggagatattcttggagcagggatctatgtgcttatgggaaaagctgcggggcttgctggcaacatggtctgggcttcctttctgtttgcaggatttactgcctctctttccgctctcagctatatggaactttcttctatgtaccctcgagcaggagcagagtatgtgtttgcgaggaaggcttttggagaacgtataggtctatttgtagggctgctggtcatctattatgtagcaattaccgcttctgcggttgctctcggctttgggaggtacttcagtaatattttcggaggtgggattctaataggagcaataagcttgtatattctcctgagccttgtcatggtttacgggatcaaggagtcagcccggctggctattctcatgacctttatagaactctcaggtctcatgataattatttacgtggggattccctatcttggcacggtaaattattttgagaccccgagcctctcaggagtctttgaggcttctgccctgattatttttgcatttctggggtttgaagatattgtacggttatcccaggaaacaaaagatgcggagaaaacaactccaaaagctttgcttatttccattttcttcactattttcctctatatttgtgtggcagtagcttccgtgagtgtgcttgattttcaggttctcggaatttcggagatcccgcttgctgaagttgcagctgtcgcttttggggaaaaggcttttgtccttctttcctggatcgctcttttttccacaatgaatacagtacttgtggttatgcttggagggtcaagaattgtttacggcatggcaaattcgggttcgcttccgaaaatcctcgcgcgggtacatcaaaaactcaagactccctggactgcaatttgcggaattgcattcttttcaagtctgttcgtcttccttggagacatagcaacagtagcaaatattgcgaattttatgatttttattgtcttttttatagtcaacatctccctcataaaactccgatacaccgacccggaaagaaagcgccctttcagagtccctgtcagtataggccgttttcccatatttccggctcttggggctctgtccgcggttttccttttttcccagatcggtaaagaagtcatgctttacgggtttttccttgcaggaataagtgcactattggtgttgcttaaaaccagaaaaagagagaatgagctttag

SEQ ID NO: 36443 - protein, 439 aa, Methanosarcina acetivorans C2A
MFEVKYNSGNYMGRESELKRDLSLLEITLVGIGDILGAGIYVLMGKAAGLAGNMVWASFLFAGFTASLSALSYMELSSMYPRAGAEYVFARKAFGERIGLFVGLLVIYYVAITASAVALGFGRYFSNIFGGGILIGAISLYILLSLVMVYGIKESARLAILMTFIELSGLMIIIYVGIPYLGTVNYFETPSLSGVFEASALIIFAFLGFEDIVRLSQETKDAEKTTPKALLISIFFTIFLYICVAVASVSVLDFQVLGISEIPLAEVAAVAFGEKAFVLLSWIALFSTMNTVLVVMLGGSRIVYGMANSGSLPKILARVHQKLKTPWTAICGIAFFSSLFVFLGDIATVANIANFMIFIVFFIVNISLIKLRYTDPERKRPFRVPVSIGRFPIFPALGALSAVFLFSQIGKEVMLYGFFLAGISALLVLLKTRKRENEL

SEQ ID NO: 36444 - DNA, 1380 bp, Thermoanaerobacter tengcongensis MB4
  CDS (1)..(1380)
atgaatttatttcgaaaaaaatctgtagatcaacttctggaagcagctgaaaaaacaggacttaataaaaaattaaccgcaatagacctggcagctttagcaataggctctgtcgttggaacgggaatttttgtgtcaacaggtgaaggagcattaagagcagggcctggagtaattatttcttacatcattggaggtataactgctgctctagctgctttcatatttgcagagcttgtgacaatgtttcccgtcgccggaagtacctacacctactcttatgtagcttttggagaattaatagcctggataattggctgggacttgcttttagagtaccttgtttcagcaagcgccgttgcatctggatggtcaggaacttttgtaggactgctcaaatctttcggcataactttgccagaagccataactaaacctcctatatcgggaggaataatggatttaccagccattttaattaccgcttttgtggcgtggattttgtacattggtgtaagggaaagcgcaaccacaaacaatataatagttctcgtaaaaataggagtcatcttgcttttcctgttcctcggtttcagccacgtaaaactttcaaaccttactcccttcgccccctatggttggaaaggaataatgtctgctgctgcaataatcttctttgcatatataggatttgacgcagtgtcaacggcagcagaagaaactaaaaaccctacgagggatgtgcctttaggccttgtaatggcaatggtagtgatacttgccctttacatttctgtggcagttgtattggtcgggatggtgccttataaaaccataattcctgacaatgctctccctggagccttaatgagcataggaatcaactggggttctgctttagttgcaacaggcgctgctgtcggtatgatttcaactttattgataacactctacggccagatacgaattttcatggttatggcaagagatggacttttgcctgaggtgttttcccacattcatccaaaatacaggacaccccatataaataccgtaataacgagtttggtagcagctataattgctggcttcctgcctttagacatcataattgagctctgcaacataggaactctatctgtctttgtaattgtctcaataggaatacttgtcctaagggttaaaatgcctaatgtagagagaaagttcagagtccctgcagtatggttagtcgcacctcttacagcagcttttagcctctatttaatggcaagccttccatgggtgacatggctaagatttggcatatggatgctggtcggccttatcatttactttgcttacggaaggtatcatagcgttttaaatgtgcaaaaataa

SEQ ID NO: 36445 - protein, 459 aa, Thermoanaerobacter tengcongensis MB4
MNLFRKKSVDQLLEAAEKTGLNKKLTAIDLAALAIGSVVGTGIFVSTGEGALRAGPGVIISYIIGGITAALAAFIFAELVTMFPVAGSTYTYSYVAFGELIAWIIGWDLLLEYLVSASAVASGWSGTFVGLLKSFGITLPEAITKPPISGGIMDLPAILITAFVAWILYIGVRESATTNNIIVLVKIGVILLFLFLGFSHVKLSNLTPFAPYGWKGIMSAAAIIFFAYIGFDAVSTAAEETKNPTRDVPLGLVMAMVVILALYISVAVVLVGMVPYKTIIPDNALPGALMSIGINWGSALVATGAAVGMISTLLITLYGQIRIFMVMARDGLLPEVFSHIHPKYRTPHINTVITSLVAAIIAGFLPLDIIIELCNIGTLSVFVIVSIGILVLRVKMPNVERKFRVPAVWLVAPLTAAFSLYLMASLPWVTWLRFGIWMLVGLIIYFAYGRYHSVLNVQK

SEQ ID NO: 36446 - DNA, 1440 bp, Thermoanaerobacter tengcongensis MB4
  CDS (1)..(1440)
atggtagagagttcaggtgcaaagggtgtcttgaggaaaaagctgcccgagcatgccatggaacttgcgcaggaggaaaaataccgcctcaagagagagcttggctggtttgagctgatgctcttcgttttgggagctacaattggggcgggaatttttgtactgccaggtgttgctgctgctaaatttgcaggacctgctataatgatttcttacgctttgggtggaatagtgactattgcagtggctctggcgtatacagagtttgcttccatggtgccagtggcaggaagtgcttacacttattcttatgttgcactaggggaaatatttgcctggattgtcggatgggacttgatatttgagtttactatgattgcgtctacggttgcagttggatggggaggatattttaattctttcttggagacggtttttgggattactttacctcaggcgatttcccacgacataactcacggtgggatagtgaacttaccggcaattttaggacttttgattgttgcatggattgctctcacaggaattagggcttctggtatagcaaatgccttatttactacggcaaaggtatttgctatcttgtttgtgctaactgttggagtattccacatcaaattggagaactggactactccgtttgctccttatggtcttgcaggtattatgactggagcggcactgaccttctttgcatatactggatttgacggaataacatctcttcttgaagaggtaaaaagacctgagagggacatacctatagctttgataggtggaataagcctgtgcgctctcttctatgtggcaatgtctgccgttatcactggaatggtacactggacaaaactcgatgttccaaacccggctgcatttgtgctaatgcaggtagggattccatggggcggagcgctcatatcaataagcgtgctatttggactcatcgctaccatgctgggcaactctttgagtgctagccgcatactctttgctatggggcgcgatggattgctgcctgaatggtttgcttttgtgcatcctactcgcagagttccaagaaatgctgcttatgtgatttatacagctgccataatatttgcaggttttctctcaataagcgaactggcagagcttgctaatatagggggcctcactgcctttacactagttaccataagcgtaatggtgatgaggtatacagatccagagaggaagaggatattcaaggttccagctatatgggtgattggacctattggaataatcggttctcttgcgttaattgcaagccttcctgttgtgacgtttataagattcactgtgtggcttataataggccttatcatctactttagctatggatacaagcattccaaggaaggtacaggatactatattgggaaagagaatcaaaagtaa

SEQ ID NO: 36447 - protein, 479 aa, Thermoanaerobacter tengcongensis MB4
MVESSGAKGVLRKKLPEHAMELAQEEKYRLKRELGWFELMLFVLGATIGAGIFVLPGVAAAKFAGPAIMISYALGGIVTIAVALAYTEFASMVPVAGSAYTYSYVALGEIFAWIVGWDLIFEFTMIASTVAVGWGGYFNSFLETVFGITLPQAISHDITHGGIVNLPAILGLLIVAWIALTGIRASGIANALFTTAKVFAILFVLTVGVFHIKLENWTTPFAPYGLAGIMTGAALTFFAYTGFDGITSLLEEVKRPERDIPIALIGGISLCALFYVAMSAVITGMVHWTKLDVPNPAAFVLMQVGIPWGGALISISVLFGLIATMLGNSLSASRILFAMGRDGLLPEWFAFVHPTRRVPRNAAYVIYTAAIIFAGFLSISELAELANIGGLTAFTLVTISVMVMRYTDPERKRIFKVPAIWVIGPIGIIGSLALIASLPVVTFIRFTVWLIIGLIIYFSYGYKHSKEGTGYYIGKENQK

SEQ ID NO: 36448 - DNA, 1428 bp, Thermoanaerobacter tengcongensis MB4
  CDS (1)..(1428)
atggcaaattcaacgtcttcttatttgtggcgtaaaaagacgcttgagatggtgctttctgaaaccgaagctgaacaattcaaattaaagaaaacattaacagctattgacttaattgcattaggtataggcgcaatcataggtactggtatatttgttattactggtgttgccgccgctgaaaaagctggtcccgcaatcgtgctctcatttattttggcaggattggcttgtgctttcgcagcaatttcttacgcagaacttgcatccatgttccccatagcaggttctacgtataactacgcatatatagcaatgggtgaatttttggcctggataattggatgggacttaatacttgagtacgtatttgctcttcctgcaatttcattgggttggtctggttatttcaccaacctccttggaagtataggaataaacattcctgcatgggcagctaactctgcatggcaagcacccggtactggcggtcttatcaatcttccagcaataggaatccttcttgccatcgcaattttaaactacatcggggtaagagaaactgctactgttaacaacattggtgttgctttcaaggtatttgtggtacttttcttcatattcacagcagtttggtatgtaaagccagctaactggtctcctttcttgccatacggatgggcaggcgtattccacggcgcagcaatcatcttctttgcatatataggatttgacgctgtttcaacagcagctgaagagacaaagaatccagcaaaagatatgcccataggaattttaggatctcttggaattagtacccttttgtacatcgctgtttcagcgattttgacaggtgttgtttcatacaccgagttgaacgacccagcccctgttgcaaaggctctcaacttaataggtctaaactgggcaagaggacttgtttcactaggtgccattgtaggtattacaacagttttgcttgttatgttctacggctccacaagaattatctttgctatgtctcgtgatggattactcccacctattttctcaaaagttcatccaaaatatagaacacctactctcgctatatatctcataacgattgcaacaactttagtagctggatttttcccaattggcgtaatcgcagaacttgtaaatataggaactatgttggcatttgtattaacttctatcgctacaatagtattaagatacacacaacctgacttgccgagaaaattcagagctcctggcatgccatggactggtattttggcaatagcttttgtactttcacttatggtatctctgccatgggagacatgggtaagacttattgtatggttcgtaatagggctcttcatctactttggatatggtagacacaacagcatacttgctaaacagcagacccagcattaa

SEQ ID NO: 36449 - protein, 475 aa, Thermoanaerobacter tengcongensis MB4
MANSTSSYLWRKKTLEMVLSETEAEQFKLKKTLTAIDLIALGIGAIIGTGIFVITGVAAAEKAGPAIVLSFILAGLACAFAAISYAELASMFPIAGSTYNYAYIAMGEFLAWIIGWDLILEYVFALPAISLGWSGYFTNLLGSIGINIPAWAANSAWQAPGTGGLINLPAIGILLAIAILNYIGVRETATVNNIGVAFKVFVVLFFIFTAVWYVKPANWSPFLPYGWAGVFHGAAIIFFAYIGFDAVSTAAEETKNPAKDMPIGILGSLGISTLLYIAVSAILTGVVSYTELNDPAPVAKALNLIGLNWARGLVSLGAIVGITTVLLVMFYGSTRIIFAMSRDGLLPPIFSKVHPKYRTPTLAIYLITIATTLVAGFFPIGVIAELVNIGTMLAFVLTSIATIVLRYTQPDLPRKFRAPGMPWTGILAIAFVLSLMVSLPWETWVRLIVWFVIGLFIYFGYGRHNSILAKQQTQH

SEQ ID NO: 36450 - DNA, 1491 bp, Streptomyces coelicolor A3(2)
  CDS (1)..(1491)
atgctcgaccaaggcgcacccccgccccacgacgcatcggccgtcccaccgtccccgggcctggccgcgcgcctcatgcgccgcaagccggtggaacgcctggtcgccgagggcggccagggcgagggcggcagcctccgccgctccctcggcctctggcagctcacgatgatcagcatcggagccaccctcggcaccggcatcttcgtcgtcctcggcgaggccgtccccaaggccggcccggccgtcacgctgtccttcgtcatcgcgggcctcaccgcgctcttctcggccctgtcctacgccgagctggccggcaccatcccggtcgccggatcctcgtactcgtacgcctacgccaccatgggcgaactggtcgcctggatctgcggctggtgcctggtcctggagtacggcgtgtccgtggccgccgtcgccgtcggctggggcgagtacctgaacgagctgctcgacggcaccatcggcgtcaccctccccgcggccctgtcggcaccgcccggcgacggcggcatcttcaacctgcccgcgctgatcgtcgtgctcctcgccatgacgttcctgctcggcggcgcccgcgagtccgcctgcgccaacacgatcatggtcgtcgtcaagatcgcggccctggtgctcttctgcgcgatcggcgtgcagggcttccgctccggcaactacgagcacttcatgccgctcggcatggccggggtcagcgcggcaggtgcgacgctcttcttctcctacatcggcttcgacgccgcctccaccgcgggcgaggaggccaagaacgcccagcgcgacctgccccgcgcgatcatgctgtccctggtcatcgtcacggtgctgtacgtcctggtcgcggccgtcgccgtcggcgccaagccctggcggaccttcaccgactccgaggcgtccctcgcgcagatcatgaccgacgtcaccgggcagagcttctggggcaccctgctggccttctgcgcggtcgtcgccatcgccagcgtcgtactgaccgtcctctacggccagacccgcgtcctgttcgccatgtcccgcgacggactggtgcccaaggtcttctccaaggtccacccgaagaccggcgcgccccgcgccaacacgctgatcgtctccctgttctgcggcgtcctcgccgccgccgtcccgctcggccagctcgccgacgccaccagcatcggcaccctcttcgccttcgcgctcgtcaacgtcgccgtcgtggtgctgcgccggacccgtcccgagatgcgccgcaccttccgggtgccgctgtcgccggtcctgcccgcgctgggcttcggcctctgcgtctggatgatggggagcctgtccaccgtcacctgggtggtcttcggtgtctggatggccgtcgggctcgtgttctacttcgtgtacggccaccgccgctcccgactcgccacaccggtcccgtccgaggcccggacgcaccagaagtga

SEQ ID NO: 36451 - protein, 496 aa, Streptomyces coelicolor A3(2)
MLDQGAPPPHDASAVPPSPGLAARLMRRKPVERLVAEGGQGEGGSLRRSLGLWQLTMISIGATLGTGIFVVLGEAVPKAGPAVTLSFVIAGLTALFSALSYAELAGTIPVAGSSYSYAYATMGELVAWICGWCLVLEYGVSVAAVAVGWGEYLNELLDGTIGVTLPAALSAPPGDGGIFNLPALIVVLLAMTFLLGGARESACANTIMVVVKIAALVLFCAIGVQGFRSGNYEHFMPLGMAGVSAAGATLFFSYIGFDAASTAGEEAKNAQRDLPRAIMLSLVIVTVLYVLVAAVAVGAKPWRTFTDSEASLAQIMTDVTGQSFWGTLLAFCAVVAIASVVLTVLYGQTRVLFAMSRDGLVPKVFSKVHPKTGAPRANTLIVSLFCGVLAAAVPLGQLADATSIGTLFAFALVNVAVVVLRRTRPEMRRTFRVPLSPVLPALGFGLCVWMMGSLSTVTWVVFGVWMAVGLVFYFVYGHRRSRLATPVPSEARTHQK

SEQ ID NO: 36452 - DNA, 1440 bp, Streptomyces coelicolor A3(2)
  CDS (1)..(1440)
atgcccgcttcccgcgtcaagtccccccacctcctcgtcgccgaatccggcgcggaccgcgaaggccacggcctgaagcgcacgatggggctgttccagctcgtctgcttcggcgtcggcgcgatcgtcggcaccggcatcttcgtcggcctgtccgactccgtcgccgaggccggccccgccgtcgtcgtctccttcgtcctggccgcgatcacctgcgtgttcaccgcgttcgccttcgccgagctgggcggcgcgatcccggtctccggctcctcgtactccttcgcctacgccgggctcggcgagcggaccgccttcctcgtcggctggtgcctgctcctggagtacggggtgtcggtctcggcggtcgcggtcggctggagccagtacgtcaacgagctgctcgacaccgtcctcggcgtccagctcccgcacgccctctccgcgggccccggcgacggcggcgcggtcaacctgcccgcggtggtcgtcatcgccctggcctcggtcctgctgatgcgcggcgtacgggagagcgcccgcgccacggccgccatggccgtcctcaagctggccgtactgctcgccttctgcgccatcggcttctacgccttccaggacggcaacctcacccccttctcgccggccggcctcggcggcatcggcgccggcaccaccgccgccttcttctcctacatcggcttcgacgcgatcaccacggccggcgaggaggccaagaacccgcgccgggacatcccggtcgccatcctggtctgcatcggcctggtcaccctcctctactgcgcggtcgccgtcgccgcgatcggcgcggtgggcggcgaccaggtcgggaaccggccggccgcgctctcctacgtcgtcgaccgggtcaccggctcggcgatcggcggcggcgtggtcgccttcggcgcggtcgtcgccatcgcctccgtggtgctcgccgtgatgtacggccagacccgcatcctgatgtcgatgtcccgggacggactgatcccccgggtcttcgagaaggtctccccgcgcaccgcgacccccgtcgccggcaccctgatcgtcggcgtggtcttcgccctccccgcggccttcgccccgctcgacgcggtggtcaacctgtgcaccatcggcaccctcgccacgatggccgccgtcaacgtctcggtgatcaccctgcggcgccgcgaaccgggcctcgcccgcaccttccgcgtgccgctctacccggcgacaccgctgctcggggtcggcttctgcctgtacctgatgtacgagacgggcggtgccacctggctccagttcgcggtgttcctcgcggtgggactgctggtctacagcgcctacgggcgccggcactcccgcctggcccggaccgccgtcagtgcggacgacgctgagcgggtaccgcaggaagcctga

SEQ ID NO: 36453 - protein, 479 aa, Streptomyces coelicolor A3(2)
MPASRVKSPHLLVAESGADREGHGLKRTMGLFQLVCFGVGAIVGTGIFVGLSDSVAEAGPAVVVSFVLAAITCVFTAFAFAELGGAIPVSGSSYSFAYAGLGERTAFLVGWCLLLEYGVSVSAVAVGWSQYVNELLDTVLGVQLPHALSAGPGDGGAVNLPAVVVIALASVLLMRGVRESARATAAMAVLKLAVLLAFCAIGFYAFQDGNLTPFSPAGLGGIGAGTTAAFFSYIGFDAITTAGEEAKNPRRDIPVAILVCIGLVTLLYCAVAVAAIGAVGGDQVGNRPAALSYVVDRVTGSAIGGGVVAFGAVVAIASVVLAVMYGQTRILMSMSRDGLIPRVFEKVSPRTATPVAGTLIVGVVFALPAAFAPLDAVVNLCTIGTLATMAAVNVSVITLRRREPGLARTFRVPLYPATPLLGVGFCLYLMYETGGATWLQFAVFLAVGLLVYSAYGRRHSRLARTAVSADDAERVPQEA

SEQ ID NO: 36454 - DNA, 2238 bp, Methanosarcina mazei Go1
  CDS (1)..(2238)
atggcgccagttgaaacaacggagaggctggggcgcagcctgggttttttctcaacttttgcaataggcaccgggacgatgataggagcaggcatatttcttcttcccggaattgccatggcaaacgcaggttcaggagcaataatctcattcctgctgggcgggcttattaccatagccacatccataagcatggcagaactggcaacaggcatgcctcttgcgggaggcagctattactatatcagcaggacaatgggagctgcattcggtgcggtgataggtctcggctcctggctggcactgatatttaaaggcacatttgccctcataggtctggcagaatacgctcagatctttcatcccatgccaatatatctggtggcggctgttacgggagtgctcctcttaataatcaatttccgtggggcaaaaagcagtggttccctccagaactttattgttgttattttgctgctaatactgtttgtattcattggaaaagtgtccttcgaggtcaggcctgagaaccttctcccggtagctccgcatggggtagtatccatattcaccacggcaggtatgatttttatctcctatctcgggctggcggaagccgctgctgttgctgaagaagtgaaaaatccgtcaaagaaccttcccagggcatttatcgcttcagcagttgtggtaacacttttctacgcaggcattatggctgtggttgcaggtttttcaggccctgaagggggtgcgtcaacagtgacccccctggcagacattgcaggctttattgcaggtgattccgggaaattctttattgctttttccgcccttcttgcaacgctttcaacagctaatggcgccatactgtcatcttcaaggttccctttcgcaatgagcagggacgcattgatgccgaaatggtttgtcagtatccataaaaaatatgagactcctcataatgctattctggtcaccgggtcagtaatggttttgctcctgtttttgtttgacatagaacagctggcaagacttgggggggctttcaacattttgatatttatcctgctgaatatggcagtgattatcctcaggaaacggaccctgcctggctatgaaccgacatttcgggacccttttttccctttcacgcagatcttcggggtggtcgggagtatgcttctgctccctctacttggtggtttgcctttacttttttccgtattgatgatatttgccggagccggctggtacatgttctatggaaaagacaaagctatgcctgcatataacctgtttgaccttctggaaaacaatgtagagagggtgagcgctgaaccggaacctgttggaagggtacttgtgcctgtttccaatcccgggcatgaaagggacctccttaaactggcagaccttcttggaaatgagataatctgtcttcatgttgttgaggttccaagccagatctcccttacagtgggtcaggaactctaccatgagaaacagatagaaatagacagccgttttcgggattattttgagcagtatcctgcaaaattcggtaataaaagagactatattgttgcctttgaccacacaatctccaattcgattatagagcaggctgaaatagagaacgctgacataattataatgggctggcacgattctaagaggttcaagtactcttttggagacgtaacaaacgatgttctcctttcctcgaaaagccagattgcacttttaaaagggcacctgcctgacagcatcaaaaaggtccttgtagcctataacggaagagaaaactccgtacacggtctttctctggcaaaaaagattgctgaaaatacaggggcttcaataagaataataagcattgtcagccctgatgaagatccggaaaagaaggcaaaaatagctgaagaacttgaagggctggttaaaaagatcccttccacacctgcaagctttaaacttcttgaaagatattctatcgaggacgcaatacttgaagtctcaaacggttacgacctgacaattattggggattccagtgagagattcaagatctctttacttggaacactatctcagaggattgccaggcacgcgagaaagccggtaatgatagttaaaaaatcaaagccaatctcaaaagaaagcctgaattatcttctgaaaaaatatgcccggaaagcatatgcaaagttcaggaaggaaaaaggcagggactga

SEQ ID NO: 36455 - protein, 745 aa, Methanosarcina mazei Go1
MAPVETTERLGRSLGFFSTFAIGTGTMIGAGIFLLPGIAMANAGSGAIISFLLGGLITIATSISMAELATGMPLAGGSYYYISRTMGAAFGAVIGLGSWLALIFKGTFALIGLAEYAQIFHPMPIYLVAAVTGVLLLIINFRGAKSSGSLQNFIVVILLLILFVFIGKVSFEVRPENLLPVAPHGVVSIFTTAGMIFISYLGLAEAAAVAEEVKNPSKNLPRAFIASAVVVTLFYAGIMAVVAGFSGPEGGASTVTPLADIAGFIAGDSGKFFIAFSALLATLSTANGAILSSSRFPFAMSRDALMPKWFVSIHKKYETPHNAILVTGSVMVLLLFLFDIEQLARLGGAFNILIFILLNMAVIILRKRTLPGYEPTFRDPFFPFTQIFGVVGSMLLLPLLGGLPLLFSVLMIFAGAGWYMFYGKDKAMPAYNLFDLLENNVERVSAEPEPVGRVLVPVSNPGHERDLLKLADLLGNEIICLHVVEVPSQISLTVGQELYHEKQIEIDSRFRDYFEQYPAKFGNKRDYIVAFDHTISNSIIEQAEIENADIIIMGWHDSKRFKYSFGDVTNDVLLSSKSQIALLKGHLPDSIKKVLVAYNGRENSVHGLSLAKKIAENTGASIRIISIVSPDEDPEKKAKIAEELEGLVKKIPSTPASFKLLERYSIEDAILEVSNGYDLTIIGDSSERFKISLLGTLSQRIARHARKPVMIVKKSKPISKESLNYLLKKYARKAYAKFRKEKGRD

SEQ ID NO: 36456 - DNA, 1281 bp, Methanosarcina mazei Go1
  CDS (1)..(1281)
atggaagaaaaatccgatttaaaaagagacctgagtttggttgagattactctaaccggaattggcaatattctcggagccggaatttacgtgcttatgggaaaagctgccggtcttgcgggcaattttgtctggttctcttttctgtttgccggtgtcactgccgcactttccgctttcagctacatggaactatcatccatgtatccgcgggcgggagcagagtatgagtttgtaaaaagagcttttggagaacgcacaggactttttgccgggctccttgtggtctattatgtgacaatcacaagttctgctgttgctctcgggtttgggaggtatttcagcagcctattcggagctagcagtctggtcggggtagctggcctttttcttttcctcagccttgtcatggtctacggtgtcaaggaatctgcccggctggctgtttttatcagcctgatagaacttaccggtcttctggtgattgtttatgcagggttcccttatatcgggacagtaaattattttgaggctccggacctcgcagggctgtttgaagcttctgccctgattttttttgcatttctcggttttgaagatatcgtcaggctgtcccaggaaacaaaaaatgcagagaaaacaaccccaagagccctgattatcgcgatatcagttacggttttcctctatgtctgtgtggccatagcttccgtaagtgtcctcgatttccgcgtgttagggctctcggaagtgccgcttgcggatgtcgcggctgtagctttcggaaatgacgcttttgtccttctgtcctggatcgctcttttttccacaatgaataccgtacttgtggtcatgctcggagggtcaaggattgtctacgggatggcagatgcaggatcttttcccagagcccttgcacgcgtacatccccgcttcagaaccccctgggccgcaattttcggaattgcctttatctcgggtttttttgtccttctgggagacataacaaccgtagcaaatattgctaattttatgatcttcatagtcttttttatggttaatgtctccctgataaaactccgttatgcagagccggaaagacatcgtcctttcagggtccctgtcagcatagggcgtttgccgctcttcccatcactcggcgcattatctgctgtttttcttttttctcagatcagcctcgagatcatggcttatggttttttccttatagtaatagggttcataattgtcctgataagaacccgaaaaatccctccctga

SEQ ID NO: 36457 - protein, 426 aa, Methanosarcina mazei Go1
MEEKSDLKRDLSLVEITLTGIGNILGAGIYVLMGKAAGLAGNFVWFSFLFAGVTAALSAFSYMELSSMYPRAGAEYEFVKRAFGERTGLFAGLLVVYYVTITSSAVALGFGRYFSSLFGASSLVGVAGLFLFLSLVMVYGVKESARLAVFISLIELTGLLVIVYAGFPYIGTVNYFEAPDLAGLFEASALIFFAFLGFEDIVRLSQETKNAEKTTPRALIIAISVTVFLYVCVAIASVSVLDFRVLGLSEVPLADVAAVAFGNDAFVLLSWIALFSTMNTVLVVMLGGSRIVYGMADAGSFPRALARVHPRFRTPWAAIFGIAFISGFFVLLGDITTVANIANFMIFIVFFMVNVSLIKLRYAEPERHRPFRVPVSIGRLPLFPSLGALSAVFLFSQISLEIMAYGFFLIVIGFIIVLIRTRKIPP

SEQ ID NO: 36458 - DNA, 1431 bp, Xanthomonas campestris pv. campestris str. ATCC 33913
  CDS (1)..(1431)
atgttcaaacaactttgggccaccaaacacccgcacgccagccatgaggcggccgacgggctgggcctgcaacgcgcgctcggtccctgggggctgaccgccctgggcatcggcgcggtgatcggcggcggcatcttcgtgatcaccggccaggccgcggccgaccatgccggcccggcgatcgtgctgtcgttcgtgctcgcggcgatctgctgcgcgttctgcgccatggcctacgccgaatttgcggcgatggtgccagtctccggcagcgcctacacctatacctacgccaccttcggcgagctggcggcctggttcatcggctggatgctggtgctggaatacggcgtctctgcctcggcggtcgcggtcagctggaccggatatttcctcagtctgctggaacacttcggcatccatttgccggccgccctggtcagcgcaccgctggacggcaagctgcagcgcaccggcgcgatcgccaacctgcccgccgccggcatcgtgttgttgctgacctggctgtgctatgtcggcatccgcaagtcgtcggcgatgaacatggcgatggtgatcctcaaaaccgggctgatcatcctggtcattgcggcgggctggaagtacgtggacccggccaactggcatcccttcatccccgccaacgaagcaccgggcaagtacggcatggaaggtgtgctgcgtggcgcggcgatggtgttcttcgcctacatcggcttcgaggcggtgtcggtggcggcgcaggaatcgcaccgtccgcaacgcgatctgccgatcggcatgatgctgtcgctggtgatctgcaccgtgctctacatcgccatggccgcggtgatgaccggcctggtgccgttcacccagctgggcaccgatgagccggtagtgaccgcagtggccgcgcatccgcagctggcctggttgcgcgtggtggtggaagtgggtgcgctgatcgggctgtcgtcggtggtgctggtgatgatcatcgggcagccgcgcatcttcatgatcattgcgcgcgatggcctgctgccggcggtgttcacgcgcatccatcccaagtaccgcacgccgcacatcaacacggtgattaccggcatcggcatcgctctgcttgcggccgtcttcccgctggatgtgctgggcgagctgacctcgatgggcacgctgatcgccttcgccgccgtgtgtgcgggcgtgctgatcctgcgccgcacccatccggaactgccgcgtccgttccgcatgccggccgcgtggctgatctgcagcgccggtgtgctcagctgcctggccttgctgtcggcgatgacgctgcacaactggatgctgatggggctatggaccctggtcgggctggtggtctatttcggctacggctatcgccacagccgcctgcgcgagggccgctga

SEQ ID NO: 36459 - protein, 476 aa, Xanthomonas campestris pv. campestris str. ATCC 33913
MFKQLWATKHPHASHEAADGLGLQRALGPWGLTALGIGAVIGGGIFVITGQAAADHAGPAIVLSFVLAAICCAFCAMAYAEFAAMVPVSGSAYTYTYATFGELAAWFIGWMLVLEYGVSASAVAVSWTGYFLSLLEHFGIHLPAALVSAPLDGKLQRTGAIANLPAAGIVLLLTWLCYVGIRKSSAMNMAMVILKTGLIILVIAAGWKYVDPANWHPFIPANEAPGKYGMEGVLRGAAMVFFAYIGFEAVSVAAQESHRPQRDLPIGMMLSLVICTVLYIAMAAVMTGLVPFTQLGTDEPVVTAVAAHPQLAWLRVVVEVGALIGLSSVVLVMIIGQPRIFMIIARDGLLPAVFTRIHPKYRTPHINTVITGIGIALLAAVFPLDVLGELTSMGTLIAFAAVCAGVLILRRTHPELPRPFRMPAAWLICSAGVLSCLALLSAMTLHNWMLMGLWTLVGLVVYFGYGYRHSRLREGR

SEQ ID NO: 36460 - DNA, 1482 bp, Xanthomonas campestris pv. campestris str. ATCC 33913
  CDS (1)..(1482)
atgtaccgaatgctgaagtctctgttgagggtcaaaccgatcgagcccgccggacgtgtggatgcgggcgaaccggtcgaaggcagcctgcagggcgaagcgacgctgcaacggaccctcaccgccaagcacctgatcatgctcggcatcggcgcggtgatcggcgcaggcatctttgtgatgaccggccaggcggctgccaaccatgctgggccagcggtgatgctgtcgtttgtcttcgcgggtatcgcctgcacgtttgccggcctgtgttacgccgagttcgcggcaatgatgccggtctccggaagtgcttactcgtattcctacgcgacgcttggagaaggcatcgcctggttcattggctggtgcctggtgctggaatatctgttcgcagggtcaagcgtcgcggtggcgtggtctgcctatctgatcagcttcatcaccggcacgctgggtcttccgttccccacagagctgaccaacgccccgcttgcctggatcaatggcgaattcgtggcgtctggcaacatcctcaacctgcctgccgtgctcatcgtggctgcggtgagtgggttgtgctatgtcggcattacccagtcggccttcatcaacgcaattgtcgtggcgatcaagatcgcagtgatctgtctgtttgttggcttcggcgcggcatatatcgacccggccaactggcatcctttcattcccgaaaataccgccccaggcgtatttggctggagcggcgtattccgcgctgcctcgatcgtgttctttgcctacattggcttcgatgcggtatcgacctcggctggagaaaccaaggacccgcaacgcaacatgccgatcggcatcctcggctcgctggcggtgtgcaccatcatctacatcatcgtgtgtgcagtgctgacaggtttgatgccatatacccagcttggcactgccaagccggtggccactgcgctggaagcgcacccgcaactgacttggctcaagactgcggtggagatcggcgcgatcgccggcctgtcctcggtggtgctggtgatgctgatggcacagccgcgcatcttctacaccatggccaaggatgggttgatgcccaaactgttcggcaaggtgcacccgaaattccacacgccatatgtcggcaccgtgatcgtgggggtggtcgccgcatcactggcggggttgatcccgctcagcgtgctgggtgaactggtgtcgatgggcaccctgctcgccttcgccaccgtgtgcgccggcgtaatggtgctgcgtttcaccaagcccgagctggagcgtccgttccgtgtaccgctggcaatgatagtttgtccgttgggtacgcttgcgtgcctggccctgttcttccaggccttccaggaacactggaaggtgttcgtgggctggaccgtgatcggcctggtcatctatttcggctacggcatccaccatagccgtctggctcgcaaggcctga

SEQ ID NO: 36461 - protein, 493 aa, Xanthomonas campestris pv. campestris str. ATCC 33913
MYRMLKSLLRVKPIEPAGRVDAGEPVEGSLQGEATLQRTLTAKHLIMLGIGAVIGAGIFVMTGQAAANHAGPAVMLSFVFAGIACTFAGLCYAEFAAMMPVSGSAYSYSYATLGEGIAWFIGWCLVLEYLFAGSSVAVAWSAYLISFITGTLGLPFPTELTNAPLAWINGEFVASGNILNLPAVLIVAAVSGLCYVGITQSAFINAIVVAIKIAVICLFVGFGAAYIDPANWHPFIPENTAPGVFGWSGVFRAASIVFFAYIGFDAVSTSAGETKDPQRNMPIGILGSLAVCTIIYIIVCAVLTGLMPYTQLGTAKPVATALEAHPQLTWLKTAVEIGAIAGLSSVVLVMLMAQPRIFYTMAKDGLMPKLFGKVHPKFHTPYVGTVIVGVVAASLAGLIPLSVLGELVSMGTLLAFATVCAGVMVLRFTKPELERPFRVPLAMIVCPLGTLACLALFFQAFQEHWKVFVGWTVIGLVIYFGYGIHHSRLARKA

SEQ ID NO: 36462 - DNA, 1587 bp, Xanthomonas campestris pv. campestris str. ATCC 33913
  CDS (1)..(1587)
atgaccacacacggtgcgagcgcacagggcaagttccacaagcggctcagcctgaccgacctgaccttcatcgggctgggctcgatcttcggctcgggctggctgttttccgccagccacgtgtcctcgatcgccgggccggccggcatcgtatcgtggattctcggcggcatcgcggtgttgttgctggggctggtgtattgcgaactcggcgccgcgttgccacgcgccggcggcgtggtgcgctaccccgagtactcgcacgggcccttgctcgggtcgttgaccggcttcattacattgattgcgttttccagcctgatcgcaatcgaagtggaagcggcgcgccagtatgcggcggcctggttcccggcgctcagccaggccggcagcacgcatcccagcctgctgggctggctggtgcaactggcgttgttgctgctgttctttgcgctcaattacttcagcgtcaagacctttgcgctggccaacaacatcgtcagcgtcttcaagtttctggtgccgatcctggtgatcgtgctgctgatgaagcacttcaatgccgacaacctgagcgtgcatggctttgcaccgtcgggcatggccggggtggaagcggcgatctccgccggcggcatcatctttgcgtacctggggctcaccccgatcgtctcggtcgccagcgaggtgcgcaacccgcaacgcaatattccgattgccttgatcctgtcggtggcgctgtccacggtgatctacgtgctgttgcaattggcatttctgggcagcattccggccgcgcaactggcgcagggctggagcggcatcgacaaggcgttttcgctgccgtaccacgacatcgcgctggcactggggatggcgtggctggccgcgctggtgatctgcgatgcgatggtgtcgcccagcggcaccggcaatatctacatgaatgccacgccgcgcgtggtgtacggctgggcgcgcagcggcgggtttctgccggtgttgacgcgggtggatccggcctcgggcatcccgcggccggcgttgtggctgagcctggggttgtcgatcttctggaccttgccgttcccgtcctgggaaaccttgattggcgtggtgtcggccgcgttggtgctgagctatgcggtggcgccggtcacggtggccgcgctgcgccgcagtgcgcccggcctggcgcggccgttccgcgtgcgcggatttgcggtgctggggccgctgtcgttcgtggtggccgcgctgatcgtgtactggtccacctggcccacgctgtcctggctgctgggccttcaggtgctcgcgttcgcggcgtacgtgctgtatcgcctgccatcgcgcgcgtgcagggcccggctgttgcgccaggtccgtgcgtcgctgtggctgatcgtgtttttcgtgctggtgatggcagtgtcgtgggcgggcaccttcggtggccatggctggatcgcgcatccgttcgacacgctgagcgtggcggtgatcgccttcggcatctatcactggggcgcgcgtagcggcctgcgcagcgacgaactggcgctggaggaggacgatggtgagtga

SEQ ID NO: 36463 - protein, 528 aa, Xanthomonas campestris pv. campestris str. ATCC 33913
MTTHGASAQGKFHKRLSLTDLTFIGLGSIFGSGWLFSASHVSSIAGPAGIVSWILGGIAVLLLGLVYCELGAALPRAGGVVRYPEYSHGPLLGSLTGFITLIAFSSLIAIEVEAARQYAAAWFPALSQAGSTHPSLLGWLVQLALLLLFFALNYFSVKTFALANNIVSVFKFLVPILVIVLLMKHFNADNLSVHGFAPSGMAGVEAAISAGGIIFAYLGLTPIVSVASEVRNPQRNIPIALILSVALSTVIYVLLQLAFLGSIPAAQLAQGWSGIDKAFSLPYHDIALALGMAWLAALVICDAMVSPSGTGNIYMNATPRVVYGWARSGGFLPVLTRVDPASGIPRPALWLSLGLSIFWTLPFPSWETLIGVVSAALVLSYAVAPVTVAALRRSAPGLARPFRVRGFAVLGPLSFVVAALIVYWSTWPTLSWLLGLQVLAFAAYVLYRLPSRACRARLLRQVRASLWLIVFFVLVMAVSWAGTFGGHGWIAHPFDTLSVAVIAFGIYHWGARSGLRSDELALEEDDGE

SEQ ID NO: 36464 - DNA, 1302 bp, Xanthomonas campestris pv. campestris str. ATCC 33913
  CDS (1)..(1302)
atgagcagccagggcaatgaatctcccgcgctggtgcgcgcggtcagccgctggcagatcgtgggcttgtcgatcaacgatgtgatcggcagcggcatttacctgctgcccgcggccacggccgcgctgctggggccgatgagcctgtgggcggtgatgctggccggcctggcagtggcgttgctggtgctgtgctacgcccaggcggccagttatttcgatacgcccggcgggagctatctgtatacgcgcgaagccttcggcccgttcaccggcttccagatcggctggatgatctggctgacacgcatcagttcggctgcggcactgagcaacgggctggccgatgcggtggcgcgcttctggccggccgccggcagcgacggctgggaacgtctgctggtggtggtgggctcgctgggcttgctcaccgccatcaacgtgatcggggtgaagtcagccgcacgcactggcgtggcgctggtgatcggcaagctggtgccgttgctgttgttcgtggccatcggcctgttttacgtggattggtcgtgggcctttgccggcagcacgccggacctgcgcgacctgggtaaccttggcgaagccgcgttgctgttgctgtttgcgtatgccggcttcgagaacatccctgccgctgcaggcgagtaccgcaacccgcgccgcgacgtgccgttcgccttgatcaccatgatcgtcaccgtgaccctgatctatgccgccgtgcaggtggtggcgcagggcaccctgcccaatctcgcggcatcgcccacgccgctggccgatgccgccagccgcttcggtggcgaagccctggcgctgatcctcaccgtgggcgccaccatctccatcctgggcaccaccagcaacacggtgatgttgggcccgcggtttttgtttgcactggcccaggacggctacggcccggccctccttgcacgcgtccacccgcgcttccacaccccggcggcagccgtgctcacgcaaggcgtgctgtcgctggcgctggctttgtcgggctcgtttacgcagctggcactgctgtcgatggtcacgcggctatttgcctatatcggcacggcggcggcggtgatcgtgctggcacgccgttatcgcgcgcgcaccgatgccttgcgcctgcccggtggcccgctcattcccatcgccgccctgctgttgtcgcttggcctgttggcgagcgccagctggcagaacctcgccgccgccgggctggccttgctggtgggctgcgtgttctacctgttcccgcgtaagccggcctga

SEQ ID NO: 36465 - protein, 433 aa, Xanthomonas campestris pv. campestris str. ATCC 33913
MSSQGNESPALVRAVSRWQIVGLSINDVIGSGIYLLPAATAALLGPMSLWAVMLAGLAVALLVLCYAQAASYFDTPGGSYLYTREAFGPFTGFQIGWMIWLTRISSAAALSNGLADAVARFWPAAGSDGWERLLVVVGSLGLLTAINVIGVKSAARTGVALVIGKLVPLLLFVAIGLFYVDWSWAFAGSTPDLRDLGNLGEAALLLLFAYAGFENIPAAAGEYRNPRRDVPFALITMIVTVTLIYAAVQVVAQGTLPNLAASPTPLADAASRFGGEALALILTVGATISILGTTSNTVMLGPRFLFALAQDGYGPALLARVHPRFHTPAAAVLTQGVLSLALALSGSFTQLALLSMVTRLFAYIGTAAAVIVLARRYRARTDALRLPGGPLIPIAALLLSLGLLASASWQNLAAAGLALLVGCVFYLFPRKPA

SEQ ID NO: 36466 - DNA, 1413 bp, Xanthomonas campestris pv. campestris str. ATCC 33913
  CDS (1)..(1413)
atgtcgtcttggctcaggcgcaaatccatcgatcaggtcaccgtgcacgaggccgggcggcagctggtgcgcagcctgagctggccacacctgatcgcgctgggcatcggcgcgatcgtcggcaccggcatctacacgctgatcggcgtgggcgcggacaaggccggcccggcggtgctgctctcgtttgtggccgccggtatcgtgtgcgcctgcgcggcgctggcgtatgcggagatggccacgatgatgccggccgccggcagcgcctacacctacagctacaccgcactgggcgagagcatcgcctgggtggtgggctggagcctggtgctggaatattcgctggtggtgagcacggtggcggtgggctggtcgggctatttcgtcgggttcctgcagtggttgggagtcaatctgccgcatgcattgattgccgggccgcacgccggcggcatcgtgaacctgccggcggtggtgatcaccttcctggtggccggcatgctgatggccggcaccaaggaaagcgccacgctcaatgcggtgttggtggtgctgaagatcattgcgctgggcgtgttcgtggcgatcgcactgccggcgttcaacagcgccaacctgcagcccttcatgccctatggcttctccaaggcgatgggcccggatggcgtggagcgcggcgtgatggcggcggcgatcatcttcttcgcgttctacgggttcgatgcgatctccactgcggccgaagagaccaagaacccggggcgcgatctgtcgatcggcatcgtcggttcgatgatcggttgcacgctgatctatgtgctggtggcgttgtcggcggtgggtgcgatgagcttcaccgtgttcggcaagagccccgagccgttggcgttgatcctgcgcgagctcggccatggcaaggcggcgctggtgatcggcgcggtggcgatcatcgcgctgccgacggtgctgctggcgttcctgtacgggcagagcaggatcttctttgtgatgtcgcgcgacggtctgttgccgcgtggcttgtccaaggtcaatgcacgcaccggcacgccggtggcgatcaccttgttcaccgcggtgctggtggccgcgttggcgggcgtggcgcggctggacgagattgccgcgctggccaatgccggtacgttggcggcgtttacggcggtggcggcgtgtctgctggtgttgcgcgtgcgcgaacccacccgtgcgcgggcgttccgcacgccgctggcctgggtggtggggccggtggcgatcctgggctgcctgtatctgttctggagcctgccgagcaccacgcagggctggttcctggtgtggaacgcgctgggcgtggtggtctacctggcctacgggcggcggaatagtcgcttggggaaggtggggtag

SEQ ID NO: 36467 - protein, 470 aa, Xanthomonas campestris pv. campestris str. ATCC 33913
MSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGVNLPHALIAGPHAGGIVNLPAVVITFLVAGMLMAGTKESATLNAVLVVLKIIALGVFVAIALPAFNSANLQPFMPYGFSKAMGPDGVERGVMAAAIIFFAFYGFDAISTAAEETKNPGRDLSIGIVGSMIGCTLIYVLVALSAVGAMSFTVFGKSPEPLALILRELGHGKAALVIGAVAIIALPTVLLAFLYGQSRIFFVMSRDGLLPRGLSKVNARTGTPVAITLFTAVLVAALAGVARLDEIAALANAGTLAAFTAVAACLLVLRVREPTRARAFRTPLAWVVGPVAILGCLYLFWSLPSTTQGWFLVWNALGVVVYLAYGRRNSRLGKVG

SEQ ID NO: 36468 - DNA, 1431 bp, Xanthomonas axonopodis pv. citri str. 306
  CDS (1)..(1431)
atgttcaaacaactttgggccaccaaacacccgcacgccagccatgaggcggccgatgggctgggcctgcaacgcgcgcttggcccctgggggctgaccgccctggggattggggcggtgatcggcggcggcatcttcgtcatcaccggccaagcggcggccgaccatgccggcccggcgatcatgctctcgttcgtgctcgcagcggtgtgctgtgcgttctgtgcgatggcctacgccgaattcgctgcgatggtgccggtctccggcagcgcctacacctacacctacgccaccttcggcgagttggccgcgtggttcatcggctggatgctggtgctggaatacggcgtgtccgcctcggcagtggcggtcagctggaccggctacttcttgagcctgctcgagcatttcgacatccatctgccggccgcattcgtcagcgcgccgctggacggcaaattgcaacccaccggggcgatcgccaacctgccggcggccggcatcgtgctgctgctgacctggctgtgctatgtcggcatccgcaagtcgtcggcaatgaacatggccatggtgatcctcaagaccggcctgatcctgctggtgatcgcggtgggctggaaatacgtggacacctccaactggcacccgttcattccggccaacgaaggcccgggcaaatacggcatggaaggcgtgctgcgcggcgcagcgatggtgttcttcgcctatatcggcttcgaagcggtgtcggtggcagcgcaggaatcgcatcgcccgcaacgcgacctgccgatcggcatgatcctgtcgctggtgatctgcaccgtgctctacatcgccatggcggcggtcatgaccggcttggtgccgtacaccttgctcggcaccgacgagccggtggtgaccgcggtggcagcgcatccgcagctggcctggttgcgcgtggtcgtggaagtgggcgcgttgatcgggctgtcgtcggtggtgctggtgatgatcatcgggcagccgcgcatcttcatgatcattgcgcgcgatggcctgctgccctcgatcttcacccgcatccatcccaagtaccgcaccccgcatgtcaataccgtcatcaccggtgtcggcatcgcgctgctggcagcggtgttcccgctggatgtgctgggcgaactgacgtcgatgggcacgctgatcgccttcgcggcggtctgcgccggcgtgctgatcctgcgtcgcacgcacccggaactgccgcgtccgttccgcatgccggccgcctggctgatctgcaccgccggcgtgttgagctgccttgcgctgctgtcggcaatgacgctgcacaactggatgctgatgggcctgtggacgctggtcgggctggtgatctacttcggctacgggtatcgccacagccgtctgcgcgacggccgctga

SEQ ID NO: 36469 - protein, 476 aa, Xanthomonas axonopodis pv. citri str. 306
MFKQLWATKHPHASHEAADGLGLQRALGPWGLTALGIGAVIGGGIFVITGQAAADHAGPAIMLSFVLAAVCCAFCAMAYAEFAAMVPVSGSAYTYTYATFGELAAWFIGWMLVLEYGVSASAVAVSWTGYFLSLLEHFDIHLPAAFVSAPLDGKLQPTGAIANLPAAGIVLLLTWLCYVGIRKSSAMNMAMVILKTGLILLVIAVGWKYVDTSNWHPFIPANEGPGKYGMEGVLRGAAMVFFAYIGFEAVSVAAQESHRPQRDLPIGMILSLVICTVLYIAMAAVMTGLVPYTLLGTDEPVVTAVAAHPQLAWLRVVVEVGALIGLSSVVLVMIIGQPRIFMIIARDGLLPSIFTRIHPKYRTPHVNTVITGVGIALLAAVFPLDVLGELTSMGTLIAFAAVCAGVLILRRTHPELPRPFRMPAAWLICTAGVLSCLALLSAMTLHNWMLMGLWTLVGLVIYFGYGYRHSRLRDGR

SEQ ID NO: 36470 - DNA, 1482 bp, Xanthomonas axonopodis pv. citri str. 306
  CDS (1)..(1482)
atgtaccgaatgctgaagtctctgttgagggtcaaaccgatcgagcccgccggccacgtcgatgcgggcgaaccggtcgaaggtagcctgcaaggcgaagccacgttgcaacggaccctcacagccaagcacctgatcatgctcggtatcggcgcggtgatcggcgccggcatcttcgtgctgaccggccaggccgcggccaatcacgccggcccggcggtgatgctgtcgttcgtgttcgctggtatcgcctgcgccttcgccggcctgtgctacgccgaattcgccgcgatgatgccggtctccggcagcgcctattcgtattcatacgccacgctcggcgaaggcatcgcctggttcatcggctggtgtctggtgctggaatacctgttcgccggctccagcgttgcggtcggctggtctgcctacctgatcagcttcatcaccgggaccctggggttgccgttccccgcagagttggcgggtgcgccgctggcctgggacggccacggctttgtcagctccggcaacctggtcaacctgccggccgtgctgatcgtcgccgcagtgagcatcctgtgctacgtcggcgtcactcagtcggcgttcgccaacgcgatcgtggttgcgatcaaggtcgtggtgatctgcctgttcgtgggtttcggcattgcctatatcgacccggcgaactggcaccccttcatcccggaaaataccggccctggccagttcggctgggacggggtgtttcgcgccgcgtccatcgtgttcttctcctacatcggcttcgacgcggtttccacctcggccggcgagaccaaggacccgcagaagaacatgccgatcggcatcctggtgtcgctggcgatctgcaccatcatctacatcatcgtctgcgcagtgctgaccggcctgctgccctacacccagctcggcaccgccaagccggtggccaccgcgctggaagcccatccgcaactgacctggctcaagaccgcggtggaaatcggtgccatcgccggcctgtcatcggtggtgctggtgatgctgatggcacagccgcgcatcttctacaccatggccaaggatgggctgatgcccaagctgttcggcaaggtgcacccgaaattccgcacgccttacgtcggcacgctcttcgtgggcgtggtcgccgcgctgctggccggggtcatcccgttgaacgtgctgggcgaactcgtctcgatgggtaccctgctcgccttcgccacggtctgcgctggcgtgctggtgctgcgcttcaccaagcccgacctggcgcgcccgttccgggtgccgctggcgatggtgatctgcccgctgggcgcgttggcctgtctgttcctgttcttccaggccttccaggaacactggaaggtgttcgtgggctggaccgtgattggcctggcgatctacttcggctacggcatccaccacagtcgcctcgcgaaacgggcctaa

SEQ ID NO: 36471 - protein, 493 aa, Xanthomonas axonopodis pv. citri str. 306
MYRMLKSLLRVKPIEPAGHVDAGEPVEGSLQGEATLQRTLTAKHLIMLGIGAVIGAGIFVLTGQAAANHAGPAVMLSFVFAGIACAFAGLCYAEFAAMMPVSGSAYSYSYATLGEGIAWFIGWCLVLEYLFAGSSVAVGWSAYLISFITGTLGLPFPAELAGAPLAWDGHGFVSSGNLVNLPAVLIVAAVSILCYVGVTQSAFANAIVVAIKVVVICLFVGFGIAYIDPANWHPFIPENTGPGQFGWDGVFRAASIVFFSYIGFDAVSTSAGETKDPQKNMPIGILVSLAICTIIYIIVCAVLTGLLPYTQLGTAKPVATALEAHPQLTWLKTAVEIGAIAGLSSVVLVMLMAQPRIFYTMAKDGLMPKLFGKVHPKFRTPYVGTLFVGVVAALLAGVIPLNVLGELVSMGTLLAFATVCAGVLVLRFTKPDLARPFRVPLAMVICPLGALACLFLFFQAFQEHWKVFVGWTVIGLAIYFGYGIHHSRLAKRA

SEQ ID NO: 36472 - DNA, 1587 bp, Xanthomonas axonopodis pv. citri str. 306
  CDS (1)..(1587)
atgaccacacacgctgcgaccacgcaaggcaagttccacaagcgcctcagcctgaccgacctgacctttatcgggctgggttcgatcttcggttccgggtggttgttttcggccagccacgtctcatcgatcgcggggccggccggcatcgtgtcgtggatcctcggtgggatcgcggtgctgctgcttgggctggtgtattgcgaactcggcgcggcattgccgcgcgccggcggggtggtgcgctacccggaatattcgcatggcgccttgctcggttcgctgaccggcttcatcaccttgatcgcgttctccagcctgatcgcgatcgaagtggaagcggcgcggcaatacgcagcggcgtggttcccgtggttgagccagccgaacagcacccatcccagcgtcgtgggttggctggtgcagctggccttgctggtgctgttcttcgtactcaactatttcagcgtcaagacctttgcgctggccaataacatcgtcagcatcttcaagttcctggtgccgatcctggtgatcgtgctgctgatgcagcacttcgatgccggcaatctgagcgtgcatgggttcgcgccatcgggcatggcgggcgtggaggcggcgatctcggccggcggcatcatcttcgcgtatctggggttgaccccgatcgtgtcggtggccagtgaggtgcgcgacctgcagcgcaatattccaattgcgctgatcctgtcggtggcgctgtccacggcgatttacgtgctgctgcagctggcgttcctgggcagcatcccggccgcgcaactcgcgcaaggctgggcgggcatcgacaaggccttctcgctgccgtaccacgacatcgccctggccttgggcatggcgtggctggccgcgctggtgatctgcgatgcgatggtgtcgcccagcggcaccggcaacatctacatgaatgccacgccgcgcgtggtgtatggctgggcacgcagtggcgggttcttgccggtgctgacgcgggtggatccggcgtcgggcatcccgcgtccggcactgtggttgagcctgggcttgtcgatcttctggacgctgccgtttccctcctgggaaacgctgatcggcgtggtgtcggccgccttggtgctgagctatgcggtggcgccgatcacggtggcggctctgcgccgcagcgcgccggacttgccgcgcccatttttcgtgcgtggcctgccggtatttgggccgctgtcgttcatggtggcggcgttgatcgtgtactggtccacctggccgaccttgtcgtggttgctcggcttgcaggtgctggcgttcgtgctgtacgtgctattgcgcctgccttcgcgccagggccgcgcgcgcctggtgcggcaggtgcgcgcgtcgttgtggctgatcgtgttcttcgtgctggtgatgctggtgtcgtgggcgggtacgttcggcggacatggctggattgcgcatcccttcgatacgttgggcgtggcggtcatcgcgttgtgcatttatcactggggcgcacgcagcggtttgcgcagcgacgagcttgcgctggaggaggacgatggtgagtga

SEQ ID NO: 36473 - protein, 528 aa, Xanthomonas axonopodis pv. citri str. 306
MTTHAATTQGKFHKRLSLTDLTFIGLGSIFGSGWLFSASHVSSIAGPAGIVSWILGGIAVLLLGLVYCELGAALPRAGGVVRYPEYSHGALLGSLTGFITLIAFSSLIAIEVEAARQYAAAWFPWLSQPNSTHPSVVGWLVQLALLVLFFVLNYFSVKTFALANNIVSIFKFLVPILVIVLLMQHFDAGNLSVHGFAPSGMAGVEAAISAGGIIFAYLGLTPIVSVASEVRDLQRNIPIALILSVALSTAIYVLLQLAFLGSIPAAQLAQGWAGIDKAFSLPYHDIALALGMAWLAALVICDAMVSPSGTGNIYMNATPRVVYGWARSGGFLPVLTRVDPASGIPRPALWLSLGLSIFWTLPFPSWETLIGVVSAALVLSYAVAPITVAALRRSAPDLPRPFFVRGLPVFGPLSFMVAALIVYWSTWPTLSWLLGLQVLAFVLYVLLRLPSRQGRARLVRQVRASLWLIVFFVLVMLVSWAGTFGGHGWIAHPFDTLGVAVIALCIYHWGARSGLRSDELALEEDDGE

SEQ ID NO: 36474 - DNA, 1317 bp, Xanthomonas axonopodis pv. citri str. 306
  CDS (1)..(1317)
atgagcacaccgcagcccgcgccggacgcgacaggcttggtccgcgtcgtcagccgatggcagatcgtcggcctgtcgatcaacgatgtcatcggcagcggcatctacctgctgcctgccgcaaccgccgcgctgctcgggccgatgagcctgtgggccgtgatgctggccggccttgcggtcgccttgctggtgctgtgctacgcgcaggcgggcagctacttcgatacgcccggcggcagctacctctacacgcgcgaagcattcggcccgttcgtcggttttcagattggctggatgatctggctcacgcgcatcagttcggcggctgccttgagcaatggcctggccgacgcagtggcgcggttctggcccaccgccgccaccgatacctgggcgcgcttgctggtcgtcgtcggctcgctgggcctgcccaccgcgatcaacgtgatcggcgtgaaatcggccgcgcgtaccggcatcgcgctggtgatcggcaagctggtgccgttgttgctgttcgtggcgatcggcctgttctatgtcgattggtcatgggcgtttgccggcaccgcgcccgatctgcgcgacctgggcaatctcggtgaagcggccttgctgctgctgttcgcctacgcaggtttcgaaaacattcccgcagccgctggcgaataccgcaacccgcggcgcgatgtgccatttgcgttgatcaccatgatcgttaccgtcaccctgatctacgcagcggtgcaggtggtggcgcagggcaccctgcccaaccttgcggcctcgccgacgccgctggcagatgccgcaagccgattcggtggcgaagcgttggcactgatcctcaccgtgggcgccaccatttccatcctcggcaccaccagcaacaccgtgatgcttggcccgcgctttctgtttgcgcttgcgcgcgatggctatggccctgcgtttctggcacgcgtgcatccgcgcttccacacgcccgcagcggcggtgctcacgcagggcgcgttgtcgcttgcattggcattgtcgggatcgtttacgcagctggcgttactgtcgatggtcacccgcctgttcgcctacatcggcaccgccgcggcagtgatcgtgctggcgcgcaggtaccggcagcgcaccgacacgttgcgcctgcccggcggaccggccatccccatcgccgccttggtgctgtcgctgggcctgctggccagcgccagctggcagaatctggccgcagcaggcgtggcgcttttggtcggttgggtgttttatctgtttccgcgcaagcgggtcgaaggcggctga

SEQ ID NO: 36475 - protein, 438 aa, Xanthomonas axonopodis pv. citri str. 306
MSTPQPAPDATGLVRVVSRWQIVGLSINDVIGSGIYLLPAATAALLGPMSLWAVMLAGLAVALLVLCYAQAGSYFDTPGGSYLYTREAFGPFVGFQIGWMIWLTRISSAAALSNGLADAVARFWPTAATDTWARLLVVVGSLGLPTAINVIGVKSAARTGIALVIGKLVPLLLFVAIGLFYVDWSWAFAGTAPDLRDLGNLGEAALLLLFAYAGFENIPAAAGEYRNPRRDVPFALITMIVTVTLIYAAVQVVAQGTLPNLAASPTPLADAASRFGGEALALILTVGATISILGTTSNTVMLGPRFLFALARDGYGPAFLARVHPRFHTPAAAVLTQGALSLALALSGSFTQLALLSMVTRLFAYIGTAAAVIVLARRYRQRTDTLRLPGGPAIPIAALVLSLGLLASASWQNLAAAGVALLVGWVFYLFPRKRVEGG

SEQ ID NO: 36476 - DNA, 1416 bp, Xanthomonas axonopodis pv. citri str. 306
  CDS (1)..(1416)
atgtcgtcttggctcaggcgcaaatccatcgatcaggtcaccgtgcacgaggccggccggcaactggtccgcagcctgagttggccgcatctgatcgcgctgggcatcggcgccatcgtcggtaccgggatctacacgttgatcggcgtgggcgccgacaaggccggaccggcagtgttgctgtcgttcgtggcggccggcatcgtgtgcgcctgcgcggcgctggcctatgccgagatggccacgatgatgccggctgccggcagtgcgtatacctacagctacaccgcgctgggcgagagcattgcctgggtggtgggctggagcctggtgctggaatactcgctggtggtcagcacggtggcggtcggctggtcgggctatttcgtcggtttcctgcaatggttgggcgtggggttgccgcaggcactcattgccgggccgcacgccggcggcatcgtcaacctgccggcggtggcgatcactttcctggtggctggcctgttgatggccggcaccaaggaaagcgccacgctcaacgcggtactggtcgtgctgaagatcatcgcgctgggcgtgttcgtggccattgcgctgccggccttcaacagcgccaacctgcagccgttcatgccgtatggcttctccaaggcgatgggccccgatggcatcgagcgcggggtgatggcagcggcggcgatcatcttctttgcgttctacggcttcgatgcgatttccaccgcggccgaggaaaccaagaaccccgggcgcgatctgtcgatcggcatcgtcggttcgatgatcggctgcacgctgatctatgtgctggtggcgctggccgcggtgggtgcgatgagctttaccgtgttcggcaagagccccgagccgttggcgctgatcctgcgcgaactcggccacggcaaggcggccttggtgatcggtgcggtggcgatcattgcgttacccacggtgttgctggcgtttttgtacgggcagagccgcatcttcttcgtgatgtcgcgcgatggcttgttgccgcgcggcttgtccaaggtcaatgcacgcaccggcacgccggtggcgatcacgctgttcaccgcggtgctggtggcggcactggccggcgtggcccggctggacgaaatcgccgccttggccaacgccggcacgctggcggcgttcacggcggtggcggcctgcctgttggtgttgcgcgtgcgcgagcccggccgcgcgcgcgccttccgcacgccgctggcgtgggtggtgggaccggtggcgatcggcggctgcctgtatctgttctggagcctgccgagcaagacgcagggctggttcctgctgtggaatgcgctgggcgtggtggtgtacctggcgtatgggcggcggaatagccggttgaatcaggcgggctga

SEQ ID NO: 36477 - protein, 471 aa, Xanthomonas axonopodis pv. citri str. 306
MSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGVGLPQALIAGPHAGGIVNLPAVAITFLVAGLLMAGTKESATLNAVLVVLKIIALGVFVAIALPAFNSANLQPFMPYGFSKAMGPDGIERGVMAAAAIIFFAFYGFDAISTAAEETKNPGRDLSIGIVGSMIGCTLIYVLVALAAVGAMSFTVFGKSPEPLALILRELGHGKAALVIGAVAIIALPTVLLAFLYGQSRIFFVMSRDGLLPRGLSKVNARTGTPVAITLFTAVLVAALAGVARLDEIAALANAGTLAAFTAVAACLLVLRVREPGRARAFRTPLAWVVGPVAIGGCLYLFWSLPSKTQGWFLLWNALGVVVYLAYGRRNSRLNQAG

SEQ ID NO: 36478 - DNA, 2010 bp, Drosophila melanogaster
  CDS (1)..(2010)
atgccgagctcacgacgtgcgatcctgaggcacatattgtcgggcatttgcaccaagatgaatcgcaccaagtcggtgcccactgacgtcatggagacgccgctaaaccgatgcctcaacaccttcgacatcgctctattgggcattggccatatggttggcgctggcatctacgtgctgactggaactgtggccaaggaaatggccggacccgggatcatattatccttcatcctggccggatttatttcgatgctggccgccctatgttacgcggagttcgggactcgagtgcccaaggcgggatcggcctatgtgtacacctacatctcgatgggtgaattctgggccttcgtcatcggctggaatatcctgctggagcatatgctgggtgcagcttcggtggccagggcctggagtggatacgtggattcaatgctgggcggttggattgggaacacaacgctggagctaacgggtggcatccacgagcccggattggcccaataccccgacgtcttagccttcctggtctgcattgtttacgcggctgctctggccggaggagtaaaggccacggcggtgtttaacagtctcctcaccctggtcaatatagccgtgatggtgctggtcatcagcgtgggattctggtatgcggatggtaagaattggtccgaggctgagggtggatttctgccctacggcgttggaggagtcatcgccggtgcagccacctgtttctacgccttcgtgggcttcgattccatagccacttccggtgaggaggccaaaaacccatcggtatccatacccgtggccactgtgatctcattgttcgtggtgacagtgggctacatccttgtcagcgccgctctgacccttatgattcccatcagtgagatcaatccggctgcctcattgccggaggcatttgggcaattgaacctctcctgggccaagtaccttatctccatcggagctctgtgtggaatgaccaccaccctgttgggatccctgttcgccctgccacgctgcatgtacgccatggcctcggatggattgctcttcagctgttttgggaagattaacccgaccacccaggtgccactgctgaatctagtggtatccggggtaatgagtgcctgcctcgctttggtcttcgatctggccaagctggtggagtttatgtccattggcactttgttggcctacaccatcgtctcggccagtgtgatcatcctgcgatatcgtcccatggagcgaattcataccacgattagggtacccgcagtggctggaagtcccgacgacgacgacgatgatgacgaggatgtggcgtcccagtccagcatggatacctcctcaccgaccagtgagatgatagaggaagtcttagctggaagactaaaggcccagttcaggtgcttggaacccctactaggacgtttcgaaccgggatctgtggtgtccgtcgccgtgatgctgttcatcttcctgagctttgccatctgtgtggagctaaaggtgtcgtggacgcaactctatacgggcacctggtgggcactgatcatctatggattcatcatcttcgcagcaggcacttgcgtggccgtgatagctgtccataaccagaacacccgtggcctgatcttcaaagttcccctggttcccttcgttcctgcacttggaatcttttgtaacatcttgttgatggtccatctggatgccgtgacttgggtaaggttctttgtctgggtttgtatcggtatggtggtgtacttcctctacgggattcgtaacagcaaagagggcgaggtctgctcctcgtactccatccttatgaccacttcggaggctggaaaggtgccgtggggttccttcaaggcaacttccggtggcaagaagtccagtaagcactccatcttcgagagattcacaggacgcagcaagccggaggacaagaaatcaattgtagaggaaagcgaaaacgaaacgtccggatattcctaa

SEQ ID NO: 36479 - protein, 669 aa, Drosophila melanogaster
MPSSRRAILRHILSGICTKMNRTKSVPTDVMETPLNRCLNTFDIALLGIGHMVGAGIYVLTGTVAKEMAGPGIILSFILAGFISMLAALCYAEFGTRVPKAGSAYVYTYISMGEFWAFVIGWNILLEHMLGAASVARAWSGYVDSMLGGWIGNTTLELTGGIHEPGLAQYPDVLAFLVCIVYAAALAGGVKATAVFNSLLTLVNIAVMVLVISVGFWYADGKNWSEAEGGFLPYGVGGVIAGAATCFYAFVGFDSIATSGEEAKNPSVSIPVATVISLFVVTVGYILVSAALTLMIPISEINPAASLPEAFGQLNLSWAKYLISIGALCGMTTTLLGSLFALPRCMYAMASDGLLFSCFGKINPTTQVPLLNLVVSGVMSACLALVFDLAKLVEFMSIGTLLAYTIVSASVIILRYRPMERIHTTIRVPAVAGSPDDDDDDDEDVASQSSMDTSSPTSEMIEEVLAGRLKAQFRCLEPLLGRFEPGSVVSVAVMLFIFLSFAICVELKVSWTQLYTGTWWALIIYGFIIFAAGTCVAVIAVHNQNTRGLIFKVPLVPFVPALGIFCNILLMVHLDAVTWVRFFVWVCIGMVVYFLYGIRNSKEGEVCSSYSILMTTSEAGKVPWGSFKATSGGKKSSKHSIFERFTGRSKPEDKKSIVEESENETSGYS

SEQ ID NO: 36480 - DNA, 1815 bp, Drosophila melanogaster
  CDS (1)..(1815)
atgaccaatctctggaaggcattgacgcgtcgcaagacggaggacgtgaacgaaggcgagtcccagttggcgcgagtgctgaaccttttcgatctgacggctttgggagtgggcagtactttgggactgggagtctatgtgctggctggtcaggtggccttcaatattgccgggccagcggtgaccatttccttcctgattgcggccatcgcgtctgccttcgcggggatctgctatgcggagttcgccgcgcgagtgcccaaggcgggaagcgcctacgtatacagctacgtgaccattggagagttcgtcgccttcaccataggatggaatctcattctggagtatgtgattggcacagcctcagttgcgcgcggcctgagcggatatttcgactctctgatcaacaacaacatgtcgaaggcattgaatgagtcgatgcacatcgacgtcgactttctgggtgactaccccgattttttgtccttcggcatggtgctgctcctggcggccatcctcgcctttggcgccaaagagtcaagcttcctgaacaacatcttcaccacagtcaatctggttacgatcgctatcgtcctggtggctggcgccatgaacgccaacgtcgacaattggcgcatcccgaagaaagatgttcccgagggctttggcacgggaggcttcatgccgttcggcattgctggagtgatggccggagctgccaaatgcttctacggcttcgtggggttcgactgcatcgccaccacgggcgaggaggccatcaacccaaagcgcaacattccgctctctatcgtggtgtcgctgatcataatcttcctatcctactttggagtgtccacggtgctgactatgatgctgccctactacaaacaggacaaggatgcaccttttcctcacgctttcgattccgtcgagtggtacaccatcaagtggattgtgaccataggtgctgtgtttgcgctctgcactagtttgttgggcgccatgttcccactgcctcgcatcctctacgccatgggcaaggacggcatattgttcaagaggctgtccacagtgaacagctacacgaagaccccgctcctggccaccattgtgtctggaatctttgcgtccataatggccatgctctttaacctggaccagcttgtggacatgatgtccatcggaaccctgttagcatacaccatcgtggcaatttgcgtgctagtgctgcgctaccaggacgaggagatgaccaagctggtgtctgtcaaggcaccgaatgttttccggcaattcttcaacggcaactccttccgggagcccaattctatgacctcgtccatcaccaaagtcggcattgtggtgttcgccatcttttgcctggtctggtgctccctccagaaagtcttcgacctggacagcaccggcggaattgtggcgctcagcttggtgggcgctgtgctaatcctcatctgcgttgtgatcggcatgcagccggtgtcgaccattgagctcacgttcaaggtgccgctagtgccgttcgtgccgtgcctcagcgtctttgcgaatttgtacctgatgtttcagctggacctgaacacatggatccgcttcctcatctggatcgtgatcggctacgtgatttacttctgttacggcatgcggaactccacgcagataagtaggagccgcagtcacgccgaggtggcggcaagcgctctgcagaaccagggacagcacgtgaatcccggcttcgagccggactacaaggtcgaaaatgggggtcgaccctacgagttctccgagaagctgtaa

SEQ ID NO: 36481 - protein, 604 aa, Drosophila melanogaster
MTNLWKALTRRKTEDVNEGESQLARVLNLFDLTALGVGSTLGLGVYVLAGQVAFNIAGPAVTISFLIAAIASAFAGICYAEFAARVPKAGSAYVYSYVTIGEFVAFTIGWNLILEYVIGTASVARGLSGYFDSLINNNMSKALNESMHIDVDFLGDYPDFLSFGMVLLLAAILAFGAKESSFLNNIFTTVNLVTIAIVLVAGAMNANVDNWRIPKKDVPEGFGTGGFMPFGIAGVMAGAAKCFYGFVGFDCIATTGEEAINPKRNIPLSIVVSLIIIFLSYFGVSTVLTMMLPYYKQDKDAPFPHAFDSVEWYTIKWIVTIGAVFALCTSLLGAMFPLPRILYAMGKDGILFKRLSTVNSYTKTPLLATIVSGIFASIMAMLFNLDQLVDMMSIGTLLAYTIVAICVLVLRYQDEEMTKLVSVKAPNVFRQFFNGNSFREPNSMTSSITKVGIVVFAIFCLVWCSLQKVFDLDSTGGIVALSLVGAVLILICVVIGMQPVSTIELTFKVPLVPFVPCLSVFANLYLMFQLDLNTWIRFLIWIVIGYVIYFCYGMRNSTQISRSRSHAEVAASALQNQGQHVNPGFEPDYKVENGGRPYEFSEKL

SEQ ID NO: 36482 - DNA, 1518 bp, Drosophila melanogaster
  CDS (1)..(1518)
atggaaacggagtctctgaaccgcaagaactcctcgcggaagagttcaatcgtgaatgggaatggagatgcctctgccaagttgaccaacggcgatggagatggaggcggagacggaggcggagaggtgactctgaaggccaagatgagcctgctcaatggatgcaccgtcatagtgggctccatcatcggatcgggcatctttgtatcgcccacgggagtgctgatgtacacgggcagtgtcaacctggccctcatcgtttgggtcatttccggccttttctcgatggtgggtgcctactgctatgcggagttgggaacgatgatcaccaagtcgggtgctgattacgcatacatcatggagactttcggacccttcatggccttcatccgactctggatcgagtgcatgatcgtgcgaccctgctcccaggccatcgtagccctcaccttcagtacctacgtcctgaagcccttcttcccggagtgcactcctccggaggactcggcccgcctgctagccgtctgttgcatccttgtgctaaccctaatcaactgctgggacgtaaaatgggcgaccgctgtgcaggatatctttacatatgcgaaactgctggccctgtttatcatcattgccactggcgtttaccaactttacctcggcaacacgcaatactttacgtttgagaatacggacacgaaagtgacctccatcgcgctgtccttctactccggtctgtttgcctacaacggatggaattacttgaacttcatcattgaggagctgaaggatcccgtcaagaatctgccccgcgccatcgccatcagttgcaccctggtgaccattgtctatgtcatggcgaatgtatccttctacaccatcctgtcgccggatgaggtcatgggctcctcggccgtggcggtgacctatgcggagcgggccttcggcatgctggcctggaccattccagtttttgtggccttgtctacgtttggagcagtgaacggcattctgctgacctcctcccgactcttctacgccggagccaacaacggccagatgcccgagatcctcaccatgatccagatccagagattcacacccactcccgcggttttggccatggcgcttctatcgatgttgtacctcaccgtttcggacatctttgctctgattaactacgtcggctttgccacttggttgagtatcggtgtggctgtattgtgcctgccttggctgagatgggcccaacccaatctgccacgtcccatccgagtgcccatggtgttccccattgtctaccttattgccaccatattcgtgaccgtggtgcccatgtacgccagtccggtggagactggatacggcatccttatgatcctgtccagtatacccgtctacctggtgttcatcgcctggaagaacaagcccatttggttccagaagactatgggcggactgacacaagttctgcagaaactgatgatggttgtgcgtccaaaagcggcgtcaaagtaa

SEQ ID NO: 36483 - protein, 505 aa, Drosophila melanogaster
METESLNRKNSSRKSSIVNGNGDASAKLTNGDGDGGGDGGGEVTLKAKMSLLNGCTVIVGSIIGSGIFVSPTGVLMYTGSVNLALIVWVISGLFSMVGAYCYAELGTMITKSGADYAYIMETFGPFMAFIRLWIECMIVRPCSQAIVALTFSTYVLKPFFPECTPPEDSARLLAVCCILVLTLINCWDVKWATAVQDIFTYAKLLALFIIIATGVYQLYLGNTQYFTFENTDTKVTSIALSFYSGLFAYNGWNYLNFIIEELKDPVKNLPRAIAISCTLVTIVYVMANVSFYTILSPDEVMGSSAVAVTYAERAFGMLAWTIPVFVALSTFGAVNGILLTSSRLFYAGANNGQMPEILTMIQIQRFTPTPAVLAMALLSMLYLTVSDIFALINYVGFATWLSIGVAVLCLPWLRWAQPNLPRPIRVPMVFPIVYLIATIFVTVVPMYASPVETGYGILMILSSIPVYLVFIAWKNKPIWFQKTMGGLTQVLQKLMMVVRPKAASK

SEQ ID NO: 36484 - DNA, 1416 bp, Bacillus anthracis str. A2012
  CDS (1)..(1416)
gtggccaacctatttaaaaagaaatccgttacgcaattgttaggggaaagtaaaagtaaaactttaacgaaaacgctaggggcatttgacctaacaatgctagggattggtgcgataattggtacaggagtactagtattaacaggattagtagcagcaagagatgctggtccagcagttattttttcattcatgattgcagcgatcgtttgtggatttgcagcgttgtgttatgcagaagttgcatctacacttccggtttcaggtagtgtgtacacatattcatatgcgacaattggtgagtttattgcccatctaatgggatggacattattatccgtatatgtcgtaacaactgccgcagtagctggtggatggacgggttattttaataacttagtaagtggatttggattagaaattccaacagagctgttaaagattccatcacaaggtgggattgtgaatttaccagcagtagttattacattagttttaacttggttactatcaagaggtacgaaagaaagtaagcgtgtgaataacataatggtattaattaaaattggtattgttattttattcattgcagttggtgcgttttatgtacaaccagaaaactggacaccatttgcaccatacggtattagcggaatctttgccggcggagcagcagtattctttgctttcttaggatttgatgcattagcaacttctgctgaagaagtaaaaaatccacaacgtgatttaccaattggtattattgcttcgttagttatttgtacaattatttatgttgtagtttgtctcgttatgacaggtatggtttcttataaagaattagatgtaccagaagctatggcatatgtattagaagttgtaggacaagataaagtagctggtgtaatcgcagttggagctgtaattggtattatggctgtaatctttgcttacatttatgcaacgacacgtgtattcttcgcgatgagccgtgacggtttattaccaaaatcatttgcgaaaatcaataagaaaacagaagcaccagtattctcaacttggttaacaggtattggtagtgctttaattgctggatttatcgatttaaaagaattgtcgaatttagcgaatattggagcgttattaacatttgcgatggtaggtgtgtcagttattattcttcgtaaaacacatccaaacttaaaacgtggctttatggtaccacttgtaccaacgctaccgcttatttcaatcgcatgttgtctattcttaatgtttaacctgccattaacaacatggatttacttcggtatttggttagcaattggagtagttgtatactttgtttattcgaaaaagcatagtcatttaaaagacgatggaagttcgcaggataatttagaacaagctaattaa

SEQ ID NO: 36485 - protein, 471 aa, Bacillus anthracis str. A2012
MANLFKKKSVTQLLGESKSKTLTKTLGAFDLTMLGIGAIIGTGVLVLTGLVAARDAGPAVIFSFMIAAIVCGFAALCYAEVASTLPVSGSVYTYSYATIGEFIAHLMGWTLLSVYVVTTAAVAGGWTGYFNNLVSGFGLEIPTELLKIPSQGGIVNLPAVVITLVLTWLLSRGTKESKRVNNIMVLIKIGIVILFIAVGAFYVQPENWTPFAPYGISGIFAGGAAVFFAFLGFDALATSAEEVKNPQRDLPIGIIASLVICTIIYVVVCLVMTGMVSYKELDVPEAMAYVLEVVGQDKVAGVIAVGAVIGIMAVIFAYIYATTRVFFAMSRDGLLPKSFAKINKKTEAPVFSTWLTGIGSALIAGFIDLKELSNLANIGALLTFAMVGVSVIILRKTHPNLKRGFMVPLVPTLPLISIACCLFLMFNLPLTTWIYFGIWLAIGVVVYFVYSKKHSHLKDDGSSQDNLEQAN

SEQ ID NO: 36486 - DNA, 1404 bp, Bacillus anthracis str. A2012
  CDS (1)..(1404)
gtgaagtcattattacgaaaaaaagcgcttagtactgaatcaccacggcaactacaaagaacattaaccgcacttgatttaacgtttttaggaattggcgccgtaattgggacagggatatttgtattaacaggtattgttgcagcgaaacattctggtcctggtattatgctatcatttcttattgctgcatttacttgtgcttgtgtagccttttgttatgccgaatttgcttcttctattcctgtctcaggcagtgtgtatacttacgcatacatgacagtcggagaagtcgtcgccttcatcgttggatggtgtttaatgctcgaatatttacttgcagtcgcagcagtagctgtcggttggtctggttatttacaatctttactacaaggatttaacatccatctgcccgccataatcgcctcggcccctggcgtaggaaaaggtggtctcattgatttaccagctgtttgtattttactcatcattaccgttcttttaagttttggtatacgtgaaagcgcacgcattaataatattatggttcttattaaattggccgttattatcgcctttatcgtagcaggcgcaaaatatgtaaaacctgaaaattggacaccgttcattccattcggatacgacggtattattactggagctgccactgtattcttcgccttcttaggctttgatgcaatcgcaactgctgcggaagaaacgaaaaaaccacagcgcgatttaccaatcggcattatcggttcccttcttatttgtactgttttatatatgatcgtatctttcgttttaacaggtatggttccttatacacaattagatgtttctgatccagttgcgtttgccttacatttcgttggtgaagatacaattgcaggactactcgctgttggagcgatgactggaatgacaaccgttctcttagtcgttatgtatggacaagttcgcgtttcatatgcgatgagccgcgacggtttacttccaaaagcgttagcacgtgtaaataaaagagtgaaaatccctttattaaatacgtggattactggtgttgttgccgctttattagcaggacttttagacctgcacgtattagcgaatttagtaaacatcggtacattaacagcctttacattcgtttgctgcgcagtacttattttacgaaaaacacaccctgacttaaaacgcggattccgcacacctttcgtacctgtactaccagttgtcgcgattctttgctgcttatatttaatgatcaatttgtctaaaacaacatggattagctttgccatttggcttatagtcggattatgcttctatttcttctattctagaaagcatagccatttagctaccgaaaaaacgaatgatgaacagaaaaaagcataa

SEQ ID NO: 36487 - protein, 467 aa, Bacillus anthracis str. A2012
MKSLLRKKALSTESPRQLQRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNIHLPAIIASAPGVGKGGLIDLPAVCILLIITVLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMINLSKTTWISFAIWLIVGLCFYFFYSRKHSHLATEKTNDEQKKA

SEQ ID NO: 36488 - DNA, 1287 bp, Bacillus anthracis str. A2012
  CDS (1)..(1287)
atgaaaaataaagccattggattatttcaaggaattgcgttatacatttcagctattttaggatcaggtgtcctatttttatcaggggtaacggcctcaatagcgggccctgcatctattgtatcctggtttatcgttattataattagttttccgcttgcttattcctttgctagtttggcacggatatttcctgattccggtggagcagcaacctttgttagaaattcttttggatatcatcttggcaatatcgttgggtggttttactttgtaacagcagcagttggtcaaacgattgtatctttaactggtgctttttacgtcagtcaggcatttggattttcgcattttgaaacaattttaattgccgtctttattttggtaattgcaggtgtttccaattattacggcgtaaatgttagtggtaaagttgcattgattttaagttctttattactgattctttttgcgtcagctgtatttgtggcgtttccaagaatacaatggggaaattttaatccctttgttccaaatggatggttttctgtcgggaacgctataacggttatcttttggtcatttttcggttgggaggcgatttgtaatctggctgagcactttaaaaggccagaaaaagatattgtcaaaggagcagttattagtgcagttgtcattggattattatttttagcgctaagccttgtcactattggaacggccacgtatggcagtcaagaaagcaacctgtctcctattggtgttataatgggagatacagtaggcggaggtgccaaagtcgttacagctgttttagctttaattatttgtacagggacagcgaatgcttttgtagccagcctaacgcaattaggatattcattaagcagagatggtgctttcccaaaatttttctcaaggctgcatgcaactactcaaattccaagacagatggtattgtttgttatctgtttttcggtagcaggtgtgttagtgacaaaagctttgtcactaacgtttgatgatattttgtttataccgacttctcttgggattttagtttatgttctttcaatggcagcaggcgttaaattatttaggaagaacacaccggcatggtgggcatcgttaatctctttcattttatgtttgctggtgattccattttttcaattgtatatatttgttccgttaattgtcgtggctatatatacgatttatatgattttgagtaataagattttcgcctacaagggaggattaaaatctaatgaaggatcaaaataa

SEQ ID NO: 36489 - protein, 428 aa, Bacillus anthracis str. A2012
MKNKAIGLFQGIALYISAILGSGVLFLSGVTASIAGPASIVSWFIVIIISFPLAYSFASLARIFPDSGGAATFVRNSFGYHLGNIVGWFYFVTAAVGQTIVSLTGAFYVSQAFGFSHFETILIAVFILVIAGVSNYYGVNVSGKVALILSSLLLILFASAVFVAFPRIQWGNFNPFVPNGWFSVGNAITVIFWSFFGWEAICNLAEHFKRPEKDIVKGAVISAVVIGLLFLALSLVTIGTATYGSQESNLSPIGVIMGDTVGGGAKVVTAVLALIICTGTANAFVASLTQLGYSLSRDGAFPKFFSRLHATTQIPRQMVLFVICFSVAGVLVTKALSLTFDDILFIPTSLGILVYVLSMAAGVKLFRKNTPAWWASLISFILCLLVIPFFQLYIFVPLIVVAIYTIYMILSNKIFAYKGGLKSNEGSK

SEQ ID NO: 36490 - DNA, 1359 bp, Mus musculus
  CDS (1)..(1359)
atggcccggggactgcccagtactgcctgtttggcacgcttctgccagaaactgaaccgtctgaagccactggaagagtctagcatggagacatcactgcggcgctgcctgtccacactggacttgactctactgggtgtgggtggcatggtgggatctgggctctatgtgctcacaggcacagtggccaaggacatggctggccccgctgtgctcttgtcctttttggtggccgctgtagcctccctgctggcggccctatgctatgcagagtttggagcccgtgtgccccgtactggctcagcatacctattcacgtacgtgtccatgggggagatatgggcattcctcataggctggaatgtgcttctagaatacctcattggaggtgccgctgtagcccgtgcctggagtggctatttggatgccatctttaaccacagcattcgcaacttcacggagtctcacctgggcgtctggcaggtgcccttcctagctcactatccagattttctggccgctggcattttactcgtggcttctgcctttgtctcctgcggagcccgagtctcctcctggcttaatcacacgttctcagccatcagtctgattgtgatcctcttcatcattgtcctgggtttcatcctggcccgtcctcacaactggagtgcagaagaaggtggtttcgcacccttcggcttctctggcatcctggctggcacagccacctgtttctatgccttcgtgggatttgatgttattgctgcctccagtgaggaggccaaaaacccacggtgggcggtgcccatggccatcgccatctccctcagcctggcagctggtgcctatattctggtctccactgtgttaaccctcatggtaccttggcacagcctagaccctgactcggcgcttgctgatgctttctacaggcggggttacagctgggctggcttcattgtggcagttggctctatctgtgccatgaacaccgtcctgctcagcaacctcttctccctgccgcgcattgtctacgccatggctgccgatgggctcttcttccaggtgtttgcccgtgtacacccccggacacagcctcctggtcctgggggctcatcagcagcaaaagaagcaagacactttccagatccctttggtgcccctgactccagccctgagcatccttctcaacacttgcctcatgctgaagctgagctacctgacctggctacgctttatcttctggctgctggtcggacttgtcgtgtattttggctatggcatctggcacagcaaggagaaccagagggagccattggagctgactacagcacactacgtggtattccccagcggtag

SEQ ID NO: 36491 - protein, 452 aa, Mus musculus
MARGLPSTACLARFCQKLNRLKPLEESSMETSLRRCLSTLDLTLLGVGGMVGSGLYVLTGTVAKDMAGPAVLLSFLVAAVASLLAALCYAEFGARVPRTGSAYLFTYVSMGEIWAFLIGWNVLLEYLIGGAAVARAWSGYLDAIFNHSIRNFTESHLGVWQVPFLAHYPDFLAAGILLVASAFVSCGARVSSWLNHTFSAISLIVILFIIVLGFILARPHNWSAEEGGFAPFGFSGILAGTATCFYAFVGFDVIAASSEEAKNPRWAVPMAIAISLSLAAGAYILVSTVLTLMVPWHSLDPDSALADAFYRRGYSWAGFIVAVGSICAMNTVLLSNLFSLPRIVYAMAADGLFFQVFARVHPRTQPPGPGGSSAAKEARHFPDPFGAPDSSPEHPSQHLPHAEAELPDLATLYLLAAGRTCRVFWLWHLAQQGEPEGAIGADYSTLRGIPQR

SEQ ID NO: 36492 - DNA, 1488 bp, Chlorobium tepidum TLS
  CDS (1)..(1488)
gtgaaaaacagcttcagaaaaaagccgctttcgttgctgctcgaagagatgaagagcgagcaccggctcaaccgtgttctcggcccgttggcgctgaccagccttggggttggcgcgatcattggtaccggcattttcgtgctcatcggtgtagccgcgcatgacaaggcaggtcccgctgtaacgctctcctttgctcttgccgggctggcctgcgtttttgcggcgctctgttacgccgaattcgcctcgatggccccggttgccggttctgcttatacctatgcctacgccacacttggtgaacttttcgcctggatcatcggctgggatctcattctcgaatacgccgttgcatcggccaccgtggcgcacggatggtcacactactttcaggatttcatgggcatatttggcctgcacataccggaaatcttttcgcgagcgcctctcgacttcgatccggcaaccggctcgctggtgctgaccggctcgatgttcgaccttccggcggtcatcatcgtgctcattgtgacggtgattctggtcaaggggattcgtgaaagcgccgggttcaacacggcgatggtcatcgtcaaggtagctatcgtgctgctggtcattgttcttggtgcgcagtatgtcaagcccgaaaactggcagccttttgcgccgttcggttattcaggactgagcgtgtttggtcataccattcttggcgaaaccggagcgggtggtgcgcctgtcggcgtgctggcgggtgcggccatgattttctttgcctacatcggtttcgattcgatctcgacccatgccgaagaggcgcgccggcccgagcgtgatgtgccgatcggtattatcgcctcgctcatcatctgcacgatgctctatgttgcggttgctgcagtgattaccggcatggtgccttacgatcagatcaacattgatgcgccagtctcctacgcattcaagcaggtcggcctcgactgggcgcagtttctcgtctccctcggagccatcacaggcatcacctcggtgctgcttgtcatgatgctcagtcagccgagaatctttctggctatggctcgcgatggtcttttgccgaataagtttttcggcgtggttcacccgaagttcaaaacgccctggaatgcgaccattctcaccggcatttttgtggccattctcggcgcgttcctgccgcttcgcttgctggccgagctggtcaacatcggtacactcttcgctttcgtcgtggtctgcgcggcggtactcatcatgcgccgtaccaatcccgatgctgaacgcccattcagagcgccgctggtgcctttcgtgcccattgccggcattctgacctgccttctgctcatgttctcgctgcctgccgagaactggtggcggctcatcgtctggctgttgataggtttctgcatctacttcttctacggacgccaccacagcgttctgaaccagcatcacgactga

SEQ ID NO: 36493 - protein, 495 aa, Chlorobium tepidum TLS
MKNSFRKKPLSLLLEEMKSEHRLNRVLGPLALTSLGVGAIIGTGIFVLIGVAAHDKAGPAVTLSFALAGLACVFAALCYAEFASMAPVAGSAYTYAYATLGELFAWIIGWDLILEYAVASATVAHGWSHYFQDFMGIFGLHIPEIFSRAPLDFDPATGSLVLTGSMFDLPAVIIVLIVTVILVKGIRESAGFNTAMVIVKVAIVLLVIVLGAQYVKPENWQPFAPFGYSGLSVFGHTILGETGAGGAPVGVLAGAAMIFFAYIGFDSISTHAEEARRPERDVPIGIIASLIICTMLYVAVAAVITGMVPYDQINIDAPVSYAFKQVGLDWAQFLVSLGAITGITSVLLVMMLSQPRIFLAMARDGLLPNKFFGVVHPKFKTPWNATILTGIFVAILGAFLPLRLLAELVNIGTLFAFVVVCAAVLIMRRTNPDAERPFRAPLVPFVPIAGILTCLLLMFSLPAENWWRLIVWLLIGFCIYFFYGRHHSVLNQHHD

SEQ ID NO: 36494 - DNA, 1392 bp, Streptococcus pyogenes MGAS315
  CDS (1)..(1392)
atgactatttttcgtaaaaaaaagaaatattccaataaaacagaaatgcaaaggcacttcaaagttattgatttaatttttttaggcctaggttcaatggttggaacaggtatctttacagttactggcataggcgctgctaagtatgcaggtcctgctttaacaatatcgattatcatttccgcgattgctattggaattttagccttattttatgcagaatttgcgtctcgtatgccttctaacggtggtgcttatagttatgtttatgcaaccttgggagagtttccagcatggcttgttggctggtatattattatggaatttttaacagctatatctagtgttgctgttggctggggaagttatttaaaaggattgcttgccaattataatatagtattaccaaacgctttaaatggcacgttcaatcttaagaatggaacttacatagatattcttcctgttttagtgatgtttttcgtgacagggattgtcctaatgaattcgaaattagccctgagattcaatagttttttagttattttaaaattttcagcactggctttatttatctttgtaggcattttttttattgatcacaataattggtttcattttgctccatatggtgtaggacaaattactggaggtaaaacaggtatatttgctggtgcttctgttatgttctttgcatttttaggatttgaatctatttcaatggcagttgatgaagtgaaagaaccacaaaaaacaatccctaaaggcatcattttatctttgattattgtaacagcactctatatagttgtcaccactattttaacgggaattgtacactacactaaattaaatgttccagacgcggtggcttttgctttaagaaatattagactttattgggcagctgactatgtgtcgatagttgctattttgactcttattacggtatgtatttctatgacctatgcattagctagaacaatttacagtattagtagagatggtttattacctaaatcactttatactctcactaaaaaaaataaagtgcctcaaaatgctactcttgtcactggactacttgctatgatttgtgcgggaatatttcctttatcgagtctagcagagtttgttaatatttgtactttagcatatttaattattctgtcgggtgcaattattaaactcagaagaatagaaggagaaccaaaagcaaatgaatttaaaactcctctagtaccattcctaccaatgttggcaattatcatttgtctatcatttatgagccaatataaagcttttacttggattgcttttgctattgccacaattattggaacattaatctacttagcttatggttatactcattcaatagaaaataaataa

SEQ ID NO: 36495 - protein, 463 aa, Streptococcus pyogenes MGAS315
MTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWFHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 36496 - DNA, 1137 bp, Thermosynechococcus elongatus BP-1
  CDS (1)..(1137)
gtgttgatagccctaatcctagcagcagcgatcgctttgtgtaacggcctcagtagtgcccaattagctgcctcccatcctgtgagtgggggtacttacgagtatgggtatcactacctttctccccctttcggctttacagcagggtggatgtttttagtggccaaatcggcttccgcagccactgccgcccttgggtctgtggcctatctctaccaatggttgggcctagaagacagcagcggacgctggcaagttatggctgctctggggctactggcggtcttgaccggcgtggtgcttttggggatccgccgatcgactcaagtgaatctggggattctccttgtcacgttcaccagtctattgctctttgtggggattggccatctccaacagcggggaggatcaccttggctggcaacatcgcaacccctatcactcaaacatcttcttcaggcaacggcactcctctttgttgcctatgcaggctatgcccgtatcgctgtgctggcggaggaggttaaaaccccccggcaaaccattccccgggctattgtgctcaccattgtcattgcgctgctgctgtacctgagtgtcgcttgggttgtcctcggcagtcatcattcaggaaacctcactactgctgcctccctagcagtggtggcgagtcgctttggcgtaccttggctaccccctcttatggctttgggggcgatcgctgccctggtggggattttgctcaatctattgcttggcctctcccgtgtagtgttggcaatggcgcgacgacgagatttaccaccaactttagctcagattccaccccaaggaaaacaacctgtcgctgccattctcgctgtgagtggggggattgccctattgatcctccttggcaatgtgcaaacgacatggtcctttagtgcctttagcgtgctgatttactacgccattaccaatcttgccgcactgcaactgcaggagccacaatttccccgctggcttgcggttgcaggtttaattggctgtctcgggctggccttttgggtcgaagtccaagtctgggtatcggggtgcggtctccttcttcttgggctggcttggcactactggatgcggagggcaaaggccctttga

SEQ ID NO: 36497 - protein, 378 aa, Thermosynechococcus elongatus BP-1
MLIALILAAAIALCNGLSSAQLAASHPVSGGTYEYGYHYLSPPFGFTAGWMFLVAKSASAATAALGSVAYLYQWLGLEDSSGRWQVMAALGLLAVLTGVVLLGIRRSTQVNLGILLVTFTSLLLFVGIGHLQQRGGSPWLATSQPLSLKHLLQATALLFVAYAGYARIAVLAEEVKTPRQTIPRAIVLTIVIALLLYLSVAWVVLGSHHSGNLTTAASLAVVASRFGVPWLPPLMALGAIAALVGILLNLLLGLSRVVLAMARRRDLPPTLAQIPPQGKQPVAAILAVSGGIALLILLGNVQTTWSFSAFSVLIYYAITNLAALQLQEPQFPRWLAVAGLIGCLGLAFWVEVQVWVSGCGLLLLGLAWHYWMRRAKAL

SEQ ID NO: 36498 - DNA, 1374 bp, Shigella flexneri 2a str. 301; identical to SEQ ID NO: 9205
  CDS (1)..(1374)

SEQ ID NO: 36499 - protein, 457 aa, Shigella flexneri 2a str. 301; identical to SEQ ID NO: 9206

SEQ ID NO: 36500 - DNA, 1293 bp, Shigella flexneri 2a str. 301
  CDS (1)..(1293)
atgatgaacacggaaggtaataacggtaacaaacccctcggtctatggaacgtcgtttccatcggtattggggcaatggtgggggcggggatcttcgcgctgctggggcaggctgcgttgctaatggaagcctcgacctggggcgcctttgcttttggcggtattgtggctatgttttccggttatgcctatgcgcgtctgggggcgagctatcccagcaatggcggtattatcgacttttttcgtcgcggattaggcaacggcgtcttttcgctagcgctctcgttgctatacctgttgacgctggcggtgagcatcgccatggttgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtctctgcgccccccagctccggtgcgttcttctcctgtattgggataaccttccttgcctatgcgggctttggcatgatggcgaacgcggcggataaagtgaaagatccgcaggtcattatgccacgggcgtttctggtggcgattggcgttaccacgttgctttatatctcgctggcgctggttttgcttagcgatgtatcggcattagagttagaaaaatatgctgataccgccgtagcgcaggctgcttctccgctgctcgggcatgtgggttatgtgatcgtcgtcatcggcgctttactggcgacggcttcaggcattaacgcgaacctgttcgccgtgtttaacatcatggacaacatgggcagcgaacgcgaactgccgaagctaatgaataaatccctgtggcggcagagtacctggggcaatatcatcgtcgtggtgttgataatgctgatgacggcggcgctaaatttagactcactcgccagcgttgccagcgccacctttttgatctgctatctggcggtgtttgtggtggcgatccgcctgcgtcatgatattcacgcctcgttgccgattcttatcgttggtacgttggtgatgttgttggtgatcgttggctttatctacagcctgtggtcccagggcagccgtgcgttgatatggattattggtgcaatcttactcagccttattgtggcaatggtcatgaagcgtaataaaaccgtataa

SEQ ID NO: 36501 - protein, 430 aa, Shigella flexneri 2a str. 301
MMNTEGNNGNKPLGLWNVVSIGIGAMVGAGIFALLGQAALLMEASTWGAFAFGGIVAMFSGYAYARLGASYPSNGGIIDFFRRGLGNGVFSLALSLLYLLTLAVSIAMVARAFGAYAVQFLHEGSQEEHLILLYALGIIAVMTLFNSLSNHAVGRLEVILVGIKMMILLLLIIAGVWSLQPAHISVSAPPSSGAFFSCIGITFLAYAGFGMMANAADKVKDPQVIMPRAFLVAIGVTTLLYISLALVLLSDVSALELEKYADTAVAQAASPLLGHVGYVIVVIGALLATASGINANLFAVFNIMDNMGSERELPKLMNKSLWRQSTWGNIIVVVLIMLMTAALNLDSLASVASATFLICYLAVFVVAIRLRHDIHASLPILIVGTLVMLLVIVGFIYSLWSQGSRALIWIIGAILLSLIVAMVMKRNKTV

SEQ ID NO: 36502 - DNA, 1257 bp, Shigella flexneri 2a str. 301
  CDS (1)..(1257)
atgagtggactcaaacaagaactggggctggcccagggcattggcctgctatcgacgtcattattaggcactggcgtgtttgccgttcctgcgttagctgcactggtagcaggcaataacagcctgtgggcgtggcccgttttgattatcttagtgttcccgattgcgattgtgtttgcgattctgggtcgccactatcccagcgcatgcggcgtcgcgcacttcgtcggtatggcgtttggttcgcggcttgagcgagtcaccggctggctgtttttatcggtcattcccgtgggtttgcctgccgcactacaaattgccgccggattcggccaagcaatgtttggctggcatagctggcaactgttgttggcagaactcggtacgctggcgttggtgtggtatatcggtactctcggtgccagttccagtgctaatctacaaaccgttattgccggacttatcgtcgcactgattgtcgctatctggtgggcgggcgatatcaaacctgcgagtatccccttccccgcgccaggaaatatcgaacttaccgggttatttgctgcgttatcagtgatgttctggtgttttgtcggtctggaagcatttgcccatcttgcctcggaatttaaaaatccagagcgtgattttcctcgtgctttgatgattggtctgctgctggcaggattagtctactggggctgtacggtagtcgtcttacacttcgacgcctatggtgaacaaatggcggcggcagcatcgcttccaaaaattgtagtacagttgttcggtgtaggagcgttatggattgcctgcgtaattggctatctggcctgctttgccagtcttaacatttatatacagagcttcgcccgcctggtctggtcgcaggcgcaacataatcctgaccactacctggcacgcctctcttctcgccatatcccgaataatgccctcaatgcggtgcttggctgctgcgtggtgagcacgttggtaattcatgccttagagatcaatctggacgctcttattatttatgccaatggcatctttattatgatttatctgttatgcatgctggcaggctgtaaattattgcaaggtcgttatcgactactggcggtggttggcgggctgttatgcgttctgttactggcaatggtcggctggaaaagtctctatgcgctgatcatgctggtggggttatggctgtttctgccaaaacgaaaaacgccggaaaatggcataaccacataa

SEQ ID NO: 36503 - protein, 418 aa, Shigella flexneri 2a str. 301
MSGLKQELGLAQGIGLLSTSLLGTGVFAVPALAALVAGNNSLWAWPVLIILVFPIAIVFAILGRHYPSACGVAHFVGMAFGSRLERVTGWLFLSVIPVGLPAALQIAAGFGQAMFGWHSWQLLLAELGTLALVWYIGTLGASSSANLQTVIAGLIVALIVAIWWAGDIKPASIPFPAPGNIELTGLFAALSVMFWCFVGLEAFAHLASEFKNPERDFPRALMIGLLLAGLVYWGCTVVVLHFDAYGEQMAAAASLPKIVVQLFGVGALWIACVIGYLACFASLNIYIQSFARLVWSQAQHNPDHYLARLSSRHIPNNALNAVLGCCVVSTLVIHALEINLDALIIYANGIFIMIYLLCMLAGCKLLQGRYRLLAVVGGLLCVLLLAMVGWKSLYALIMLVGLWLFLPKRKTPENGITT

SEQ ID NO: 36504 - DNA, 1626 bp, Drosophila melanogaster
  CDS (1)..(1626)
atgcgcgataaaatatcacaactattttgcttgcaaaagaacgcatgcaaaaataattcaacagataataacagaggacataatgtgccaacaaaaacaacgagcaacgggaccatgtgcgccaatgggtctcttgggacagaagggcccgaagcgccagagaccgactcatcagggaccgggcggatgcggaagccgctggagaggaatggctcaacgcagaaccacgttgttcacctcgagagaaggctgggcctcttcagtggggtggctttaattgttggaactatgatagggtctggaatttttgtgtcaccctccggtttactggttcgcactggttccgttggagttagctttataatctggcttgcctgtggtgtgctctctctgctgggcgctctggcatacgctgaacttggcacgatgaacacgtcgtcgggggcggaatgggcctactttatggatgcctatggaccggcgccggcgtttctgttctcatgggtatcgactttggtgttgaagccatctcaaatggctataatatgcttatcatttgcacagtacgccgttgaggcctttgtgacggaatgcgatccgcccaggggtgtggtcaagatggtcgccctggtggcaattgtgatgatcctgttcgtgaactgctacagcgtcaacctgggaatggccgtgcagaacgtattcaccgccgccaaactggtggccgttgtggtcgtgatctgcggcggagcctggaaactgatgcagggcaacacgcagcatctgtcgaatgcatttaatggcccaatgcccaatgtgggcgccatcgccacggccttctacacgggtctgtgggcctacgatggctggaacaacctgaactacgtaaccgaggagatcaagaatcccagcaagaatctaccgcgctcgatcatcatcggcataccgctggtcacgctctgctatgcgctgatcaacatctcctacctggcggccatgtcgccgcaggagatgatcgagtcggaggcggtggccgtcaccttcggcaatcgcatcctgggcgcgctcgcctggctgatgccactcagcgtcaccatcagcacctttggcagcgccaatggaacgctcttcgcagctgggcgtctgtgctttgcggccagtcgagagggtcatctgctggatatcctctcctatgtccatgtgcgtcgtcttacacctgctccggggctgatattccactcgctgattgcctcggcaatggtgctccatggcacaattgattcgctgattgatttcttcagcttcaccgcctggatattctacggcggagcgatgctggccctgatcgtgatgcgctacaccaaacccaactatccgcggccctacaaggtgccgatcatcattcccgttgtggtcttggtcatctccgtgtatctcgtggcggcaccaatattcgagacaccgcgcgttgagtatctctatgccctgctcttcatattcgcgggcctgatcttctatgtgccgttcgtcaagctcggaatgacgccgagatttatgaacaaggtgacgctattctttcagctgctgctggaggtggtgcccacctcatcgatggccatgttcgagtga

SEQ ID NO: 36505 - protein, 541 aa, Drosophila melanogaster
MRDKISQLFCLQKNACKNNSTDNNRGHNVPTKTTSNGTMCANGSLGTEGPEAPETDSSGTGRMRKPLERNGSTQNHVVHLERRLGLFSGVALIVGTMIGSGIFVSPSGLLVRTGSVGVSFIIWLACGVLSLLGALAYAELGTMNTSSGAEWAYFMDAYGPAPAFLFSWVSTLVLKPSQMAIICLSFAQYAVEAFVTECDPPRGVVKMVALVAIVMILFVNCYSVNLGMAVQNVFTAAKLVAVVVVICGGAWKLMQGNTQHLSNAFNGPMPNVGAIATAFYTGLWAYDGWNNLNYVTEEIKNPSKNLPRSIIIGIPLVTLCYALINISYLAAMSPQEMIESEAVAVTFGNRILGALAWLMPLSVTISTFGSANGTLFAAGRLCFAASREGHLLDILSYVHVRRLTPAPGLIFHSLIASAMVLHGTIDSLIDFFSFTAWIFYGGAMLALIVMRYTKPNYPRPYKVPIIIPVVVLVISVYLVAAPIFETPRVEYLYALLFIFAGLIFYVPFVKLGMTPRFMNKVTLFFQLLLEVVPTSSMAMFE

SEQ ID NO: 36506 - DNA, 1866 bp, Drosophila melanogaster
  CDS (1)..(1866)
atgcccagctggagcgtgacgaatgcgtttcgcgtgctcacacgcaaaaagcccctggaggactcaaatgaatccaaattggccaaggtcttatccgccttcgatcttaccgccctgggaatcggatcgacgttgggtgtaggcgtttacgtcctagctggcgaagtgtccaagcaatatgccggtccagccgtggtcgtaagcttcctcatcgctgccatcgcctcgattttcgccgggctgtgctatgcggaattcggagctcgggttccaaaggcgggatcggcgtacatctacagctatgtgaccattggcgagtttatcgccttcctcatcggctggaatctcattctcgaatacgcaattggctctgccagtgtcgtcaagggtttaagcacctatctcgatcagctttgcggcaatccgatgagcagtttcctgggcacccacatgcccctcaacatcgagggaatgggtgcctatccggatctgtttgccttcgtggtgaccatacttttttccctggccattgcagttggagccaaggagtccaccagggtgaacaatgttttcactatgcttaatcttggagtcgtgttgttcgtcattatcgcgggtctttttaaagtttccagcagcaactggtccattccaaaatctcaggtacccgagggctacggcgatggtggatttatgccctacggagtttcgggcataataaaaggagctgcagtttgcttttacggcttcattggcttcgactgcattgccacagctggagaggaggccaagaaccccaagaagtccattccatttgctgtgattgtctcgctggccatgatcttcctagcctactttggagtgtccacagtgctgaccatgatgctgccctattttgagcaggatgagaaggctccgctgccccatgtcttccggataaatgggtggcatgtggccgagtatgttgtcagtattggagcgatgtttggactgtgctccagcatgatgggagccatgttcccgctgccaaggatcgtgtttgccatgtccaacgatggactgctgttcaaatttctcggagacattagcgagaagtacaagacccctttcaagggaaccatgatcacaggtatgctgactggcattctggcggcagttttcaatcttagccaactggtgaacatgatgtccattggcactttgttggcctattccatggtggccagttgtgtccttatgctgcgctacgaagtggacgatcgacgggagagccgcattgtggcaaacggacgtgccacgggtctggagcaggatcgtccgtgtgctctatggaggcgtatattcaacctaaatggtcagacagtacccacaaagcagacttcaaggatcgtcacctacagtgtcacgctgttctctctttggtgcatggttttctcgcagattctaaccaagttcgaggaggatctggctaacgtgacgtccttcgatggtattaagctggtgctaggcaccataccccttgcagtactgctcctggtcatctcgcgtcagccaacatcaggggtgaaattgtcgttcaaggtgcccttggttccctggctacccggcatttccattttgatcaacatttacctgatgatcaagttggacattctcacatggattcgcttcagtatatggatcgccataggcctggcaatcttcctggcctatggcatccgtcacagccggctgaggcagcgggaacagcgcaacaattccattgccatgatgcgggactgcagcaattcggcgttgttgggcggccaggagaactcaaagtacagcaacgaggtgcccctgatattgatgcacagtacatcctaa

SEQ ID NO: 36507 - protein, 621 aa, Drosophila melanogaster
MPSWSVTNAFRVLTRKKPLEDSNESKLAKVLSAFDLTALGIGSTLGVGVYVLAGEVSKQYAGPAVVVSFLIAAIASIFAGLCYAEFGARVPKAGSAYIYSYVTIGEFIAFLIGWNLILEYAIGSASVVKGLSTYLDQLCGNPMSSFLGTHMPLNIEGMGAYPDLFAFVVTILFSLAIAVGAKESTRVNNVFTMLNLGVVLFVIIAGLFKVSSSNWSIPKSQVPEGYGDGGFMPYGVSGIIKGAAVCFYGFIGFDCIATAGEEAKNPKKSIPFAVIVSLAMIFLAYFGVSTVLTMMLPYFEQDEKAPLPHVFRINGWHVAEYVVSIGAMFGLCSSMMGAMFPLPRIVFAMSNDGLLFKFLGDISEKYKTPFKGTMITGMLTGILAAVFNLSQLVNMMSIGTLLAYSMVASCVLMLRYEVDDRRESRIVANGRATGLEQDRPCALWRRIFNLNGQTVPTKQTSRIVTYSVTLFSLWCMVFSQILTKFEEDLANVTSFDGIKLVLGTIPLAVLLLVISRQPTSGVKLSFKVPLVPWLPGISILINIYLMIKLDILTWIRFSIWIAIGLAIFLAYGIRHSRLRQREQRNNSIAMMRDCSNSALLGGQENSKYSNEVPLILMHSTS

SEQ ID NO: 36508 - DNA, 1353 bp, Streptococcus agalactiae NEM316
  CDS (1)..(1353)
atggagaatcataattctattaaacagacctatggattaatgactacaattgctatgattgtaggtgtagtgattggttcaggcatttattttaaagttgatgacatccttaaatttactggtggagatgtctttttaggcatggtaattttagtactaggttctttttcgattgtttttggaagtttgtcaatttctgagctagctattagaacgagtgaaagtggtggtattttttcttactacgaaaaatatgttagcccagctttagcagcaactttaggcttgtttgcgtcttttttgtatcttccaactttaacagcaatcgtttcatgggtagctgcattttatactttaggtgaatcatcaagtttggaatcacagattattttagctgctgtttatattttagcacttagtctcatgaatatctttgctaagcgtattgcagggggattccaatctttaacgacctttgtaaaaatgattcctttagtcctaattgctttaattggtgctttttggtctgataaagctccacaacttccacaacatttaacagctattcagccgtcaaatgttggatggagttgggtgtcaggtctggtaccattgtattttgcatatgatggttggacaatttttgttagtattgcaccagaagtcaagaatcccaagaagaatttaccacttgcctttgtcattggtccagcgcttatcttattatcatatttggcatttttctatggtttgacacaaattttaggtgctagctttattatgacaaccggtaatgatgctattaattatgcagctaacattattttcggtcctagtgttgggcgtttattatctttcattgttattttatctgtattaggtgttgccaatggacttttacttgggacgatgcgtctacctcaagcttttgcggaacgcggatggatcaaaagtgagaggatggctaacataaatttgaagtatcaaatgtcattgccagctagtttgacggtgacggctgtagctattttttggctttttgttcactttatggttacaaaatttaatttattgccgggtagtgatattagtgaaattgctgtggtgtttaataatactagtttaatcattctttatgttttagtactcagcctttatctcaaaaaagatattaaaaataaatttaccggcttagtttcaccgattctagcaattttaggcggtttgatcctctttatcgggagtttgttaagtaatttctttacggttttaattttccaatgtttttgcttattattctgtttgatttgtcattatatctatcaaaaaaataacccaaaaactcatgaatag

SEQ ID NO: 36509 - protein, 450 aa, Streptococcus agalactiae NEM316
MENHNSIKQTYGLMTTIAMIVGVVIGSGIYFKVDDILKFTGGDVFLGMVILVLGSFSIVFGSLSISELAIRTSESGGIFSYYEKYVSPALAATLGLFASFLYLPTLTAIVSWVAAFYTLGESSSLESQIILAAVYILALSLMNIFAKRIAGGFQSLTTFVKMIPLVLIALIGAFWSDKAPQLPQHLTAIQPSNVGWSWVSGLVPLYFAYDGWTIFVSIAPEVKNPKKNLPLAFVIGPALILLSYLAFFYGLTQILGASFIMTTGNDAINYAANIIFGPSVGRLLSFIVILSVLGVANGLLLGTMRLPQAFAERGWIKSERMANINLKYQMSLPASLTVTAVAIFWLFVHFMVTKFNLLPGSDISEIAVVFNNTSLIILYVLVLSLYLKKDIKNKFTGLVSPILAILGGLILFIGSLLSNFFTVLIFQCFCLLFCLICHYIYQKNNPKTHE

SEQ ID NO: 36510 - DNA, 1452 bp, Staphylococcus epidermidis ATCC 12228
  CDS (1)..(1452)
atgggaagtttttttaatcggatgactcgaaaagagaatcctactatttatcaaagtaaagatgggcatcttaaacgcacattacgtgtacgcgactttcttgcactaggtgttggtacaattgtttctacatctatcttcactttaccaggtgttgtcgcggctgagcatgccggacctgctgtttcattgtcattcttattagctgctattgtggcaggtcttgtagcctttacttatgcagaaatggcatctacaatgccttttgctggttcagcttattcatggattaatgttctttttggtgaattattcggatgggttgccggttgggcgcttttagcagaatactttattgctgttgctttcgttgcttcaggcttttctgctaacttaagaggtcttattgcaccattgggcatttctttacctaaatcattatctaatccatttggaagtaacggtggtgtcattgatatcattgctgctgtagtgattattttaactgcattactattatcacgcggaatgaacgaagccgctcgtatggaaaatgtattggttatattaaaggtgttggccatcattttatttgtgattgttgggctaactgcgattaatttcagtaactatataccttttattccagaacataaagttactgaaactggcgactttggaggttggcaaggtatttatgctggagtttcaatgatttttttagcttatattggttttgactctattgctgctaattcagctgaagcgattaatccacagaagacaatgcctagaggaatcttagggtcactcatagtagcaattgtattgtttgtggccgtagcacttgttcttgttggcatgttccattactctcaatacgctgataatgcagagccagtaggttgggcattacgagaaagtggtcatggtattattgctgcaattgttcaagcaatttctgtcatcggtatgttcactgcattaatcggtatgatgcttgcaggttcacgtctattatattcatttggacgagatggtttactcccttcttggttaagtcaattgaatcacaaacatttacctaatcgagcacttgtcatacttacaatcattggcgtagttatcggatcaatgttcccgtttgctttcttagcacaattgatttccgcaggtacccttgttgcattcatgtttgtgtcactagcaatgtatcgattaagaaaacgtgaagggaaagatttacctaagccagagtttaaattacctttatatcctatattgcctgcaattacatttatattagtattgctagtattttggggattaagttttgaagctaagttgtatacactgatatggtttattgtaggtataattatttatttaatttatggaattagacattccaaaaagaatgatgaagaagcgtatcaagtacctagaaaataa

SEQ ID NO: 36511 - protein, 483 aa, Staphylococcus epidermidis ATCC 12228
MGSFFNRMTRKENPTIYQSKDGHLKRTLRVRDFLALGVGTIVSTSIFTLPGVVAAEHAGPAVSLSFLLAAIVAGLVAFTYAEMASTMPFAGSAYSWINVLFGELFGWVAGWALLAEYFIAVAFVASGFSANLRGLIAPLGISLPKSLSNPFGSNGGVIDIIAAVVIILTALLLSRGMNEAARMENVLVILKVLAIILFVIVGLTAINFSNYIPFIPEHKVTETGDFGGWQGIYAGVSMIFLAYIGFDSIAANSAEAINPQKTMPRGILGSLIVAIVLFVAVALVLVGMFHYSQYADNAEPVGWALRESGHGIIAAIVQAISVIGMFTALIGMMLAGSRLLYSFGRDGLLPSWLSQLNHKHLPNRALVILTIIGVVIGSMFPFAFLAQLISAGTLVAFMFVSLAMYRLRKREGKDLPKPEFKLPLYPILPAITFILVLLVFWGLSFEAKLYTLIWFIVGIIIYLIYGIRHSKKNDEEAYQVPRK

SEQ ID NO: 36512 - DNA, 1368 bp, Bradyrhizobium japonicum USDA 110
  CDS (1)..(1368)
atgacggcatcagatgcgggtactgcgccctggactggccggttgaccggaagaggggcgggtgtctccgttctggtcgcaaccgccatcgtcgttgccgacatgatcggggtcggcgtcttcaccagcctcggcttccaggtcaaggacatcccgtccggcttctcgatcctgctgctgtggagcgtcggcggcatcgtcgcactgtgcggggtgttctcctacagcgagctcggcgcgatgtttccgcgctcgagcggcgaatacaatttcctcggccgtgcctatcatcccgccttcggctttctcgccggctgggtctcggcgacggtcggctttgccgcgccggtcgcgctcgccgcgatggccttcggcgaatatgccaagtcggtcgtccccgacctgccgccgatcccgctcgccatcggcgtggtgtggctggtctcgctcgtgcaactgaccggcgtcaggcactcctcgaccttccagctgatctcgaccatcctgaaggtcgtgctgatcgtcgccttcctggtcgccggcttcatcatcggcgtgccgcagccgatcgccttcacgccgcagccgggcgacctcgcgcacatcgtcagcgcgcccttcgcgatcggcctcgtcttcgtgatgtactcgttctcgggctggaatgcggcgacctatatcatcggcgagatgaacatgccgcagcagaacctgccgcgcgcgctgctcgcgggcacgctgatcgtgctcgtgctgtatgtcgcattgaatgcggtgtttctctactccacgccggtcggcgcgctcgccggccagctcgatgtcgccagtgtcgccggcagcgccatcttcggcagcctcggcggccggatcgtcggcgccatgatctgcgtcggcctgatctcctcgatcagcgcgatgatgtggatcggtccgcgcgtgatgatgacgatgggggaggacattccggcgctgcgcgtgttctcgcgcaagtcgacgagcggcgcgccggcctatgccatcctgtttcagctcgcggtcgcgaccctgctgctgttcacgcgcagtttcgaggcggtgctcgacttcatccagttcgcgctcttgttctgctcgttcttcacggtcgccggcgtgatcaagctgcgcatcaccgatcctgacctgccgcggccctatcgcgcctggggatacccgttcacgccgctcgttttcctgctcgtgaccgcgttcatgatgtactacctcttgaccgagcggccggtgcagtcgctgtcggggatgttcgtcatgctctcgggcctgttgatttatgctgttttccgcaggcggccggtcgccgctggcacgtcacacaatcgcgaatag

SEQ ID NO: 36513 - protein, 455 aa, Bradyrhizobium japonicum USDA 110
MTASDAGTAPWTGRLTGRGAGVSVLVATAIVVADMIGVGVFTSLGFQVKDIPSGFSILLLWSVGGIVALCGVFSYSELGAMFPRSSGEYNFLGRAYHPAFGFLAGWVSATVGFAAPVALAAMAFGEYAKSVVPDLPPIPLAIGVVWLVSLVQLTGVRHSSTFQLISTILKVVLIVAFLVAGFIIGVPQPIAFTPQPGDLAHIVSAPFAIGLVFVMYSFSGWNAATYIIGEMNMPQQNLPRALLAGTLIVLVLYVALNAVFLYSTPVGALAGQLDVASVAGSAIFGSLGGRIVGAMICVGLISSISAMMWIGPRVMMTMGEDIPALRVFSRKSTSGAPAYAILFQLAVATLLLFTRSFEAVLDFIQFALLFCSFFTVAGVIKLRITDPDLPRPYRAWGYPFTPLVFLLVTAFMMYYLLTERPVQSLSGMFVMLSGLLIYAVFRRRPVAAGTSHNRE

SEQ ID NO: 36514 - DNA, 1434 bp, Xylella fastidiosa Temecula1
  CDS (1)..(1434)
atgttcaaacaactctgggccaccaaactctctcaacccagccaggacagtgccgaaggactcagcatgcaacgcgtccttggagtgtgggggttaactgcactgggtatcggtgcggtgattggcggcggcatctttgtcattaccgggcaagccgcggccaatcacgccggaccagccattatgctgtcgttcgcactcgcggcgatctgctgtacgttctgtgcgctggcgtatgccgaattcgcggcgatggtgccggtctctgggagcgcctacacctatacctatgccactttcggtgagctggcagcctggttcatcggttggatgctggtattggaatatggggtttctgccgcggcggtggcggtgagctggagcggctatttcctcagcttgttacagcatctgggcatccatctgcccgccgcactagtgaatgcgccattggacggcacgctgcacgccactggagccattgccaatctgccggcagccaccatcgtgctgctgctgacttggttgtgctacttcggcatccgtaagtcctcgaagatcaatatcgcaatggttgcactcaaaagcgggctgatcttgctgattattggcgtcggctggaaatacgtgaaccctgattactggcaaccgttcatcccgaccaatcaagggccgggcaaatacggatggaatggtgtgttacatggcgcgtcaatggtgtttttcgcctacatcggttttgaagcggtgtcggtggccgcgcaggaatcgcaccgtccacagcgcgaccttcctatcagcatgatgagtgcgttagcgatctgcaccgtgctgtacatcatgatggccgccgtcatgactggattagtcccttacacgcaactgggcacagatgagccagtcgtcaccgcagtcgccgcacacccccaactgggctggctgcgcgtcgtggtcgaaatcggtgcattggtcggactgtcttcggtcgtgttggtgatgctcatcggacaaccgcgcatctttatgatcatggccggtgatggcctgctgccaccgatattcagcacaatccactccaaacaccgcactccgcacatcaacacggtgatcaccggactaggtattgcgttgctcgcagcggtgttcccactggatgtactcggcgaactcacctcaatggggacgttgattgcctttaccgccgtctgtgccggcgtgctgattctgcgctgtactcggccagatctgccacgcccattccgaatgccggcagcatggttgttttgctccgctggtgtactcagttgcattaccttattgtcagcaatgaccaggcacaattggatgctgatgagcgtgtggactgttcttggtttttccctgtacttcagttacggatatcgccacagcaaactgcatcaagaaagcacctga

SEQ ID NO: 36515 - protein, 477 aa, Xylella fastidiosa Temecula1
MFKQLWATKLSQPSQDSAEGLSMQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIHLPAALVNAPLDGTLHATGAIANLPAATIVLLLTWLCYFGIRKSSKINIAMVALKSGLILLIIGVGWKYVNPDYWQPFIPTNQGPGKYGWNGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAAVFPLDVLGELTSMGTLIAFTAVCAGVLILRCTRPDLPRPFRMPAAWLFCSAGVLSCITLLSAMTRHNWMLMSVWTVLGFSLYFSYGYRHSKLHQEST

SEQ ID NO: 36516 - DNA, 1443 bp, Xylella fastidiosa Temecula1
  CDS (1)..(1443)
atgtcattcttgccatcgtttctaaagcgcaagtccattgatctaatcaccgtgcatgaagaaggacgacgcctggtccctacactgagctggccacatctgatcgcatttgggattggtgcaatcgttggcactgggatctacaccttaatcggggtcggggcagaaaaagcggggccagcagtcctcctctcattcgtcatcgctggggtcatctgtgcctgcgcagcgctggcatatgccgagatggcgacaatgatgccagtggcaggcagcacttatacgtacagctatgtggccctcggtgaggggattgcctggatcgtggggtggagtctcatcttagagtactcactggtggtcagcactgttgcggtgggatggtccgggtacatgactgggtttctcaagagcgtaggggtcgatatgccgctggcgctcaccgccggaccgtatgctggcgggataatcaatcttccagcggcagtgatcacctgcgttgtggctggactgctgatcgtcggcacaaaagaaagcaccacactcaacgcggttctggtggtggttaagatcattgcgctctctgtgttcgtcgtgatcgcgctaccacattttgatatggctcatctgaaaccattcatgccctatgggtttatcaagtcaatcgacaccggaggtgtggaacgcggggtgatggccgctgcagcaatcattttttttgctttctatggtttcgatgcaatctccaccgcagccgaggaaactaagaatccaagccgcgatctgtccatcggcatcatcggttctatgatcggatgcaccttaatttacgtattagtggcactagctgcgatcggtgcaatgcactacaccgtgttcggtcccagtactgaaccgctggcgctgattctgcggcaacttgaccaaggcaacaccgccaggctcatcggagcagctgcgattatcgcgctacccactgtactgttagcctttttatatggacaaagccgcattttgttcgtgatgtctcgggatgggctgctgccacgtggattgtcgacggtgaatgcacgcacaggaacaccgatcgccacgacactgttcaccgcagttctcgtcgcaacggcagcagggttggtgccattgggcgagattgccgcgctggctaatgctggcacgctgactgcgttcatcgcagtagctttatgcctgctggtactgcgggtacgtgaaccacagcgcgtgcgtgcattccgtacaccactggcttgggtcgtcgggccaatcgcaattgctggttgtttgtatctgttctggagtctaccaaagatgacacaatacctttttctgctgtggaacgcactgggattgtgtgtgtatctggtctatgggcgccacaccagcctgctatcaaaggcggtaagcatcgacacgccaagataa

SEQ ID NO: 36517 - protein, 480 aa, Xylella fastidiosa Temecula1
MSFLPSFLKRKSIDLITVHEEGRRLVPTLSWPHLIAFGIGAIVGTGIYTLIGVGAEKAGPAVLLSFVIAGVICACAALAYAEMATMMPVAGSTYTYSYVALGEGIAWIVGWSLILEYSLVVSTVAVGWSGYMTGFLKSVGVDMPLALTAGPYAGGIINLPAAVITCVVAGLLIVGTKESTTLNAVLVVVKIIALSVFVVIALPHFDMAHLKPFMPYGFIKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNARTGTPIATTLFTAVLVATAAGLVPLGEIAALANAGTLTAFIAVALCLLVLRVREPQRVRAFRTPLAWVVGPIAIAGCLYLFWSLPKMTQYLFLLWNALGLCVYLVYGRHTSLLSKAVSIDTPR

SEQ ID NO: 36518 - DNA, 1398 bp, Lactobacillus plantarum WCFS1
  CDS (1)..(1398)
atggggattttccagcgcattttccaaaaagaagatttggagcgctatttacaaaaagatagtcattttgaacgaaccctctccgcagtcgatctgattgcacttgggattggtgccgtcattgggaccgggattttcatcctacccggaacggttgccgcaacaaaagcgggacccgggattattttatctttcgttttggctgccattgtgtgtgccgtcgccgcaatgtgttacgccgagtttgcttcggtgctcccaatcgccggttccgcgtattcatacggaaacattgtctatggcgaaatgattggttggatcattggttgggctctggtactcgaatacgtcctagccgttgcgaccgttgccgttgggtgggccgcgtactttaattcattcattgctggttttggcctcaagttaccgaaagccatcaccggttcgtttgaccccgcccacgggacctatatcaacgtgatcgcaattctgattgtctgtctgattgcttggattatcgataccggcctaaaaacgtcgattcgattaaacaatattattgtggtcgtaaaattagcaatcattgtattgttcttattagtcggttcattttatgttaaaccaagtaactggacaccctttgccccatttggtgggacggaaattctcaagggcgccgcggtcgtcttcttcgcttacttagggtttgatgctgtgtcttcgtcggcagccgaagttaaaaatgccaagcgcaacatgccaattggaatcattgggaccctagtcatctgtaccatcttctacattctcgtttcaggagtgctgaccgggatggtttcgtacaaacagttgaacgttgacgatgcagtggcgttcgctttacaactcgtccatcaaaacttcgttgccggtattatctcgattggtgccctcgccggcatgttcacaatgatggttacgatgatctacagtagctcacggctattatattcaatcggccgtgacggcttactcccacgtttcttaggtaaaatcgataagcaccacgcccctaaaaacgccatgttgacggttacaatcgtgaattcaattcttgctggtctcattccgttagaccaattggcaaacttggttaatatcgggacattaattgccttcgccttcgtttcttttggaattttgctactacggcgtaatcccaagctcaacgcgatcaagggcttccgcgtgccactttacccggttctcccaattatttctggcttgctgtgcctgttcatgatgacccagctatccatggaaacttggctggcatccctagtctggttcctccttggtctcatcatttactttggctatggcattcggcatagtcgcatgaataaagctgatgagtaa

SEQ ID NO: 36519 - protein, 465 aa, Lactobacillus plantarum WCFS1
MGIFQRIFQKEDLERYLQKDSHFERTLSAVDLIALGIGAVIGTGIFILPGTVAATKAGPGIILSFVLAAIVCAVAAMCYAEFASVLPIAGSAYSYGNIVYGEMIGWIIGWALVLEYVLAVATVAVGWAAYFNSFIAGFGLKLPKAITGSFDPAHGTYINVIAILIVCLIAWIIDTGLKTSIRLNNIIVVVKLAIIVLFLLVGSFYVKPSNWTPFAPFGGTEILKGAAVVFFAYLGFDAVSSSAAEVKNAKRNMPIGIIGTLVICTIFYILVSGVLTGMVSYKQLNVDDAVAFALQLVHQNFVAGIISIGALAGMFTMMVTMIYSSSRLLYSIGRDGLLPRFLGKIDKHHAPKNAMLTVTIVNSILAGLIPLDQLANLVNIGTLIAFAFVSFGILLLRRNPKLNAIKGFRVPLYPVLPIISGLLCLFMMTQLSMETWLASLVWFLLGLIIYFGYGIRHSRMNKADE

SEQ ID NO: 36520 - DNA, 1332 bp, Lactobacillus plantarum WCFS1
  CDS (1)..(1332)
atgcaggaaacaaagcaagcaacgaccctgaaccgttcactcggtttttggtcagcactttcactcgtcgttggtacggttattgggtcaggaatcttcttcaagcaatcatcagtccttgatagtgcgggctcaccgagcgctgcgttactcgcctggttactaggtggactgattacgttgaccgcgggcttaacaatcgcccaggtcggtgcccaaatgccgcatacgggcggactctatgtctacatggaacaaatctatggtaaattgtggggctttctctctggttggatgcaaatcgccgtctacggtcccgctatcatcgcttcaattagcgcttacctcggtatattactagttggtttcttcaacctgcaggcgggttggcaggcgccactttcaattggcgtcatcgtcctgattggaatcctcaacatgttcgaaaaccgttggggcgccgcatttcaaattgcgaccacgttgggcaaattattaccgattgcggctattattatttttggactcttctatggtaatcagaacgcgctgggacagtctttacatacaattacccaatcaacgggtagtttcggggttgccgtcctcgcaacactttttgcctatgatggctggatcttagtcgctaacttgggtggcgaaatcaagaacccgcagaagttattaccacaagccattattttagggatttcaatggtcttgattgcgtataccttagtcagctatgggattctccacttcgtacccgcggcaacgatccacaaactcgggcaacaaacgacgctgtactttgcccaagcggcgtttggcacaattggcgggcgcctactgaacattgggattatcatctcgatggtgggctgtttaaacggcaagattatgaccttcccccgcatcgtgtacgccatggctgctcagaatcagctgccattcgctaaacaactcagttacttgcacaaaaaatcacacgagccgatcgccgcaaccattgccattctcgtttatgctagtattatgatcctgttctttaatccagatcgcttatcggacctctgtatcttcacggtctactgcttctacgtggcaaccttcgttggtgtctttattttaagaaaacgacgcccagcttctgagcgaccattctcgacacccggatttccgatcacaccgctgattgcgattctgggcgcactgttcgtgattatcagtgaaattggctcagacttatctggtgtactgatttccttggttatcgtggccgttgggttcccaatctattattggaagcagcagcaaaatcaaaatgcttaa

SEQ ID NO: 36521 - protein, 443 aa, Lactobacillus plantarum WCFS1
MQETKQATTLNRSLGFWSALSLVVGTVIGSGIFFKQSSVLDSAGSPSAALLAWLLGGLITLTAGLTIAQVGAQMPHTGGLYVYMEQIYGKLWGFLSGWMQIAVYGPAIIASISAYLGILLVGFFNLQAGWQAPLSIGVIVLIGILNMFENRWGAAFQIATTLGKLLPIAAIIIFGLFYGNQNALGQSLHTITQSTGSFGVAVLATLFAYDGWILVANLGGEIKNPQKLLPQAIILGISMVLIAYTLVSYGILHFVPAATIHKLGQQTTLYFAQAAFGTIGGRLLNIGIIISMVGCLNGKIMTFPRIVYAMAAQNQLPFAKQLSYLHKKSHEPIAATIAILVYASIMILFFNPDRLSDLCIFTVYCFYVATFVGVFILRKRRPASERPFSTPGFPITPLIAILGALFVIISEIGSDLSGVLISLVIVAVGFPIYYWKQQQNQNA

SEQ ID NO: 36522 - DNA, 1428 bp, Lactobacillus plantarum WCFS1
  CDS (1)..(1428)
atgaaagcatcacaacgattgctggttaaaaaatcagtcaatccagctaattttaataagggtggcctcgaaaagacgttgagcgcatttagtttaaccatgatgggtgttggcgcaatcgtgggttctgggatttttatcacacccggaattatcgccgctaagtatgccggtccggctgccatgctctcatttgtgattgctgcggtcgtgtgttcgttggccgcattatgttacgctgaattttcttcaaccattcccttggcggggagtgcctatacttacgtttataccgtttttggggaattcttagcgtggattcttggttggtctctgatctcagaatatttattcgcggtatcttcggtggcagtaagttggtcatcgtactttcagaatttaatgagcggctttggcctaaaactaccaacatttctgaccgccgcagctggtactgccggtgtcagtggtgctggattcaacttaattgcttttgtcgtggttttggccgtctcactgttattggtcggtgggctacaagagtcaacacgggtcaattcaattatggtaatcgttaagattctagtgattgttcttttcattggcgtggcaattttctttgtgaaacctgccaattatcatccgttcatgccccatggtgttagcggactggtcaaaggcgcgtcgttagcattctacgcgtatattgggtttgatgcggtgtcgactgcttcagaagaagtgaaaaatcctaagcgtaatatgccaatcggaattgtcggttcgttagtcgtagcatcgattttatacgtggcaatggccgccgttctggtcggggtcgtgcattacagtaagcttaacgtgggtgatcccgtggcgtatgccttagccgtcattcatcaaaactgggcggcggggattgtgtcactgggtgccgttgtcggtatgacgaccgttttgattgtcatgttatatggtgggacccggttactgtttgcgattagccgggatgggttgttaccgaaagtctttcggacggtcagtccccataccaaagtgccagttaagagtacttggatttttggcattattgccagtgtatttgcggctgtgattccattagataaaattgcggagttagtcaatattggaacgctatttgcattcgctatggtgtctatcggtgttgtcttcctgcgtcgacacgaaacgctacaacaaatcaatagttcatttaaagtaccattttatccagtgttaccagttgtctcgttcctcgcatgtgtctacctgatgcttaatttgcaggcatttacgtggcatatgtttggtatttggctggttattggcatcgtgatttactttgcctatagttatcggcactcccgtattcgagcagggttacgtgccaaagaatcaaaatcgtaa

SEQ ID NO: 36523 - protein, 475 aa, Lactobacillus plantarum WCFS1
MKASQRLLVKKSVNPANFNKGGLEKTLSAFSLTMMGVGAIVGSGIFITPGIIAAKYAGPAAMLSFVIAAVVCSLAALCYAEFSSTIPLAGSAYTYVYTVFGEFLAWILGWSLISEYLFAVSSVAVSWSSYFQNLMSGFGLKLPTFLTAAAGTAGVSGAGFNLIAFVVVLAVSLLLVGGLQESTRVNSIMVIVKILVIVLFIGVAIFFVKPANYHPFMPHGVSGLVKGASLAFYAYIGFDAVSTASEEVKNPKRNMPIGIVGSLVVASILYVAMAAVLVGVVHYSKLNVGDPVAYALAVIHQNWAAGIVSLGAVVGMTTVLIVMLYGGTRLLFAISRDGLLPKVFRTVSPHTKVPVKSTWIFGIIASVFAAVIPLDKIAELVNIGTLFAFAMVSIGVVFLRRHETLQQINSSFKVPFYPVLPVVSFLACVYLMLNLQAFTWHMFGIWLVIGIVIYFAYSYRHSRIRAGLRAKESKS

SEQ ID NO: 36524 - DNA, 1500 bp, Lactobacillus plantarum WCFS1
  CDS (1)..(1500)
atgcaacggttattaaaacggttaactttaaaggaagatccaagcatatatgaagacaaagattctcacctagctcgagtattgacggtcaaggacttcttggctttaggggtggggacgattgtttcaacgtcaatttttacattacccggagtggtggctgcgaaccatgcgggccctgcggtagtcttctcattcatcgtcgcagccgtcgttgccggcctggttgcatttgcttatgctgaaatggcggcggcgatgccgtttgccggttctgcttattcgtggatcaacgtaatgttcggtgaattctttggttggatcgctggttgggcgttgcttgcggagtactttattgcgttggcattcgtcggttcaggactgtccgccaatctgcgggggctcttgtcaccattaggactaactctaccgaaagctttgtcaaatacgtttgggactgatggtggtgtggtcgacctgattgccgtcttggtgattgcgctggtctcgttactgctctcacgtggaatcagtaaggcctcccgggtcgaaaacgtgttagtggtgttgaaagtgttagccgtactcacgtttatcgtcgtgggtgcgacggcgatccacgtgcaaaactacgtcccgtttatccccaagtatcatttaaacgctgatggtagtgcttttgggggctggcaaggaatttatgccggggtatcgatgattttcttagcttatattgggtttgattcgattgccgctaattcagcggaagctaagaatcctggcaaaacaatgccacgaggaattcttggttcactcgtcattgcggtggtactctttgtggctgttgctttggtcttagtcggtatgttcaaatattcatcatatgctaataacgctgaaccagtcggctgggcattacgacaagctggccatccgattgttgccagtgttattcaggccattgccgtgctgggaatgtttactgcgctgattgggatgactttagcagggtcacggctaatttattcctttgggcgtgatggtatgttacctaagtggcttggcaagttacatcgtaatcaacctaataacgcgctacttgtgttaacaatcgttgctattatcattggggcgttttgcccgtttgcttttctggcccaattgatttcagcgggaaccctgattgccttcatgtttgtctcgctgggaatctatgctttgcggcgtcgtgaaggtgttgatattgcggtaccagcctttaagatgccgttctatccagttttaccagctattgcctttctaggcgcactgttcgtttttatgggcttagatatccaggcaaaattatacgcgggcgtgtggttcatcgtcggtttagtgatctactttagctatggtatgcgtcactcatatttggctgaaaaacgtctgtctgagactgatactgcggctaaatcagcttcgaaggtggctgattcgactgttgaagagcgtgactga

SEQ ID NO: 36525 - protein, 499 aa, Lactobacillus plantarum WCFS1
MQRLLKRLTLKEDPSIYEDKDSHLARVLTVKDFLALGVGTIVSTSIFTLPGVVAANHAGPAVVFSFIVAAVVAGLVAFAYAEMAAAMPFAGSAYSWINVMFGEFFGWIAGWALLAEYFIALAFVGSGLSANLRGLLSPLGLTLPKALSNTFGTDGGVVDLIAVLVIALVSLLLSRGISKASRVENVLVVLKVLAVLTFIVVGATAIHVQNYVPFIPKYHLNADGSAFGGWQGIYAGVSMIFLAYIGFDSIAANSAEAKNPGKTMPRGILGSLVIAVVLFVAVALVLVGMFKYSSYANNAEPVGWALRQAGHPIVASVIQAIAVLGMFTALIGMTLAGSRLIYSFGRDGMLPKWLGKLHRNQPNNALLVLTIVAIIIGAFCPFAFLAQLISAGTLIAFMFVSLGIYALRRREGVDIAVPAFKMPFYPVLPAIAFLGALFVFMGLDIQAKLYAGVWFIVGLVIYFSYGMRHSYLAEKRLSETDTAAKSASKVADSTVEERD

SEQ ID NO: 36526 - DNA, 1341 bp, Lactobacillus plantarum WCFS1; identical to SEQ ID NO: 9305
  CDS (1)..(1341)

SEQ ID NO: 36527 - protein, 446 aa, Lactobacillus plantarum WCFS1; identical to SEQ ID NO: 9306

SEQ ID NO: 36528 - DNA, 1425 bp, Lactobacillus plantarum WCFS1
  CDS (1)..(1425)
atggatttatcacacacgcggttactccgcaaaaaagatatcaatgccatgttagccacttatcacagtccgctcaaaaaggaacttaaaacatttgacctaacgatgctgggaattggggccatcatcgggaccgggattttcgttttaactggtacgggggccttgacggctggtcccggcctaatgatctcattcgtcttagctgcaattgcttgcctgtttgcttcactctgctacgctgaattcgctgcgatggtgcctgaaagtgggtcagcgtacacctatgcctacacaaccctcggcgaaattgttgcattcattatcggctgggacttgatgttagaataccttttcgctgtctcaaccgtttcagcgggctggtcaggctactttcaatcattcttggcgggcttcggcctcaaactgcccgctgctttgtcggcagctgcaggttccgtccctggtgtgaccagctattttaatctgccggccttcaccattattatcctgattaccactttattgtctctcggggtcaaagaaactaaacgcgtcaataacgtcatggtagtgattaaattagccgttgttcttttattcatctttaccgcagtgcgcttcatcaagccggcaaactggagtccgttattaccgtttggcttcaagggcgtattcggcgcagcttctagcgttttcttcgccttcatcggttttgacgccatttcatctagcgttgaagaaacattggaaccatccaaaacactcccacgttccatgttactgtctcttggtatctgtaccattctctacgtggctgtatcagccatcatgactggcgtggtcccatttgaaacgtttgccaagtacattgatcatccgatttcggccgttcttatttactccggtcaaaattggatggccggaatcattgaccttggcgcgattcttggtatgaccactgtaatgttagtctgtctctacggtcaaactcggatttccttctccatgtcgcgggatggattactcccccatgtctttagcgatattagtgccaagaccggtgcaccacttaaatcaaccgtcttatttgggtcgattgccgcaatcatgggtggctttattccattagctgacttagctgaactggtgaatatcggtactttgactgcctttaccctagtttccttctccatcttacggctacgtaaaacacaaccagatcttcggcgtcccttcaaaacgccgtgggtcccgtttgtaccaatcatgtcaatcatctgttgtgtcttcctactaatcaacctgaagcctgtcacttggattcgcttcgtggtatggttagccatcggtatggtcgtttactttggctattccgttaaacactcccagttgaagacggatacagccaccgatgagaaataa

SEQ ID NO: 36529 - protein, 474 aa, Lactobacillus plantarum WCFS1
MDLSHTRLLRKKDINAMLATYHSPLKKELKTFDLTMLGIGAIIGTGIFVLTGTGALTAGPGLMISFVLAAIACLFASLCYAEFAAMVPESGSAYTYAYTTLGEIVAFIIGWDLMLEYLFAVSTVSAGWSGYFQSFLAGFGLKLPAALSAAAGSVPGVTSYFNLPAFTIIILITTLLSLGVKETKRVNNVMVVIKLAVVLLFIFTAVRFIKPANWSPLLPFGFKGVFGAASSVFFAFIGFDAISSSVEETLEPSKTLPRSMLLSLGICTILYVAVSAIMTGVVPFETFAKYIDHPISAVLIYSGQNWMAGIIDLGAILGMTTVMLVCLYGQTRISFSMSRDGLLPHVFSDISAKTGAPLKSTVLFGSIAAIMGGFIPLADLAELVNIGTLTAFTLVSFSILRLRKTQPDLRRPFKTPWVPFVPIMSIICCVFLLINLKPVTWIRFVVWLAIGMVVYFGYSVKHSQLKTDTATDEK

SEQ ID NO: 36530 - DNA, 1290 bp, Salmonella enterica subsp. enterica serovar Typhi Ty2
  CDS (1)..(1290)
atggataccctgcaacaatctccgccagcagagcctgaaggcggtctgcggcgtaacctgaagaagcggcacctgctgatgatgtcgctgggcggcacgattggcaccggcttatttatcggcattgccgaaccgttaagcagcgtcgggccggcgggaaccttactggcctatctgtttgccggaaccattatgctggcgacgatgatgtgtcttggcgaattatcatgcgcctttcctcactccggttcatttcaacattacgcgctgatgtttatgccgtcaccttgctggagctataccattggctggctttactggtttagctgggtcttttccctggcagccgacctcactgccgcagggtttattgctcaccagtttttccccgcggttccggtatatatgttctgcctggcgattctgctcatcctgacggctatcaatctcacctccgcaaaaagttttggcgaatgcgaatactggctttcggccattaaggtcttcgcgatcgtgctgtttatctgcgcgggcggggtcatgatctactcgctaatgggccatagtgactggcacccgacgttaaaaacagacggaatgtggtttccccacggttgggagcaaattgtggtctgtatgacgatcgtgatttactccttccagggggtggaactggtcggaaatgcggcaggggagaccgaatcgccgcacattattttaccgaaggtgatcctggggatcggtctcagaatcattttgttttacggcctggcgattgcggtgctggcgctggtctatccgcatgaactgacgccaaatggacaaagtccctttgtatgggtattctcccacgcgggcattccgggggcggatacgctgatgacgctggtgatcttttccgccgcggtttctgccgctaactcggccatttacgccagttcgcgtatgctgtggtctatggcgggcgatcgctttgcgccagcctgctttggtaaaacgaacggcggcggcgtgccggtgtatgctattttaatcacggccttgctggcgttggtgtcgttgctgacccgctatattcccgcacagcaattttatttatatctgatcgccagtaccgggcaggtgggttgcctggcatggataaccatcggatggtgccagtatcgcttccgacaatcggtgcgtaatggcacgtacgccagcgatttgctacgctatcgatcgccgctttttccctggacggcccgatttgtcattatcaccaattttgccattatggtcggcacctag

SEQ ID NO: 36531 - protein, 429 aa, Salmonella enterica subsp. enterica serovar Typhi Ty2
MDTLQQSPPAEPEGGLRRNLKKRHLLMMSLGGTIGTGLFIGIAEPLSSVGPAGTLLAYLFAGTIMLATMMCLGELSCAFPHSGSFQHYALMFMPSPCWSYTIGWLYWFSWVFSLAADLTAAGFIAHQFFPAVPVYMFCLAILLILTAINLTSAKSFGECEYWLSAIKVFAIVLFICAGGVMIYSLMGHSDWHPTLKTDGMWFPHGWEQIVVCMTIVIYSFQGVELVGNAAGETESPHIILPKVILGIGLRIILFYGLAIAVLALVYPHELTPNGQSPFVWVFSHAGIPGADTLMTLVIFSAAVSAANSAIYASSRMLWSMAGDRFAPACFGKTNGGGVPVYAILITALLALVSLLTRYIPAQQFYLYLIASTGQVGCLAWITIGWCQYRFRQSVRNGTYASDLLRYRSPLFPWTARFVIITNFAIMVGT

SEQ ID NO: 36532 - DNA, 1392 bp, Enterococcus faecalis V583
  CDS (1)..(1392)
atgtctattttcagaaaaaaagaaatcactgtgcctgtcaatgacagtggtgggatgaaaaaaaatcttaagacgatggacttaatttttctaggaattggggctgtagtaggaacagggatttttgttgtgacaggtgtcgcagcggaacgctatgcaggtccagggctcgtcttatcatttctggtagcagcagccgcgattattttatctggtttatgctatgcagaatttgcatcacgtattccggtcattggtgggccgtatgcctacatgtatgtggtctttggagaaattgtggcttggatgactggttggatgattatttgtgagtttttcttggcggtttcatccgttgcttcaggttggtcaggctatgtccatggctttttggatagcttaggtttttctttgccgcaagcgttaagtggcgcttataatccaacaaatggtacatatattgatttgattgccatgttggtcgttgtagccgtaactttttgggtatctttagaagcgaaaacagcgttacgtttaaataacttaatggttttcgtgaagtttgggattattttattatttgttctcgtgggaatcttttatgtgaaaccaacgaactggcaaccatttattccttatggtttttcaggcgttttcagtggtgctgctttagttttctttgcctttctagggtttgatgcggtcagcatggccgcggaggaagtgaagaatccgaaaaaagatattccaaaagggattattggttccattattatttcaacattgttatatattgttgttacgttagttttaactgggattgttccatttacggatttaggggtcaaggatccggtggcttttgcgatgcgcttcattaatcatggcgcaattgcgacaatcatttcagttggtgctattttaaccttattaacagtgacgattgcgatgatgtacagtttagcccgtgtgatttatgcgattagtaaagatggattattgccgcagtttatgagcaaaatcgatgagaagcggcacacacctaagaatgcaacctatgtagctggatttttagcaatggtttttgctgggattgttccaatggagatgttggctgaacttacaaatatcgtgacactcttttatctgatgtttctcgctttaggaattatcaaattacggacaatgaaaggagaaccgcaagcaggtgaatttaaagtaccacttgtgccggttctaccattaatttcaatcgtggtttgcgccgctctgatgttccaattgtctttagctacttggcaagtatttggcgtagccgtagtgattggtttggctatttatttcttttatggacgtcaccatagtatcgttcgtttcgagacaaaagaataa

SEQ ID NO: 36533 - protein, 463 aa, Enterococcus faecalis V583
MSIFRKKEITVPVNDSGGMKKNLKTMDLIFLGIGAVVGTGIFVVTGVAAERYAGPGLVLSFLVAAAAIILSGLCYAEFASRIPVIGGPYAYMYVVFGEIVAWMTGWMIICEFFLAVSSVASGWSGYVHGFLDSLGFSLPQALSGAYNPTNGTYIDLIAMLVVVAVTFWVSLEAKTALRLNNLMVFVKFGIILLFVLVGIFYVKPTNWQPFIPYGFSGVFSGAALVFFAFLGFDAVSMAAEEVKNPKKDIPKGIIGSIIISTLLYIVVTLVLTGIVPFTDLGVKDPVAFAMRFINHGAIATIISVGAILTLLTVTIAMMYSLARVIYAISKDGLLPQFMSKIDEKRHTPKNATYVAGFLAMVFAGIVPMEMLAELTNIVTLFYLMFLALGIIKLRTMKGEPQAGEFKVPLVPVLPLISIVVCAALMFQLSLATWQVFGVAVVIGLAIYFFYGRHHSIVRFETKE

SEQ ID NO: 36534 - DNA, 1500 bp, Enterococcus faecalis V583
  CDS (1)..(1500)
atgacaaattttctttttgtggttttcaaacttgaaattctaaaagaaatagctatactgaaaagagatcgtcacagaatttttcatgaaaacagctattattttcgttatcttttcaaaaaagtggaaattttgttacgcttttttagtttaaatgaaatgagggagtctatggagaaaaagcaattaaaaagagagataacaacgtttggtgcgttatccacggtaatgggtacggtgattggcgctggtgttttctttaaagctgcgagtgtcgttggacacgcacagtcagctagtttagctatctttgcttgggtgttaggtggtgccttaaccatttgtgcaggattaaccagcgccgaacttgctacagcaatccctgaaacaggtggcgcagtgaagtatattgaatatacatatggtaaattagctggttttcttttagggtgggcacaaagtatcatttattatcctgccaacatttcggcgttatccattatttttagtacacaactaatcaatttgtttcatctatcggcaaatttattgattccaattgccattcttgcgggaaccagtatcacgataattaatttattaggaacaaaaattgcttctttggtccaatcaacgacattggtagtaaaactgattccaattgccttgatttctttagtaggattatttactcccggacaagtagctgtttcactttttcctgttgaaacaacagcgaatactggctttttagttgcttttagtggcgccttagtcgccaccatgtttgcttatgatggctggctgggtgtgggtaacgtggctggtgaaatgaagcgaccagaaagagacttgcctaaagccattatttttggtttgttattgattactttaatttatgccttaattaattttgtgtttctaaaaacattaccaattgagcaaatcgctgggaatttgaatgcagcttcggatgcttctgtggctatttttggaccaattggcggcaaaatcgtaactattgggattttaatctctgtatatggtgcgttaaacggctacacaatgacagggattcggattccttatgccttagccttagataatctgatgccttttagtcgtcagtttcaaaagttgtctaaacgctttgttgttccttacgttgctggaattttccagttagctgtagccattatcatgatgtttttcggaaccttcgatttattgacggatatgttagtttttgttatgtggctgtttaatctattaattttcttagctgtttttattttaagaaaacgagaacctgaattaaaacgaccgtataaagttcctggctatccaattattccaattatcgcaagtctaggtggtatcttcatcttggttacaacgagtattacacagcctattctagcattgattggtatagggattacgcttctaggaattccagtttatttagttaataaacaaaaaacgaagccaaaaacgtaa

SEQ ID NO: 36535 - protein, 499 aa, Enterococcus faecalis V583
MTNFLFVVFKLEILKEIAILKRDRHRIFHENSYYFRYLFKKVEILLRFFSLNEMRESMEKKQLKREITTFGALSTVMGTVIGAGVFFKAASVVGHAQSASLAIFAWVLGGALTICAGLTSAELATAIPETGGAVKYIEYTYGKLAGFLLGWAQSIIYYPANISALSIIFSTQLINLFHLSANLLIPIAILAGTSITIINLLGTKIASLVQSTTLVVKLIPIALISLVGLFTPGQVAVSLFPVETTANTGFLVAFSGALVATMFAYDGWLGVGNVAGEMKRPERDLPKAIIFGLLLITLIYALINFVFLKTLPIEQIAGNLNAASDASVAIFGPIGGKIVTIGILISVYGALNGYTMTGIRIPYALALDNLMPFSRQFQKLSKRFVVPYVAGIFQLAVAIIMMFFGTFDLLTDMLVFVMWLFNLLIFLAVFILRKREPELKRPYKVPGYPIIPIIASLGGIFILVTTSITQPILALIGIGITLLGIPVYLVNKQKTKPKT

SEQ ID NO: 36536 - DNA, 1314 bp, Coxiella burnetii RSA 493
  CDS (1)..(1314)
atgcactccagatttcagaaagggaaaataccgaatagcgtattaaaacgcgatttaggattaatcggtgcaacgatgatggggctgggctctatcgtaggaacgggtattttcgttagtatcggcgtggcggcgggcgtcactgggccttctgtggttctcgctattgttttagccgctttggttgctacatgtaacgcattatcgagcgctcaactggcggccagtcacccggtcagcggcggcactcacgaatatggttatcgttatctgcatcctgcattgggttttacggcgggatggatgtttttatgtgcaaaaatagcctcagccgcaacggcggctcttggttttgccggttatttattgcatttattaggaatcacgtcgatctctatgatcccgattgcggttagcatagctattctattaacgcttttagttttgagcggccttaaaaaatccaatttggccaatcttattattgtttctataatcttaatttcactaataacgttcgtattatcaggcttaccgcatttatttagcatgggtcttcctcattttaaacctttctttccgacagcagcgcctagtgggttaagaaattttctctacgcaacggctttgatgtttgtcgcttataccggttatgcgcgtattgctactttaggagaagaggtcaaaaaccccaaacgttttattcctcaagcgattatattgacattaatcattagtgctgttttgtacattgcagtagccgtcgttgctatcagcattgtaggcgcagatcacctttcacaagcggcccaaaatcgggcaactccacttgaaacagcagcacgcgctttgaatcgccgaggtttggatatcatcctagcatttggcgcttgtacagcgatgttaggcgtattattaaaccttatgctgggactttcacggatggctttggcgatggggcgtaaaagggatttaccttcgatgttcggaacgctttcaaaaaaacaacggacgccatcggcggcgatactaggggtgggccttgctattatcgggctttcgctgataggaaacgtcgaaataacatgggcattcagcgcttttaccgtattaatttattatttcattaccaaccttgccgctcttcagttacccaaagccgatcgtctttatccgcggatatttcctgttggtgggctaatagcttgcttatttcttgccttttgggtgcccctgatgatttggtcaattggcataggcctgattgctgttggacttgcttggaaatattttatggctcgtttatggatatga

SEQ ID NO: 36537 - protein, 437 aa, Coxiella burnetii RSA 493
MHSRFQKGKIPNSVLKRDLGLIGATMMGLGSIVGTGIFVSIGVAAGVTGPSVVLAIVLAALVATCNALSSAQLAASHPVSGGTHEYGYRYLHPALGFTAGWMFLCAKIASAATAALGFAGYLLHLLGITSISMIPIAVSIAILLTLLVLSGLKKSNLANLIIVSIILISLITFVLSGLPHLFSMGLPHFKPFFPTAAPSGLRNFLYATALMFVAYTGYARIATLGEEVKNPKRFIPQAIILTLIISAVLYIAVAVVAISIVGADHLSQAAQNRATPLETAARALNRRGLDIILAFGACTAMLGVLLNLMLGLSRMALAMGRKRDLPSMFGTLSKKQRTPSAAILGVGLAIIGLSLIGNVEITWAFSAFTVLIYYFITNLAALQLPKADRLYPRIFPVGGLIACLFLAFWVPLMIWSIGIGLIAVGLAWKYFMARLWI

SEQ ID NO: 36538 - DNA, 1464 bp, Streptomyces avermitilis MA-4680; identical to SEQ ID NO: 9239
  CDS (1)..(1464)

SEQ ID NO: 36539 - protein, 487 aa, Streptomyces avermitilis MA-4680; identical to SEQ ID NO: 9240

SEQ ID NO: 36540 - DNA, 1479 bp, Streptomyces avermitilis MA-4680
  CDS (1)..(1479)
atgctcgaccaaggcgcacccccgcagtcccgcagtcatccctcggccccgggcctcggcgcccgcctgatgcgccgtaagccggtggaaaacctggtcgccgagggcggccagggcgagggtggcactttgcgccgctccctcggcctctggcagctgaccatgatcagcatcggtgccaccctcggcaccggaatcttcgtggtgctcggcgaggcggtgccgaaggcgggccccgccgtgaccctgtccttcgtgatcgccggtctcaccgcgctcttctcggccctctcctacgccgagctcgcgggcaccatcccggtctccgggtcctcgtactcgtatgcgtacgcaacgatgggtgagctgatcgcctggatctgcggctggtgtctcgtcctggagtacggcgtctcggtcgccgccgtcgcggtcggctggggcgagtacctcaacgaactcctcgacggcaccatcggcgtcaccatcccggacgcgctctccgcgccgcccggcgacggcggcatcttcaatctgcccgcgctgatcgtcgtcctgctcgcgatggcgttcctgctgggcggcgcgaaggagtccgcgcgcgccaacacgatcatggtgatcgtgaagatcgccgcgctgctgatgttctgcgcgatcggcatccagggcttcaagtccggcaactacgagaacttcatgccgctgggcatggcgggcgtcagcgccgccggggccacgctcttcttctcgtacatcggcttcgacgcggcctccacggccggcgaggaggcgaagaacgcgcagcgcgacctgccgcgcgcgatcatgctctcgctcgtcatcgtgaccgcgctgtacgtgctcgtcgccgccgtcgccgtgggtgccaagccctggaaggggttcaacgactccgaggccgcgctcgccgggatcatgaaggacgtcaccggacagaccttctggggcaccctgctcgccgcctgtgccgtcatcgccatcgccagtgtcgtcctgaccgtgctctacggacagacccgcatcctcttcgcgatggcccgggacggcctcgtgcccaaggtgttcgcgcgcgtccaccccaagacgggggcgccccgcgccaacaccgtcatcgtgtcgctcttctgtggtgtcctcgccgccgcgatcccgctcgggcagctcgccgacgccaccagcatcggcaccctcttcgccttcgggctggtcaacatcgcggtcgtggtgctgcgccggacccgcccggacatgcggcgcaccttccgggtgccgctgtccccggtgctgccggcgatcggcttcgcgctctgcgtctggatgatgggcagtctctcggccgtcacctgggtggtcttcggagtctggatggccgtcgggctcgtgttctacttcagttacggccaccgccgttcccggctggccacggcagacaccgcagtatccgcacagaagtga

SEQ ID NO: 36541 - protein, 492 aa, Streptomyces avermitilis MA-4680
MLDQGAPPQSRSHPSAPGLGARLMRRKPVENLVAEGGQGEGGTLRRSLGLWQLTMISIGATLGTGIFVVLGEAVPKAGPAVTLSFVIAGLTALFSALSYAELAGTIPVSGSSYSYAYATMGELIAWICGWCLVLEYGVSVAAVAVGWGEYLNELLDGTIGVTIPDALSAPPGDGGIFNLPALIVVLLAMAFLLGGAKESARANTIMVIVKIAALLMFCAIGIQGFKSGNYENFMPLGMAGVSAAGATLFFSYIGFDAASTAGEEAKNAQRDLPRAIMLSLVIVTALYVLVAAVAVGAKPWKGFNDSEAALAGIMKDVTGQTFWGTLLAACAVIAIASVVLTVLYGQTRILFAMARDGLVPKVFARVHPKTGAPRANTVIVSLFCGVLAAAIPLGQLADATSIGTLFAFGLVNIAVVVLRRTRPDMRRTFRVPLSPVLPAIGFALCVWMMGSLSAVTWVVFGVWMAVGLVFYFSYGHRRSRLATADTAVSAQK

SEQ ID NO: 36542 - DNA, 1416 bp, Bacillus cereus ATCC 14579
  CDS (1)..(1416)
atgagtaatttactaaaaaagaaatccgttacacaattgttagagcataatcaaagcaagactttaacgaaaacattaggagcatttgatttaattatgttaggggtaggctcgatagttggaacgggtgttcttgtgttaactggattagtagcagcaagaaatgctggtccagcagttgttttttcatttatacttgcagcaattatatgtggatttatagcattatgttacgctgaaattgcttctacactcccggcgtctggtagtgtatatacgtactcatatgcaacaattggtgagtttgttgctcatctagtaggttggtcattgctgttaatatatatcgtggcaacagcagctgtcgctgctggatggacaggctatttccacaatttaataaagggatttggattagagatacctaaagctctagtaacgattccttcgcatggtggtattgtgaatctaccagcagtaattattacattgatattggcatggatgttatctcgtggtacgagagaaagtaaacgaatcaataatataatggtattgattaaaattggaatgattttgttgtttattacggttggtatattctatgtaaaaccaatgaactggataccaattgcaccatacggtttaagtggagtttttacgggtggagcagctattttattcgcttttacgggttttgatatattagcaacttcagcagaagaagtaaaagatccgaaacgtaatcttcccatcggtattattgcatcattaatcatatgtacaattatttatgttatggtatgccttgttatgacaggaatggtttcctataaagaattaaatgttcctgaggcaatggcttatgtaatggaagttgtaggacaaggaaaagtcgctggtgcaattgctgcaggtgctgtaattggccttatggctgttattttttccaatatgtatgcggcaacacgagtattctttgcaatgagtcgtgatggattgttaccgaaatcatttgcgaaagttaataagaaaactggagcacccacttttataactggattagcaggaatagggagctctataatagctgggtttattgatttgaaagaattagttaatttagttaatatcggtagtttggtgacatttgcgttagtttgtctatcagttattatccttcgtaaatcacacccaaatttaaaacgtggatttatggtaccttttgtacctgtattaccatgcgttgcaattgtatgctgtgtgtttttaatgctaaatttaccgttaaggacatgggtgtactttagtatttggattactattggggtagtagtatatttcctttattcgataaaatacagtaatttaaatgaggaaacgatctcgaaattacatgataaaattgcgagataa

SEQ ID NO: 36543 - protein, 471 aa, Bacillus cereus ATCC 14579
MSNLLKKKSVTQLLEHNQSKTLTKTLGAFDLIMLGVGSIVGTGVLVLTGLVAARNAGPAVVFSFILAAIICGFIALCYAEIASTLPASGSVYTYSYATIGEFVAHLVGWSLLLIYIVATAAVAAGWTGYFHNLIKGFGLEIPKALVTIPSHGGIVNLPAVIITLILAWMLSRGTRESKRINNIMVLIKIGMILLFITVGIFYVKPMNWIPIAPYGLSGVFTGGAAILFAFTGFDILATSAEEVKDPKRNLPIGIIASLIICTIIYVMVCLVMTGMVSYKELNVPEAMAYVMEVVGQGKVAGAIAAGAVIGLMAVIFSNMYAATRVFFAMSRDGLLPKSFAKVNKKTGAPTFITGLAGIGSSIIAGFIDLKELVNLVNIGSLVTFALVCLSVIILRKSHPNLKRGFMVPFVPVLPCVAIVCCVFLMLNLPLRTWVYFSIWITIGVVVYFLYSIKYSNLNEETISKLHDKIAR

SEQ ID NO: 36544 - DNA, 1311 bp, Bacillus cereus ATCC 14579
  CDS (1)..(1311)
atgcatcatgatgagaagaacaaaattggtttaacagtagcactttctatcgtagtaggaacgattattggatctggtgtgtttatgaaaccagggagcgtattagattactcggggagttctaatatggccattcttgcttggataattggtggtctgttgacgctagcgagtggtttaacagtagctgaaattggagcgcaaatcccgaaaaatggtgggttgtatacgtatttagaggagatttacggaagtttttggggatatttatcaggttggatgcaaacaattgtttatggacctgctattatcggaacattaggtttatactttagttctttaatgattaattttttctatttagataaagtatggaatttaccaattgcaattggaacagttgtgttccttggcgttgtaaatagtatgggaacaaaatacggaggtatcgttcaaacaatcacgacaattgggaagatgattccgattgtgttaattgttgtgctaggtttctggaaagggaatagtgatatctttaacgtagttgtgccgatatcgcaaaatcaaagcatcggtatggcaattttagcaacgttatttgcttatgacggctggattttacttgcttcgattggtggagaaatgaagaatccaacaaagttattaccgaaagcaatgacagtagggattttaatcgtaacggctgcttacgtattaattaacttggcgttattaaatgtattaccagcagcgaaaattgtagaccttggagaaaatgcaacagcgacagctgcgggtatgttacttggagaatatggcgggaaaattattagtatcggtattatcgtttccattttcggctgtttaaatggaaagattttaacgttcccacgtatcccaatgtctatggcagagcgtggacaacttccattttctaagtttattgcaaaggaaagtccgagatttaaaacaccagcaaatgcgattactgttgaaatcattttaggaattattttaatgattattagtgatccaaataagctatctgagatttccgtattcattatttatattttctacgtaatgacgtttattggtgtcttcatcttaagaaaacgtaataagaataaagagcgtgcatatagtgtaccgttattcccaatcgtaccaatcgtagcgattttaggttcgttctttgtaatcggtagtgcgattattaacgatccagtaagttgtttcttatcaattggaattgtctttactggactgccggtgtattggtatttaaataagaagaaagaaacagaatga

SEQ ID NO: 36545 - protein, 436 aa, Bacillus cereus ATCC 14579
MHHDEKNKIGLTVALSIVVGTIIGSGVFMKPGSVLDYSGSSNMAILAWIIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISQNQSIGMAILATLFAYDGWILLASIGGEMKNPTKLLPKAMTVGILIVTAAYVLINLALLNVLPAAKIVDLGENATATAAGMLLGEYGGKIISIGIIVSIFGCLNGKILTFPRIPMSMAERGQLPFSKFIAKESPRFKTPANAITVEIILGIILMIISDPNKLSEISVFIIYIFYVMTFIGVFILRKRNKNKERAYSVPLFPIVPIVAILGSFFVIGSAIINDPVSCFLSIGIVFTGLPVYWYLNKKKETE

SEQ ID NO: 36546 - DNA, 1257 bp, Shigella flexneri 2a str. 2457T
  CDS (1)..(1257)
atgagtggactcaaacaagaactggggctggcccagggcattggcctgctatcgacgtcattattaggcactggcgtgtttgccgttcctgcgttagctgcactggtagcaggcaataacagcctgtgggcgtggcccgttttgattatcttagtgttcccgattgcgattgtgtttgcgattctgggtcgccactatcccagcgcaggcggcgtcgcgcacttcgtcggtatggcgtttggttcgcggcttgagcgagtcaccggctggctgtttttatcggtcattcccgtgggtttgcctgccgcactacaaattgccgccggattcggccaagcaatgtttggctggcatagctggcaactgttgttggcagaactcggtacgctggcgttggtgtggtatatcggtactctcggtgccagttccagtgctaatctacaaaccgttattgccggacttatcgtcgcactgattgtcgctatctggtgggcgggcgatatcaaacctgcgagtatccccttccccgcgccaggaaatatcgaacttaccgggttatttgctgcgttatcagtgatgttctggtgttttgtcggtctggaagcatttgcccatcttgcctcggaatttaaaaatccagagcgtgattttcctcgtgctttgatgattggtctgctgctggcaggattagtctactggggctgtacggtagtcgtcttacacttcgacgcctatggtgaacaaatggcggcggcagcatcgcttccaaaaattgtagtacagttgttcggtgtaggagcgttatggattgcctgcgtaattggctatctggcctgctttgccagtcttaacatttatatacagagcttcgcccgcctggtctggtcgcaggcgcaacataatcctgaccactacctggcacgcctctcttctcgccatatcccgaataatgccctcaatgcggtgcttggctgctgcgtggtgagcacgttggtaattcatgccttagagatcaatctggacgctcttattatttatgccaatggcatctttattatgatttatctgttatgcatgctggcaggctgtaaattattgcaaggtcgttatcgactactggcggtggttggcgggctgttatgcgttctgttactggcaatggtcggctggaaaagtctctatgcgctgatcatgctggtggggttatggctgtttctgccaaaacgaaaaacgccggaaaatggcataaccacataa

SEQ ID NO: 36547 - protein, 418 aa, Shigella flexneri 2a str. 2457T
MSGLKQELGLAQGIGLLSTSLLGTGVFAVPALAALVAGNNSLWAWPVLIILVFPIAIVFAILGRHYPSAGGVAHFVGMAFGSRLERVTGWLFLSVIPVGLPAALQIAAGFGQAMFGWHSWQLLLAELGTLALVWYIGTLGASSSANLQTVIAGLIVALIVAIWWAGDIKPASIPFPAPGNIELTGLFAALSVMFWCFVGLEAFAHLASEFKNPERDFPRALMIGLLLAGLVYWGCTVVVLHFDAYGEQMAAAASLPKIVVQLFGVGALWIACVIGYLACFASLNIYIQSFARLVWSQAQHNPDHYLARLSSRHIPNNALNAVLGCCVVSTLVIHALEINLDALIIYANGIFIMIYLLCMLAGCKLLQGRYRLLAVVGGLLCVLLLAMVGWKSLYALIMLVGLWLFLPKRKTPENGITT

SEQ ID NO: 36548 - DNA, 1563 bp, Nitrosomonas europaea ATCC 19718
  CDS (1)..(1563)
atgatcttctggcgcgtaaaatcgctagatgccattctggctacagccgaaaagaaaagtcttcaccgttctctgggtgtgtggcagttgacgctgctgggggtgggagcgattatcggcacaggtatttttgtgctgactgccgaggcagcacaaaaagccggccccggtatgatgattgcttttgtcattgccggtttcgtttgtgcagtggccgcactctgctattccgagctttcttcaatggtaccggtatccgggtctgcttatacctattcctacgccgtgcttggtgaactgatcgcatggatggtgggatgggcgttgatactggaatattctgttgcagccggggcagtggccgtaggctggtcgggctatttcgtcgggttgctgaataatgcctcgctgggattcgaaattccctatgtgctggcgaacgggccgtttgccgggggtatcatcaatctgcctgcggttgtcatctgtctgctggtcgtcggcctgctgatcatcggaacacgagagagcgccatgttcaatgccatactcgttgcagtcaaaatcatcgctctgacggcgttcattgcactggcactgccggctaccgacatgaaccatttcgacccttttctgccactgggaacttcgggtgtcgttgctgcggctgcttccatttttttcgcatatgtcggttttgatgcggtatcaaccgcagcggaagaaacaaaagatccgcaacgcaatcttccgatcgctctgatcagctcattgctgctgtgtacgttgttttatttactggtatctgccggggtgatcggcgcagtgggtgcacagccactggtcgatgccgcaggcgaggggctcgctcccggttccagggaaatggctgcgcagtgcaaatcacttgcggcagcagggcagcaaccggtggtttgctcgcatgaagcgctggcgcatgtgttgcgtgaaataggctgggagaaaattggtaacctgcttggtctggctgctttcctggcacttccctcggtgattctcatgatgctgttcggacagacgcgtatttttttcgtcatgtcgcgtgatggtttgctgccggaagtattgagtcgcatccatccgcgcttcaaaaccccgtatatcgttacgctggttaccggtgtcggcgtaatggcagcagcagctttcctgccggtgggtaagcttgcaaatatttccaactccggaacattgttcgcttttctggtcgtggcattgacggtcatgattctgcgagtcagagacaaaaatcgtcccaggcctttcaggacgcccatgatctggctggtggggccgcttgccattggcggttgtctgattctttttctgtttttaccgatggatgccaaactggtgtttccagtctggaccggaatcggcttgattttttattttctttacggctaccggagaagccacgttttgctgggtatcgatacgccttcgggtggtgagaatctgatcgaaccgatccgatctctcgcggatggcagtgatgaaaccgaagtgaaagtgaaataa

SEQ ID NO: 36549 - protein, 520 aa, Nitrosomonas europaea ATCC 19718
MIFWRVKSLDAILATAEKKSLHRSLGVWQLTLLGVGAIIGTGIFVLTAEAAQKAGPGMMIAFVIAGFVCAVAALCYSELSSMVPVSGSAYTYSYAVLGELIAWMVGWALILEYSVAAGAVAVGWSGYFVGLLNNASLGFEIPYVLANGPFAGGIINLPAVVICLLVVGLLIIGTRESAMFNAILVAVKIIALTAFIALALPATDMNHFDPFLPLGTSGVVAAAASIFFAYVGFDAVSTAAEETKDPQRNLPIALISSLLLCTLFYLLVSAGVIGAVGAQPLVDAAGEGLAPGSREMAAQCKSLAAAGQQPVVCSHEALAHVLREIGWEKIGNLLGLAAFLALPSVILMMLFGQTRIFFVMSRDGLLPEVLSRIHPRFKTPYIVTLVTGVGVMAAAAFLPVGKLANISNSGTLFAFLVVALTVMILRVRDKNRPRPFRTPMIWLVGPLAIGGCLILFLFLPMDAKLVFPVWTGIGLIFYFLYGYRRSHVLLGIDTPSGGENLIEPIRSLADGSDETEVKVK

SEQ ID NO: 36550 - DNA, 1446 bp, Mycobacterium bovis AF2122/97
  CDS (1)..(1446)
gtggtcggcccgcggacgagaggatatgcgatccacaagctgggtttctgcagcgtcgtcatgctcgggatcaactcgataatcggcgccggtatcttcctaactccaggtgaggtgatcgggctcgcaggacccttcgcgccgatggcctatgttttagctggcattttcgcgggtgtcgtggcgatcgtcttcgcgacggcggcaaggtacgtcagaacaaacggtgcctcctacgcctacacaacggccgcatttgggcgccggatcggcatctatgtcggtgtcacccacgccattaccgcgtccatcgcttggggggtgttggcttcttttttcgtctcgacgctgttgcgagtggccttccccgacaaggcctgggccgacgccgagcaactgttcagtgtgaagacgctgacgtttctcggctttatcggcgtgctgttggccatcaacctcttcggcaaccgggcgatcaagtgggccaacggaacgtcaacggtaggcaaggcattcgcgctctcggcattcattgtcggcgggctgtggatcatcaccacccagcacgtgaacaactacgcaacggcgtggtcggcatacagcgcgaccccgtactcgttgcttggcgtcgccgaaattggcaagggcacgttctcgagtatggcgctggccacgattgtcgcgttgtacgcattcaccggtttcgaatcgatcgcgaacgccgccgaagaaatggacgcgccggaccggaacctgccgagagctataccgatcgcgatcttctcggttggcgcgatctacttgctcaccctaacggtagcgatgctgctcggatcgaacaagatcgccgcgtcgggcgacaccgtgaaactggccgcggccatcggaaacgctaccttccgaacgatcatcgtcgtcggagccctgatatcgatgttcggcatcaatgtcgcggcctcgttcggtgcaccgcggctttggaccgcgttagcggacagcggggttctgccgacacgcttgtcacgcaagaaccaatacgacgtgccgatggtctccttcgcaattacggcgtcgttggcgctcgcattcccgttggcgctgcggttcgacaacctgcacctgaccggcctggcggtgatcgcccgattcgtccagttcatcatcgtgccgatcgctctcatcgcattggcgaggtctcaggcagtagaacatgctgctgtgcggcgaaatgcgttcaccgacaaggtgttaccgcttgttgcgatcgtggtctcggttgggctggcagtgtcctacgactaccgctgcatctttctagtgcggggtggtccgaactacttctcgattgctttgatcgtgatcacgttcatcgtggtaccggcgatggcttatctgcactactaccgaatcattcgccgggttggcgatcggccgagcactcgctag

SEQ ID NO: 36551 - protein, 481 aa, Mycobacterium bovis AF2122/97
MVGPRTRGYAIHKLGFCSVVMLGINSIIGAGIFLTPGEVIGLAGPFAPMAYVLAGIFAGVVAIVFATAARYVRTNGASYAYTTAAFGRRIGIYVGVTHAITASIAWGVLASFFVSTLLRVAFPDKAWADAEQLFSVKTLTFLGFIGVLLAINLFGNRAIKWANGTSTVGKAFALSAFIVGGLWIITTQHVNNYATAWSAYSATPYSLLGVAEIGKGTFSSMALATIVALYAFTGFESIANAAEEMDAPDRNLPRAIPIAIFSVGAIYLLTLTVAMLLGSNKIAASGDTVKLAAAIGNATFRTIIVVGALISMFGINVAASFGAPRLWTALADSGVLPTRLSRKNQYDVPMVSFAITASLALAFPLALRFDNLHLTGLAVIARFVQFIIVPIALIALARSQAVEHAAVRRNAFTDKVLPLVAIVVSVGLAVSYDYRCIFLVRGGPNYFSIALIVITFIVVPAMAYLHYYRIIRRVGDRPSTR

SEQ ID NO: 36552 - DNA, 1470 bp, Mycobacterium bovis AF2122/97
  CDS (1)..(1470)
ttgagcgcggcctcacagcgtgtcgacgccttcggcgaagaggccggctatcacaaaggcctcaagccccgacaactgcagatgatcgggatcggcggcgcgattgggaccggcctgttcctcggcgccagcggccggcttgccaaggccggacctgggttgttcttggtgtacggcgtgtgcggggtttttgtcttcctgatcctgcgggcgctgggtgagctggtgctgcaccgtccgtcgtcaggctcgtttgtgtcgtatgcacgtgaatttttcggcgagaaggccgcttacgcggtgggctggatgtacttcctgcactgggcgatgacgtcgatcgtggacaccaccgcgatcgccacctacttgcagcgttggacgatcttcacggtggtcccgcaatggattcttgccctgatcgccttgacggtggtgttgtcgatgaacctgatttcggtcgaatggttcggcgagctggagttttgggccgcgctgatcaaggttctcgcgctgatggcgttcctagtggtgggaaccgtttttttggccgggcgataccccgtcgacggccacagcaccggattgagcttgtggaacaaccatggcgggctgttcccgacaagctggctgccgctgctgatcgttacctcgggagtggtgttcgcgtactcagcagtcgaattggtagggacggcggccggggagaccgccgagccggagaagatcatgccgcgggcgatcaattcggtggtcgctcgcatcgcgatcttttatgtcgggtcggtggccctgctagcgctgttgctgccgtataccgcctacaaggccggcgagagcccgttcgtcacgttcttttccaaaatcggtttccacggtgccggtgacttgatgaacatcgttgtgcttaccgccgcgctgtcgagcctgaacgcggggctgtattcgaccggccgcgtcatgcattcgatcgcgatgagcggcagcgccccaaggttcaccgcgcgaatgtcgaaaagcggtgtgccctacggcgggatcgtgttgaccgcggtcatcaccctgttcggtgtcgcgctgaacgccttcaagcccggtgaagccttcgagattgtgctcaacatgtccgcgctgggcatcatcgcgggttgggccaccatcgtgctgtgtcagcttcgacttcacaagctggccaacgccgggatcatgcagcggccgcggttccgcatgcccttctccccctacagcggctacctcaccttgctcttcttgcttgtcgtgctggttacgatggcgtccgacaaaccgatcggcacctggacggtggcgacactgattattgtcattccggccctgaccgcaggctggtacctggtacgcaagcgtgtcatggccgtcgcccgcgaaaggctgggtcataccgggccatttccggcggtcgccaacccgcccgtgaggtcaagagactga

SEQ ID NO: 36553 - protein, 489 aa, Mycobacterium bovis AF2122/97; identical to SEQ ID NO: 9208

SEQ ID NO: 36554 - DNA, 1329 bp, Rhodopirellula baltica SH 1
  CDS (1)..(1329)
atgaacactgactcgcgaccgaacaacccttccgagcctgcgaaacttcgacgtgacgtcggcctgtttggtgcgatgatgatgggactgggatccatcgttggcacgggcgtctttgtcagcatcggaatcgcggccggaatcaccggtccgtcagtcgtgctcgcgattctcgtcgctgggttggtcgccaccttcaacggcctgagcagcgctcaattggcggcggctcaccccgtcagtggtggcacctacgaatacggctaccgctggctgacaccttcgatgggattcacggcgggctggatgtttttgtgtgccaagtctgcttccgccgccaccgccgccttgggttttgccggatacgcgttgcaacttttccaattcgatcatgacgactggatcgtgccgttggccattggtgcagtggtcgcgacaacgttgctgctgctcggcggtattcggcgatccaactggaccaacattgcgatcgttagcatgacgctgatcgcactggccagcttcgtgatcgccggtttgccgtttgcgtggcgagaaggctcgtcaaacttgacacccttttttgcgtcggattccccagcaatcgcgacgcggcaattcctggaggcctgcgcattgatgttcgtcgcctacacgggctacggccgaatcgcgacactcggcgaagaagtccacaacccacgccgaacgattccgcgagccatcattgtaatactgcttgtatcttcgctgctgtacgcaatcgttggcggcatcgcggtcgccgcggcgggaattgacgtttggagctccacctcacaacagaccgcacccttgcaacttgtcgcaaatcatctgaactcaccattggtcgccaaactagttgccatcggcgcggtgaccgcgatgctaggtgtgctcctcaacctgattctcggcctatcgagagttgtcttcgccatgggacgccgcggtgacttgccgcgtggcttggcaaccgtctcgactcaaaactcaaatccgtctggtgctgtcatcgcggtgggcatcggcgtgggaacgctcgcgctcatcggagatgtcgaaacaacgtggtcgttcagcgccttcaccgtgttggtctactacgcgctcaccaatctcgcagcaacacgcctgactgctgacgaacgcttgttctcaccaatcgtgccttggcttggcctggcttcctgcctcggcctagcgttctgggtgcaaccaaagatctggatcatcggcttgtcattgatcgctgtcggattggtctttcaacaatgcatgaaacgatctgatacatcagcaagctga

SEQ ID NO: 36555 - protein, 442 aa, Rhodopirellula baltica SH 1
MNTDSRPNNPSEPAKLRRDVGLFGAMMMGLGSIVGTGVFVSIGIAAGITGPSVVLAILVAGLVATFNGLSSAQLAAAHPVSGGTYEYGYRWLTPSMGFTAGWMFLCAKSASAATAALGFAGYALQLFQFDHDDWIVPLAIGAVVATTLLLLGGIRRSNWTNIAIVSMTLIALASFVIAGLPFAWREGSSNLTPFFASDSPAIATRQFLEACALMFVAYTGYGRIATLGEEVHNPRRTIPRAIIVILLVSSLLYAIVGGIAVAAAGIDVWSSTSQQTAPLQLVANHLNSPLVAKLVAIGAVTAMLGVLLNLILGLSRVVFAMGRRGDLPRGLATVSTQNSNPSGAVIAVGIGVGTLALIGDVETTWSFSAFTVLVYYALTNLAATRLTADERLFSPIVPWLGLASCLGLAFWVQPKIWIIGLSLIAVGLVFQQCMKRSDTSAS

SEQ ID NO: 36556 - DNA, 2190 bp, Rhodopirellula baltica SH 1
  CDS (1)..(2190)
ttgtttggagccaccagcgtcggcgtcggcgcgatcgtgggcggcgggatcctcgcactggccggagtcgcgtttgcgacaacaggtccatccgcgattctggcgtttggcctcaacggcgtcatcgcgatcctgaccgcgctcagtttcgcggagatggcgtcgaagttccccgaatccggcggcacttacaccttcagccgcaaagtcctctcagtcgaatccgctttcacggtgggttgggtcgtttggtttgcatcgatcgttgcctccgttctctatgcgatcggcttcggtagttttgcgacgctgttgctgagcgaactgtattcgactcagggttcggtcccacattggcttggcgaaccctggagcgtccctgtcgtttcgcttgcgacgaccgtcggtatcggcggcctgatgacgtttcgaacgtccggtggaggagcctggatcaacgtcgccaaagtggctgtcttctcggttctgatcatcggcggattctggatgctgaccgggcaacccgtttccaaaaccaccgcggaattgcgtccgtttctcgcatcgggctggggcggtttggtacaagccatgggatacagcttcatcgccttgcaggggtttgacttgatcgccgcagtcggcggtgaagttcgcgaaccgaccaagaacatcccacgagcgatgttgctgtcgctggtcattgcgttgctgatctatttgccacttttgtttgtgctgaccaccgttggtaccgatggatcccaaagcattcgcgaattggccgcatccgatcccgaagccgtggtcgcactggccgcgcggcactacctcggcacatcaggctattggctggtgctgatcgcggcggttctctcaatgttctcggctcttcaagccaacctgtttgcggcatcgagaattgctctcgcgatgtctcgggacaacacactcccgaacgcactgagtcgtttggccgccggatccggttccccctggatctcggtgttggtgacgaccggtttggtgtgcttgctgattcagcttttgccagacattgcggcggccggggcggcatccagcttgatcttcctggtgacattcgcgatcgcccattggttggccatattggtacggcaacgcagcgtgctgacaccgccaccgttccgagttccgggttacccagccgttcctgtcgttggcggcttggcttgtttggcgttggctatcttccaaggcatcgcggtgcctgaagctggaatcatcgcggtcatgtggatcgcgattggcggcgtactgttcctatccttgttcgctcgtcgagcccggctgaccgatgtgtccaacatcgccagcaatcctgaactctcgcgattgcgcggtaactcgccgttggtattggtgccaatcgcgaatccgaacaacgctcgcgcgatgattgcgttggcggacaccttggtccccgccgccctgggacgcgtgctggttcaaaccgttgtcgtcgcacctcacgactgggatccgttggtcaatcaccggccctccgctcaacttcactcggtgatgaacgaaatcttgcacgcctccgcgagtctgggtgtgcggtgcgaaaccctgaccacggtttctgcggaacccatgatggaaatcgcccgcgtcgccaaactgcaccaatgccaatcggtgctgttgggcttgagcgagatcactccggaggcacgcgacacgccgctggaaggtttgctcgggcaactatccagcgatgttgtcgtgcttcgtgctcccaaggattggcagctcgaccaaagccagcagattctcgttccggtcggtggacgtggcggccacgactacttgctcactcgactgctgagcagtctctctcgtgaacaacaaagacaagtcaagtttctgcgagtgatccccaccgatacacttcgtgccgatcaaaaacgtattcgcaaagagttggatcggacaactcgagtcaacgcgggcagggtttgtgaacgcgaggtcgtgcggagcaatgatccagtcaaaacaatcgccgaccgagccggcacggcaggactgatcattctgggtgctcaacgactgggaccacggcaaaagctattcggtgacttcacccgcaaggtcgcgctcgaatccgactgccccgtgatcatcatcagccgccgcggctaa

SEQ ID NO: 36557 - protein, 729 aa, Rhodopirellula baltica SH 1
MFGATSVGVGAIVGGGILALAGVAFATTGPSAILAFGLNGVIAILTALSFAEMASKFPESGGTYTFSRKVLSVESAFTVGWVVWFASIVASVLYAIGFGSFATLLLSELYSTQGSVPHWLGEPWSVPVVSLATTVGIGGLMTFRTSGGGAWINVAKVAVFSVLIIGGFWMLTGQPVSKTTAELRPFLASGWGGLVQAMGYSFIALQGFDLIAAVGGEVREPTKNIPRAMLLSLVIALLIYLPLLFVLTTVGTDGSQSIRELAASDPEAVVALAARHYLGTSGYWLVLIAAVLSMFSALQANLFAASRIALAMSRDNTLPNALSRLAAGSGSPWISVLVTTGLVCLLIQLLPDIAAAGAASSLIFLVTFAIAHWLAILVRQRSVLTPPPFRVPGYPAVPVVGGLACLALAIFQGIAVPEAGIIAVMWIAIGGVLFLSLFARRARLTDVSNIASNPELSRLRGNSPLVLVPIANPNNARAMIALADTLVPAALGRVLVQTVVVAPHDWDPLVNHRPSAQLHSVMNEILHASASLGVRCETLTTVSAEPMMEIARVAKLHQCQSVLLGLSEITPEARDTPLEGLLGQLSSDVVVLRAPKDWQLDQSQQILVPVGGRGGHDYLLTRLLSSLSREQQRQVKFLRVIPTDTLRADQKRIRKELDRTTRVNAGRVCEREVVRSNDPVKTIADRAGTAGLIILGAQRLGPRQKLFGDFTRKVALESDCPVIIISRRG

SEQ ID NO: 36558 - DNA, 1455 bp, Rhodopirellula baltica SH 1
  CDS (1)..(1455)
gtgattgcgacgtgtggcggtgaagacgtccggcgattggactacattagcgaccaccggccccggacgatctgtttccctgcttctgccggcaccgattcaagctcggaatatcatctcgaaagcagtcgtttgagcggcaaatacggattctggaccctcgcgtttctagtcatcgccaacatgatcggcgctggcgttttcacgacttctgggtattcgctggccgatctgggttctccccaactagtcctgtgggcgtggctggccggcggtgtcatcgctgtcgcgggcgccatcagctacgccatgttgatccgagtcatgccacagtcgggtggcgaatacctatttctttcgcgggctgcacacccgttgctgggatacgttgccggatgggtttcattgatcgcaggtttttcgggcgcgatcgctttcgcggccacggcactggaaggttatctcctacccgaacacttgcgtcccgaatggatgcccgccggcatcgtcaccatcatggcgatcgtcttggcgggcttctttcatggcttgcatcctcgggtcggtgccaccacacagaacatcgctgtcagtgtcaaactgattctgttggccacgatccttctcttcgccgtctaccagtggttcggtggcgatttgatcgtccgcaattctgaagtgcaaatgactgccgaaaccacctcatggtcgccgtgggttgccttcgctggaagtctggtttggatctcgctgagctattcgggcttcaacgcagcggtttatgtcgccgatgaagttatcgacgcgactcgtgtggtgcctcgagcattggtcttcggcacactcgcgacgacgttgctgtatttatgcctcaacgccgtctttgtgtttgccccctccgcggcgagcatcgttggcaaaccggatgtggcggcaatcgcggccgccagtctgggtggcaatggattcgctcacttcgtccgctggacgattgcactgtgtttgctgacatctgtcctcagcatgatgatggcggcaccacgtgtgtacgcgaaaatggctgacgatggcatgctgcccgcttggatgcggttccgaggggaagcgcccttcgccgcgacggtggtgcaaatgatggtggcaatcacactggtattgatatcagacttgcaaggcttgttatcctacctcggactgacactttcgctgtctgcggcttgctcggtttgttgcctcttcttgccatcaatccgcaatcacccaaaggctgcgcccaaacattggctgatcgcccccgctttctatgtcgccgcaacaatcgtttccgccgccatcatgacgctcaatgatccaaagcaattgattgcgactggaatcacattcatggttggcgggacaatgtacgtgctgacgactcagttcaaatcagacaacacgcacgagcaaccaagctga

SEQ ID NO: 36559 - protein, 484 aa, Rhodopirellula baltica SH 1
MIATCGGEDVRRLDYISDHRPRTICFPASAGTDSSSEYHLESSRLSGKYGFWTLAFLVIANMIGAGVFTTSGYSLADLGSPQLVLWAWLAGGVIAVAGAISYAMLIRVMPQSGGEYLFLSRAAHPLLGYVAGWVSLIAGFSGAIAFAATALEGYLLPEHLRPEWMPAGIVTIMAIVLAGFFHGLHPRVGATTQNIAVSVKLILLATILLFAVYQWFGGDLIVRNSEVQMTAETTSWSPWVAFAGSLVWISLSYSGFNAAVYVADEVIDATRVVPRALVFGTLATTLLYLCLNAVFVFAPSAASIVGKPDVAAIAAASLGGNGFAHFVRWTIALCLLTSVLSMMMAAPRVYAKMADDGMLPAWMRFRGEAPFAATVVQMMVAITLVLISDLQGLLSYLGLTLSLSAACSVCCLFLPSIRNHPKAAPKHWLIAPAFYVAATIVSAAIMTLNDPKQLIATGITFMVGGTMYVLTTQFKSDNTHEQPS

SEQ ID NO: 36560 - DNA, 1338 bp, Bordetella parapertussis 12822
  CDS (1)..(1338)
atgacgcgcgccgccgagagcggcatggcccaggcccgcggcctgtcggtgctggacgcggtagccgtgctggtgggcgtggtcatcggcatcggtatcttcggcttcccgccgctggttgcccagcatgcgcagtccgagagcgtctacctggcgctctggctgggcggcgcggcggtcatgctgatgggagccctgtgctatgccgagctgggctcggcctatcccggcgccggcggcgaatacctctacctgcgccacgcgtgggggccgcgcgtagccttgctgttcgcgtgggcgcgctgcacggtcatccagaccggcgcgatcgccgtggtggcgttcatctatggcgaatacgcccaggagctggcgccgctgggcacgcacggcgtggccctgcacgccgccatcgccgtcattgccctgacgctgctcaatatcatgggcacccagcccagcaagcgcatacagctcgtcttcaccgtcctgacgctggcagcgctggcggcagtggtggccaccggcctgtccgcgccccccgccccgccggcgccggtcgagccgctggccggcagcacgctgggcctgctgggcatggggctggtgttcgtgctgctgacctatggcggctggaacgaagccgcctacctcagcggcgaactgcgcgaggcccggcgcaacatggccaaggtgctgctgatcggcaccgccgtggtcgccggcgcctatctgctgaccaatctggcgctgctgcagatcttcggcctgcaaggcctgcgcgagacgcgggcggtggccgccacgctgatggcgctggccgcgggtccgtatgcggcgatcgtgctgagcctgctggtctgcgtcacggcgctgtcgaccatcaacggcaccatcctgacgggcgcgcgcgtctatagcgcgctggggcaggacgtaccgcgcctgcggccgctggccggctggagcatgcgcggccagaccccgacctcggcgctgctggcgcaaggcgccatcacgctggtgctgctgggctatggcgcctacgcgcacgatggcgtgcagacgctggtggcctacacggcgccggtgttctggctgttcatgctgctggtggccgcctcggtctggcggctgcgccgcctcgacccgcaccggccgcggccatttcgcgtgccgctctacccgctgccgccgctgctgctgggcctgacctgtgccggactggtctggtccagcgcccgttatgcgggcgtcggcgccctgctgggcctggccgtgctggcggcgggcttgcccgcgctgcggctgctgcgcgcggcgccgcggtccgcgtga

SEQ ID NO: 36561 - protein, 445 aa, Bordetella parapertussis 12822
MTRAAESGMAQARGLSVLDAVAVLVGVVIGIGIFGFPPLVAQHAQSESVYLALWLGGAAVMLMGALCYAELGSAYPGAGGEYLYLRHAWGPRVALLFAWARCTVIQTGAIAVVAFIYGEYAQELAPLGTHGVALHAAIAVIALTLLNIMGTQPSKRIQLVFTVLTLAALAAVVATGLSAPPAPPAPVEPLAGSTLGLLGMGLVFVLLTYGGWNEAAYLSGELREARRNMAKVLLIGTAVVAGAYLLTNLALLQIFGLQGLRETRAVAATLMALAAGPYAAIVLSLLVCVTALSTINGTILTGARVYSALGQDVPRLRPLAGWSMRGQTPTSALLAQGAITLVLLGYGAYAHDGVQTLVAYTAPVFWLFMLLVAASVWRLRRLDPHRPRPFRVPLYPLPPLLLGLTCAGLVWSSARYAGVGALLGLAVLAAGLPALRLLRAAPRSA

SEQ ID NO: 36562 - DNA, 1338 bp, Bordetella bronchiseptica RB50
  CDS (1)..(1338)
atgacgcgcgccgccgagagcggcatggcccaggcccgcggcctgtcggtgctggacgcggtagccgtgctggtgggcgtggtcatcggcatcggcatcttcggcttcccgccgctggttgcccagcatgcgcagtccgagagcgtctacctggcgctctggctgggcggcgcggcggtcatgctgatgggagccctgtgctatgccgagctgggctcggcctatcccggcgccggcggcgaatacctctacctgcgccacgcgtgggggccgcgcgtagccttgctgttcgcgtgggcgcgctgcacggtcatccagaccggcgcgatcgccgtggtggcgttcatctatggcgaatacgcccaggagctggcgccgctgggcacgcacggcgtggccctgcacgccgccatcgccgtcattgccctgacgctgctcaatatcatgggcacccagcccagcaagcgcatacagctcgtcttcaccgtcctgacgctggcagcgctggcggcagtggtggccaccggcctgtccgcgccccccgccccgccggcgccggtcgagccgctggccggcagcacgctgggcctgctgggcatggggctggtgttcgtgctgctgacctatggcggctggaacgaagccgcctacctcagcggcgaactgcgcgaggcccggcgcaacatggccaaggtgctgctgatcggcaccgccgtggtcgccggcgcctatctgctgaccaatctggcgctgctgcagatcttcggcctgcaaggcctgcgcgagacgcgggcggtggccgccacgctgatgacgctggccgcgggtccgtatgcggcgatcgtgctgagcctgctggtctgcgtcacggcgctgtcgaccatcaacggcaccatcctgacgggcgcgcgcgtctatagcgcgctggggcaggacgtaccgcgcctgcggccgctggccggctggagcatgcgcggccagaccccgacctcggcgctgctggcgcaaggcgccatcacgctggtgctgctgggctatggcgcctacgcgcacgatggcgtgcagacgctggtggcctacacggcgccggtgttctggctgttcatgctgctggtggccgcctcggtctggcggctgcgccgcctcgacccgcaccggccgcggccatttcgcgtgccgctctacccgctgccgccgctgctgctgggcctgacctgtgccggactggtctggtccagcgcccgttatgcgggcgtcggcgccctgctgggcctggccgtgctggcggcgggcttgcccgcgctgcggctgctgcgcgcggcgccgcggtccgcgtga

SEQ ID NO: 36563 - protein, 445 aa, Bordetella bronchiseptica RB50
MTRAAESGMAQARGLSVLDAVAVLVGVVIGIGIFGFPPLVAQHAQSESVYLALWLGGAAVMLMGALCYAELGSAYPGAGGEYLYLRHAWGPRVALLFAWARCTVIQTGAIAVVAFIYGEYAQELAPLGTHGVALHAAIAVIALTLLNIMGTQPSKRIQLVFTVLTLAALAAVVATGLSAPPAPPAPVEPLAGSTLGLLGMGLVFVLLTYGGWNEAAYLSGELREARRNMAKVLLIGTAVVAGAYLLTNLALLQIFGLQGLRETRAVAATLMTLAAGPYAAIVLSLLVCVTALSTINGTILTGARVYSALGQDVPRLRPLAGWSMRGQTPTSALLAQGAITLVLLGYGAYAHDGVQTLVAYTAPVFWLFMLLVAASVWRLRRLDPHRPRPFRVPLYPLPPLLLGLTCAGLVWSSARYAGVGALLGLAVLAAGLPALRLLRAAPRSA

SEQ ID NO: 36564 - DNA, 1398 bp, Chromobacterium violaceum ATCC 12472
  CDS (1)..(1398)
atgagtttgatgcgcaagaagagcgtgcaaggcatgttggccgccgctcagacttcgcgcgggctgcgaaaagagctctccgcgttcgaccttaccatgctgggcatcggcgccatcatcggcaccggcattttcgtgctcaccggcaccggcgccaccatcgccggccccggcctggtgctttccttcgtcatcagcgccttcgcctgcggcttcgcagcgatgtgctatgccgaattcgcttccatgctgccgatttccggctccacttacacctacgcctacgccacgctgggcgagctgatcgcctggatcatcggctgggacctgctgctggaatacctgctggcctcgtccgcggtgtcggtcggctggtccggctacttccagagcctgctgtccggcttcggcgtcacgctgccgcaggcgctgaccgccgccgccggctcggtgccgggcaaggaaaccttgttcaacctgccggccttctgcatcgcgatgatcatcaccgcgctgctggccttcggcatcaaggaatcgaagcgcgtcaacaacatcgtggtgctgatcaaggtggcggtggtggtgctgttcatcgccatcggcgtgtggcacgtcaagccggccaactggcagccggcgctgccgttcggcttctccggcgtgttccacggcgccgccatcgtgttcttcagcttcatcggcttcgacgccgtcacctgcgcggcggaagaggtgaagaacccggccaaggacatcccgcgcggcgtgatctggtcgctggtggtgtgctccatcctgtacgtggtggtggcagccatcatgaccggcatcgtgccctacatgaacttcgccggcgtcgaccacccggtgtcgctggcgctgcaggtggccaagctggactggttcgccggcttcgtcgacctgggcgccatcctgggcatgatgaccgtgatcctggtgatgacctacggccagacccgcatcctgttcgcgatgagccgcgacggcctgctgcccaagatcttttccgaggtgaaccccaagtacggcaccccgtacaaggccacctggctgatcggcaccatcatcgcgctgctggccggcttcgtgccgctgcacacgctggccgagctggtgaacatcggcaccctggccgcgttcacgctgatcgcgctgtcggtgatcgtgctgcgcaagcgcgagccggacctgccgcgcaagttcgtctgcccggcggtgcccaccattccggcgctggccatcctgtgctgcggtttcctgatgacccagctgtcgctgctgacctggacctgcttcgccgcctggctgttgatcggcctggtggtgtacttcggctactcgcggcgcaattcgctgctgcacaatccggcctga

SEQ ID NO: 36565 - protein, 465 aa, Chromobacterium violaceum ATCC 12472
MSLMRKKSVQGMLAAAQTSRGLRKELSAFDLTMLGIGAIIGTGIFVLTGTGATIAGPGLVLSFVISAFACGFAAMCYAEFASMLPISGSTYTYAYATLGELIAWIIGWDLLLEYLLASSAVSVGWSGYFQSLLSGFGVTLPQALTAAAGSVPGKETLFNLPAFCIAMIITALLAFGIKESKRVNNIVVLIKVAVVVLFIAIGVWHVKPANWQPALPFGFSGVFHGAAIVFFSFIGFDAVTCAAEEVKNPAKDIPRGVIWSLVVCSILYVVVAAIMTGIVPYMNFAGVDHPVSLALQVAKLDWFAGFVDLGAILGMMTVILVMTYGQTRILFAMSRDGLLPKIFSEVNPKYGTPYKATWLIGTIIALLAGFVPLHTLAELVNIGTLAAFTLIALSVIVLRKREPDLPRKFVCPAVPTIPALAILCCGFLMTQLSLLTWTCFAAWLLIGLVVYFGYSRRNSLLHNPA

SEQ ID NO: 36566 - DNA, 1332 bp, Chromobacterium violaceum ATCC 12472
  CDS (1)..(1332)
ttgaacgaaaacagttccactcaaaagaagggctcgctcggagtctggatgtgcaccgccctggtggtgggcaatatgataggttccggcgtcttcctgctgccggcctcgctggcgccgttcggcggcgtgtccatgctgggctggctggtgacttcctgcggcgccatctgcctggcgctggtgttcgcccggctgtcgtccatcctgccgcgcgagggcggaccctacgcctatatccacgccggcttcggcgacttcgccggcttctggatcgcctggggctactggatcgcgctgtgggcgggcaatgccgcgctggcggtggcggccaccagctatctgcaggtgttcttcccgatattggggcatagcgagccgctggccggcgccgtcgccatcggcctgatctgggtcgtcacctggatcaacagccgcggcgcgcgcagctcgggcgtggtggctgtggtgaccacgctgctgaagctgctgccgctggcggcggtcaccttcatcggcttcttccatttccagccggaaaacctggcgttcaaccctcatggcaagccactgctgtcctcgctgtcggcgacgatggcgctgaccttgtgggccttcctcggcctggagtcggcctcggtgccggcaggcgacgtggtggagccggagaagaccattccgcgcgcgacagtgataggcacgctgctggccaccgtgctctacatcctgtccacggtgtcgctgatgggcctgatgccggcggacacgctggcggcttcgcaggcgccgttcgccgatgcggcgcggctgatgtggggcgactggggctactggctggtgggcttcggcgcagtggtgtcctgcttcggcgcgctcaacggctggagcctgatgcaggcccacgtgccggcggcggctgccaaggacgggttgttccccagccgtttcgaccagcgcaacgcggccggcgtgcccatcttcggcctggtgctgtccagcgcgctggtcaccattctgatggcgatgaagtacgcaggcggcgacagcggggtgaagatcttcgagttcatcatcctgctggccaccgccactacgctgctgccctacgctttctgctcgatggcgctgatcgccatcatgctgatgcgcggcaaggcgttcacggccaaggattacatcgcgcccggtttcttcgccggcatcggcttcgtctactcgctgtgggcgctgtacggctccggcgccgacatcgtgatgtggggcatgctgctgttgctgatgggcctgcccatttatgtctggcagttgaaggagcggtacgcggccgattga

SEQ ID NO: 36567 - protein, 443 aa, Chromobacterium violaceum ATCC 12472
MNENSSTQKKGSLGVWMCTALVVGNMIGSGVFLLPASLAPFGGVSMLGWLVTSCGAICLALVFARLSSILPREGGPYAYIHAGFGDFAGFWIAWGYWIALWAGNAALAVAATSYLQVFFPILGHSEPLAGAVAIGLIWVVTWINSRGARSSGVVAVVTTLLKLLPLAAVTFIGFFHFQPENLAFNPHGKPLLSSLSATMALTLWAFLGLESASVPAGDVVEPEKTIPRATVIGTLLATVLYILSTVSLMGLMPADTLAASQAPFADAARLMWGDWGYWLVGFGAVVSCFGALNGWSLMQAHVPAAAAKDGLFPSRFDQRNAAGVPIFGLVLSSALVTILMAMKYAGGDSGVKIFEFIILLATATTLLPYAFCSMALIAIMLMRGKAFTAKDYIAPGFFAGIGFVYSLWALYGSGADIVMWGMLLLLMGLPIYVWQLKERYAAD

SEQ ID NO: 36568 - DNA, 1851 bp, Oryza sativa (japonica cultivar-group)
  CDS (1)..(1851)
atggcggccgtcgatacgccggagaagccgtacgagggtaagccggcggcggaggcgaggagctactggcggtggcagaaggaagatttcttcccggagccgtccttcgcgagctggggcgcgtaccgcgcggcgctggccgcgacgcccgcgcggttccgcgaccgcttcgccggccgctccaccgacgccgacgagctcggcgcgctgcgccgccgcagcgagaacgagatgcgccgctgcctcacgtggtgggacctcacgtggttcgggttcggctccgtcatcggtgccgggatcttcgtgctcaccggccaggaggcgcacgaccacgccggcccggccatcgtgctctcctacgtggcctccggcctctccgccatgctgtccgtgttctgctacacggagttcgccgtcgagatccccgtggccggcggctccttcgcctacctccgcgtcgagctcggcgacgtggcggccttcatcgccgccgcgaacctcatcctcgagagcatcatcggcacggccgcggtggcgcgctcctggacgtcgtacctcgcgtcgctcatcaacaagccggcgagcgcgctgcgcatacagacgtcgctcgccgaggggtacaacgagctggaccccatcgcggtggtggtgatcgcggtcacggcgaccctggccattctgagcgccaagggcacctcccgcgtcaactgggtcgcctccgccgtgcacgtcctcgtgatagccttcgtcatcgtggccggcttcctccacgcgaagaccagcaacctgaccccgttcatgccgcacggcgtgccgggcgtgttccgcgcggcggcgatcgtctacttcgcctacggcgggttcgacaacatcgcgaccatggcggaggagaccaagaacccatcgagagacatccctctcgggcttctcggctccatgtcggtgatcacggccatctactgcgtgatggcgctggtgctgagcatgatgcagccgtacacggcgatcgaccggagcgcggcgtactcggtggcgttcagcaacgtcgggatgcggtgggcgcagtacgtggtggcgctcggcgcgctcaaggggatgacgacggtgctgctggtcggggcgctcggtcaggctcggtacaccacgcacatcgcgcgcagccacatcatcccgccggtgttcgcgctggtgcaccccaggaccggcacgccggtgcacgccaccgtgctcatcgccgccgccggcgcctgcatcggcctcttctccagcctcgacgtgctctccagcctcctctccgtcagcacgctcttcatcttcatgatgatggccaccgccctcctcgtccgccggtactacgtgcggggcgtgacgagcaggacgcacgcgaggcggctggtggcgttgctatcggtggtcatcggctcgtcggcgggcatcgcggcgtactggggcgcggcgccggagcggtgggttgggtacaccgtgctggtgccggcgtgggcggcgggcacgctcggcatccagcttctggtgccggcggcgcgcgcgcccaaggtgtggggcgtgccgctcgtgccgtggctgccgtcgctgtccatcgccaccaacctcttcctcatgggctcgctcggcgcgcaggcgttcatccgcttcggcgtctgcaccgccatcatgctgctctactacgtgctcgtcgggctgcacgccacctacgacgtcgcgcacggcgcgtgctccggcgacgacgtcgacgaggaggtctacgctgatgccgcccacgtggacgatgcgaaggcggcggccgcggtcgctgccaacgcagacgtggagagggcgggcgcgaagatctga

SEQ ID NO: 36569 - protein, 616 aa, Oryza sativa (japonica cultivar-group)
MAAVDTPEKPYEGKPAAEARSYWRWQKEDFFPEPSFASWGAYRAALAATPARFRDRFAGRSTDADELGALRRRSENEMRRCLTWWDLTWFGFGSVIGAGIFVLTGQEAHDHAGPAIVLSYVASGLSAMLSVFCYTEFAVEIPVAGGSFAYLRVELGDVAAFIAAANLILESIIGTAAVARSWTSYLASLINKPASALRIQTSLAEGYNELDPIAVVVIAVTATLAILSAKGTSRVNWVASAVHVLVIAFVIVAGFLHAKTSNLTPFMPHGVPGVFRAAAIVYFAYGGFDNIATMAEETKNPSRDIPLGLLGSMSVITAIYCVMALVLSMMQPYTAIDRSAAYSVAFSNVGMRWAQYVVALGALKGMTTVLLVGALGQARYTTHIARSHIIPPVFALVHPRTGTPVHATVLIAAAGACIGLFSSLDVLSSLLSVSTLFIFMMMATALLVRRYYVRGVTSRTHARRLVALLSVVIGSSAGIAAYWGAAPERWVGYTVLVPAWAAGTLGIQLLVPAARAPKVWGVPLVPWLPSLSIATNLFLMGSLGAQAFIRFGVCTAIMLLYYVLVGLHATYDVAHGACSGDDVDEEVYADAAHVDDAKAAAAVAANADVERAGAKI

SEQ ID NO: 36570 - DNA, 1332 bp, Gloeobacter violaceus PCC 7421
  CDS (1)..(1332)
atgaaggcagtagcggatcgggtcggctccccgaggccaacgctgggactgaccgacgcggtggcgctcatcgtgggcatcgtcgtcggggccggcatctttgagacccccgcgctggtggccgccaacaccggcgggcccctctggacgctgctggcctggctgttggggggcggcatttcgctgattggggcgctgtgctacgccgaattgaccacggcctatccccacgcgggcggcaattattactacttgctgcgcgccttcggccgggatctggcctttttgtacgcctgggcgcggctcgcggtcgtgcagaccggttcgattgcgctgctggcctttgtgagcggcgattacgcttcgcagctgtggcgcctgggagagtactctccgtcgatttacgccgccctggttattgccctgttcaccgccctcaacattgccggcatccgccagggcgcccggacccagaacctgcttgccgtcgccaccgtgctgggcctcgccgccgttatcgtcggggggctgctcgccccggccccggcccagccgctggcggcccccgcccccgcttccacaaatttcggcctcgcgatggtcttcgtactgctcacctacggcggctggaacgaagcggcctatatctcggcggaactgcgctcggtaaagcgcaacatggtgcgcgccctgcttgtgagcatcgggatcatcacagcactctacctgctggccaatgtcgcctttatccatgctttgggaacggcgggaatggccggatctcaggcggtggccgccgatttgatgcggcgggtggcgggggcgccgggggcggcgtttatcagcgccctcatcgtcgtctgcgccctcagctccgccaacgcctcgatcatcacgggggggcgcaccaactacgccctcgggcaggactttacactgttccgctttttgggccgctggcggacaggcaccgagacgcccgccaacgccctggcggtgcagggggtgattgccctcgggctggtggtgctcggcaccgccacccggggcggcttcaagacgatggtcgaatacaccgctccggtgttctggctgtttttcctgctcacgggcgcggcgcttttggtgttgcgctcgcgcgacccgcagatagagcggcccttccgggtgcccctctatccgctcacaccgctgttgttttgtcttatctgcggctatatgctccaggcgagcctcgcctacacaggcaccggcgccctggtgggggtggcggtgctgttggtgggcctgccgctgctgtggatagcccggcgcacgcgtaccgattcttga

SEQ ID NO: 36571 - protein, 443 aa, Gloeobacter violaceus PCC 7421
MKAVADRVGSPRPTLGLTDAVALIVGIVVGAGIFETPALVAANTGGPLWTLLAWLLGGGISLIGALCYAELTTAYPHAGGNYYYLLRAFGRDLAFLYAWARLAVVQTGSIALLAFVSGDYASQLWRLGEYSPSIYAALVIALFTALNIAGIRQGARTQNLLAVATVLGLAAVIVGGLLAPAPAQPLAAPAPASTNFGLAMVFVLLTYGGWNEAAYISAELRSVKRNMVRALLVSIGIITALYLLANVAFIHALGTAGMAGSQAVAADLMRRVAGAPGAAFISALIVVCALSSANASIITGGRTNYALGQDFTLFRFLGRWRTGTETPANALAVQGVIALGLVVLGTATRGGFKTMVEYTAPVFWLFFLLTGAALLVLRSRDPQIERPFRVPLYPLTPLLFCLICGYMLQASLAYTGTGALVGVAVLLVGLPLLWIARRTRTDS

SEQ ID NO: 36572 - DNA, 1416 bp, Gloeobacter violaceus PCC 7421
  CDS (1)..(1416)
gtggccgacctgcaaaaagaagggggcctcgacggagggttaaagcgcaccctcggtcccatcaacttgattagcctcggggtgggtgccatcatcggcgccgggattttcgtgatcacggggcaagccgctgcccagtacgccgggccggccatcaccatttcgttcatcctcgccgccttcgcctgtgcctttgcggggctgtgctacgccgaattcgccgctttgcttcccatctccggcagcgcctacacctatgcctacgccactctgggcgaactggtggcctggatcatcggctgggatttgattatcgagtacgcgctatccgccgcgacggtggctgtcggctggtcgggctatgtggtgagctttctgagggatttcggcattgttatgccgccacaattcaccgcctccttcggccaaccggtgaccctcgccgacggtacgacggcggccgggttgctcaacgtcccggctgtgctgattatcctggcgctctcgctgctgttggtggtgggcgtgagcgaatcggcttccgtcaacggcatcattgtcgtcgtcaaagtggccgtgatcgtcgcctttttggttttcggcgccagttacatcgacacggccaactggacgccgtttattcccgaaccggtcgaaccgggccgatacgggtactttggtatcctgcgggcggcgggggtgatcttttttgcctacatcggtttcgatgcggtctccaccgccgcccaggaagccaaaaatccccagcgcgacatgcccatcggcattctgggttcactggtcgtctgcacggtgctctacatcctggtggccctcgtgctcaccgggatcgtcgattacaggcaactgggcgtgcccgacccgatcgccgtgggtgtagacgccatcggcctgggttggctcacgttcatcgtcaaaatcggcgccatcgccgggctcacctcggtgatgctcgtgaccctgtacggccagacgcgcatcttctacacgatgagccgcgacggcctgctgccaccgctatttagcgccatccacccgcgcttcaagaccccttatctctcgacgatgctgctgggtctttttgtgagcgtcgtggcaggcttggtccccctgggcatcctgggagaactggtgagcatcggcacgctgttcgcctttatcgtcgtgagcgccggagtgctctttttgcgctaccgccagccggatctgccccggccttttcgctgtccgctggtgccgtgggtaccgcttgccagcatcgtcgcctgcctggcgttgatgtccgggctacctgccgacacctggctgcggctgtttgcctggctcgggctgggattactggtttacttcgtctacgggcgcgtgcacagcaagttgcaatcgagaagagcttga

SEQ ID NO: 36573 - protein, 471 aa, Gloeobacter violaceus PCC 7421
MADLQKEGGLDGGLKRTLGPINLISLGVGAIIGAGIFVITGQAAAQYAGPAITISFILAAFACAFAGLCYAEFAALLPISGSAYTYAYATLGELVAWIIGWDLIIEYALSAATVAVGWSGYVVSFLRDFGIVMPPQFTASFGQPVTLADGTTAAGLLNVPAVLIILALSLLLVVGVSESASVNGIIVVVKVAVIVAFLVFGASYIDTANWTPFIPEPVEPGRYGYFGILRAAGVIFFAYIGFDAVSTAAQEAKNPQRDMPIGILGSLVVCTVLYILVALVLTGIVDYRQLGVPDPIAVGVDAIGLGWLTFIVKIGAIAGLTSVMLVTLYGQTRIFYTMSRDGLLPPLFSAIHPRFKTPYLSTMLLGLFVSVVAGLVPLGILGELVSIGTLFAFIVVSAGVLFLRYRQPDLPRPFRCPLVPWVPLASIVACLALMSGLPADTWLRLFAWLGLGLLVYFVYGRVHSKLQSRRA

SEQ ID NO: 36574 - DNA, 1371 bp, Gloeobacter violaceus PCC 7421
  CDS (1)..(1371)
atggcttcgacgtccgggggcgttctgcgccgttcgttgggattgatagacggcgcggcgctcatcgtcggcatcacgattggctccggcatcttcgcaagccccggccgggtggtcgagcaggtgggctcggtggggatggcgctggccgtctgggtggtggggggcctgctgtcgttggcgggggcactgtgctacgccgaactgggggcggccttgccggtggccgggggcgagtacgcctacttgagccgcaccctcggccggcctttgggcttcatgttcacctggacccagttttttgtgatgaagaccggctcccaggcgattatcagcatcgtctttgcaagctacctgggcagcgtcctcttcggcctcgacccgcgcggggcgggcgtggacggcgactggcgcatcaaggcgatcgccgtcgccacgatcttgctgctcacggccgtcaactgtctgggggtgcgccagggagcggtggtgcaggtggtcttcacggcactgaaattgctggccctggccgggatcatcgccatgggctttgccgccttcttccagggcggctccagccactttgtcgacccgtttgccgggtcgatcgccgcgccgagcgcctttggcctcgcgatgatcacctgcctgtgggcctacgacggctggaacaacctcaactatgtgagcgaagaactgcgcgagcccgagcgcaacctgccccgggcgatcgtcttcggcaccctgggggtgatggcggtctacgtgcttgctaacgtcgcctacctctcggcgctcacccccgcccagatggcgggctcccgggccgtcgccaccaacctggcggtgcaggtgattgggccgattggcggcgtcctggtgcccatcgccgtggcaatttcgacctttggcagcaccaacggttcgctgatcaccggggcgcgcgtcttttacgcggcggcccgcgacggccagtttccgcgcttttttggctacgtgagcccccgggcggtgcccgccgcggcgctggtggcccagggggcgtgggcgtcgatgctggttttgcccggcgacttcggcaccctggtcgattacttcggctttgccgcctggctgttctacgcccttgccgtcgtcggattgatgatcctgcgcgcccaggcgccggatctgccccgtccctataaagtccggccctacccgctggtgcctctggtgtttctcgccgcctcgggttttctcatcgtcaattcgctgctgaccactccccaatcctggttcgccctcggcttcatgggtctgggtctgggggtgtactttctgttcttccgcgtccccagggtggcggtaccaaccacttcgcaaccataa

SEQ ID NO: 36575 - protein, 456 aa, Gloeobacter violaceus PCC 7421
MASTSGGVLRRSLGLIDGAALIVGITIGSGIFASPGRVVEQVGSVGMALAVWVVGGLLSLAGALCYAELGAALPVAGGEYAYLSRTLGRPLGFMFTWTQFFVMKTGSQAIISIVFASYLGSVLFGLDPRGAGVDGDWRIKAIAVATILLLTAVNCLGVRQGAVVQVVFTALKLLALAGIIAMGFAAFFQGGSSHFVDPFAGSIAAPSAFGLAMITCLWAYDGWNNLNYVSEELREPERNLPRAIVFGTLGVMAVYVLANVAYLSALTPAQMAGSRAVATNLAVQVIGPIGGVLVPIAVAISTFGSTNGSLITGARVFYAAARDGQFPRFFGYVSPRAVPAAALVAQGAWASMLVLPGDFGTLVDYFGFAAWLFYALAVVGLMILRAQAPDLPRPYKVRPYPLVPLVFLAASGFLIVNSLLTTPQSWFALGFMGLGLGVYFLFFRVPRVAVPTTSQP

SEQ ID NO: 36576 - DNA, 1602 bp, Photorhabdus luminescens subsp. laumondii TTO1
  CDS (1)..(1602)
atggcgctatacaaagcctcttcacggccaaaatccgattcagggcagggtaaatttaagaaacagttaacactcacggatttaaccttcatcggattaggggctatttttggttctggctggttatttgcagccagtcatgtgtctgttattgcagggcctgccgggattttttcctggctgattggtggtatcgccgtgctgttactcggcattgtttattgcgaactgggtgcggcactgccgaaatcaggtggcattatccgttatccggtgttttctcatggcgaactcatgggatatttaatgggttccatcaccttaatcgcattttccagcctaatagccatcgaagtcgtcgctgctcgacaatatgcggcggcgtggttcccctttctcagtcagccgggttcgggtgatccgactctgacaggctggctggttcaatttatcttattagcatttttcttttaccttaattacaacagcgtgaaaacctttgcaaaatccaacaatattattagtattttcaagtttatcgttccgctgctcgtcattattatcctatttaattatttcaatccgagtaatctgcaagttcacggattttctccttttgggatatcgggtattgaagctgcggtttcaaccggaggcattatttttgcctatcttggcctaacgcccattatttccgtcgctggtgaagtggaaaaaccccaaaaaacaattcctattgccctcattctctctatttcactgtctacggttatttatgttttattacagttagcgttccttggtgggataccctctgatctactttttagtggctggaataacattgggcaatatttttcattgccgtttcgtgatatagccttaatcctcggtgtggggtggctcgcttttttggtggtatgtgatgcggtgatctctccaagtggtaccgggaatatttatatgaatgccactccccgtgtagtttatggttgggcaaaaagtgggacgttatttaatgtgtttacccatgttgatgaaaaatcggggataccacgtcctgcactttggttgacatttattctttctgttttttggacattaccttttccttcatgggaaaaactcatcagtgttgtttctgcggcgttaattctgagctacgcattagcgccagtaactgcttctgccttacgtcgtaatgccaaggagataaaacgtcctttttatgttaaatggtttgcgatcattggtccgctttcctttattatttccgccttcattgtttactggtctggttggaaaaccgtttcttggctacttggattacagattatcttgttttttatctacttgttatttaaaaataaagttccgataggcaaagtgagtttgcgtcaacagataacctctgctttatggttgattagtttttacagtgccatgatcattttgtcctatttaggcacatttggcggtaagggaattattcccgcgccttgggatattgtggcagtggcagtgatctctttaattgccttctattggggaacttttagcgctttacccaatgctattttaccaacggaggatgaggattag

SEQ ID NO: 36577 - protein, 533 aa, Photorhabdus luminescens subsp. laumondii TTO1
MALYKASSRPKSDSGQGKFKKQLTLTDLTFIGLGAIFGSGWLFAASHVSVIAGPAGIFSWLIGGIAVLLLGIVYCELGAALPKSGGIIRYPVFSHGELMGYLMGSITLIAFSSLIAIEVVAARQYAAAWFPFLSQPGSGDPTLTGWLVQFILLAFFFYLNYNSVKTFAKSNNIISIFKFIVPLLVIIILFNYFNPSNLQVHGFSPFGISGIEAAVSTGGIIFAYLGLTPIISVAGEVEKPQKTIPIALILSISLSTVIYVLLQLAFLGGIPSDLLFSGWNNIGQYFSLPFRDIALILGVGWLAFLVVCDAVISPSGTGNIYMNATPRVVYGWAKSGTLFNVFTHVDEKSGIPRPALWLTFILSVFWTLPFPSWEKLISVVSAALILSYALAPVTASALRRNAKEIKRPFYVKWFAIIGPLSFIISAFIVYWSGWKTVSWLLGLQIILFFIYLLFKNKVPIGKVSLRQQITSALWLISFYSAMIILSYLGTFGGKGIIPAPWDIVAVAVISLIAFYWGTFSALPNAILPTEDED

SEQ ID NO: 36578 - DNA, 1413 bp, Corynebacterium diphtheriae NCTC 13129; identical to SEQ ID NO: 9471
  CDS (1)..(1413)

SEQ ID NO: 36579 - protein, 470 aa, Corynebacterium diphtheriae NCTC 13129; identical to SEQ ID NO: 9472

SEQ ID NO: 36580 - DNA, 1482 bp, Rhodopseudomonas palustris CGA009
  CDS (1)..(1482)
gtggccgggatctggacgcgtaaatcgctgagcagcctgcaaatcgaggctgcggccggggacagcggcgacggcgaggtccgccacctgaagcggtcgctgtcggcagtcaatctggtcgccctcggggtcggcggcatcatcggtgccggcatcttcgtgctcaccggccacgccgccgccgccaacgccgggccggcggtgtcgctgtcgttcctgctcggcgcgatcacctgcgcgttcgccgggctgtgctacgccgagatggcctcgaccgtgccggtgtctggcagcgcctacacctatgcgtatgcgacgatcggcgagctggtggcctggatcatcggctgggacctgatcctggaatacgcggtcggcgccatcacggtggcgatcggctggtccggttacttcgtcagcctgctcggcaatttcggcattcatctgccgccgcagttcaccacggcaccgctcgcctacgacgccgcaacccacgcctggtcgaccaccggggcgtttctcaacctgccggcaatagcgatcgtcgtcgcgatcgccacgctgctggtgatcggcatccaggaatcggcgcggttcaacaacgtcatcgtcggcatcaagctgacggtgatcgcgctgtttctgatcttcgccgctccgatggtgacgccggccaactgggtgacggcggccaatccggatggcgcgttcattccaccggcgcaggagaacggcatcttcggctggtccggcgtgctgcgcggcgccgcggtggtgttcttcgccttcatcgggttcgacgcggtctcgaccgccgcgcaggaagccaagaacccgcagcgcgatatgccgctcggcatcctcggctcgctggcgatctgcaccgtgctgtatgtctcggtcgcattcgtgctgaccgggatcgtgccatacgaccggctcaacgtgcccgatccgatcgcggtcgggatcgacgccgccgggatcggctggctgtcctcgatcgtcaagatcggcgtcgtcaccgggctgacctcggtgatcctggtgctgatgctcgggcagacccgcgtgctgcgggcgatggcgcatgacggcctgatgccgaggggcgccgccgccacccacccgcgcttccgaaccccgcatgtcgccaccatcggcaccggcgtgatcgtcgccggccttgccggggtgctgccgatcggactggtcggcgaattggtcagcatcggcacgctgttcgcgttcgcggtggtctgcgtcggcgtgctggcgctgcggatcaagcatcccgagcagcatcgcccgttcaaggtgccggcgatctggctggttgcgccggccggcgcgatcgtatcgttcatcctgatgctcggcctgccgctcgatacctggatacggctggcggtgtggctggcgatcggccttgcgatctacttcctgtacggccgtcatcacagcaagcccgcgaggcgctaa

SEQ ID NO: 36581 - protein, 493 aa, Rhodopseudomonas palustris CGA009
MAGIWTRKSLSSLQIEAAAGDSGDGEVRHLKRSLSAVNLVALGVGGIIGAGIFVLTGHAAAANAGPAVSLSFLLGAITCAFAGLCYAEMASTVPVSGSAYTYAYATIGELVAWIIGWDLILEYAVGAITVAIGWSGYFVSLLGNFGIHLPPQFTTAPLAYDAATHAWSTTGAFLNLPAIAIVVAIATLLVIGIQESARFNNVIVGIKLTVIALFLIFAAPMVTPANWVTAANPDGAFIPPAQENGIFGWSGVLRGAAVVFFAFIGFDAVSTAAQEAKNPQRDMPLGILGSLAICTVLYVSVAFVLTGIVPYDRLNVPDPIAVGIDAAGIGWLSSIVKIGVVTGLTSVILVLMLGQTRVLRAMAHDGLMPRGAAATHPRFRTPHVATIGTGVIVAGLAGVLPIGLVGELVSIGTLFAFAVVCVGVLALRIKHPEQHRPFKVPAIWLVAPAGAIVSFILMLGLPLDTWIRLAVWLAIGLAIYFLYGRHHSKPARR

SEQ ID NO: 36582 - DNA, 1518 bp, Mycobacterium avium subsp. paratuberculosis str. k10
  CDS (1)..(1518)
atggccagtcgatggcggacgaagtcggtggaacagtcgatcgccgacaccgacgagccggacacccggctgcgcaaggacctgacctggtgggacctggtcgtgttcggcgtcgcggtggtgatcggcgccggcatcttcaccgtcaccgcgtcgacgaccggcgacatcaccggcccggccatctgggtgtcgttcgtgatcgcggcgggcacctgcgcgctggcggcgctgtgctacgccgagttcgcctccaccctgccggtggccggcagcgcctacaccttctcctacgccaccttcggggagttcctggcctggatcatcggctggaatctgctgctggagttggccatcggcgccgcggtggtggccaagggctggtccagctatctgggcacggtgttcggattctccggcggcacagtcaaattcggggccgcccagctcgactggggtgcgctggtgatcgtcggtggggtggccaccctgatcgcgctgggcaccaagctgtcgtcgaggttctccgcggtgatcaccgggatcaaggtgtcggtggtggtgttcgtcgtggtggtcggcgtcttctacatcaagcgcgccaactactcgccgttcatccccaagccggaggccggcggccaggccaagggcatcgaccagtcggtgctgtcgctgctgaccggggcgcacaccagccactacggctggtacggcgtgctggccggggcgtccatcgtgttcttcgcgttcatcgggttcgacatcgtggccaccatggccgaggagaccaagcatccgcagcgcgacgtcccccggggcatcctggcgtcgctgggcatcgtcacgctgctctacgtggcggtcgccgtcgtgttgtccggcatggtgtcctacacccaactcaagacgatgccgggccgcgggcaggccaacctggccaccgccttcaccgccaacggcatccactgggcgagcaagatcatctccatcggcgcactggccgggctgaccacggtcgtgatggtgctgatgctcggccagtgccgggtgctgttcgcgatggcgcgcgacgggctgttgccgcgggcgctggccaagaccgggtcgcggggcacgccggtgcgcatcaccgtgctggtcgccctggtggtggcggtgacagcgtcggtgttcccgatcaccaagctcgaggagatggtcaacgtcggaacgctgttcgccttcgtcctggtctccgccggggtgatggtgctgcgccgcacccgaccggacctggagcggggcttcaaggcgccgtgggtgccggtgctgccgatcgcctcgatcggcgcctgcgtgtggctgatgctcaacctcaccgcgctcacctgggtccggttcggcatctggctggtggtgggcacggcgatctacgccggctacggctactggcactcggtgcagggccgtcgcgacgccggcgaacccgaccgcagcgacgcgctggcggccgaccccaacagcccggtgccgtaa

SEQ ID NO: 36583 - protein, 505 aa, Mycobacterium avium subsp. paratuberculosis str. k10
MASRWRTKSVEQSIADTDEPDTRLRKDLTWWDLVVFGVAVVIGAGIFTVTASTTGDITGPAIWVSFVIAAGTCALAALCYAEFASTLPVAGSAYTFSYATFGEFLAWIIGWNLLLELAIGAAVVAKGWSSYLGTVFGFSGGTVKFGAAQLDWGALVIVGGVATLIALGTKLSSRFSAVITGIKVSVVVFVVVVGVFYIKRANYSPFIPKPEAGGQAKGIDQSVLSLLTGAHTSHYGWYGVLAGASIVFFAFIGFDIVATMAEETKHPQRDVPRGILASLGIVTLLYVAVAVVLSGMVSYTQLKTMPGRGQANLATAFTANGIHWASKIISIGALAGLTTVVMVLMLGQCRVLFAMARDGLLPRALAKTGSRGTPVRITVLVALVVAVTASVFPITKLEEMVNVGTLFAFVLVSAGVMVLRRTRPDLERGFKAPWVPVLPIASIGACVWLMLNLTALTWVRFGIWLVVGTAIYAGYGYWHSVQGRRDAGEPDRSDALAADPNSPVP

SEQ ID NO: 36584 - DNA, 1353 bp, Lactobacillus johnsonii NCC 533
  CDS (1)..(1353)
atgaaacaacaaaaccatcttaagcgttcattaggcttcttttcagctatttcaattgttattgggacaatcattggatcaggtatctttttcaaacaagcttcagttcttcaaagtgctcataattcaaccttagctattagtgcttggatctttggtggtgttattacactagcagctggtttaacaattgctgaaattggagctcaaatgccatatactggcggattatatgtttacattgagaagttatatggtcggattcttggttttctagccggatggatgcaagttatcgtctatggccctgcaattattgcagccgtaggtggttttaccggtattcttatcgccaatttctttaatctaaatgattcctggcgcattcctctatcaattgggtgtatgctttttatcactattattaattttttagataataaggtaggtgcagcattttcagttattactacaattggaaaaatgattccgattgctgcaattattatttttggtatcttttggggtcaaaataatgccttaggtcagactatttctgacgttaaacaaagtagtggcggatttggagttgctgtgttagctaccttgtttgcttacgacggctggattttaattgcgaacttaggtggtgaaatgaaaaatcctcaaaaagtccttccgcaagcgattatcttaggaattacgattgttttaacgatctacactctaattacagtcggtatcttacgctttattccagccgaccttattgagcgcctaggagaggatacaactacgtatttagctacaaaagcttttggcaatattggtggaaagctattaacattaggaataattatttcgatgcttggtactctcaatggtaaaattattacttttccaagaattgtttatgctatggctaaaagaaatgatttgccattttcatcttatttaacctatttaactccaaaaggaaaatctcctatcgttgctactatttttatcaccgtattagcaactttaatgctagtattgttcgatcctgatcgcttatcagacttatgtgtctttacgatatattgcttttatattttggcctttttcggcatttttaaattaagacgagaaaattctaatcgtccttttagtactccgctctatcctttagtaccaatcgttgcaattttaggtggattatttatcattgtcagtgaactatttaatgatcctgctggtgtagttctatttttaggaatagtagctgttggcctacctattttttactatcttaagcgtaaggaaaaaacaagtagaaataaggcgatagaaataaatgaaaatcatgattag

SEQ ID NO: 36585 - protein, 450 aa, Lactobacillus johnsonii NCC 533
MKQQNHLKRSLGFFSAISIVIGTIIGSGIFFKQASVLQSAHNSTLAISAWIFGGVITLAAGLTIAEIGAQMPYTGGLYVYIEKLYGRILGFLAGWMQVIVYGPAIIAAVGGFTGILIANFFNLNDSWRIPLSIGCMLFITIINFLDNKVGAAFSVITTIGKMIPIAAIIIFGIFWGQNNALGQTISDVKQSSGGFGVAVLATLFAYDGWILIANLGGEMKNPQKVLPQAIILGITIVLTIYTLITVGILRFIPADLIERLGEDTTTYLATKAFGNIGGKLLTLGIIISMLGTLNGKIITFPRIVYAMAKRNDLPFSSYLTYLTPKGKSPIVATIFITVLATLMLVLFDPDRLSDLCVFTIYCFYILAFFGIFKLRRENSNRPFSTPLYPLVPIVAILGGLFIIVSELFNDPAGVVLFLGIVAVGLPIFYYLKRKEKTSRNKAIEINENHD

SEQ ID NO: 36586 - DNA, 1377 bp, Lactobacillus johnsonii NCC 533
  CDS (1)..(1377)
atggttaaaaaaactgttcctaaaaagttaacttttatgtcaatttactttttaggaattaacggaattataggatcaggagcatttttacttccgcaatctatttataaagatatggatctattgagtgtagttgtcttactttctgctgcattaacggtagggttaatcgcattatgttatgcggatttggctagtcgttttaccggttccggagctgcatggctatattcgtacaatgcatttggtagatttgcaggctatgagcttggtgtatttacatggtttttgggctgttgtacttatgctgctgaagtagtagcatttttaacaacgcttaaaagttttgtacctgcattcaatcaaagctcagtctattttgctgtcgggataggattagttttattgttctcaattattaatttctttggtcgtgccttagttaaaataattgataacacttcctccattgctaagctatcaactattattttgtttattattgttggtatgttcttcatgcatattgcaaacttccatcccgttttaccagccgcagctgcaaagggtgtaggaccatttttccatcactttggtgcagcctttagtgttgtgttttatttgtttagtggtttctcatttattccaattgctgcctctcagatgaaagatccagctaaaaatattccacgggctttagttgctgttatggttacggtaactattctttatactttgatggtattaattgctattggtattttgggtcacaagatgtcatggtacaccattcctattgctaatgcctttaagtctgctgtaggagaatggggctatgtgattattatcattggagttttgttaagtattttcggtgtggcatttacgtgctcgtttaatacaccagctttgattgcttccttagctctagaacaccaattattaccaaattgggtaggaaaaaagaataaatttgatgctccatgggtaggtattattttaactgccgctgtaaccttacttttaattactcaatcatacttgttcttagttggatgtattgttttagcttcatttgttcaatatgtaccatctatttttgcggttattaaatttaagcatactggtcaatatccaaaccatggctttaagcttccaggtggctacacaattccaattttagctttattagtagcttgctatttaatctttaactttacttgggaaactattttactctcaatagttgtagctgctgtaacagctgttttatacctgttcttaggaaagaagagattagctaagatgggcggaattccaactgcagttagagagaaaaagaatcatatagaagctgatttaaagaagaaaaattaa

SEQ ID NO: 36587 - protein, 458 aa, Lactobacillus johnsonii NCC 533
MVKKTVPKKLTFMSIYFLGINGIIGSGAFLLPQSIYKDMDLLSVVVLLSAALTVGLIALCYADLASRFTGSGAAWLYSYNAFGRFAGYELGVFTWFLGCCTYAAEVVAFLTTLKSFVPAFNQSSVYFAVGIGLVLLFSIINFFGRALVKIIDNTSSIAKLSTIILFIIVGMFFMHIANFHPVLPAAAAKGVGPFFHHFGAAFSVVFYLFSGFSFIPIAASQMKDPAKNIPRALVAVMVTVTILYTLMVLIAIGILGHKMSWYTIPIANAFKSAVGEWGYVIIIIGVLLSIFGVAFTCSFNTPALIASLALEHQLLPNWVGKKNKFDAPWVGIILTAAVTLLLITQSYLFLVGCIVLASFVQYVPSIFAVIKFKHTGQYPNHGFKLPGGYTIPILALLVACYLIFNFTWETILLSIVVAAVTAVLYLFLGKKRLAKMGGIPTAVREKKNHIEADLKKKN

SEQ ID NO: 36588 - DNA, 1311 bp, Lactobacillus johnsonii NCC 533
  CDS (1)..(1311)
ttgaaaagacaaattagctttggtcaagccctagctacagtcgttggaactgtaatcggtgggggcgtttttttcaaaataggaagcattagtcatgaaaccggcacttcctcattaactcttttcgtctggattttagccggtattgtttccatcgcttctggccttaccgtatctgaaattgcagctgctcttccagttactggcggctctatcaagtacatcgagtatacttatggaaaagtttggggctttttatttggctgggctcaaatgctagtctatttccctgccaatattgcagctttaagtgtaatattcgggcaacaatttgttgttttatttaacttacctgctaaatacgcaactttaattggtctactgctcgccatctttttaatgggcttaaactttatttctacaaagttttcaacccgaatgcaatcagtcatgactattcttaaggccattccaattgctttaattgtgcttttcggtctttttaattcaagcaaagtcgatattaacttattccctttaagcgctgggcataatacatctttttggacaggcttaagtggcggtttacttgcagctttatttgcttatgatggttggattaacgtaactaatttagctggtgagattgaaaagcctgagaaaaacctatcaagagctatcattattggactatcggctattactttaatttatgtattagtcaactatgcatttttaactgccatcccctttaaagaaattgttggcaatcaaaatactgcctatttagcttcgttaaaattatttggtagtttaggcggtaaattagttacgattggaattttaatttcagtttatggcgcaattaatggttttatgcttacgggaatgagaataccttatactttagccaaaaataagatgttaccattttctgataaaattagtcgcactaatgttaatacaggtgtacctactcttagtgccctaattattctcgtggtatctttaataatgattctactaggaacttttgacctgttaactaatatgctcgtcttcgtcatgtggacctttaccaccttaatttcaattgcagtggtaattttgcgctaccgcgaacctaaactagaacgtccttatgttgttccttggtatccgattgtcccgatcatctcaattggtggtggtttattcattgtgatcagtactgtaattaatgaattttggctctcaataaccggtatcggtctaacgctattgggccttcctatttattactatatgaaaaaacagaataatcgccaataa

SEQ ID NO: 36589 - protein, 436 aa, Lactobacillus johnsonii NCC 533
MKRQISFGQALATVVGTVIGGGVFFKIGSISHETGTSSLTLFVWILAGIVSIASGLTVSEIAAALPVTGGSIKYIEYTYGKVWGFLFGWAQMLVYFPANIAALSVIFGQQFVVLFNLPAKYATLIGLLLAIFLMGLNFISTKFSTRMQSVMTILKAIPIALIVLFGLFNSSKVDINLFPLSAGHNTSFWTGLSGGLLAALFAYDGWINVTNLAGEIEKPEKNLSRAIIIGLSAITLIYVLVNYAFLTAIPFKEIVGNQNTAYLASLKLFGSLGGKLVTIGILISVYGAINGFMLTGMRIPYTLAKNKMLPFSDKISRTNVNTGVPTLSALIILVVSLIMILLGTFDLLTNMLVFVMWTFTTLISIAVVILRYREPKLERPYVVPWYPIVPIISIGGGLFIVISTVINEFWLSITGIGLTLLGLPIYYYMKKQNNRQ

SEQ ID NO: 36590 - DNA, 1353 bp, Lactobacillus johnsonii NCC 533
  CDS (1)..(1353)
atgactaataaaagttccgtacctaagaaactttcctttatatctatctatttcttaggtattaatgcagtcattggatcagggacattcctgctaccttctgtaatttatcgttacatgaacttaacagctattcttgttcttctctgtactgctgtcactgtcagcatgattgctttatgctatgctgacttatccagccgtttcacacaatccggagccgcttggctttattcatataatgcttttgggcgtttttcgggttatgaactaggtatttttacttggtttttaggatgtacaactctttctgctgaagtagttgctttattaaccattctaaagagttttctacctatttttaaaaataatgcagtctacattagtggagttatcttcttaattttactgttttcaattattaatttctttggtagatcttgggtaaaaattgttaataacatttcagctgcagctaagattattacattacttgtcttcattattgtgggggccttctttattaagaaagctcactttactccggtaattccacatgcagctttaaccggtgttggcccattctttaaacattttggggctgccttcacaccaattttttatttatttactggattttcttttattccaattgccgcaaagcaaatgaataatccagaaaagaatattccacgcgttttaattgcagtaatgactagtgtaacaattctagattgcttgatgcttttagttgcaattggtttaagtgggcaaaaactaggaagttattctaatccattagcgagtgctctaaagactggtgttggccaatggggttttgcttttatgattgtcggaatgttaatttcaatctttggtgttgcctttagtgcttcatttaatactccttcacttattgcatcccttgctaccgaacatgggatgcttccgaaatggattggtaagaaaaataaacacgatgctccttgggttggtattatttttaccgctgttctttcaggagccttagctactcaaagctacctattccttgtttcatgtacagttttagcatcctttgttcaatatgtgccatcaattttagcagtcattaaatttaagcatagtaatgaatacccaacacacggtttttcactacctggaaaatacactattccaattattgctttgattatttcttgttatatggttactaactttactcctaagacactactcttaggggctgtagttgcagtgattgcggctgcctgctacttctttattgataaggatgaaaagttagaaaaagaacatgaagactttttagctaaattaagacgaaaaaactaa

SEQ ID NO: 36591 - protein, 450 aa, Lactobacillus johnsonii NCC 533
MTNKSSVPKKLSFISIYFLGINAVIGSGTFLLPSVIYRYMNLTAILVLLCTAVTVSMIALCYADLSSRFTQSGAAWLYSYNAFGRFSGYELGIFTWFLGCTTLSAEVVALLTILKSFLPIFKNNAVYISGVIFLILLFSIINFFGRSWVKIVNNISAAAKIITLLVFIIVGAFFIKKAHFTPVIPHAALTGVGPFFKHFGAAFTPIFYLFTGFSFIPIAAKQMNNPEKNIPRVLIAVMTSVTILDCLMLLVAIGLSGQKLGSYSNPLASALKTGVGQWGFAFMIVGMLISIFGVAFSASFNTPSLIASLATEHGMLPKWIGKKNKHDAPWVGIIFTAVLSGALATQSYLFLVSCTVLASFVQYVPSILAVIKFKHSNEYPTHGFSLPGKYTIPIIALIISCYMVTNFTPKTLLLGAVVAVIAAACYFFIDKDEKLEKEHEDFLAKLRRKN

SEQ ID NO: 36592 - DNA, 1389 bp, Lactobacillus johnsonii NCC 533
  CDS (1)..(1389)
atgaagttgaatccgtttagaaaagaaagcctcaagcgttatctcggtactgataagcactttgtcaaaacgctcggggcttttgacttattaaccattggtatcggagcagttattgggacaggaatttttattttaccaggtacggttgctgctaaagaagctggtcctggtgtaacactttcatttcttattgctgctttagtttgtacgctagcaagtatgtgttatgccgaactctcttctagcatccctgttgcgggctcggcttattcctacggaaatatcctttacggagaagttattggctggattttaggttgggcattaatcttagaatatatgctctcagttgctgcagtatcagctggatgggcttcttatttcaactccttactacacagctttggcttacacatcccgcatcattttgagggaccattcgatccgttaaatggtacgtacctaaatttatgggcagtcattagtgttttattaattggaatcttactttctcgtggaatgaaagcatccatgaaatttaataatgctgctgttttaattaagatagcaatcatatttatttttattggtgttggtttattttttattaagcctaaaaactatcaacctttcacgccatatggaactacaggcgttttacgtggagctacaacagtcttttttgcgtttttaggttttgacgttgtttcatcttcagcagctgaagttaaaaatcctaaaaaaaatatgcctattggaatcatcggtactctaatcgtagcagctcttctctatatgggagtttcagtagttttaactgggatggtaaattataaacaactagatgtagctaatccggttgcctacgctctaaaggtcgttaaccaaggttgggtagcagatttattatcgattggtgctattgttggaatgagtacaatgatgttaaccatgatttactcaagttcacgtctaatttattccattggacgcgatggactcctacctagctttttaggaaaaattgataagcatggtcttccagaaaatgccctatggattgtaactattgtgattgcaattatgggtggtctcttttctcttgaagaacttactagtttagtttcaattggaacactacttgccttcacttttgtttcatttggagttatcctattacgcagaagaaaagatattcctgaaggtgacttcaaggttccattctatccagtaattccaattctttccggacttgcttgcattggcatgatgtgttttttatctgttaaaacttatatttttgctagcgtttggttcttatttggactatttatttactgcgtctatggatataaacatagtaaaatcagtaaaagaaataattaa

SEQ ID NO: 36593 - protein, 462 aa, Lactobacillus johnsonii NCC 533
MKLNPFRKESLKRYLGTDKHFVKTLGAFDLLTIGIGAVIGTGIFILPGTVAAKEAGPGVTLSFLIAALVCTLASMCYAELSSSIPVAGSAYSYGNILYGEVIGWILGWALILEYMLSVAAVSAGWASYFNSLLHSFGLHIPHHFEGPFDPLNGTYLNLWAVISVLLIGILLSRGMKASMKFNNAAVLIKIAIIFIFIGVGLFFIKPKNYQPFTPYGTTGVLRGATTVFFAFLGFDVVSSSAAEVKNPKKNMPIGIIGTLIVAALLYMGVSVVLTGMVNYKQLDVANPVAYALKVVNQGWVADLLSIGAIVGMSTMMLTMIYSSSRLIYSIGRDGLLPSFLGKIDKHGLPENALWIVTIVIAIMGGLFSLEELTSLVSIGTLLAFTFVSFGVILLRRRKDIPEGDFKVPFYPVIPILSGLACIGMMCFLSVKTYIFASVWFLFGLFIYCVYGYKHSKISKRNN

SEQ ID NO: 36594 - DNA, 1401 bp, Lactobacillus johnsonii NCC 533
  CDS (1)..(1401)
atgaacgaaaatgaaacaagtaaattaggcttttggtctattgttttgttggccattaattcgattattggctcaggaatatttttaacacctgggagcgtagttcaacaggctggatctaaagctttaattgtatattttatagctgcaatttttgcatctattttagctatttcttttgcagcagcagcaaaatatgtaactaaatctggagcagcttatgcatactcaaaggcagcttttggaaataatgttggtttctatatgggaattttacgttatttttcagctagtgttgcctggggtataatggcagttggggttattaaatctactatttctatttttggtggtaacccaaatgaaacgatgagcgtaactattggttttttgatattaatggctgttattacggtaattaatttatttggtcaaaaagtggttaagtatgttatgaacttagcgactattggtaagttagctgctctagtattaattattgttgcaggggtagttttattaattgtaagtggtgcttcaagtaatttaagtcaggtagatcaaattactcaaaatggtcaaaagattgttcctactttaactactacaggttttgtaatggcaatcgtatctgccttctatgcctttactggatttgaatcagttgcttctggttcagacgatatgaagaatcctgctaaaaacttaccacgcgctattcctttagctattattgttatcgcggtaatttatattggggttgttgctgttgcaatgatgctcgatccaaaagcattaatgacaactaagcaagttgtcgcaattgcggctatttttaagaatgaaattttaagggatgttatcttagttggtgctttagtttcaatgtttggtattaatgttgcttctagttttaatgctccacgaattttagaagctatggcacgtgaaaaccaattttcaaaagctttaactaaaagaaccaagaataattttccaattagaaccttctttatttccgtattatttgcaattttaattccaatggcatttgaatataatatggttaacttgattactttaagtgccatggtacgttttttaggctttattgtagttccattggcagttattcaattctatcgtggaaaaactgcagaaccagttttagatgcgcaaaggaatgtgtggactgatattgtagttccaattctttccattgttctagtgattttcttactagtagaatataactggaaggctcagtttggggtagtcaatgcccaaggacaagtaactggaattaactggtatgcaattgctatgatgatttttggatttatcctcttacctctaattatgtttattatctctagaaaagatcgtaaagctagtaaataa

SEQ ID NO: 36595 - protein, 466 aa, Lactobacillus johnsonii NCC 533
MNENETSKLGFWSIVLLAINSIIGSGIFLTPGSVVQQAGSKALIVYFIAAIFASILAISFAAAAKYVTKSGAAYAYSKAAFGNNVGFYMGILRYFSASVAWGIMAVGVIKSTISIFGGNPNETMSVTIGFLILMAVITVINLFGQKVVKYVMNLATIGKLAALVLIIVAGVVLLIVSGASSNLSQVDQITQNGQKIVPTLTTTGFVMAIVSAFYAFTGFESVASGSDDMKNPAKNLPRAIPLAIIVIAVIYIGVVAVAMMLDPKALMTTKQVVAIAAIFKNEILRDVILVGALVSMFGINVASSFNAPRILEAMARENQFSKALTKRTKNNFPIRTFFISVLFAILIPMAFEYNMVNLITLSAMVRFLGFIVVPLAVIQFYRGKTAEPVLDAQRNVWTDIVVPILSIVLVIFLLVEYNWKAQFGVVNAQGQVTGINWYAIAMMIFGFILLPLIMFIISRKDRKASK

SEQ ID NO: 36596 - DNA, 1398 bp, Lactobacillus johnsonii NCC 533
  CDS (1)..(1398)
atgaaaaacttctttaagaaagttccagtaaatacttttttaaaagcagattctcgcttaactagacatttaaatgctcgtgatttagttgcgttgggaatcggggcagttattggaacaggaatttttattttgcctggtcatgaagcggcacagcatgctggtccagcagttgctatttcttttttattagcagcaattgtttctggtatggtgggaatggcttatgctgaattttcttctgcaatgccagtagctggctccgcctattcttttggttcagtaatctatggagaagtagtagggtggataattggatggggattattattagaatattttttagctgtttctgctgaagcgactggttttgcttcatattttaataataatattttagcgccaattggaattcatttgcctaaagcacttgaagctggaccaatggaaggtggagtaataaatatttctgctgttttaattgtgttaatcgttgctttgattttatatcaaggtgctaacttatctaaacgtgtggaaaatatagcagtaattatcaaagtcgcaattattattttgtttattgtgattgggatgttctatattaaggctgacaactatgtcccattttatcctaaaaaattccaaacaccaccattagggattgggggaatatctacagctgcagccactgtattctttgcatttattggttttgatgctttagcagcaaacagtgctgaaacaaaggatcctgaaaaaaacgttgttaaaggaatcatggggacagtgattattgctgttctactatatgtaagtttttctctagttttaactggaatggttaattacaaacaattaaatgttgatgatccagcagcttatgcactaaaagtagttggcttaactgcgtggaataaattgattaccgttggagcattagtcggaatctttaccgcaatgattactatgttgctgggcggctcaagattactctatgctttaggaagagatggattattaccggattccatgggaagtgtgcatgctaaaaagatgattcctgatcacgcagtaattgtctctacaatagtagcagctgtttttgctggattggttcctttaatggaattagcttcattaattaatgcagggacattaatcgcatttgctttaatttcatttggaattattcctctacggcatcgaaaagatattgtgaatgatggatttaagatgccactttatccggtactgcctgtaattgctggattactaagcgtatatttcatttggatgttaccaaatacgacaaaaattatggtgggaatctggttaattgtgggaatcattgtgtatgcaacatacggtataaaacattctaaactacagaattaa

SEQ ID NO: 36597 - protein, 465 aa, Lactobacillus johnsonii NCC 533
MKNFFKKVPVNTFLKADSRLTRHLNARDLVALGIGAVIGTGIFILPGHEAAQHAGPAVAISFLLAAIVSGMVGMAYAEFSSAMPVAGSAYSFGSVIYGEVVGWIIGWGLLLEYFLAVSAEATGFASYFNNNILAPIGIHLPKALEAGPMEGGVINISAVLIVLIVALILYQGANLSKRVENIAVIIKVAIIILFIVIGMFYIKADNYVPFYPKKFQTPPLGIGGISTAAATVFFAFIGFDALAANSAETKDPEKNVVKGIMGTVIIAVLLYVSFSLVLTGMVNYKQLNVDDPAAYALKVVGLTAWNKLITVGALVGIFTAMITMLLGGSRLLYALGRDGLLPDSMGSVHAKKMIPDHAVIVSTIVAAVFAGLVPLMELASLINAGTLIAFALISFGIIPLRHRKDIVNDGFKMPLYPVLPVIAGLLSVYFIWMLPNTTKIMVGIWLIVGIIVYATYGIKHSKLQN

SEQ ID NO: 36598 - DNA, 1239 bp, Bdellovibrio bacteriovorus HD100
  CDS (1)..(1239)
atgttggttttttatgccacgggcatgatccttggggcgggggtgtattcggtgatcggtaaggctgccggggtagctcaagagggattgtggctgagttttattttggcggcgctggcggctgtgttgacggctctgtcctatgctgaacttgcgacactttttcccaaggcgggggcggaatatgtttatatgaaagagatctttccgcaaagaaagatcctttcttttctttgtggttgtctgatgatctttgccgctatcatcacggcttcgacggtgtcgctgtcatttgccgcttatactcaggactttttcaaggccccggaaatgctggtcgccatagtcttgctgggttttttcactctggtgaacatctggggggtgcgcgaatccggatgggtgaacattgtgttcaccctggttgagctatcggggctggtgatatttatttttgtcggtttacggcagcccgatttcggcaaagtcctgtcagttccagtttcctggggcgtggtgaccggagcgtctttgattttttttgcttacctggggttcgagagcatggtgaatctggctgaagaggcaaaaaagcctgataagaacattccccgcgcgattttgctcagtctttcgctgaccacggtcgtctatgtggcggtcagtctggcggcgctggcgatgatgagccccggggatttgcaaaagtcggatgctgtcttaagtgcagccctgcaaaaacattctccagaggcggcaagggccttggcggggattgcgttgtttgccacagccaacacggtgatgatcgccttgctgggggccagtcgaatcagtctggggatggcgcggggaagggatttgccgaaggttttttccaaaatattaccccaacggcaaagtccgtggctttcttcgttgttggtttttttgctggcattgttgttcttgccattaaagaaaatcgaagtgcttgccagtgtttcttcgtttgtgacgatcgtggtttttatcatcatcaacggagcggtggtgtatctgcgccggaaagagcctcagcgaaagcgcccttttcgggtgccaggggccgtggctggatggccggtgcttcccatactggcggcaggtatggcgttattctttttgtttaactttgaagagcaggtgtactacgtcggggtggggattgtgatctttgtgcttgtggtttatcaggcgctgcattttcgccgcgcctga

SEQ ID NO: 36599 - protein, 412 aa, Bdellovibrio bacteriovorus HD100
MLVFYATGMILGAGVYSVIGKAAGVAQEGLWLSFILAALAAVLTALSYAELATLFPKAGAEYVYMKEIFPQRKILSFLCGCLMIFAAIITASTVSLSFAAYTQDFFKAPEMLVAIVLLGFFTLVNIWGVRESGWVNIVFTLVELSGLVIFIFVGLRQPDFGKVLSVPVSWGVVTGASLIFFAYLGFESMVNLAEEAKKPDKNIPRAILLSLSLTTVVYVAVSLAALAMMSPGDLQKSDAVLSAALQKHSPEAARALAGIALFATANTVMIALLGASRISLGMARGRDLPKVFSKILPQRQSPWLSSLLVFLLALLFLPLKKIEVLASVSSFVTIVVFIIINGAVVYLRRKEPQRKRPFRVPGAVAGWPVLPILAAGMALFFLFNFEEQVYYVGVGIVIFVLVVYQALHFRRA

SEQ ID NO: 36600 - DNA, 1281 bp, Treponema denticola ATCC 35405
  CDS (1)..(1281)
atggaaaataaaggtaaattagggcttttaagtatttgccttcttggagtaaatgccattgtcggtaccggaatatttttgcttccgggaaaggccgccaaattggtcggtgtatcgagtatcggagttattttattcgatgccgttttggttattttgattgcactttgttttgctgaagcaggaggcttgtttaaaaagaacggcggtccttatgtttatgcaaaagaagccttcggcgaattcgtcggttttgaagtaggctttatgaaatgggcaataatggttattgcttgggctgcaatggctgtaggttttcccacagcgttaggaagtgtatttcctttagcagcaacacctttttggcgaagcgttatagccgtagctattcttttgtttttaggattgatgaacattgctggagtacgaatttcaaaaatcgtaaacaatgttattacaatcggaaaattggtgccccttatcttctttattcttttaggtatcttttttataaaaggcgataattttcaacctatgcagtcggtaggtgccttaactacaacgtctttcggagcagctgctcttttaatcttttatgcctttacggggtttgaatctattgccgttgccgctgaagatatggataagcctgaaaaaaatgttcctcttgctattgttttggtaatcagcggtgtttccgttttttatatacttattcaagtagttgctataggtattttgggtgatggacttacagcaagtgaagctcctgttgcagatgctgccgcaaagtttttaggccccgttgcaaaagccgttgttacaaccggaaccttggtttcaataggcggaataaatgttgcttcttctttcttagctcctcgaagtgccgtagctcttgccgacgacggttttttacccaagtttgtaactaaaagaaataaaaaagatgttccctacatttcggttattttaacaaccgccttgacagccttggtttgcttaacgggcagtttttcaaaacttgccgcaatttcggttgtttcccgctttgctcaatatataccgacctgtcttgcaatcttagtattcagaaaacgcggtatgaaaggctcttttagaattcccggtgtttatgttgtttcttttttggcggtaggaataagcctttggcttttatataattcaagctgggacaagattttattcggtttaggcggtcttgtagtcggagccgttttttacgttataatgaaacttacacagaaaaaagctaactaa

SEQ ID NO: 36601 - protein, 426 aa, Treponema denticola ATCC 35405
MENKGKLGLLSICLLGVNAIVGTGIFLLPGKAAKLVGVSSIGVILFDAVLVILIALCFAEAGGLFKKNGGPYVYAKEAFGEFVGFEVGFMKWAIMVIAWAAMAVGFPTALGSVFPLAATPFWRSVIAVAILLFLGLMNIAGVRISKIVNNVITIGKLVPLIFFILLGIFFIKGDNFQPMQSVGALTTTSFGAAALLIFYAFTGFESIAVAAEDMDKPEKNVPLAIVLVISGVSVFYILIQVVAIGILGDGLTASEAPVADAAAKFLGPVAKAVVTTGTLVSIGGINVASSFLAPRSAVALADDGFLPKFVTKRNKKDVPYISVILTTALTALVCLTGSFSKLAAISVVSRFAQYIPTCLAILVFRKRGMKGSFRIPGVYVVSFLAVGISLWLLYNSSWDKILFGLGGLVVGAVFYVIMKLTQKKAN

SEQ ID NO: 36602 - DNA, 1404 bp, Bacillus cereus ATCC 10987
  CDS (1)..(1404)
gtgaaatcattattacgaaaaaaggcgattactactgaatcaccacgacaactacaaagaacattaaccgcacttgatttaacgtttttaggaattggcgccgtaattggcacagggatttttgtattaacaggtattgttgcagcgaaacattctggtcctggtattatgttatcatttcttattgctgcatttacttgtgcttgtgtagccttttgttatgccgaatttgcttcttctattcctgtctcaggaagtgtgtatacttacgcatacatgacagtcggggaagtcgtcgccttcatcgtcggatggtgtttaatgctcgaatatttactggcagtcgcagcagtagctgtcggttggtctggttatttacagtctttactacaaggatttaacatccatctgcccgccataatcgcctcggcacctggcgtaggaaaaggtggtctcattgatttaccagctgtttgtattttactcatcattaccggtcttttaagttttggtatacgtgaaagcgcacgcattaataatattatggttctgatcaagttagcagttattatcgcctttatcgtagcaggtgcaaaatatgtaaaacctgaaaattggacaccgttcatcccattcggatacgacggtattattactggagctgctactgtattcttcgccttcttaggctttgatgcaatcgcaaccgctgcggaagaaacgaaaaaaccacagcgtgatttaccaattggcattatcggttcccttcttatttgtactgttttatacatgattgtatctttcgttttaacaggtatggttccgtatacacaattagatgtttctgatccagttgcgtttgccttgcatttcgttggggaagatacgattgcaggactactcgctgttggagcgatgactggaatgacaaccgttctcttagtcgttatgtatggacaagttcgcgtttcatatgcgatgagccgcgatggcctacttccaaaagcgttagcacgtgtaaataaaagagtgaaaatccctttattaaatacgtggattactggtgttgttgccgctttattagcaggacttttagatctgcacgtattagcgaatttagtaaatatcggtacattaacagccttcacattcgtttgctgtgcagtacttattttacgaaaaacacaccctgacttgaaacgcggattccgtacacctttcgtacctgtattaccagttgtcgctattctttgctgtttatatttaatggctaatttatctaaaacgacatggattagctttatagcttggcttatagtcggtttatgcttctatttcttctactctagaaaacatagtcatttagctactgaaaaagcaaacgatgaacagaaaaaagcataa

SEQ ID NO: 36603 - protein, 467 aa, Bacillus cereus ATCC 10987
MKSLLRKKAITTESPRQLQRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNIHLPAIIASAPGVGKGGLIDLPAVCILLIITGLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMANLSKTTWISFIAWLIVGLCFYFFYSRKHSHLATEKANDEQKKA

SEQ ID NO: 36604 - DNA, 1416 bp, Bacillus cereus ATCC 10987
  CDS (1)..(1416)
atgagtaagttatttaaaaagaaatctgttacacaattattagatcctagtaagagtaaaaccttaatgaaaacattgggttcatttgatttagttatgttaggattaggttcaataattggaacgggagttcttgtgttagcaggattagtagcagcaagagacgctggaccagcagttgttttttcattcgtattggcagcaattgtatgtggatttatagctttatgttacgcagaaattgcttctatacttccggtttcaggaagtgtatatacgtatgcctatgcaacaattggtgaattagttgcacatttagtaggttggatgctactttcgatctatattttagcgacagcagcggttgccagtgggtggacaggttattttcacaatttaataagtggattgggtttagatatgccaaaatcactgttaatgattccatctcaaggtggtatgatgaatctaccagcgatggtcattacattaatcattacatggatgttatcgcgtggtacaaaggaaagtaaacgtatcaataatataatggtgttaattaaaattggaatggttatattatttattgtagttggtgtattctatataaagccagagaactgggtaccgtttacaccatatggtgtaagtggagttttagctggtggggcagcagcattctttacttttatgggatttgatatattagcaacttcggcagaagaagtaaaagatccacaacgaaatcttcccattggtattattgtatcgttaatcatatgtacacttatatacgttatagtgtgccttgttatgacaggaatggtttcctataaagaattaaatgtacctgaagcaatggcttatgtaatggaagtagtaggacaaggtaaggtcgctggtgtaattgctgtaggagctgtcattggtcttatggctgttattttctcttctatgtatgccgcaacacgagtattctttgcaatgagtcgtgatggactgttacccaaatcacttgcgaaaattaataggaagactggagcaccgacttttacaattggcttggtgggaataggaagttcttttatagctgggtttattgatttaaaagaattagcgaacttagttaatattagtggtttggtaacgtattcaatggtgggagtatcagttattgtccttcgcaaaactcatccgaatttaaagcgtggctttatggtaccatttgtacctatattgccaatcatttcaattgcaagttgtgtatttttgatgtttaatttaccattaagaacatggttgtacttctgcatttggataactattggagtaataatatattttgtttattcaataaaacatagtaatttaaatgaggaagcaatttcaaaagcaaaagataaaatagtcaaataa

SEQ ID NO: 36605 - protein, 471 aa, Bacillus cereus ATCC 10987
MSKLFKKKSVTQLLDPSKSKTLMKTLGSFDLVMLGLGSIIGTGVLVLAGLVAARDAGPAVVFSFVLAAIVCGFIALCYAEIASILPVSGSVYTYAYATIGELVAHLVGWMLLSIYILATAAVASGWTGYFHNLISGLGLDMPKSLLMIPSQGGMMNLPAMVITLIITWMLSRGTKESKRINNIMVLIKIGMVILFIVVGVFYIKPENWVPFTPYGVSGVLAGGAAAFFTFMGFDILATSAEEVKDPQRNLPIGIIVSLIICTLIYVIVCLVMTGMVSYKELNVPEAMAYVMEVVGQGKVAGVIAVGAVIGLMAVIFSSMYAATRVFFAMSRDGLLPKSLAKINRKTGAPTFTIGLVGIGSSFIAGFIDLKELANLVNISGLVTYSMVGVSVIVLRKTHPNLKRGFMVPFVPILPIISIASCVFLMFNLPLRTWLYFCIWITIGVIIYFVYSIKHSNLNEEAISKAKDKIVK

SEQ ID NO: 36606 - DNA, 1590 bp, Xenopus tropicalis
  CDS (1)..(1590)
atggcggaaggtgcaagattgcgcaccagtgctgagaagatcccagaggaaaagggacaggactctggctcaggttcaagctctggggaagatggtggtgtggctctgaagaaagagattgggttggtgagcgcctgtggcattatagtaggtaatattattggttctggtatatttgtatcgccaaagggagtgctggagaatgcaggttctgtgggaatggcactcattgtatggattgtcacaggggtaatcactgcagtaggagccctttgctatgcagaactaggggtcaccatcccaaaatctggaggagactattcatacgttaaagatatatttggtggattagcagggttcctccgactgtggatagcagttctggtaatatatcctacaaatcaagccgttattgccctgacattctccaattacgtcctgcagcccctctttcctacatgctttgcaccagagtctggacttcgattgttggctgcagtctgtctattgttgctgacatgggtgaactgcgccagtgtgcgctgggcaactcgcgtgcaggacatatttacagctggaaaacttttagccctgggacttatcattattatgggaattgtgcagatctgcaaaggagagtatttctggctggagccaaagaacgcctttgagaatttccaggagccagacattggtctgattgcactggccttcttgcagggatccttcgcttacggtggctggaatttcctcaactatgtcacagaagaactggtgaacccctacaagaacttgccccgtgccatctttatctctattccacttgttacctttgtgtacgtatttgccaacattgcctatgtgactgccatgtcaccccaggaattactggcatccaacgctgtggctgtgacatttggtgaaaagttgctaggtgttatggcctggatcatgccaatttctgtggctctctccacttttgggggagtcaatggatctctctttacttcatccaggttgttttttgcgggagccagagagggccatctcccaagtgtattggcaatgattcacatcaaacgttgcactcctattccagccctgctctttacttgcatctccactcttctgatgttagtgaccagtgatatgtacactcttatcaattacgtgggcttcatcaattacctgttttatggagtaacagtggcaggacagattgtcctacgatggaagaagccagacattccacgacctattaaggtgaacctgattttcccagtgatctacctcctattttgggccttcctactagttttcagcttatggtcagagcctgtggtctgtggaattggccttgcaatcatgctgactggggtgcctgtctatttcttgggagtgcattggcagaacaagcctcagtgctttaataattttgtggatgccatgacacgtgccggtcaaaagctatgtgtggttgtgtatccccaaatggacaataaagatgaagatgtgagtgaagagaccaaagagcagagggcgccaatctataaaccagggtctgaggaagaaagtggagcacaagcctga

SEQ ID NO: 36607 - protein, 529 aa, Xenopus tropicalis
MAEGARLRTSAEKIPEEKGQDSGSGSSSGEDGGVALKKEIGLVSACGIIVGNIIGSGIFVSPKGVLENAGSVGMALIVWIVTGVITAVGALCYAELGVTIPKSGGDYSYVKDIFGGLAGFLRLWIAVLVIYPTNQAVIALTFSNYVLQPLFPTCFAPESGLRLLAAVCLLLLTWVNCASVRWATRVQDIFTAGKLLALGLIIIMGIVQICKGEYFWLEPKNAFENFQEPDIGLIALAFLQGSFAYGGWNFLNYVTEELVNPYKNLPRAIFISIPLVTFVYVFANIAYVTAMSPQELLASNAVAVTFGEKLLGVMAWIMPISVALSTFGGVNGSLFTSSRLFFAGAREGHLPSVLAMIHIKRCTPIPALLFTCISTLLMLVTSDMYTLINYVGFINYLFYGVTVAGQIVLRWKKPDIPRPIKVNLIFPVIYLLFWAFLLVFSLWSEPVVCGIGLAIMLTGVPVYFLGVHWQNKPQCFNNFVDAMTRAGQKLCVVVYPQMDNKDEDVSEETKEQRAPIYKPGSEEESGAQA

SEQ ID NO: 36608 - DNA, 1527 bp, Xenopus tropicalis
  CDS (1)..(1527)
atgggtacctctaccaagtacacacctgcctccacagaagagccaaaccgtaatgggacaaaagattccacagcagactcgggctcgcaagagtccatgaaactgaagaaagagatctccctgttaaatggggtgtgcctcattgtggggaacatgattggctctggaatctttgtgtcacccaaaggggtcttaatatacagtgcttcatttggcctctcactggtattatgggcagttggtggtattttctctatctttggcgctttgtgttatgctgagcttgggactacaatcaccaaatctggggccagctatgcctatatcctagaggccttcgggggttttgtggctttcatcagattatggacatctcttctcatcattgaacccacaagccaagctgtcattgccatcacattttccaactatatgttgcagcctatcttcccttcttgtggatctccttatgctgctaatagactcattgcagcaggttgtatagcactccttacctttgtgaattgtgcctatgtaaaatgggggaccagggtccaggatatcttcacttatgccaaagtgctagctctgattgctgtcattatagctggaattgtaaagatctgtcaaggtcattcagagaactttgaaaattcgtttgctggctcctcatacgatgttggtgacattgctcttgcattatattctgcacttttttcatactcaggatgggacacacttaactttgtaacagaggaaataaaaaacccagagaggaacctgccattggccattgggatttctatgccaatagtgacagtgatttacatccttaccaatgtggcctattacaccgtgctggatatcagggaaattcttgccagtgatgctgttgctgtgacctttgctgatcagatttttggcatatttaactggacgataccactggctgtcgctttgtcatgctttggtggcctcaatgcatctatccttgctgcatccaggctgttctttgtgggatctcgggagggccatcttcctgatgcactcagcatgattcatgtagaaagatttacacccatacctgctcttctctttaatggtgcaatggccctggtgtacctctgtgttgaagatattttccagctcattaattactacagtttcagttactggttatttgtgggactttctattgcgggacagctgtatctgcgctggaaacaaccagaccgaccaaggccactcaagctcagcctagtgttcccaatcatattctgtctttgcactgtgttcctggtggctgtacccctgtatagtgatctaataaattctctgattggagtgggaattgcattgtcaggagtcccagtctatttccttctggttcgtgttcctgagaaacggaagccacaatgtcttcagcgtgctgcaggtgctctgacacgatatacacaaattctgtgctactcagtactaactgaaatggatacagaagaggaaaaagacttctcaaaaagtgattga

SEQ ID NO: 36609 - protein, 508 aa, Xenopus tropicalis
MGTSTKYTPASTEEPNRNGTKDSTADSGSQESMKLKKEISLLNGVCLIVGNMIGSGIFVSPKGVLIYSASFGLSLVLWAVGGIFSIFGALCYAELGTTITKSGASYAYILEAFGGFVAFIRLWTSLLIIEPTSQAVIAITFSNYMLQPIFPSCGSPYAANRLIAAGCIALLTFVNCAYVKWGTRVQDIFTYAKVLALIAVIIAGIVKICQGHSENFENSFAGSSYDVGDIALALYSALFSYSGWDTLNFVTEEIKNPERNLPLAIGISMPIVTVIYILTNVAYYTVLDIREILASDAVAVTFADQIFGIFNWTIPLAVALSCFGGLNASILAASRLFFVGSREGHLPDALSMIHVERFTPIPALLFNGAMALVYLCVEDIFQLINYYSFSYWLFVGLSIAGQLYLRWKQPDRPRPLKLSLVFPIIFCLCTVFLVAVPLYSDLINSLIGVGIALSGVPVYFLLVRVPEKRKPQCLQRAAGALTRYTQILCYSVLTEMDTEEEKDFSKSD

SEQ ID NO: 36610 - DNA, 1827 bp, Rattus norvegicus
  CDS (1)..(1827)
atgtggattggaaagccaggatttttgaaagttgagattggaatggttgagttcggatccctccaccaggctctgaagatgttatggcagaacctccatcagtttggccagaagttggttcgccggcggcccctggcggcaagtgaacagtctgagtcttccttgtctcgatgtctgaccactttggaccttgtgtccttgggtgtgggcagtaccctgggagcaggcgtgtatgtcctggccggagaggtggccagagagaaagctgggccgtccatcatcatctgcttcttaattgctgccctgtcttcagtgatgtctggactctgttatgcggagtttggagccagggtaccgtgttcaggttccgcttatctctacagctatgttacagtgggccagctgctggctttcatcactggctggaacctcatactcaactatgtcattggagcagccagtgtggctcgggcctggagtgcagcttttgatggcctcatagggaaccatatctcccaagccctgcagacgactttccctatccaagtgcccagctttctggccaagtatccagacttttttgcacttggtctggtgatagtcctcactggaatcctggccctgggagcacgagagtcagccatggtcactagggttttcacaggagtgaatcttttggtgctgtgttttgtctccctctctggcttcattaacggcaagctacacaactggcagctcacagaggatgactacaaactggctttgtcagagaccaacagcactgacagctgtgtgccaacagagggatactatggaaccacatgtttcttcgccttcattgggtttgactgtattgcgagtacaggggaagaggcccgctgtccccagcgttccatcccattgggcatcgtgatctcactcttcatttgctttctgatgtattttggtgtttcatccgcactcaccctcatgatgccctactaccagattaacatcaacagccccttgccccaggcatttatccatgttggatggggccctgctcgctatgcagtagctgtgggaaccttatgtgccctttcatccagcctcataggttccattttcccagtgcctcgggtggtgtattccatggcagaggatgggctcctgttccggaaacttgcccaggttcatcctcgaacacacaccccggtcctagccacggtcctttgtggagtcattgcagcattcatggctttccttgttgagctcagtgatctggtggacctctcatccatagggactttgctcgcctattctttggtggccttctctgttcttgtcctcaggtaccagccagaccagaacttaagctcttgtaagaaggagaaatctgacagtatggctgttgagctggagcctgggcttgaactttcttcatgcatggagcctatgtctccagaagggactccagggattgcaaggggactctgtatgcccatggacaccaccccaactttgagatctggccggatcgtctatggatgtgcttccctgcttgccctccttctggtgttcctgtgcctgattctggtccagtggtccacacagctgttctctggtaacccagttttgatagctgtggctgtttcactgtttcttcttactgtcggggtggtcactgtcatctggagacagcctcagagcaccattcctctccactttaaggttccagccctgcctgtgcttcctgtactgagtatctttgtgaacatctacctgatgatgcaaatgactactgggacctggattcgctttggtatctggatggtgattggtgagtag

SEQ ID NO: 36611 - protein, 608 aa, Rattus norvegicus
MWIGKPGFLKVEIGMVEFGSLHQALKMLWQNLHQFGQKLVRRRPLAASEQSESSLSRCLTTLDLVSLGVGSTLGAGVYVLAGEVAREKAGPSIIICFLIAALSSVMSGLCYAEFGARVPCSGSAYLYSYVTVGQLLAFITGWNLILNYVIGAASVARAWSAAFDGLIGNHISQALQTTFPIQVPSFLAKYPDFFALGLVIVLTGILALGARESAMVTRVFTGVNLLVLCFVSLSGFINGKLHNWQLTEDDYKLALSETNSTDSCVPTEGYYGTTCFFAFIGFDCIASTGEEARCPQRSIPLGIVISLFICFLMYFGVSSALTLMMPYYQININSPLPQAFIHVGWGPARYAVAVGTLCALSSSLIGSIFPVPRVVYSMAEDGLLFRKLAQVHPRTHTPVLATVLCGVIAAFMAFLVELSDLVDLSSIGTLLAYSLVAFSVLVLRYQPDQNLSSCKKEKSDSMAVELEPGLELSSCMEPMSPEGTPGIARGLCMPMDTTPTLRSGRIVYGCASLLALLLVFLCLILVQWSTQLFSGNPVLIAVAVSLFLLTVGVVTVIWRQPQSTIPLHFKVPALPVLPVLSIFVNIYLMMQMTTGTWIRFGIWMVIGE

SEQ ID NO: 36612 - DNA, 1908 bp, Rattus norvegicus
  CDS (1)..(1908)
atggcccggggactgcccagcactgcccgcttggcacgcttttgccagaaactgaaccgtctgaagccactggaagagtctagcacagagacatcactgcggcgttgcctgtccacactggacttgaccctactgggtgtgggtggcatggtgggatctgggctctatgtactcacaggcacagtggctaaggacatggctggccctgctgtgctcttgtcctttttggtggccgctgtagcctccctgctggcagcactatgctatgcagagtttggagcccgcgtgccccgtactggctctgcatacctattcacctacgtgtccatgggggaaatatgggcatttctcataggctggaatgtgcttctggaatacctcattggaggtgctgctgtggcccgtgcctggagtggctatttggatgccatctttaaccacagcattcgcaacttcacagaatctcacatgggtgtctggcagatgcccttcctagcccactatccagattttctggctgctggcattttgcttgtggcttctgcctttgtctcctgtggcgcccgagtctcctcctggctcaaccacacattctcagccatcagtctgattgtgatcctcttcatcatcgtcctgggtttcatcctggcccgtcctcacaattggagtgcagaagaaggtggctttgcacccttcggcttctctggcatcctcgctggcacagccacctgtttctatgcctttgtgggcttcgatgtcattgccgcctccagtgaggaggccaaaaacccacggtgggccgtgcccatggccattgccatctcgcttggcctggcagctggtgcctatattctggtctccactgtgctgaccctcatggtgccttggcatagcctggaccctgactcggcacttgctgatgccttctacaggcggggctacggctgggctggcttcattgtggcagttggttctatctgtgccatgaacacggtcctgctcagcaacctcttctccctgccgcgcattgtctacgccatggctgccgacgggctcttcttccaggtgttcgcccgtgtacacccccggacacaggtgcctgtggtgggaatcctggtgtttggggtccttatggctctcctggcactgctgatggacctcgaggcactggtccagttcctatccatcggcaccctgctggcctatacctttgtcgccaccagcatcattgtgctgcgtttccagaaagcttccccacccagttccccttgcccagccagccccggccccacagttaagaagtacgactccttctcggaccatatacagctagtagatgctgtacaggcttcgatgtctgagcctgggcagctgcgaccagccctgaagcccttcctgggcttcctggatggactcagccctggaactgctgtgacctgggcgctgggcatcttgatagcctcagctatttccctggcgtgtgtgctagtcttcgggaactcagccctgcacctcccacggtggggctatgtcttgctgctggtcgtcagtggtgctgtctttctgtccagcctcctggtcctgggggctcaccagcagcaaaagaaacaagacactttccagatccctttggtgcccctgactccagccctgagcatcctcctcaacctttgcctcatgctgaagctcagctacctgacctggctgcgttttatcttctggctgctggtcggactcgtcgtgtattttggctacggcatctggcacagcaaggagaaccagagggagccattggagctgactactgcacactacgtggtattccccagcggcagcctggaggaaaccgtgcaagctgtgcagcctgatagccagacaccagtccagggaccaggctgtaccgagtag

SEQ ID NO: 36613 - protein, 635 aa, Rattus norvegicus
MARGLPSTARLARFCQKLNRLKPLEESSTETSLRRCLSTLDLTLLGVGGMVGSGLYVLTGTVAKDMAGPAVLLSFLVAAVASLLAALCYAEFGARVPRTGSAYLFTYVSMGEIWAFLIGWNVLLEYLIGGAAVARAWSGYLDAIFNHSIRNFTESHMGVWQMPFLAHYPDFLAAGILLVASAFVSCGARVSSWLNHTFSAISLIVILFIIVLGFILARPHNWSAEEGGFAPFGFSGILAGTATCFYAFVGFDVIAASSEEAKNPRWAVPMAIAISLGLAAGAYILVSTVLTLMVPWHSLDPDSALADAFYRRGYGWAGFIVAVGSICAMNTVLLSNLFSLPRIVYAMAADGLFFQVFARVHPRTQVPVVGILVFGVLMALLALLMDLEALVQFLSIGTLLAYTFVATSIIVLRFQKASPPSSPCPASPGPTVKKYDSFSDHIQLVDAVQASMSEPGQLRPALKPFLGFLDGLSPGTAVTWALGILIASAISLACVLVFGNSALHLPRWGYVLLLVVSGAVFLSSLLVLGAHQQQKKQDTFQIPLVPLTPALSILLNLCLMLKLSYLTWLRFIFWLLVGLVVYFGYGIWHSKENQREPLELTTAHYVVFPSGSLEETVQAVQPDSQTPVQGPGCTE

SEQ ID NO: 36614 - DNA, 1467 bp, Rattus norvegicus
  CDS (1)..(1467)
atggagagaaaggaggagaaagatggcagcgacaagcccgaggggcaagaacagggcagtggggcagcggggctgacgatgaagagggagattggtctgtggagcgcagtgtccatgacggctggctgtatgattggttctggcatcttcatgtcaccacagggggtcttggtttacataggcagtcctggagccagtctcatcatctgggcaacctgtggcctcctggccctgttgggtgccctgtgctatgctgaactgggcagcctggttcctgagtctgggggagagtatgcctacattttgcgagccttcggctctctgcctgccttcctggtcatctacataattgttctggtaggcagaccagctgccatcactgctgtctctctgagtttcgctgagtatgccctggctcccttttatccgggctgctcctcagtccctcaggtcatagtcaagattgtggcttgttcttgcatccttgtgctgcttctgatcaacttctggagctcacggatgtccactgtgctgatgaacgtgtgcacggctgccaaactgttctcgctactagtcattgtagtgggtggggctgtggggctggcgcagggccggattcccacagaatccctgctgtttgccttccacaacacaacgcaacaggcagggcgcattggcatggctttctaccaggggctgtggtcctttgacggctggagtaatatcaacacggtgatagaggagatcaagaacccaaagcagaacctggtgtgggcagtggtgattgccattcccctggtcaccatcctgtatgtcctggtcaatatcagttacctgctggttatgtcaccctcagagatcctcacttctgatgccatagccgtgacctgggggaaccaagttctggggtcctgggcctggctggtgcccttggctgttgcactttcaacatttggcgctgtcaatggggggttcttcagcggcagtcgcgtgtgctatgcagcagccagagaaggccacatgccccagcttatgtccatgattcatgtgcatcgacttaccccagcgccagccctgatcttcaccacggctgtggctttgctgctggtcatcccaggaaacttcagcacctttgtgaacctcttgagcttcctgtcctggctcacctatggaaccaccttcgcctgtctcctgtacttgcgaataaagacaaggaatcttcaccacacttacaaggttcccaccttcatccctgtcatcatgctcctggtgtccctctacctggtgctggcacccatcattgaccacccccagatggaattcctgtacatcttcctgttcgtgctcactggctttccggtgtacttcctgcttttccacttccagtgtcagtccaagtgtgtacagacggccactatgcatctccagctgctcctggaagtggctccaaccattaaagatcactga

SEQ ID NO: 36615 - protein, 488 aa, Rattus norvegicus
MERKEEKDGSDKPEGQEQGSGAAGLTMKREIGLWSAVSMTAGCMIGSGIFMSPQGVLVYIGSPGASLIIWATCGLLALLGALCYAELGSLVPESGGEYAYILRAFGSLPAFLVIYIIVLVGRPAAITAVSLSFAEYALAPFYPGCSSVPQVIVKIVACSCILVLLLINFWSSRMSTVLMNVCTAAKLFSLLVIVVGGAVGLAQGRIPTESLLFAFHNTTQQAGRIGMAFYQGLWSFDGWSNINTVIEEIKNPKQNLVWAVVIAIPLVTILYVLVNISYLLVMSPSEILTSDAIAVTWGNQVLGSWAWLVPLAVALSTFGAVNGGFFSGSRVCYAAAREGHMPQLMSMIHVHRLTPAPALIFTTAVALLLVIPGNFSTFVNLLSFLSWLTYGTTFACLLYLRIKTRNLHHTYKVPTFIPVIMLLVSLYLVLAPIIDHPQMEFLYIFLFVLTGFPVYFLLFHFQCQSKCVQTATMHLQLLLEVAPTIKDH

SEQ ID NO: 36616 - DNA, 1575 bp, Anopheles gambiae str. PEST
  CDS (1)..(1575)
atggtgaacgtcaaacaaacaaaaaaaccaggaagaagaaacagaaaagtgcgtcaaacaaaaatggccaaagtcggtgatgtggacaaccggccggtacagcagggctttcggcgcgaaagtgatgagggcaaggcggtggccggcacgtccgaaagccccgacgctggcggcggcggtggcatcgagatgaagaaggagcttggcctgatggatggagtggcgatcatcgtgggcgtgatcgtcggtgccggcattttcgtctcgcccaagggtgtgctgctctactccggctcgatcggtgtggccatcatcgtgtggatactgtccggtgtgctgagtatggtcggtgcgctgtgttatgccgagctgggcaccatgattcccaagtcgggcggtgattacgcgtacatcggtgaagcgttcggtccgctgccagcgttcctgtacctttgggtggcactgctgattctcgtcccggccggcaatgccattaccgcgatcacgttcgcccaatatctgctgcagccgctgtggcccacctgcgaaccgccgtacgagtcggtgcgcttgctagccgccgttataacctgtcttcttaccgcgatcaactgtcgaaatgtgaaatgggtcgcccgggtgacggagacgttcacggggatgaaggtgttggccctgctcgtcattaccggtgccggtgcgtggcatctgatgagtggcaacacggagctgctcgaggccccgttcgccaactccaagatacagcccggcttcattgcggtcgctttctacaacgggctgttttcgtactcgggctggaattatctcaactttgtcacggaggagctgaaagatccctaccgcaatttaccccgcgccatctgcatcagcatgccggtcgtcactgtcatctatgtcatcacgaacatcgcctactttgcggtgctaccgccggacgagatgctttcctcgcaggccgtcgcggttacatttgcggagaaaatgctcagcttcatggcctggacgatgccactgttcgtggcgtgctctaccttcggctcgctgaacggtgcaatctttgcctcgtcgcgactgttctttgtgggcgcccgaaacggacatctgccggcggcactttcactgatcaacattaactgtctgacgccgataccttcattgctgttcctgtgtgcccttacgcttctgctgctgttcattcgcgatgtgtttgcgatcatcaactacgtcagctacgtggagatcttgttcatcttcatttccgtcgccggtctgttacggttacggcagaaggctcccgatgcacaccgacccatcaaggtgtccctgatcgttccgatcgtgttcttactgacggctggatttttggtcatcttctcggtgtttgagtcgccgatggaggtcggcatcggtacgctcgtcatactgctgggcattcccgtgtactacgtcacgatcgggaaaccgtggcgctggctgacccaaaagtcgcaatcgttcaatcgattctgctccaaactgttcctatgtatgccgaacagcgaaaagctcgactag

SEQ ID NO: 36617 - protein, 524 aa, Anopheles gambiae str. PEST
MVNVKQTKKPGRRNRKVRQTKMAKVGDVDNRPVQQGFRRESDEGKAVAGTSESPDAGGGGGIEMKKELGLMDGVAIIVGVIVGAGIFVSPKGVLLYSGSIGVAIIVWILSGVLSMVGALCYAELGTMIPKSGGDYAYIGEAFGPLPAFLYLWVALLILVPAGNAITAITFAQYLLQPLWPTCEPPYESVRLLAAVITCLLTAINCRNVKWVARVTETFTGMKVLALLVITGAGAWHLMSGNTELLEAPFANSKIQPGFIAVAFYNGLFSYSGWNYLNFVTEELKDPYRNLPRAICISMPVVTVIYVITNIAYFAVLPPDEMLSSQAVAVTFAEKMLSFMAWTMPLFVACSTFGSLNGAIFASSRLFFVGARNGHLPAALSLININCLTPIPSLLFLCALTLLLLFIRDVFAIINYVSYVEILFIFISVAGLLRLRQKAPDAHRPIKVSLIVPIVFLLTAGFLVIFSVFESPMEVGIGTLVILLGIPVYYVTIGKPWRWLTQKSQSFNRFCSKLFLCMPNSEKLD

SEQ ID NO: 36618 - DNA, 1707 bp, Apis mellifera
  CDS (1)..(1707)
atggccagccgattgtggaaggcgctctcccgaaggcggatagatgagaatcttgagaataaaagcgaactagctcgagttttaggcttattcgatctcactgcacttggcgtgggttcgactcttggccttggtgtttatgtccttgctggtagcattgccaaagagacggctggtccagccgtctgcatttcttttctcattgcagctatcgcttccgggtttgccgggatgtgttatgcagaatttgcttccagagttccgaaagcaggatcagcatatgtttacagttatgtaacagtaggagaattcattgcttttattataggatggaatttaattttggagtatataataggtacagcaagtgtcgcccgaggacttagtaattatttggatgccttgataggaaatgtaataagtgaaacattgcattctttgatgcctataagcgtttcgtttttatcagaatatccagacttcttcgcgtttactgtagtaatacttctcataatattactaagcgtaggcgtgaaggaatcgtcaattttaaataatatattcactgtaataaacttgatgaccattttaataatcataattgcaggatctattaaagctgatccagctaattggagaatatcaataaatgatataccagaatcagagcaacaacatgcaggatcaggaggttttatgccctttggtataagcggagtgatgatcggggcagcaaaatgtttttatggtttcgtaggatttgacgctgtcgctactactggcgaagaagctaaaaatcctcaacggaacatacctatagccattgttgtttccttaattataattttaatggcttattttagtatttcgactgtattaaccatgatgtggccttattatgaccagaatgccgacgcaccgtttccatacgtattcgataaaattggatggcccactgttaaatggattgttaatatcggtgcagcatttgcattatgcacaagtatgctcggagccatgtttcccttaccgcgaatactttatgctatgggtaatgatgggataatttttaaacgacttgcaaacgtacatccgaaaacgatgacacctattttcggtacagtggtttccggtttattcacaggaattatgacacttatttttaatcttcaacaattgattgatatgatgtctatcggaacgttgttagcatatacgatcgttgcaatatcagttttaatattaagatatcaaggaaaagaatgtacatcaaatactcagtctataacaccaatagatggttataagttaacaccaatgaatattttaaaacaaattgtcaatttgcagaatcaaaaagaagtaactgagatgtctattaaagttgcaaaatacagtattgcaattttatgtgttgttatatttattactgcatttttcattagttacgttgataccgaagtatttggcaagaatgtaccattagtcccacttcttccatgttgcagtatttttataaatttatatttgatgttgcaattagatgctttcacttggatgagattttctatttggatggttataggtcttactatttatttcttttatggcatatctcacagtgaacaaggaaagaaagataaaattgaagctgaaatgataaaacgaaaatatgctgaccaagttaggatcgtaaccagattctaa

SEQ ID NO: 36619 - protein, 568 aa, Apis mellifera
MASRLWKALSRRRIDENLENKSELARVLGLFDLTALGVGSTLGLGVYVLAGSIAKETAGPAVCISFLIAAIASGFAGMCYAEFASRVPKAGSAYVYSYVTVGEFIAFIIGWNLILEYIIGTASVARGLSNYLDALIGNVISETLHSLMPISVSFLSEYPDFFAFTVVILLIILLSVGVKESSILNNIFTVINLMTILIIIIAGSIKADPANWRISINDIPESEQQHAGSGGFMPFGISGVMIGAAKCFYGFVGFDAVATTGEEAKNPQRNIPIAIVVSLIIILMAYFSISTVLTMMWPYYDQNADAPFPYVFDKIGWPTVKWIVNIGAAFALCTSMLGAMFPLPRILYAMGNDGIIFKRLANVHPKTMTPIFGTVVSGLFTGIMTLIFNLQQLIDMMSIGTLLAYTIVAISVLILRYQGKECTSNTQSITPIDGYKLTPMNILKQIVNLQNQKEVTEMSIKVAKYSIAILCVVIFITAFFISYVDTEVFGKNVPLVPLLPCCSIFINLYLMLQLDAFTWMRFSIWMVIGLTIYFFYGISHSEQGKKDKIEAEMIKRKYADQVRIVTRF

SEQ ID NO: 36620 - DNA, 1656 bp, Apis mellifera
  CDS (1)..(1656)
atgcatgtcgcgcccttcaaacgagttaccgtgggacatgatccacagacaagtaacggtaatcagtcgcaacagcaattgcaaggcagtggatggaatggaattccagaaacaacattggtctctcgatcgatcagaagcaacggcaacagcaacggctggaacccaattacatcgccgttccaacgtcaaccggaacaacaacagctacacgaacggaaacagaaagaaattaaatctggggatctgggcgatgatgaagacgggggtggatggggtggagggctggaggggacggacccagaggagaacaactctgttcacctcaagagacgggtgggactcgtcagtggggtggctctaatcgttggtaccatgataggtagcgatctatacgatttcaggcttttggttcgaaccggcagtatcggaatcagcttcctcgtatggacggcctgcggcatgttgagtctgtgcggtgcgttagcatacgccgagctgggtacgatgaatacgagcagcggcgccgagtacgcttactttatggacgcattcggtgcaccacctgctttcctcttctcgtgggtttccactttggtcttgaaaccatctcaaatggcaataatctgtttgtcgttcgcacagtatgcggtcgaggcctttgcggccgattgtgatccacccgaggaagtcgtcaaaatcgttgcgcttctggcgatcatacttatattattagtgaactgttacagcgttaatctggccacaggtgtacaaaacgcgtttaccgcagccaaattgatcgccatacttgtcgtaattgccggtggctcttataagttgatacagggtaatacgcagcatctaaaaggcgctttcgatacgttcgacggtagtaccgttaatataggcagattagccactgctttttatactggtttatgggcgtacgatggatggaataatctcaattatgtcactgaagaaatcaaagatccttcgaaaaatttgccacgttctattatgattggtatacctctcgtcacgctgtgttacgcattgataaatgtttcttatctagccgtaatgtcaccttcggagatgattgaaagcgaggctgttgcagtgactttcggaaatcgaattcttggcgttatggcatggcttatgccactctcggttgcgattagtacttttggttccgcaaatggtactcttttcgcagcaggtagactttgtttcgcggcatctcgagaaggccatttactcgactgtcttagttatgtgcatgtgcgacgttttactcctgcacctggacttatttttcattccctcgttgcaggagcgatggtaatatctggaaacattgattccttgatcgattttttttcattcactgcttggatcttttatggtggagcaatgttagctctattggtgatgcgaaggaccagaccgaatcatccacgaccatataaatgtccgctaataatacctgtcctcgtacttggaatttctgcgtacctgattatagcgccaatcatcgataaacctcaaattgaatacttgtatgcggctggatttatattagcgggcatgcttgtctacctcccgtttgttaaatacggatatgtgcccaaatttatgggtaaatattaa

SEQ ID NO: 36621 - protein, 551 aa, Apis mellifera
MHVAPFKRVTVGHDPQTSNGNQSQQQLQGSGWNGIPETTLVSRSIRSNGNSNGWNPITSPFQRQPEQQQLHERKQKEIKSGDLGDDEDGGGWGGGLEGTDPEENNSVHLKRRVGLVSGVALIVGTMIGSDLYDFRLLVRTGSIGISFLVWTACGMLSLCGALAYAELGTMNTSSGAEYAYFMDAFGAPPAFLFSWVSTLVLKPSQMAIICLSFAQYAVEAFAADCDPPEEVVKIVALLAIILILLVNCYSVNLATGVQNAFTAAKLIAILVVIAGGSYKLIQGNTQHLKGAFDTFDGSTVNIGRLATAFYTGLWAYDGWNNLNYVTEEIKDPSKNLPRSIMIGIPLVTLCYALINVSYLAVMSPSEMIESEAVAVTFGNRILGVMAWLMPLSVAISTFGSANGTLFAAGRLCFAASREGHLLDCLSYVHVRRFTPAPGLIFHSLVAGAMVISGNIDSLIDFFSFTAWIFYGGAMLALLVMRRTRPNHPRPYKCPLIIPVLVLGISAYLIIAPIIDKPQIEYLYAAGFILAGMLVYLPFVKYGYVPKFMGKY

SEQ ID NO: 36622 - DNA, 2163 bp, Apis mellifera
  CDS (1)..(2163)
atgttcatcacatgttacttgtcatttagccacgccctcgaatgctatgtgtgtaccgatcaagaaggtaataaagaaaaatgtttaaagagtacaaaaatttgcgaacaacatcaagatacgtgtctcacggaaattaaatggggaagtacaccatactggtcgcaaggagcaaaaaaacaatattatgtctcaaaaagatgttccacgaaaaaagaatgtgaacgaataaaacgtgctaatatggatgattgcacttatatttggtatcaagattggaaatgttccgactgctgtcaaggagataaatgcaattattatgtgatttccatggcggagaaattacatgcttattggttgaccgttatcgctgcattgacatttttgcatatatggcagagtcggaagaaagaggtggattattctcaggatacaagattggcaagatgtctgtccacgttggatctcacggctctcggtataggttcgactctcggcgtgggtgtgtacgttctcgcaggctccgtttcgaaaacgatcgcaggccctgccgtaatagtctcgttcgctattgccgcgattgcatcaatgtttgcaggtctgtgttacgcggaattcggtgcaagagtaccacgtgcaggatcagcgtacatatacagttacgtaacaatgggagaatttacagcttttctgatcggttggacgttaattctcgaatacgtaattggctcggccagcgtggtacgaggactgagcacttacgtagacgctttgtttaataatactatgagaaacgcgttcgaaacggcggcgcatatagacatcgatcacctctcttcttatccggatttctttgccttcggaataactctaatcttttccgctgcattggcgttcggcgcaaaggagtcctcggtagccaataatttctttacgcttacaaatctttccgtagttctattcgtcataatcgctggatctcttaaagccaacataaacaattggaagacgaagccaacttgtacgacggaaaattgcaaatacgggaatggaggtttcatgccttacggtatagctggtgttataagcggagcggcaacctgcttttacggattcatcggtttcgattgtgtcgcgactaccggcgaggaggcgaaagatccacaaaaatcgattccaatagcaatcgttgcttcgttgaccgtcgtctttctttcgtacttcggtgtatccacggtattgactaccgtccttccttatttcgagcagaacgaggatgccccgtttccggaattattcgatcgcatcggttggaattgggcgaaatggctggtgactataggtgccatttgcggtctgtgttcaagtttattaggagcgatgtttcccttaccacgaattatttacgccatggcatccgacggattgatattcgaatggatgggaaaggtcagttcacgattccatactcctctgatgggtacattctccgcaggaattcttactggtttgctggctgccatttttgaattgactcaactggtaaatatgatgagcattggaacactgctcgcttattcgatcgtcgcaacgtgtgtactcatacttcgatacgaggagagcgaagcataccaaaaaaagggggatcgtgatccaagaaccttgaaattcattgcgaggcagttaattaacgctaatggattaaatcattctacgaaattaacgtctcaaatcgttacttaccttgtcgtgtgttacgttatcctatgtatttgcatcggtattacaatttcaatttttaccgatgaaataatgaatggtaaaattacacttatcgttccattaacaattctgctattagctcttgtcgttattcttgtttttatttatcttcaaccgacttctggaaagaatcttgcattttcggtaccgttggtgccatttttgcctgctttcagtattattattaatatttatctcatgatgatgttagataaaatgacatggataagatttttaatatggatgacagttggacttggaatatactttttttacggtgtttggcatagtaaaatgagaaaagataaacacacaaaattaccagaaaatggttataatgaagacacgtggaaaaccaatgattcctctatgcataaatga

SEQ ID NO: 36623 - protein, 720 aa, Apis mellifera
MFITCYLSFSHALECYVCTDQEGNKEKCLKSTKICEQHQDTCLTEIKWGSTPYWSQGAKKQYYVSKRCSTKKECERIKRANMDDCTYIWYQDWKCSDCCQGDKCNYYVISMAEKLHAYWLTVIAALTFLHIWQSRKKEVDYSQDTRLARCLSTLDLTALGIGSTLGVGVYVLAGSVSKTIAGPAVIVSFAIAAIASMFAGLCYAEFGARVPRAGSAYIYSYVTMGEFTAFLIGWTLILEYVIGSASVVRGLSTYVDALFNNTMRNAFETAAHIDIDHLSSYPDFFAFGITLIFSAALAFGAKESSVANNFFTLTNLSVVLFVIIAGSLKANINNWKTKPTCTTENCKYGNGGFMPYGIAGVISGAATCFYGFIGFDCVATTGEEAKDPQKSIPIAIVASLTVVFLSYFGVSTVLTTVLPYFEQNEDAPFPELFDRIGWNWAKWLVTIGAICGLCSSLLGAMFPLPRIIYAMASDGLIFEWMGKVSSRFHTPLMGTFSAGILTGLLAAIFELTQLVNMMSIGTLLAYSIVATCVLILRYEESEAYQKKGDRDPRTLKFIARQLINANGLNHSTKLTSQIVTYLVVCYVILCICIGITISIFTDEIMNGKITLIVPLTILLLALVVILVFIYLQPTSGKNLAFSVPLVPFLPAFSIIINIYLMMMLDKMTWIRFLIWMTVGLGIYFFYGVWHSKMRKDKHTKLPENGYNEDTWKTNDSSMHK

SEQ ID NO: 36624 - DNA, 1446 bp, Apis mellifera
  CDS (1)..(1446)
atggaacaagtcgggaaaaaaggaaatgaaaaaattgcgctgaaacgagaattaggcctgttcagcgcagtgggcatgatcgtagcggttatgatcggttccggaatatttgtatcccccactagcgctctcgaaagatcaggatctgtcggtctttgtctgatcgtctggatttcttgtggcttattatccctactgggagcgctagcgttcgccgaattaagcacagtcgttccacgttccggtgccgaatatgcttatttcatcgaagctttctcacccctgcatcaatatgccggccaaataccagcatttatatgctcgtgggtttacgtaatggtattacgaccaaccgaagtggcggtaatcatgttgacattcgccgagtacagtgtacaaccgttttctggttatttagaaaatctttccgaagaatggatgtttagattgaaaaaactcatagctatcctagcgctcggcctgatcacgtacattaatttaacaagcgtgaagttatacgtgaaagttcaaaatatattcaccgtatgcaaaatagttgcgtgtattttcgtgatttgcggtggaatatggtggttatgcactggtcatacggagttattggagaaaccgtttcacggtactacaacttcggcaggcaacgtggcgctagcgttctatagtggattatgggcttacgatggatggacttccgccgcgatcgtcacggaagagattcagaaaccggaaattaatattctcagaagtattttaatcggtgtaccattgatcactattttatacgtttcgatgaatctgatgtacatggccgctctaacgatacctgaaatggtaagagccccagctgtggcagttctctgggcgaagaaagttctaccctcgtggttgggcttcgtgatacctctgggtgttgcgatatctacttttggatgcagtcttagcattcaattcggagtatcaagactctgctatgtagccggtcgcgaaggccacgtaccaagagttttcagcttcgtacatatcgaaaaaatgactcccgccgcggcagtagcgtttcaaggattacttacgttactttatctgctcacgggagatattatcgcacttatcgaattcgcaagttttttaacatgggtattttacggatttgccatgttatcattaataatcatgcggagaacgaaaccaaacgcatcgagaccatacgcggtaccgattctggtaccttggctaatattaggagtttctattttcttggctgtaacaccgatcgtgcatgaaccaacaccgaaatacttgtttgcattgttatttgttcttcttggcattctcgtttatcatacgtacgtgtataaaaaagtaaaaagtagtttggcaacaattcaaacagcagaaatgaaacttatttatactgcttatttatactag

SEQ ID NO: 36625 - protein, 481 aa, Apis mellifera
MEQVGKKGNEKIALKRELGLFSAVGMIVAVMIGSGIFVSPTSALERSGSVGLCLIVWISCGLLSLLGALAFAELSTVVPRSGAEYAYFIEAFSPLHQYAGQIPAFICSWVYVMVLRPTEVAVIMLTFAEYSVQPFSGYLENLSEEWMFRLKKLIAILALGLITYINLTSVKLYVKVQNIFTVCKIVACIFVICGGIWWLCTGHTELLEKPFHGTTTSAGNVALAFYSGLWAYDGWTSAAIVTEEIQKPEINILRSILIGVPLITILYVSMNLMYMAALTIPEMVRAPAVAVLWAKKVLPSWLGFVIPLGVAISTFGCSLSIQFGVSRLCYVAGREGHVPRVFSFVHIEKMTPAAAVAFQGLLTLLYLLTGDIIALIEFASFLTWVFYGFAMLSLIIMRRTKPNASRPYAVPILVPWLILGVSIFLAVTPIVHEPTPKYLFALLFVLLGILVYHTYVYKKVKSSLATIQTAEMKLIYTAYLY

SEQ ID NO: 36626 - DNA, 2076 bp, Ustilago maydis 521
  CDS (1)..(2076)
atgtcttccgacccggtaggcgctgccattgctcttgctggaatccctgacgagccctcgtctctccattccaaggcgcttcgaccatcaataaatctatcacatcgcggctcgctagaatcgaaaccaagctcggacagcatcctcttgccggaagagcacgaggacgaagaagattttgtcgtcttcgaggaccgcaacacattaccagcacccaagcttgctgacggagacttcgatgagttggaagcaactagcagcaggaatgatgtggagaaaagatcaacactgggaagcatagcgcgtgctagcgtggaaagtctatcatttggatatcgagatcatctactaccattaactctaagtggggatggcgacgaatcgcttggcggagattatggggagagagagggttcggtatccgcgacagcgaggggaagtagatccacgcttggatcgacatcttcatctcggcgtcggcgtcacaacagaggctactcacgcgatcggttagcagaaagacgcgtaaccctaatcgatggcatcgcactcacgattggcgtgcagataggatctggtatcttctcgtcacctggtgtggtgacgctcaacacgggcagcattggcgcctcgatcgtcgtctggctgctctcaggtcttctggcttggaccggagcctcatcgtttgccgaactcggtgcatcgatcccactcaatggtggctcgcaggcgtatctcaactactcctttggtccgctctcagcgtttctgtacacatggtcggcgttgacagctctcaaaccaggtgcaggtgcgatcatcgcaaccattttcggagagtatgtggcgagaatcatttttcacgctacgggcaaagttgcagaccaccctcacgaaacaggtctcgatggcatcccagcatggtcgatcaagctgctggctgtagcgattgtagcgctcatcaccgcagctcatgctttttccaacaagcttggtactcggacgcagatcgcgaccacggtcgtcaaattgctcgcactcacagctgtacctatcttggctattgtacaagccgcacgaggcaaaacaagcccaagttctcagcaagcattttcgagcttgagcgccatgttcgcgggaagctcaacttcaccttcgtcgtatgcacttgcgctgtacagtgggctttgggcgttcgacgggtgggatcagtcgtgttttgtcgcaggagagatgaagcgagtggaaaaggacttgcctcgagtgattcacatgagcctggccacggtgattctgatcttcctctcagcggtggtgtcgtattttgttgttctacctgccgagttggtgaaacgcaccaacacagtagcgctcgatttcgggagtgcgatctttggcactgttggtgggatcgtatttgcggttttggtcgcgttctcatgctttggtgcgttgaacggacagatatacactacggctcgactcattctggccgcctcacgcgagggatacctcccagaacgactgggcgacctgaatcgccaaacgggtacaccgatcgcagcactgcttctacaactcgtgctcatctcggcgttcgtcctcttcggatccggcttcgcctcgctcgtcaacttctacggcgtttgcagttggaccttctacctcgcttctgttctaggattgctagtgctccgtataaaggagcctaatctgaatcgaccatatcgaacgtggttgggcaccccaattctgttcgcagcagtagcgctatttttgttgctcatgccgatcgggagtgcgcccttggaagggttggcagcgttgttgtttatcggcgccggtgtaccggtctattatctgacgcagagtaggtcgggatgggtgtccaacgttccattgctgtcgaggctgaaggcgtggtttgcgcgcgcgcgtggtgcgggtggtgtgcatgacgccagaggacatcatgtggttctgccgacaacggatgcggcagcaggcgagaccgagcaagaggacgaggaacagattgaaatgcttcccaagaaaggaacagatcacaaggcatga

SEQ ID NO: 36627 - protein, 691 aa, Ustilago maydis 521
MSSDPVGAAIALAGIPDEPSSLHSKALRPSINLSHRGSLESKPSSDSILLPEEHEDEEDFVVFEDRNTLPAPKLADGDFDELEATSSRNDVEKRSTLGSIARASVESLSFGYRDHLLPLTLSGDGDESLGGDYGEREGSVSATARGSRSTLGSTSSSRRRRHNRGYSRDRLAERRVTLIDGIALTIGVQIGSGIFSSPGVVTLNTGSIGASIVVWLLSGLLAWTGASSFAELGASIPLNGGSQAYLNYSFGPLSAFLYTWSALTALKPGAGAIIATIFGEYVARIIFHATGKVADHPHETGLDGIPAWSIKLLAVAIVALITAAHAFSNKLGTRTQIATTVVKLLALTAVPILAIVQAARGKTSPSSQQAFSSLSAMFAGSSTSPSSYALALYSGLWAFDGWDQSCFVAGEMKRVEKDLPRVIHMSLATVILIFLSAVVSYFVVLPAELVKRTNTVALDFGSAIFGTVGGIVFAVLVAFSCFGALNGQIYTTARLILAASREGYLPERLGDLNRQTGTPIAALLLQLVLISAFVLFGSGFASLVNFYGVCSWTFYLASVLGLLVLRIKEPNLNRPYRTWLGTPILFAAVALFLLLMPIGSAPLEGLAALLFIGAGVPVYYLTQSRSGWVSNVPLLSRLKAWFARARGAGGVHDARGHHVVLPTTDAAAGETEQEDEEQIEMLPKKGTDHKA

SEQ ID NO: 36628 - DNA, 2328 bp, Gallus gallus
  CDS (1)..(2328)
atgcacagccctgcagcatgtcctcgtgaacttgttatgaggaagaagtatatgttatggaagtactttgccaagtctgtgctaacactgcccagaagtcagctgaaccctggtttcaccaatgaagaagatacttctttccgctatatcaaaacaaaggatgggggcaagagcgttcatcaataccccctgtacctattgctgacggcaataccgaccctcctacctgcagcagcttcttctgatagggaccaaaagaagcagttctgcactaagtggtgcttacttaagatggctgaccaaaagcaaatcaatgtgtctgcacgactgaacagatcatttgaataccaaaatgcagcacgggtgtatcacctcagagctggtaaaggccagccttctggcttgccgttttgctgtgcccactggcacatcaagaaagcaaaatatattctaagtcaaacatgccttcagagcaacaaggcacggcacagtgagtatacagtgccagaaagagatacacagagagcatacagtgccagtgcgaggaagacaatactggcttgcttcctgagcataaacaaaatggttgagcgctgtaacactggaaatacaggacccctgccttcagctaatctcctatctgggcccaacagccgctgcttcatccacaccctcagcacaggggtgggagcccaaagggcgatcctgcatctgaagcagaaggaaaaggcaggctcaggtggttcaggaggacagattgttttaaagaatcaagatctgccgtgtccaggaagtgctgaggaaggttccaaccctgttttctggtattcatcacagcagaaggctgacagagaccaccagggacggtccacaatgaggagaaggcaaacgacagattcgcctcatgaatccacagacctgagtgaaggaaaggagaaattaagactgaaacaagaggtcggcctgattagcggagtgtcattaattgcaggcaccatgataggctcggggatctttatgtcccctgagtgggtgctgcatcacatggggagccccgccagcagcctgctcatgtgggcagcgtgtggtctgctggccatgtttggagccctgtcttacgctgagcttggaaccgtgatcaaagagtctggaggcgaatatatttacatcctgaggatttttggttcctttcctgcttttctttttgcctacacttctgtcatcctggtgagaccagctgcgttggcagctgtctgtctgagctttgctgaatacgccgtcgcgccgttctacccaggatgctcctccccgcaggttgtcatcaaatgtacagctgctgcctgcatcctggtcctaactatcatcaactgcctcaatgtgaggctggcgatgtctgttatgaatgtttttacagctgccaaactcttggctttgctggtgatcgtggtgggcggattggtgctgcttgccaaggggcagactcagagctttcagaacacttttcaaggcacaaatgcaggtatcgggacgatcggagtggcattttatcaggggctgtggtcctacgatggctggaacaacctgaactacgtaaccgaggaactgaagaaccctgaggtgacccttcccagagctgtgatgattgctattcctttggttacatgcctgtatttgctggtaaacatcagctactttgcggccatggctccatctgagctgctgacttcaggagctgtggccgtcacttgggggaacaaagtcctggctaactgggcatggctcatctccctgtcagtggcactgtctacgtttggttcatccaacggcacgttctttagcggaggccgcgtgtgctacatcgctgcaagggaaggtcatatgcctgacatcttgtccatggcccacgtgcgatgcctcacgccatcccctgcgctgctgttcacatctgccatgtctttaataatgataatcccaggaaacttcaccagcattgtgacctatttcagttttataacatggattttctatggcatgactatttctggtcttctgtatttaaaaatcaagaaaccagacctgccaagatcatacaaggtgccgattgtcatccccataattgtgctgatcgcggccgtgtacctggtgttagctccaatcatcgatcagccccagattgagattctctacgtagtcctgttcatttgcagcggtattgtcctttacttccccctggttcgcttcaagtggcacccccacttcttacagacggtcactttgcatctccagcagttcctggaagttgctccgacctccagagatgtgaactga

SEQ ID NO: 36629 - protein, 775 aa, Gallus gallus
MHSPAACPRELVMRKKYMLWKYFAKSVLTLPRSQLNPGFTNEEDTSFRYIKTKDGGKSVHQYPLYLLLTAIPTLLPAAASSDRDQKKQFCTKWCLLKMADQKQINVSARLNRSFEYQNAARVYHLRAGKGQPSGLPFCCAHWHIKKAKYILSQTCLQSNKARHSEYTVPERDTQRAYSASARKTILACFLSINKMVERCNTGNTGPLPSANLLSGPNSRCFIHTLSTGVGAQRAILHLKQKEKAGSGGSGGQIVLKNQDLPCPGSAEEGSNPVFWYSSQQKADRDHQGRSTMRRRQTTDSPHESTDLSEGKEKLRLKQEVGLISGVSLIAGTMIGSGIFMSPEWVLHHMGSPASSLLMWAACGLLAMFGALSYAELGTVIKESGGEYIYILRIFGSFPAFLFAYTSVILVRPAALAAVCLSFAEYAVAPFYPGCSSPQVVIKCTAAACILVLTIINCLNVRLAMSVMNVFTAAKLLALLVIVVGGLVLLAKGQTQSFQNTFQGTNAGIGTIGVAFYQGLWSYDGWNNLNYVTEELKNPEVTLPRAVMIAIPLVTCLYLLVNISYFAAMAPSELLTSGAVAVTWGNKVLANWAWLISLSVALSTFGSSNGTFFSGGRVCYIAAREGHMPDILSMAHVRCLTPSPALLFTSAMSLIMIIPGNFTSIVTYFSFITWIFYGMTISGLLYLKIKKPDLPRSYKVPIVIPIIVLIAAVYLVLAPIIDQPQIEILYVVLFICSGIVLYFPLVRFKWHPHFLQTVTLHLQQFLEVAPTSRDVN

SEQ ID NO: 36630 - DNA, 1818 bp, Oryza sativa (japonica cultivar-group)
  CDS (1)..(1818)
atgacgcaagagccgacgtcactcctccccgtctgggcgcgggcgccaacgcggaggcccaagaccacacggcgccacccgctccacctccacgaagcagccatggaggaagaaggcgcagaccaccggcccccctcctcctcctccggcggccgcggcttcctctccggcctctgcgccgccgcgctacgccgcaagcccatctccgcccacgcggcccacgccgcctccggcgagggcctcgtgcggcagctcggcgtcttcgagctcgtgctcctcgggatcggcgcgtccatcggcgccgggatcttcgtcgtcaccggaacggttgcccgcgacgccggcccaggtgttacaatcagttttgttcttgctggagccgcatgtgtgctcaatgccttgtgctatgccgaactcgcatctcgatttcctgctgtggttgggggagcatacttgtacacgtatgcggcgtttaacgagctcaccgcgttcctggttttcactcagttgatgcttgattatcatattggggcggcaagcatagctcgtagcttggcaagctattttgtccaattccttgagctaattccattcttgaagggccatattccaacttggataggtcatggagaagagttctttggtggtgttgtatcagttaatatattagctccaattcttctcatcatcttaactacaattctctgctatggggtcaaagaatcatcagcagtaaatacctttatgactacattgaagatagtgattgttatagttgttgtatttgctggtgtctttgaggtggatgtatcaaattggtcaccgtttatgccaaatggtttcaaatctgttgtaaccggagctacagtggtctttttcgcatatgttggatttgatgcagttgctaattctgctgaagaggccaaaaaaccacagagggacttgccgataggtatcctagggagccttctagcatgcgtcttattatatgttgctgtatgcttggtgattactggaatggtgccatatactttacttggtgaagatgctcctttggctgaggcttttgctgctaaggggctgaaatttgttactgtattgatcagcatcggagctgttgctggtcttactacaacacttcttgttggtttgtatgttcagtcacgtttgtatcttggacttggaagggatggattgctaccttcaatatttgccaaagtacacccaacgcgtcatactcctctgcattctcagatctgggttggttgtgttgcagcagttttggctggtctctttaatgtgcatgaactctctcatattctctcagttggcacgctgaccggttattcagttgtatcagcttgtgtaatcacacttcgatggaatgacaagaccaccagttgtcgctcccttggaaatatgtcaatctggcaggagggtgttctatgtcttgtcataattgctctttgtggtttcgtagcaggaatgtgctatcggtttagctatgccattgccttcatgataatagctcttctcatagctgttgctgctggttttgctctccagtttcgacaggtatatgtggatccacctggcttttcttgtcctggagttcctattgttccaatggtctctgttttcttcaatatgcttctctttgctcagctgcatgaagaagcttggtatagatttgtcatccttagtctccttgctgtgggtgtctatgccggctatggtcagtaccacgcagttccttcaagttcagaccacccacacccggccgttgcttatcatggaattccttctgaagctccatga

SEQ ID NO: 36631 - protein, 605 aa, Oryza sativa (japonica cultivar-group)
MTQEPTSLLPVWARAPTRRPKTTRRHPLHLHEAAMEEEGADHRPPSSSSGGRGFLSGLCAAALRRKPISAHAAHAASGEGLVRQLGVFELVLLGIGASIGAGIFVVTGTVARDAGPGVTISFVLAGAACVLNALCYAELASRFPAVVGGAYLYTYAAFNELTAFLVFTQLMLDYHIGAASIARSLASYFVQFLELIPFLKGHIPTWIGHGEEFFGGVVSVNILAPILLIILTTILCYGVKESSAVNTFMTTLKIVIVIVVVFAGVFEVDVSNWSPFMPNGFKSVVTGATVVFFAYVGFDAVANSAEEAKKPQRDLPIGILGSLLACVLLYVAVCLVITGMVPYTLLGEDAPLAEAFAAKGLKFVTVLISIGAVAGLTTTLLVGLYVQSRLYLGLGRDGLLPSIFAKVHPTRHTPLHSQIWVGCVAAVLAGLFNVHELSHILSVGTLTGYSVVSACVITLRWNDKTTSCRSLGNMSIWQEGVLCLVIIALCGFVAGMCYRFSYAIAFMIIALLIAVAAGFALQFRQVYVDPPGFSCPGVPIVPMVSVFFNMLLFAQLHEEAWYRFVILSLLAVGVYAGYGQYHAVPSSSDHPHPAVAYHGIPSEAP

SEQ ID NO: 36632 - DNA, 1920 bp, Oryza sativa (japonica cultivar-group)
  CDS (1)..(1920)
atggcattggatggcggcggcgaggttggcaggaggaggaggaggaggggatggggaggcgggttcccgagcctgatgcggcggaagcaggtggactccgaccgggtccgcgccgccgagggggaagggcaaccccagctcgccaaggagcttaacatcccggcgctggtcgcgatcggtgtcggttcaacaattggagctggggtatatgttcttgtcggaacagttgctagggagcatgctggtccagcattgacaatttcatttctgatagctggaatagcttccgcgctctcagccttctgttatgccgagcttgctagtcggtgcccatctgctggaagcgcctaccattattcatacatctgcgttggtgaaggtgttgcctggttgattggttgggctttagtgctggaatatactattggtggatctgctgttgcccgtggcatatcccccaatcttgccttgttctttggaggaccagacagtcttccatggattttatcacgccaccagcttccatggtttgatgtcattgttgatccctgtgccgctgccctcgtttttgttgttactgttttgctatgtgttgggataaaagagagttcagctgtacaagagcttataacagttctgaatgcttgtgtgatgatatttgttattgtagctggtagttatatcggcttccagataggatgggttggctataaagttactgatggatattttccacatgggataaatggaatgcttgctggatcagcaactgttttctttgcatatattggctttgatacagttgctagtactgctgaggaggtgaagaatccacagagagatctaccactgggaataggagcggcattgtctatctgctgttgcttgtacatgatggtttctgttgttattgttgggctggtaccatatttcgctatggacccagatacgcccatttcatctgtctttgcgaaacatggaatgcagtgggccatgtatattgtgacaagtggtgctgttcttgcactttgttcaactttgttggggtcacttcttccgcagcctagaatactaatggcgatggcacgagacgggctgctgccatctttcttcgccgatgttaacaagaggacacaagttcctgtaaagagcacagtcgtgactggtctctgtgcagcagctctggcttttttcatggatgtttcccagctggcaggaatggtcagtgtaggtacactccttgcattcaccatagttgctgtctcgatcttaatactcagatatattcctccggatgaggttcctctgccttcatctctgcaagaaacattctgtttgagccaagaatatgatgaggaaagggttagcggtattcttggagatgagagatgcaaaacatctgaaacaaaggatgtgattctcgcagaatctatggaggatcctctcattgagaagaaaataacaagaaagatggacgagatgaagcgtcggaaggtggccgctttcagcataggatctgtttgtgttggagttatggttctcacatccgcagcttctgccacatggctgccttttcttcctatgtgtattggctgcatcgttggcgctctgttgcttgtagccggtcttggcctcctctgctggatcgaccaagatgatggcaggcattctttcggccaatctggaggatttacatgccctttcgttccacttctgccagtcttgtctatcctcgtaaacacatacctgttgataaatctgggtggagaggcatggatgagagtaggcatatggctgctgataggcgtcttggtgtacattttgtacggacgaactaacagctccttgaaggatgtcatctacgtccccgtagcgcaggccgatgagatatacaagagttcatctggatatgtgtcctag

SEQ ID NO: 36633 - protein, 639 aa, Oryza sativa (japonica cultivar-group)
MALDGGGEVGRRRRRRGWGGGFPSLMRRKQVDSDRVRAAEGEGQPQLAKELNIPALVAIGVGSTIGAGVYVLVGTVAREHAGPALTISFLIAGIASALSAFCYAELASRCPSAGSAYHYSYICVGEGVAWLIGWALVLEYTIGGSAVARGISPNLALFFGGPDSLPWILSRHQLPWFDVIVDPCAAALVFVVTVLLCVGIKESSAVQELITVLNACVMIFVIVAGSYIGFQIGWVGYKVTDGYFPHGINGMLAGSATVFFAYIGFDTVASTAEEVKNPQRDLPLGIGAALSICCCLYMMVSVVIVGLVPYFAMDPDTPISSVFAKHGMQWAMYIVTSGAVLALCSTLLGSLLPQPRILMAMARDGLLPSFFADVNKRTQVPVKSTVVTGLCAAALAFFMDVSQLAGMVSVGTLLAFTIVAVSILILRYIPPDEVPLPSSLQETFCLSQEYDEERVSGILGDERCKTSETKDVILAESMEDPLIEKKITRKMDEMKRRKVAAFSIGSVCVGVMVLTSAASATWLPFLPMCIGCIVGALLLVAGLGLLCWIDQDDGRHSFGQSGGFTCPFVPLLPVLSILVNTYLLINLGGEAWMRVGIWLLIGVLVYILYGRTNSSLKDVIYVPVAQADEIYKSSSGYVS

SEQ ID NO: 36634 - DNA, 1686 bp, Oryza sativa (japonica cultivar-group)
  CDS (1)..(1686)
atggcggcgctgcgtgacgtgctgctgtcgatcgcgcagacgccgcaccggctgcggcggcgggcgctggtgacgtggacgccggcgcaggagacgagcgaggtgagggacaggtcgggggcgcggatgaagcggcggctggagtggtacgacctcgtggggctcggcgtcggcgggatgctgggcgccggcgtcttcgtcaccaccggccgcgtcgcgcgcgacaccgccggccccgccgtgttcgcctcctacgtcatcgccggcgtctccgcgctcctctcctccttctgctacgccgagttctccgtccgcgtccccgccgccggcggcgccttcagctacctccgcgtaacgttcggtgagctggtggggttcttcgggggagccaacatcctgatggagtacgtgctgtcgaacgcggcggtggcgaggagcttcacggactacctggcctcgacgtgcgggatcacggagccggacgcgtggaggatccaggtcgacggcatcgccaagggctacaacgcgctcgacttcccggccgtcgcgctcatccttgtcctaactctctgcttgtgctacagcaccaaggagagcgcgatgctgaacatggtgatcacggtgttccacctgctcttcttcgtgttcatcatcctggccggcctgtggaacggcagcgcgcggaacctggtgtcgccgcacggcctggcgccctacggcgtccgcggcgtcctcgacggcgccgccatcgtctacttcagctacatcggctacgactcggcgtccaccatggccgaggaaatccgcgaccccgcccgcgccctccccgtcggcatcgccggctcagtcctcgtcgtctccgcgctctactgcctcatgtccctcgccctctgcgccatgcttccctacaccgagatagcggagagcgcgccgttctcggcggtgttcagggagaaggcggggtgggagtgggcggggagcgtcgtcggggccggggcgagcctggggatcgtggcgtcgctgctggtggcgatgctggggcaggcgaggtacctgtgcgtcatcgccagagcgcggctggtgccggcgtggctggccaaggtgcacccttccaccggcactcctatgaacgccaccatctttctaggattgtgcacagcatcaatcgcactcttcacagagctgcaggtagtgttcgagatgatatcaatcggaacactcctggtcttctacctggtcgccaacgcgctcatctaccaccgatacgcgaagctgggtgccaaccgatctctgcatgtcctcctcttcctgctcatccttacactgagctcccttggcttctccctctcgaggaggatccatgggcaatgccgatggggaatggctttgttcggcgccacctccgtgacgattaccgccatgttccactgcgcggtacggcgagacatgccagagccaccatcagagtggatggtccctctgatgccatggccggcggctgcatccgtcttcctgaatgtgttcctgatgaccactctcaaggtgatgtcatttcagaggtttggcctctggagctttgtgatcatagtcttctatgtctgctatggggtgcactccacatactctgcagaagaaaatgaggctgtcaatgctatgattcatcatgccaatatggacatatcttag

SEQ ID NO: 36635 - protein, 561 aa, Oryza sativa (japonica cultivar-group)
MAALRDVLLSIAQTPHRLRRRALVTWTPAQETSEVRDRSGARMKRRLEWYDLVGLGVGGMLGAGVFVTTGRVARDTAGPAVFASYVIAGVSALLSSFCYAEFSVRVPAAGGAFSYLRVTFGELVGFFGGANILMEYVLSNAAVARSFTDYLASTCGITEPDAWRIQVDGIAKGYNALDFPAVALILVLTLCLCYSTKESAMLNMVITVFHLLFFVFIILAGLWNGSARNLVSPHGLAPYGVRGVLDGAAIVYFSYIGYDSASTMAEEIRDPARALPVGIAGSVLVVSALYCLMSLALCAMLPYTEIAESAPFSAVFREKAGWEWAGSVVGAGASLGIVASLLVAMLGQARYLCVIARARLVPAWLAKVHPSTGTPMNATIFLGLCTASIALFTELQVVFEMISIGTLLVFYLVANALIYHRYAKLGANRSLHVLLFLLILTLSSLGFSLSRRIHGQCRWGMALFGATSVTITAMFHCAVRRDMPEPPSEWMVPLMPWPAAASVFLNVFLMTTLKVMSFQRFGLWSFVIIVFYVCYGVHSTYSAEENEAVNAMIHHANMDIS

SEQ ID NO: 36636 - DNA, 1599 bp, Yarrowia lipolytica CLIB99
  CDS (1)..(1599)
atgccctctcaacggtggactcaaatcaaccaggggccagatcgcgactcattggagctcgcgtcgttggcctcgtcacactcggacggtaacgaggtccattcaccttcctcctcacgcaacctgtccccctgggactcgcccattggttctgattttggagacgacagagagccgctacatgagcgtacagagagtggtcacacggtggagtcattccagctgcagcagagcacggatgtcggcccgcaacaggctctggacaagcagaaatcgctcacgtatttcaactgtctggcgctggtgatgggtttgcaagtcggatcgggcatcttctcgtcgccaggaacagttgatcacaatgccgggtcaattggctcggcgatcatcgtttgggcggtcgccggagtgctcgcctggactggagcctgctcatacaccgaactgggctccactatccctctgaacggttcgtcgcaggcgtacctcaactacgtttttgggtctctagccggttttctgtttgcgtgggcagctcttatggtgctcaagccgggaagtgcagccatcattgctctcgtgtttggtgaatacgtggtcaaaatgtgtattggcacagacacgcctgctcccttttgggctgtcactctggcagctctgggcggactggcatttgtgaccggcctcaactgcttcagcaccaagagcagcacccgggctggaaacggctttctggttctcaaactgggtcttctgctgctcattttcattgtcggaatcgtaggagtggccaaaaaagagacccggagtgcccaaatcagcgaaaactggttcaacggtgcatccacgaaactcggcaactacgccgttgctctgattgccggagtctgggcctacgacggatgggacaatgtcaactacgtgacgtcggaaatgaagaactttcgaagagacctgccacgtgtcatccacacggcgatgccagtggtcatcttctgctacctgctggtcaacctggcctacttcatggtgctggacaaggaagaggtgcggtccacccaaacggtggctgtgctgctggcaggacgggtgatgggacgtgcaggagaaatcatcgtctccttgttgattgcgctatcgtgtcttggcgcgctcaatgccacaacctttactgctggccggttggcgtatgcatctgctcaggagggacacttacctaaactgttttcccgattaagcgcccgaaacacccccatctactgcattttgatggagtgtaccttggcggctgtcttcatcttttttggcggctttgagtcgctggtcatgttctacggagtgtcttcgtatctcttctactttgtgaccgtggcttccgtcttggtgttgcggttcagagaacccgagcttgatagaccgtataagacatttctcaccacgccaatcattttctgctcggttgcactgtttcttatttcctacggcttctttgagaagcccagacaagctctcttgtcgcttttgtttattggttcaggaattcccgtttactttttgcgtcattatggatacatgggcgtgagcgagccgagagcatga

SEQ ID NO: 36637 - protein, 532 aa, Yarrowia lipolytica CLIB99
MPSQRWTQINQGPDRDSLELASLASSHSDGNEVHSPSSSRNLSPWDSPIGSDFGDDREPLHERTESGHTVESFQLQQSTDVGPQQALDKQKSLTYFNCLALVMGLQVGSGIFSSPGTVDHNAGSIGSAIIVWAVAGVLAWTGACSYTELGSTIPLNGSSQAYLNYVFGSLAGFLFAWAALMVLKPGSAAIIALVFGEYVVKMCIGTDTPAPFWAVTLAALGGLAFVTGLNCFSTKSSTRAGNGFLVLKLGLLLLIFIVGIVGVAKKETRSAQISENWFNGASTKLGNYAVALIAGVWAYDGWDNVNYVTSEMKNFRRDLPRVIHTAMPVVIFCYLLVNLAYFMVLDKEEVRSTQTVAVLLAGRVMGRAGEIIVSLLIALSCLGALNATTFTAGRLAYASAQEGHLPKLFSRLSARNTPIYCILMECTLAAVFIFFGGFESLVMFYGVSSYLFYFVTVASVLVLRFREPELDRPYKTFLTTPIIFCSVALFLISYGFFEKPRQALLSLLFIGSGIPVYFLRHYGYMGVSEPRA

SEQ ID NO: 36638 - DNA, 1656 bp, Canis familiaris
  CDS (1)..(1656)
atggtcaggaagcctgtggtgtccaccatctccagtggaggttacctgcaggggaatgttaatgggaagctgccttccttgggtggcaaggagccccctgggcaggagaaagtggtgctgaagaagaagatcactttggtgaggggcatctccatcatcattggcaccatcattggagcaggaatcttcatctctcctaagggcgtgctccagaacaccggcagcgtgggcatgtctctggtgatctggacagtctgtggggtcctgtccctgtttggagccttgtcttatgctgaattgggaacaagtataaagaaatctggtggtcattatacatatattctggaagtgtttggcccattgccagcttttgtacgagtctgggtggaactgctcataatacgccctgcagccactgctgtgatttctctggcatttggacgctatattctggaaccattttttattcaatgtgaaattcctgaacttgcaatcaagcttattacagctgtgggcataactgtagtgatggtcctcaacagcatgagtgtcagctggagcgcccggatccagattttcctaaccttttgcaagctcacagcaattctgataattatagtgcctggagttatgcagctaattaaagggcaaacacaacactttaaagatgctttctcaggaagaggtgcgaatattatggggttgccactagctttttattatggaatgtatgcatacgctggctggttctatctcaactttgttactgaagaagtggagaatcctgaaaaaaccatcccccttgcaatatgtatatccatggccatcgtcaccattggctacgtgctaacaaatgtggcctactttacgaccattagtgccgaggaactcttgctttcaaatgcagtggcggtgaccttttctgagcggctactgggaaatttctcattagcagtcccgatctttgttgccctctcctgctttggctccatgaatggtggtgtgtttgctgtctccaggttattctatgttgcgtctcgagagggtcaacttccagaaatcctctccatgattcatgtccgcaagcacactcctctgccagctgttattgttttgcaccctttgacgatgataatgctcttctctggggacctctacagtcttttgaatttcctcagttttgccaggtggctttttattgggctggcagttgctgggctgatttatcttcgatacaaacgcccagatatgcatcgtcctttcaaggtgccgctgttcatcccagccttgttttccttcacgtgtctcttcatggttgccctttccctgtattcggacccatttagtacagggattggcttcatcattactctgacgggggtccctgcatactatctctttattatctgggacaagaaacccaagtggtttagaagactgtcagaaacacgagcttctcaccagggaaaatggggcggacaccccactgtccgactcaaatacatggaggtagctggagctggcaagctccggcgagggctggcggtagctgttttgcttggctgcctccatttatcagccagactgtgtcacagcccagatgactggattgactgggagtggatccctcttgctaaagcaagatatggaggatag

SEQ ID NO: 36639 - protein, 551 aa, Canis familiaris
MVRKPVVSTISSGGYLQGNVNGKLPSLGGKEPPGQEKVVLKKKITLVRGISIIIGTIIGAGIFISPKGVLQNTGSVGMSLVIWTVCGVLSLFGALSYAELGTSIKKSGGHYTYILEVFGPLPAFVRVWVELLIIRPAATAVISLAFGRYILEPFFIQCEIPELAIKLITAVGITVVMVLNSMSVSWSARIQIFLTFCKLTAILIIIVPGVMQLIKGQTQHFKDAFSGRGANIMGLPLAFYYGMYAYAGWFYLNFVTEEVENPEKTIPLAICISMAIVTIGYVLTNVAYFTTISAEELLLSNAVAVTFSERLLGNFSLAVPIFVALSCFGSMNGGVFAVSRLFYVASREGQLPEILSMIHVRKHTPLPAVIVLHPLTMIMLFSGDLYSLLNFLSFARWLFIGLAVAGLIYLRYKRPDMHRPFKVPLFIPALFSFTCLFMVALSLYSDPFSTGIGFIITLTGVPAYYLFIIWDKKPKWFRRLSETRASHQGKWGGHPTVRLKYMEVAGAGKLRRGLAVAVLLGCLHLSARLCHSPDDWIDWEWIPLAKARYGG

SEQ ID NO: 36640 - DNA, 1599 bp, Canis familiaris
  CDS (1)..(1599)
atggaaaaaggagccaggcaccgaaacaacgctgaaaagaaccacccaggtgggagcgagttggaggccagccaggagactggttccacagggggcggagtagccctgaagaaagagattggattggtcagtgcttgtggtatcattgtagggaacatcattggctctggaatcttcgtctcgccgaaaggtgtgctggagaatgctggctctgtaggcctcgccctcattgtctggattgtgactggtctcatcacagctgtgggagccctgtgctatgctgaacttggggtcaccatccccaaatctggaggtgactactcctacgtcaaggacatctttggaggactggctgggttcctgaggctatggattgcggtgctggtgatctaccccaccaaccaggctgttatcgctctcaccttctccaactatgtgctgcagccgctcttccccacctgcttcccccccgagtctggccttcgactcctggctgccatctgcttattgctcctcacatgggtcaactgtgccagtgtgcggtgggccacccgggttcaagacattttcacagctgggaagctcctggccctggccctgatcatcatcatgggagttgtacagatctgcaaaggagagtatttctggctggagccaaagaatgcatttgagaatttccaagaacccgacatcggcctcatcgcactggctttccttcagggctcctttgcctacggaggctggaactttcttaattacgtgactgaggaacttgttgatccctacaagaaccttcccagagccatcttcatctccatcccactggtcacatttgtgtatgtctttgccaatgtcgcttatgtcactgcaatgtccccccaggagctgctggcatcaaacgcagtcgccgtgacatttggagagaagctcctaggggtcatggcctggatcatgcctatatctgttgccctgtccacatttggaggagtcaatgggtctctcttcacctcctcccggctgttctttgctggagccagagagggccaccttcccagcgtgttggccatgatccacgtgaagcgctgcaccccaatcccagccctgctcttcacatgcatctcaaccctgctgatgctggtcaccagcgacatgtacacactcatcaactatgtgggcttcatcaactacctcttctatggagtcacaattgctggacagatagttcttcgctggaagaagcctgatatcccccgccctatcaagatcaacctgctgttccccatcatctacttgctgttctgggccttcctgctgatctttagcctgtggtcggagcccgtggtgtgtggcactggcctggccatcatgctgacgggagtgcctgtctatttcctgggtgtttactggcaacacaagcccaagtgtttcaataacttcattgagtcgctaaccctggtgagccagaagatgtgtgtggctgtgtaccccgagatggatgcgggctcgaggacagaggaaacgaatgaggacacagaggagcagcggcagcccatctaccaacccactgcctccaaggacaaggagcagccccagccctga

SEQ ID NO: 36641 - protein, 532 aa, Canis familiaris
MEKGARHRNNAEKNHPGGSELEASQETGSTGGGVALKKEIGLVSACGIIVGNIIGSGIFVSPKGVLENAGSVGLALIVWIVTGLITAVGALCYAELGVTIPKSGGDYSYVKDIFGGLAGFLRLWIAVLVIYPTNQAVIALTFSNYVLQPLFPTCFPPESGLRLLAAICLLLLTWVNCASVRWATRVQDIFTAGKLLALALIIIMGVVQICKGEYFWLEPKNAFENFQEPDIGLIALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTIAGQIVLRWKKPDIPRPIKINLLFPIIYLLFWAFLLIFSLWSEPVVCGTGLAIMLTGVPVYFLGVYWQHKPKCFNNFIESLTLVSQKMCVAVYPEMDAGSRTEETNEDTEEQRQPIYQPTASKDKEQPQP

SEQ ID NO: 36642 - DNA, 1308 bp, Parachlamydia sp. UWE25
  CDS (1)..(1308)
atggcaacaaataaaatggggctcatgagcgcaattttgcttgggatcaatatgattttaggatcgggaatctttcttctccctggaaaagtttctgaattaaccggtgcatctagtctgtatgtctatgtctttgtttctctacttattttgtcaattgcttggtgctttgcgcaatgtgcagctctattcgatcgcaatggaggtgcttatttatatgctaaagaagcttttggtgattttataggatttgaaataggttttatgcgatggattgctggagcgatggcttgggcttcgcttattgtaggttttgttacagctctgagttctatttggccaaatgcattgacagagcctttaaggggatttttgatcttaatttttttagctcttcttattttatttaatatgggaggaactgaaaaacttaaaaatatcaacaatgtcgtgacgatagcaaaggtattacctcttctattttttgttttgattggttttttttatactaaggggaactttcaagcgattgatgtgtcattatcccatttagattctatttcttttggaaatgccgctatagttattttttatgcttttggagggtttgaaactcttgttattgctgcaggagaaataaaaaatcctcaccgtaacttaccaatagcggtgatggctgttattagcttttgctcgtttctatattttttaattcaaataattgccatggagatattaggacctcacttggctgaaagttctattcctttagctgatgcgactgaacaaatgattgggtccgctgggagatggattgtaactttaggtatgattatttcgattggaggtgtgaatcttacagcttcttttattactccaagaagtggagcggctttagcagaagatggtttggttcccagatggatcgccaaaaataataaagccggtgttcccgtagtagctatcttcttgacagcaagtttgactaccattgctgctttgtcagggagttttactcagctagctgtgatcagcgttgtctctcgatttgtacagtatggagcgacatgtttagctgtttttgtcctttattatcgcaatagggcaacattaaaaatgttaaaaaaaatatctctggttattattccttcgttatctttgattggtcttatttggatgttatttcaagcttcttcttctcagttatattggggcctaggggcgctcctgcctggaattcccatttatttttttcagaagtggaaaaataatttaacgttagcgacagtttctgaaatgggtgattaa

SEQ ID NO: 36643 - protein, 435 aa, Parachlamydia sp. UWE25
MATNKMGLMSAILLGINMILGSGIFLLPGKVSELTGASSLYVYVFVSLLILSIAWCFAQCAALFDRNGGAYLYAKEAFGDFIGFEIGFMRWIAGAMAWASLIVGFVTALSSIWPNALTEPLRGFLILIFLALLILFNMGGTEKLKNINNVVTIAKVLPLLFFVLIGFFYTKGNFQAIDVSLSHLDSISFGNAAIVIFYAFGGFETLVIAAGEIKNPHRNLPIAVMAVISFCSFLYFLIQIIAMEILGPHLAESSIPLADATEQMIGSAGRWIVTLGMIISIGGVNLTASFITPRSGAALAEDGLVPRWIAKNNKAGVPVVAIFLTASLTTIAALSGSFTQLAVISVVSRFVQYGATCLAVFVLYYRNRATLKMLKKISLVIIPSLSLIGLIWMLFQASSSQLYWGLGALLPGIPIYFFQKWKNNLTLATVSEMGD

SEQ ID NO: 36644 - DNA, 1332 bp, Picrophilus torridus DSM 9790
  CDS (1)..(1332)
atgaagagagggcatggcagtggagttataagtgtacctgttgcaactgctgtgggccttggcgcaataataggtgcaggcatatttgtccttagcggaactgcaatagcacttgccggtgccaatgcccttttttcctttatccttgttggcatacttgcagtgattattgcagtgcaatttggagagctcggatcgataatgccaaacgcaaagggcgcatccttttcatatacgtacaatgcctttggaagtgagcttgggttcataataggtatacttttatatttcagctttgcaactgcaatttccgcaatagccctgggctttggttcctacctttcaagcgtgcttttacttcatggtaataattatccaataatgttcgccattttattaatatttattttatcaattgtaaatataattggaataaaaaaggctgcaaggctggattcatttcttgtcttgataaagcttttaattttaacagtatttataatatcggctgttttgctggcccatttttctgggacattgaatttaaacaattttcatggttcggccagacaatccggtgttttacctgttctttctgcaagcatagctgtattctttgcatactcaggatttcagtccatttcaacaataacatcaaatgtcaggggcggcgcttccggtgctgcaagggcgatagtactatccgtggttataagcatgattttttacatcctggtcatttttgcattgatgctgatggtgcctgcatcaaaatttgtaatatcggctgatccgctttcctttgcattaaaatatgtaagggcaccatacagtatttttatacttgttgatgccggtgcacttatggcaactgcatcggcaactcttgcaatgatacttacatcctcaagggtgatatatcaaatctctgagaataaacttttaccaggattttttagaaaatacgataggaaaagggatgtgccagtaaatggtgtaattttatcagcattaataggtgttgcaatgctattctccggcaatatttatattatagccgcaattagcaattttgggcttttaatttcataccttgtttcatcacttgcattaatacacttcaggagaaacaataaaaccggaagctttaaaacaccattttacccatatattacggtaataagcatagttatgctccttgtttttattcttggaatgccacgggaggttttggacataggcatgattttaataataatactgcttatgctctattattttcttgttgagttcaaaagagaccgtgttatacatgaggagctttttaaataa

SEQ ID NO: 36645 - protein, 443 aa, Picrophilus torridus DSM 9790
MKRGHGSGVISVPVATAVGLGAIIGAGIFVLSGTAIALAGANALFSFILVGILAVIIAVQFGELGSIMPNAKGASFSYTYNAFGSELGFIIGILLYFSFATAISAIALGFGSYLSSVLLLHGNNYPIMFAILLIFILSIVNIIGIKKAARLDSFLVLIKLLILTVFIISAVLLAHFSGTLNLNNFHGSARQSGVLPVLSASIAVFFAYSGFQSISTITSNVRGGASGAARAIVLSVVISMIFYILVIFALMLMVPASKFVISADPLSFALKYVRAPYSIFILVDAGALMATASATLAMILTSSRVIYQISENKLLPGFFRKYDRKRDVPVNGVILSALIGVAMLFSGNIYIIAAISNFGLLISYLVSSLALIHFRRNNKTGSFKTPFYPYITVISIVMLLVFILGMPREVLDIGMILIIILLMLYYFLVEFKRDRVIHEELFK

SEQ ID NO: 36646 - DNA, 1338 bp, Picrophilus torridus DSM 9790
  CDS (1)..(1338)
atggaactaaagaggtcaataacattaacaggagcaataatgataaatcttggtgccatcataggcgcaggcatctttgttataataggcatagctgcatacagggcaggccccggtgttataatatcaatagttttatccggtataatagcaattctaacaggattaagcttttcagagatcgcaaggcatgttgccaaggaaggtggtgcatacgaatacgcaaaggatacgctgtcgccgtcagcaggttttgttgcgggctggatgtggacctccggtaatataatagcaatagccgccgttgcaacaagctttggcagctacttcgatgttctatttaatataaatgtaaacccgttttttatagctgtaatatgcatacttgccttcatgacattaaacatccttggaataaaaaattcaacaaagaccataactggccttgtaatattaaatgtgcttgtactgctggtttttatattctcaggaataacaaggttcaattctaataattatgttaattttatgccacacggaatctccggaataataacaggaacggcactgatcttctttgcatttacaggtttttcaagggtgacaactgtaagtgatgaggttattaaccctgaaaaaacgatacctcttgcgataattgtatcgataataatatcatcaattctatatatattaatagccgttgttttaataggacttaagccatattatgcataccagggctcaacgtcacccttaagcctggccgtatcctcgcttcataatagatatattgatataatagtatcaataggtggcgttacatcaacggcaggtgttacactgacaggcatacttggcacgtcaagggttctgtttgccatgggcagggataaagagctgccggaaaaactatcatacattgataggttctcaacgccggtatttgcaataatattatcatcaatacttggaataatatttttgatctttgtctcctttggaacaatagttgaggcctcaaattcatctgttctaatctcatatataattataaatgtggctgcaggctttttgtatctaaagctaagaaaaagggaaacaaaaaggcttgcaggcaggccattttttataatcatacctgcacttggcatagcaacaattcttttgataataagccatataaatataggaagcctggagattacaggtgtaatactattgatctgcataatatattatataataagaagaatagctcttaacattgaggggcgcagggttcccaggcacagcgatgtgcgtctctttggaaaaagcaggtcaaggacaaactaa

SEQ ID NO: 36647 - protein, 445 aa, Picrophilus torridus DSM 9790
MELKRSITLTGAIMINLGAIIGAGIFVIIGIAAYRAGPGVIISIVLSGIIAILTGLSFSEIARHVAKEGGAYEYAKDTLSPSAGFVAGWMWTSGNIIAIAAVATSFGSYFDVLFNINVNPFFIAVICILAFMTLNILGIKNSTKTITGLVILNVLVLLVFIFSGITRFNSNNYVNFMPHGISGIITGTALIFFAFTGFSRVTTVSDEVINPEKTIPLAIIVSIIISSILYILIAVVLIGLKPYYAYQGSTSPLSLAVSSLHNRYIDIIVSIGGVTSTAGVTLTGILGTSRVLFAMGRDKELPEKLSYIDRFSTPVFAIILSSILGIIFLIFVSFGTIVEASNSSVLISYIIINVAAGFLYLKLRKRETKRLAGRPFFIIIPALGIATILLIISHINIGSLEITGVILLICIIYYIIRRIALNIEGRRVPRHSDVRLFGKSRSRTN

SEQ ID NO: 36648 - DNA, 1404 bp, Bacillus thuringiensis serovar konkukian str. 97-27
  CDS (1)..(1404)
gtgaagtcattattacgaaaaaaagcgcttagtactgaatcaccacggcaactacaaagaacattaaccgcacttgatttaacgtttttaggaattggcgccgtaattgggacagggatatttgtattaacaggtattgttgcagcgaaacattctggtcctggtattatgctatcatttcttattgctgcatttacttgtgcttgtgtagccttttgttatgccgaatttgcttcttctattcctgtctcaggaagtgtgtatacttacgcatacatgacagtcggagaagtcgtcgccttcatcgtcggatggtgtttaatgctcgaatatttactagcagtcgcagcagtagctgtcggttggtctggttatttacaatctttactacaaggatttaacatccatctgcccgccataatcgcctcggcccctggcgtaggaaaagatggtctcattgatttaccagctgtttgtattttactcatcattaccggtcttttaagttttggtatacgtgaaagcgcacgcattaataatattatggttcttattaaattggctgttattatcgcctttatcgtagcaggcgcaaaatatgtaaaacctgaaaattggacaccgttcattccattcggatacgacggtattattactggagctgccactgtattcttcgccttcttaggctttgatgcaatcgcaactgctgcggaagaaacgaaaaaaccacagcgcgacttaccaatcggcattatcggttcccttcttatttgtactgttttatatatgatcgtatctttcgttttaacaggtatggttccttatacacaattagatgtttctgatccagttgcgtttgccttacatttcgttggcgaggatacaattgcaggactactcgctgttggagcgatgactggaatgacaaccgttctcttagtcgttatgtatggacaagttcgcgtttcgtatgcgatgagccgtgacggtttacttccaaaagcgttagcacgtgtaaataaaagagtaaaaatccctttattaaacacgtggatcactggtgttgttgccgctttattagcagggcttttagacctgcatgtattagcgaatttagtaaacatcgggacattaacagcctttacattcgtttgctgcgcagtacttattttacgaaaaacacaccctgacttaaaacgcggattccgcacacctttcgtacctgtactaccagttgtcgcgattctttgctgcttatatttaatgatcaatttgtctaaaacaacatggattagctttgccgtttggcttatagtcggattatgcttctatttcttctattctagaaagcatagccatttagctaccgaaaaaacgaatgatgaacagaaaaaagcataa

SEQ ID NO: 36649 - protein, 467 aa, Bacillus thuringiensis serovar konkukian str. 97-27
MKSLLRKKALSTESPRQLQRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNIHLPAIIASAPGVGKDGLIDLPAVCILLIITGLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMINLSKTTWISFAVWLIVGLCFYFFYSRKHSHLATEKTNDEQKKA

SEQ ID NO: 36650 - DNA, 1317 bp, Bacillus thuringiensis serovar konkukian str. 97-27
  CDS (1)..(1317)
atgcatcatgatgagaagaacaaaattggtttaacggtagcactttctatcgtagtaggaacgattattgggtctggtgtgtttatgaaaccagggagcgtattagattactcggggagttctaatatggcgattcttgcttgggtaatcggtggtctgttaacgttagcaagtggtttaacagtagctgaaattggagcgcaaatcccgaaaaatggtgggttgtatacgtatttagaggagatttacggaagtttttggggatatttatcaggctggatgcaaacgattgtttatgggccagctattattggaacattagggttatactttagttctttaatgattaattttttctatttagataaagtatggaatttaccaatcgcaattggaacagttgtgttccttggcgttgtaaatagtatgggaacaaaatacggaggtatcgtccaaacgatcacgacaatcgggaagatgattccaatcgtattaattgttgtgttaggtttttggaaagggaatagcgatatctttaacgtagttgtgccgatatcagaaaatcaaagtatcgggatggcaatcttagcaacgttatttgcttatgacggctggattttacttgcttcgattggtggagaaatgaagaatccaacaaagttattaccgaaagctatgacagttgggattttaattgtaacagctgcttacgtattaattaatttggcgttactgaatgtattaccagcaacacaaattgtagaccttggagaaaatgcaacagcgacagctgcaggaatgttacttggagaatatggcgggaaaattattagtatcggtattatcgtttctattttcggttgtttaaatggaaagattttaacgttcccacgtatcccgatgtcgatggcagaacgtggacaacttccatttgctaagtttattgcaaaggaaagcccaagatttaaaacaccagcaaatgcgattactgttgaaatcattttaggaattattttaatgattattagtgatccaaataagctatctgagatttccgtattcattatttatattttctacgtaatgacgtttatcggtgtcttcattttaagaaaacgtaataaaaataaagagcgtgcatacagtgtaccgttattcccaatcgtcccaatcgttgcgattttcggttcactctttgtaatcggtagtgcgattattaacgatccactaagttgtttcttatcaattggaattgtctttacgggactgccggtatattggtatttaaataagaagaacaaaactgaagtgtcataa

SEQ ID NO: 36651 - protein, 438 aa, Bacillus thuringiensis serovar konkukian str. 97-27
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPATQIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAIFGSLFVIGSAIINDPLSCFLSIGIVFTGLPVYWYLNKKNKTEVS

SEQ ID NO: 36652 - DNA, 1485 bp, Acinetobacter sp. ADP1
  CDS (1)..(1485)
atgaaaaatcccgtgacgtttagccaacgtctattacgtagaaagccgattaattttttagtacaagaaactcaacaaggtggaaaaactttaaaaagatcgctgactttatttcaactcactatgtttggtgtcggcgcgacaattggtacaggtatttttttcgtactaagtgaacaggtccctgtagcaggaccagcagttttaatttcatttattcttgctggaattacagcaggcttaacggccttatgttatgccgaattaagttcaatgattcctgcatcaggttcttcttattcatatgcttatgcaacgcttggtgaaggtgtcgcatttttggtcgcagcgtgtcttattttagaatatggggtctcggctgctgcggttgctatcggttggagtgaatatcttaataatcttattcataacgtttttggcgtacatttacccaactggttgctttcagctccttttgttgctgatggatacaaattacatttaggtggcaccggacttatcaatttacctgctgcaattttagtctttttatgctgtatgttgttgatgcgtggagtaacagaatcagcgcgaatcaatgcagtcatggttttgattaaactatgtgtattgattttatttatttccattgctgcaacagcatttaacgccgagcatttgacaccattttctccacatggctttgctggaattagtgcagcggcaggttcgattttttttacgtttattggtctggatgctgtatctaccgcaggtgaagaagttgaaaatccgcgtcggaatttacccttagcaattattagtgccttatttgttgtcattattttttatattctggtcgcattaacagctttaggggctcaagaacagggtttatttaaaggccagcaagctggacttgcggtaattttgcaagaaataacaggctctacttggcctgcaattattttagcagccggtgcagttatttcggtattttcgattacccttgtcgttctttatggtcaaactcgtattttatttgcaatgtcgcgtgatggccttgcacctaaaatctttcatcgtgtcagtacccaaaccttaactcctaatgcgaatacactcattgtggcagtgattgtatcaatcatcgctgggtttgttcctgctgatgtattgtgggatttgaccagtatgggaacacttattgcttttactgtagtgtccattggtgttttggtattgcgttatcgcatgcccgatgcaccacggggttttaaggttcctttttttcctgcactgcctgttttgagtatctgtgcatgtctatatttaatatccagtctttctgccattgtttacgtgatcgcggcgatctgggcagttattgcagcaacttattatttttcatgtgcatccaaaaactcagtgcttgaagcaggatctgaagcttattcgcatcagaatggagacgatcaccaatga

SEQ ID NO: 36653 - protein, 494 aa, Acinetobacter sp. ADP1
MKNPVTFSQRLLRRKPINFLVQETQQGGKTLKRSLTLFQLTMFGVGATIGTGIFFVLSEQVPVAGPAVLISFILAGITAGLTALCYAELSSMIPASGSSYSYAYATLGEGVAFLVAACLILEYGVSAAAVAIGWSEYLNNLIHNVFGVHLPNWLLSAPFVADGYKLHLGGTGLINLPAAILVFLCCMLLMRGVTESARINAVMVLIKLCVLILFISIAATAFNAEHLTPFSPHGFAGISAAAGSIFFTFIGLDAVSTAGEEVENPRRNLPLAIISALFVVIIFYILVALTALGAQEQGLFKGQQAGLAVILQEITGSTWPAIILAAGAVISVFSITLVVLYGQTRILFAMSRDGLAPKIFHRVSTQTLTPNANTLIVAVIVSIIAGFVPADVLWDLTSMGTLIAFTVVSIGVLVLRYRMPDAPRGFKVPFFPALPVLSICACLYLISSLSAIVYVIAAIWAVIAATYYFSCASKNSVLEAGSEAYSHQNGDDHQ

SEQ ID NO: 36654 - DNA, 1377 bp, Erwinia carotovora subsp. atroseptica SCRI1043
  CDS (1)..(1377)
atggaacaaccatcctccaagctcaagcgtgggttaagcacgcggcacatccgctttatcgcccttggttcagcgatcggaacgggtctgttttatggttccgctagcgcgatccaaatggctggccccagtgtgttactggcttatctgatcggtgggattgttgcgtatatcatcatgcgcgcactgggcgaaatgtcggtgcataacccacagtccagctcgttttcccgctatgctcaggattatctcgggccgttggcggggtatgtcaccggctggacctactgctttgaaatgctgattgtcgccattgccgatgtgaccgcgtttggcatctacatgggtgtctggttccctgctgtgccgcactgggtgtgggtcttgagcgtggtgctcatcattggtgccatcaacctgatgaatgtgaaggcctttggtgaactggagttttggctctctttcttcaaagtggccaccattatcatcatgatcgctgccgggatcggcatcattgtctggggaattggtaacggtggtgaacccactggtatccataatctatggagcaatggtgggttcttcagtaacggtgtgatgggaaccattctatcgctgcaactggtgatgtttgcgtatggcggcgtggagatcatcgggatcaccgccggtgaagccaaagacccgcataaatccatccctcgtgcgattaactctgtaccgtggcgtattctggtgttctatgtcggtacgctattcgtcattatgtcgatttatccgtggaatcaggtaggcaccaacgggagcccgttcgtactgacgttccagcatatgggtattacagcggcagcaggcattctgaactttgttgtgattaccgcttcgctgtcggcaattaacagtgatgtcttcggcgtaggccgtatgctgcacgggatggcggaacaagggcatgcaccgaaggtgtttagccgtgtttccaaacgtggtatcccgtgggtcacggtggtcgtgatgatgatggcgctgctggtggcggtgtacctgaattatattatgcccggtaaagtttttctggttattgcctcactggccacctttgcaacggtgtgggtgtggatcatgattctgttttcccagattgccttccgccgccgtctgagtgttgatgaagtgaaggcgttggcgtttccgctacgtggtggtatcgcgacctccgtgttcggtatcgtcttcctgttcttcattatcggtttgattggctacttcccggatacccgcatatcactgtatgtcggcattatctggatactggtgcttttagtgggctatgtctggaagaagaagcatcagaacgcggtggctgcacagaattaa

SEQ ID NO: 36655 - protein, 458 aa, Erwinia carotovora subsp. atroseptica SCRI1043
MEQPSSKLKRGLSTRHIRFIALGSAIGTGLFYGSASAIQMAGPSVLLAYLIGGIVAYIIMRALGEMSVHNPQSSSFSRYAQDYLGPLAGYVTGWTYCFEMLIVAIADVTAFGIYMGVWFPAVPHWVWVLSVVLIIGAINLMNVKAFGELEFWLSFFKVATIIIMIAAGIGIIVWGIGNGGEPTGIHNLWSNGGFFSNGVMGTILSLQLVMFAYGGVEIIGITAGEAKDPHKSIPRAINSVPWRILVFYVGTLFVIMSIYPWNQVGTNGSPFVLTFQHMGITAAAGILNFVVITASLSAINSDVFGVGRMLHGMAEQGHAPKVFSRVSKRGIPWVTVVVMMMALLVAVYLNYIMPGKVFLVIASLATFATVWVWIMILFSQIAFRRRLSVDEVKALAFPLRGGIATSVFGIVFLFFIIGLIGYFPDTRISLYVGIIWILVLLVGYVWKKKHQNAVAAQN

SEQ ID NO: 36656 - DNA, 1449 bp, Propionibacterium acnes KPA171202
  CDS (1)..(1449)
atgcaggaaggtgattctgtcaccccgcacaccagcaccaccgttgataagggggatgccggctacgacaaggccttaaagaacaggcacctgcagatgatcgccatcggcggctcaatcggcaccggcttgtttctgggtactggcggacgccttgcccaaggtggccccggattggcgataagctacgccgtctgtggcatcttcgccttcctcatggtgagggccctcggtgagatggctattcgtcgtccgtcctcaggcgccttcgtgtcctacgcgcgtgaattcatgggtgagaagggcgcctacgccaccggatggttcttcttccttgactggtcggtcacggtgatggctgacatcaccgcagtggcgctgtacctgcattattggacgcccttgcgtgccatcccacaatgggtgttagcgctcatcgccctcggcgtggtgtttaccctcaacatgttgagcgtgaagatgttcggcgaggccgaattttggttcgctgctatcaaggtagccgcgatcatcctgttcatgatcgcggccatctgggccatcgtcacgggtgcgcgggttggcaactacaccgcaggccttcacaacatcgcccagcatggcggattcttccccgctgggctggcgccggtctttgcactcactctgggagtgatcttcgccttcggcggcaccgagatggtcggcgtagcagcaggcgagaccaaggatgcgagcaagatcttgcccaaggccatcaactcgatgatcctgcgtatcttcgtcttctacgtcggttcgatcatcttgatggcgctggtactgccgtacactgcctattcaagcaatgaatccccgttcgtcaccttcttcaccggaatcggaattccctacgctggtgacatcatccaggtaatcgtcctgacggctgccctcagctcgctcaatgctggcctgtactcgaccggacgcaccctgaggtcattggcggttgccggcgaagcaccaaaagccgctgctaaactcaaccgtcaccacgtgccttctggcggcatcgccatgaccgccgccctcggtctgctgggcgttgccctcaacgccttcctcccggatagcgccttcgagatcgtcatgaacctcgccggcatcggtatcgccggcacgtgggcgatggtcctgctcgcccacacccgtttcgtgagcgcagtgaggcggggcaaggacaaccgaccggaataccgcatgcctggtgccccggtcacgaactacatctcattggccttcctgctgatcgtcgtactgtcgaacgtcacttcggaatcggggcgctggacactagccctcttcgccctggtcgcaattgccatggtcgccgggtggtacgcagtccgtaacagcatcaaacccgacctgctcgacaacgtggttccaagcgatgaggggatgtga

SEQ ID NO: 36657 - protein, 482 aa, Propionibacterium acnes KPA171202
MQEGDSVTPHTSTTVDKGDAGYDKALKNRHLQMIAIGGSIGTGLFLGTGGRLAQGGPGLAISYAVCGIFAFLMVRALGEMAIRRPSSGAFVSYAREFMGEKGAYATGWFFFLDWSVTVMADITAVALYLHYWTPLRAIPQWVLALIALGVVFTLNMLSVKMFGEAEFWFAAIKVAAIILFMIAAIWAIVTGARVGNYTAGLHNIAQHGGFFPAGLAPVFALTLGVIFAFGGTEMVGVAAGETKDASKILPKAINSMILRIFVFYVGSIILMALVLPYTAYSSNESPFVTFFTGIGIPYAGDIIQVIVLTAALSSLNAGLYSTGRTLRSLAVAGEAPKAAAKLNRHHVPSGGIAMTAALGLLGVALNAFLPDSAFEIVMNLAGIGIAGTWAMVLLAHTRFVSAVRRGKDNRPEYRMPGAPVTNYISLAFLLIVVLSNVTSESGRWTLALFALVAIAMVAGWYAVRNSIKPDLLDNVVPSDEGM

SEQ ID NO: 36658 - DNA, 1407 bp, Propionibacterium acnes KPA171202
  CDS (1)..(1407)
atggcagtagcggccacgggcatcccggcggaatccggcgaacccgctatggacaaaccccgcatgaagggtcgtcacctggtgatgatgagccttggctcggccatcggaaccggactcttcgtagggtctggcaagggtgtggctgcagctggaccagcaaccttggtggcgtatatcgtcgccgggttactcgtcatcgccatcatgtacatgctcggcgagatggttgcagcccatcccgactccggggcgttttcggtctacacatcccgagccatgggctcagcagctggctttgcgatggggtgggtctggtggatcgaactagtcgtcgtcgtcgcggccgaggcgatcgcggcggcgtcgacccttgttgctatgtggccaatagcccctgtctggctgcttaccctcatcttcctggtcgtcctcaccgcaatcaacctgctgggagccgacagattcggagagttcgagttctggtttgccctgcttaaagtggtcgccgtcgtcgtcttccttaccatcggtgtgctgcttatttgcggagtcttggcggctcccgcggcgggaacatccaacctcgtcggccacggcggattcctgcccaatgggtggtctggggtggcgacagccctgcttttggtcgccttcagcttcggtggcatcgagatcatggcggtggcggccgccgagaccgaagaccctgcccacaatgtctcccgggctgtgcgcaccatcgtttggcgaatcctggtgttctacatgggttcagtagccatcatggttatcgcggtgccttgggacgaccccgaactcggcgcttcccccttcgtggccgtccttaaccgggccggtatcccagcagcctccgaggtcatgaccttggtcattgtgttggccttgctgagttccctcaatgccaatctttatggggctgcccggatgcttggctctttagcggaacgcggcatggcccctcgcgtcgccatgcgaaccaggggacgctcggtgccgacggttgcggtgctggccagcgtcgcctttggattctgttgtgtgctggctactttcgaatggggcgacgccgtactcggtactctgcttaatatcgtcggttcaaccatcatcgttacctacttcttcaccatctgctctcactacgtgctgcgtcgccgcgctgagaaggagggcgccccgctgccgatgcggttgaaagggtttccggtggtgaactgggcagcaatgatcctgctgattggcatcgttgtactgggcatgttttcccccgacgtacgagctcaactgatgtcaacgggggcgctcgtcgtcatcctctatgtcattggagtgggatggtcccatcacgccggacgcagccccttccatcccacgaccgactga

SEQ ID NO: 36659 - protein, 468 aa, Propionibacterium acnes KPA171202
MAVAATGIPAESGEPAMDKPRMKGRHLVMMSLGSAIGTGLFVGSGKGVAAAGPATLVAYIVAGLLVIAIMYMLGEMVAAHPDSGAFSVYTSRAMGSAAGFAMGWVWWIELVVVVAAEAIAAASTLVAMWPIAPVWLLTLIFLVVLTAINLLGADRFGEFEFWFALLKVVAVVVFLTIGVLLICGVLAAPAAGTSNLVGHGGFLPNGWSGVATALLLVAFSFGGIEIMAVAAAETEDPAHNVSRAVRTIVWRILVFYMGSVAIMVIAVPWDDPELGASPFVAVLNRAGIPAASEVMTLVIVLALLSSLNANLYGAARMLGSLAERGMAPRVAMRTRGRSVPTVAVLASVAFGFCCVLATFEWGDAVLGTLLNIVGSTIIVTYFFTICSHYVLRRRAEKEGAPLPMRLKGFPVVNWAAMILLIGIVVLGMFSPDVRAQLMSTGALVVILYVIGVGWSHHAGRSPFHPTTD

SEQ ID NO: 36660 - DNA, 1461 bp, Streptococcus pyogenes MGAS10394
  CDS (1)..(1461)
atgaaatttacaatcattactaactatgatacacttagtagaaaatcatttactatagaaggtgataacatgactatttttcgtaaaaaaaagaaatattccaataaaacagaaatgcaaaggcacttcaaagttattgatttagtttttttaggcctaggttcaatggttggaacaggtatctttacagttactggcataggcgctgctaagtatgcaggtcctgctttaacaatatcgattatcatttccgcgattgctattggaattttagccttattttatgcagaatttgcgtctcgtatgccttctaacggtggtgcttatagttatgtttatgcaaccttgggagagtttccagcatggcttgttggctggtatattattatggaatttttaacagctatatctagtgttgctgttggctggggaagttatttaaaaggattacttgccaattataatatagtattaccaaacgctttaaatggcacgttcaatcttaagaatggaacttacatagatattcttcctgttttagtgatgtttttcgtgacagggattgtcctaatgaattcgaaattagccctgagattcaatagttttttagttattttaaaattttcagcactggctttatttatctttgtaggcattttttttattgatcacaataattggtctcattttgctccatatggtgtaggacaaattactggaggtaaaacaggtatctttgctggtgcttctgttatgttctttgcatttttaggatttgaatctatttcaatggcagttgatgaagtgaaagaaccacaaaaaacaattcctaaaggtatcattttatctttgattattgtaacagcactctatatagttgtcaccactattttaacgggaattgtacactacactaaattaaatgttccagacgcggtggcttttgctttaagaaatattagactttattgggcagctgactatgtgtcgatagttgctattttgactcttattacggtatgtatttctatgacctatgcattagctagaacaatttacagtattagtagagatggtttattacctaaatcactttatactctcactaaaaaaaataaagtgcctcaaaatgctactcttgtcactggactacttgctatgatttgtgcgggaatatttcctttatcgagtctagcagagtttgttaatatttgtactttagcatatttaattattctgtcgggtgcaattattaaactcagaagaatagaaggagaaccaaaagcaaatgaatttaaaactcctctagtaccattcctaccaatgttggcaattatcatttgtctatcatttatgagccaatataaagcttttacttggattgcttttgctattgccacaattattggaacattaatctacttagcttatggttatactcattcaatagaaaataaataa

SEQ ID NO: 36661 - protein, 486 aa, Streptococcus pyogenes MGAS10394
MKFTIITNYDTLSRKSFTIEGDNMTIFRKKKKYSNKTEMQRHFKVIDLVFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 36662 - DNA, 1518 bp, Desulfotalea psychrophila LSv54
  CDS (1)..(1518)
ttggcagcacagttttgggagcgcattttgatggataagaaagcagcagtgactgaaagagcagaattgaagaagtcgattaagcccgttcaggcttgggccctcgccttgggtgcgattcttggatggggtgcatttgtcttaccaggtctacgctttttgcctcaggccgggccacttgcctcttgcatcggttttgttctgggtggtgtaatgctgttttccgtggcaatcagttacggaaatatggtgagtaagtacaaggtgaccggcggagcttttgccttctcctttgttggttttggtcccaccgtggcctttatctgtggatgggcccttgtgcttggttatatctgtatcattgccctgaatgcgacagctgtctctctgctgacccgttttgttttcccgggcgtctttgaagtagggatgctgtactccattgttggctgggatgtctatgcaggtgagatagccatgctggtcggcatactctgtctttgtgggtttttgaatttccgtggcgcagatcttgttggtaagattcaggtattccttgcctttgccctctgtgctagtgtctttattgttttcggcggttccgtttcccatgagactgcagctgtttctaacctctctcctctttttgctgataacaagagcccgcttgccagtattatggccattgttgccattgcaccatggctctatgtgggttttgataccattcctcaggcagctgaggaattcgacttcccgcacaagcgcgctgaaaagctcatgctttccgcaattggctggggcattgtcctttatgcaatggtaaccatcgccgttgcctgcatcatgccatataaagagcttctcgccatgaatagcccctgggctaccggaaccgtagcaaacatggcccttggtcgggttggtagtgtgattcttgccactgctgttcttgccgcaatctttaccggaatcaatggtttctttattgcatcttctcgtctgctctttgccatgggtcgggcaaccatcctgccatcttggtttgctgatatccatccaaaataccaaacccctcataaggcgatcctctttgttcttgccattgccgtaaccgcgcccttctttggtcgtgaagtattgaattgggttgttgatatgtctgctgtcggtactgttattgcctatcttatctcttgcctcagtgcctataaggtaatgaagcatgcccagaataagagaggtgttatgcatgcagtgcttggctcaattagttctgttgtctgtattttgcttcttaccgttccgggttcacccggtgccattggcatgcagtcttgggttgctctctgtctctgggttatccttggcgcttggttctataatgcaagaatgggtgattttaaagcccttaccacggaagagcagagtactctcattttaggaagttcacgtcgagttttctttggtaaaggtaaaaaagctccggctcagcagccagcatccaaagaagcgtaa

SEQ ID NO: 36663 - protein, 505 aa, Desulfotalea psychrophila LSv54
MAAQFWERILMDKKAAVTERAELKKSIKPVQAWALALGAILGWGAFVLPGLRFLPQAGPLASCIGFVLGGVMLFSVAISYGNMVSKYKVTGGAFAFSFVGFGPTVAFICGWALVLGYICIIALNATAVSLLTRFVFPGVFEVGMLYSIVGWDVYAGEIAMLVGILCLCGFLNFRGADLVGKIQVFLAFALCASVFIVFGGSVSHETAAVSNLSPLFADNKSPLASIMAIVAIAPWLYVGFDTIPQAAEEFDFPHKRAEKLMLSAIGWGIVLYAMVTIAVACIMPYKELLAMNSPWATGTVANMALGRVGSVILATAVLAAIFTGINGFFIASSRLLFAMGRATILPSWFADIHPKYQTPHKAILFVLAIAVTAPFFGREVLNWVVDMSAVGTVIAYLISCLSAYKVMKHAQNKRGVMHAVLGSISSVVCILLLTVPGSPGAIGMQSWVALCLWVILGAWFYNARMGDFKALTTEEQSTLILGSSRRVFFGKGKKAPAQQPASKEA

SEQ ID NO: 36664 - DNA, 1407 bp, Rickettsia typhi str. Wilmington
  CDS (1)..(1407)
atgagttttttaaggaaaaaaagttttgaatcagtaaaagagataggtagttcaagtggtcttagtaagacacttggagcatttgatttaatattattaggtcttggtgctatgatcggtactggtgtattcgttgtgactggtataattgcagctaagttttcaggtccggcagtgatgatatcttatatgattgccggtattacgtgtatctttgtagcacttgtttatactgaacttgctgcaatgctaccaacttctggaagtatttacacttattcttacgttgcatttggtgaagtctttgcttggatgataggtagcgttataatattagagcttggagtatctgctggcatagtagcagctggttggtctggctatgtacaaggcatattagaggctggaggaatatatttaccaaaagtattaactactgtaccttcaaatggtggggtaataaatttacctgcctttttaatttcggcattcattggatttattttatttttaggaaccaaagatagtaaaaaaataaatgctattttggtttttataaaaatggcagcaatatttgcttttgttttggcatctgctccgcattttgatgctactaattggagtaattttatgccatttggtttcggtagtgttgtaatgggttcttctattttatttctcgcttttacaggttttggaacaattgccactgcagctgaagaatgtaaaaatccaaagcgggatatattaatcggtattataggatcgttaatcttaactactttagtatatgttataatgtcaggattagttactggtatagctccttttgatcaattaaataatgatcgtccacttgcttatgccttaactattaataatagtaaaattggttcagcaattgtttcaacaggagctgtttgtggtatgatgactgtgttgatgatgaatatttacggtacttctcgtattttttatgctatcgcacgtgatggtttacttcctaaaagttttgcaaagcttcacccaaaatatgatagcccatatattacgattataatattttctgcacttgcagcatttttaggtggtttttgtcctactgaaatcataacacaattaacttcaatgggcgcacttattgattatattgttgtagcaataatagtaatgatgtttaggataaaattaccaactgctcaaagatcatttaaatgtcctatagtatttattattgcaccatttattttattagcttgtatttatttattacttacacaaatgtatggtgacgaaatatataaaggaaactttaacctattaacatcaggtagagtattaatatattggtttattacaatatttgtattatatcttataagatcattttttatgaaaaaagaataa

SEQ ID NO: 36665 - protein, 468 aa, Rickettsia typhi str. Wilmington
MSFLRKKSFESVKEIGSSSGLSKTLGAFDLILLGLGAMIGTGVFVVTGIIAAKFSGPAVMISYMIAGITCIFVALVYTELAAMLPTSGSIYTYSYVAFGEVFAWMIGSVIILELGVSAGIVAAGWSGYVQGILEAGGIYLPKVLTTVPSNGGVINLPAFLISAFIGFILFLGTKDSKKINAILVFIKMAAIFAFVLASAPHFDATNWSNFMPFGFGSVVMGSSILFLAFTGFGTIATAAEECKNPKRDILIGIIGSLILTTLVYVIMSGLVTGIAPFDQLNNDRPLAYALTINNSKIGSAIVSTGAVCGMMTVLMMNIYGTSRIFYAIARDGLLPKSFAKLHPKYDSPYITIIIFSALAAFLGGFCPTEIITQLTSMGALIDYIVVAIIVMMFRIKLPTAQRSFKCPIVFIIAPFILLACIYLLLTQMYGDEIYKGNFNLLTSGRVLIYWFITIFVLYLIRSFFMKKE

SEQ ID NO: 36666 - DNA, 1416 bp, Bacillus cereus ZK
  CDS (1)..(1416)
gtggccaacctatttaaaaagaaatccgttacgcaattgttaggggaaagtaaaagtaaaactttaacgaaaacgctaggggcatttgacctaacaatgctagggattggtgcgataattggtacaggagtactagtattaacaggattagtagcagcaagagatgctggtccagcagttattttttcattcatgattgcagcgatcgtttgtggatttgcagcgttgtgttatgcagaagttgcatctacacttccggtttcaggtagtgtgtacacatattcatatgcgacaattggtgagtttattgcccatctaatgggatggacattattatccgtatatgtcgtaacaactgccgcagtagctggtggatggacgggttattttaataacttagtgagtgggtttggattagaaattccaacagagctgttaaagattccatcacaaggtgggattgtgaatttaccagcagtagttattacattagttttaacttggttactatcaagaggtacgaaagaaagtaagcgtgtgaataacataatggtattaattaaaattggtattgttattttattcattgcagttggtgcgttttacgtacaaccagaaaactggacaccatttgcgccatacggcattagcggaatctttgccggcggagcagcagtattctttgctttcttaggatttgatgcattagcaacatctgctgaagaagtaaaaaatccacaacgtgatttaccaattggtattattgcttcgttaattatttgtacaattatttatgttgtagtttgtctcgttatgacaggtatggtttcttataaagaattagatgtaccagaagctatggcatatgtattagaagttgtaggacaagataaagtagctggtgtaatcgcggttggagctgtaattggtattatggctgtaatctttgcttacatttatgcaacgacacgtgtattcttcgcgatgagccgtgatggtttattaccgaaatcatttgcgaaaattaataagaagacagaagcgccagtattctcaacttggttaacaggtattggtagtgctttaattgctggatttatcgatttaaaagaattgtcgaatttagcgaatattggagcattattaacatttgcgatggtaggtgtgtcagttattattcttcgtaaaacacatccgaacttaaaacgaggctttgtggtaccacttgtaccaacgctaccgattatttcaatcgcatgttgtctattcttaatgtttaacctaccgttaacaacatggatttactttggtatttggttagcaattggagtagttgtatactttgtttattcgaaaaaacatagtcatttaaaagacgatggaagttcgcaggataatttagaacaagctaattaa

SEQ ID NO: 36667 - protein, 471 aa, Bacillus cereus ZK
MANLFKKKSVTQLLGESKSKTLTKTLGAFDLTMLGIGAIIGTGVLVLTGLVAARDAGPAVIFSFMIAAIVCGFAALCYAEVASTLPVSGSVYTYSYATIGEFIAHLMGWTLLSVYVVTTAAVAGGWTGYFNNLVSGFGLEIPTELLKIPSQGGIVNLPAVVITLVLTWLLSRGTKESKRVNNIMVLIKIGIVILFIAVGAFYVQPENWTPFAPYGISGIFAGGAAVFFAFLGFDALATSAEEVKNPQRDLPIGIIASLIICTIIYVVVCLVMTGMVSYKELDVPEAMAYVLEVVGQDKVAGVIAVGAVIGIMAVIFAYIYATTRVFFAMSRDGLLPKSFAKINKKTEAPVFSTWLTGIGSALIAGFIDLKELSNLANIGALLTFAMVGVSVIILRKTHPNLKRGFVVPLVPTLPIISIACCLFLMFNLPLTTWIYFGIWLAIGVVVYFVYSKKHSHLKDDGSSQDNLEQAN

SEQ ID NO: 36668 - DNA, 1404 bp, Bacillus cereus ZK
  CDS (1)..(1404)
gtgaagtcattattacgaaaaaaagcgcttagtactgaatcgccacggcaactacaaagaacattaaccgcacttgatttaacgtttttaggaattggcgccgtaattgggacagggatatttgtattaacaggtattgttgcagcgaaacattctggtcctggtattatgctatcatttcttattgctgcatttacttgtgcttgtgtagccttttgttatgccgaatttgcttcttctattcctgtctcaggcagtgtgtatacttacgcatacatgacagtcggagaagtcgtcgccttcatcgttggatggtgtttaatgctcgaatatttacttgcagtcgcagcagtagctgtcggttggtctggttatttacaatctttactacaaggatttaacatccatctgcccgccataatcgcctcggcccctggcgtaggaaaaggtggtctcatcgatttaccagctgtttgtattttactcatcattaccggtcttttaagttttggtatacgtgaaagcgcacgcattaataatattatggttcttattaaattggctgttattatcgcctttatcgtagcaggcgcaaaatatgtaaaacctgaaaattggacaccgttcattccattcggatacgacggtattattactggagctgccactgtattcttcgccttcttaggctttgatgcaatcgcaactgctgcggaagaaacgaaaaaaccacagcgcgatttaccaatcggcattatcggttcccttcttatttgtactgttttatatatgatcgtatctttcgttttaacaggtatggttccttatacacaattagatgtttctgatccagttgcgtttgccttacatttcgttggtgaagatacaattgcaggactactcgctgttggagcgatgactggaatgacaaccgttctcttagtcgttatgtatggacaagttcgcgtttcgtatgcgatgagccgtgacggtttacttccaaaagcgttagcacgtgtaaataaaagagtaaaaatccctttattaaacacgtggatcactggtgttgttgccgctttattagcagggcttttagatctgcatgtattagcgaatttagtaaacatcgggacattaacagcctttacattcgtttgctgcgcagtacttattttacgaaaaacacaccctgacttaaaacgcggattccgcacacctttcgtacctgtactaccagttgtcgcgattctttgttgcttatatttaatgatcaatttgtctaaaacaacatggattagctttgccgtttggcttatagtcggattatgcttctatttcttctattctagaaagcatagccatttagctaccgaaaaaacgaatgatgaacagaaaaaagcataa

SEQ ID NO: 36669 - protein, 467 aa, Bacillus cereus ZK
MKSLLRKKALSTESPRQLQRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNIHLPAIIASAPGVGKGGLIDLPAVCILLIITGLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMINLSKTTWISFAVWLIVGLCFYFFYSRKHSHLATEKTNDEQKKA

SEQ ID NO: 36670 - DNA, 1416 bp, Bacillus cereus ZK
  CDS (1)..(1416)
atgagtaatttactaaaaaagaaatccgttacacaattgttagagcataatcaaagcaagactttaacgaaaacattaggagcatttgatttaattatgttaggagtaggctcgatagtcggaacaggtgttcttgtcttaactggattagtagcagcaagagatgctggtccagcagttattttttcatttgtacttgcagcaattatatgcggatttatagcattatgttacgcagaaattgcttctacactcccggcgtctggtagtgtatatacgtactcatatgcaacaatgggtgagtttgttgctcatctagtaggttggtcattgctgttaatatatattgtggcaacagcggctgtcgctgctggatggacaggctatttccacaatttaataaaagggtttggattagagatacctaaagctctagtaacgattccttcgcatggtggtattgtgaatctaccagcagtaatcattacattgatattagcatggatgttatcccgtggtacgaaggaaagtaaacgaatcaataatataatggtattgattaaaattggaatgattttgttgtttattacggttggtatattctatgtaaaaccaatgaactggataccaattgcaccatacggtttaagtggagtttttacgggtggagcagctattttattcgcttttacgggttttgatatattagcaacttcagcagaagaagtaaaagatccgaaacgtaatcttcctatcggtattattgcatcattaatcatatgtacaattatttatattatggtatgccttgttatgacaggaatggtttcctataaagaattaaatgttcctgaggcaatggcttatgtaatggaagtggtaggacaaggaaaagtcgctggtgcaattgctgcaggtgctgtaattggccttatggctgttattttttcgaatatgtatgcggcaacacgagtattctttgcaatgagtcgtgatggattgttaccgaaatcatttgcgaaagttaataagaaaactggagcacccacttttataactggattggcaggaatagggagttctataatagctgggtttattgatttgaaagaattggttaatttagttaatatcggtagtttggtgacgtttgcgttagtttgtctatcagttattatgctacgtaaatcacacccaaatttaaaacgtggatttatggtaccttttgtacctgtattaccatgcgttgcaattgtatgctgtgtgtttttaatgctaaatttaccgttaagcacatgggtgtactttagtatttggattactattgggggagtaatatatttcctttattcgataaaacacagtaatttaaatgaggaaacgatctcgaaattacatgataaaattgcgagataa

SEQ ID NO: 36671 - protein, 471 aa, Bacillus cereus ZK
MSNLLKKKSVTQLLEHNQSKTLTKTLGAFDLIMLGVGSIVGTGVLVLTGLVAARDAGPAVIFSFVLAAIICGFIALCYAEIASTLPASGSVYTYSYATMGEFVAHLVGWSLLLIYIVATAAVAAGWTGYFHNLIKGFGLEIPKALVTIPSHGGIVNLPAVIITLILAWMLSRGTKESKRINNIMVLIKIGMILLFITVGIFYVKPMNWIPIAPYGLSGVFTGGAAILFAFTGFDILATSAEEVKDPKRNLPIGIIASLIICTIIYIMVCLVMTGMVSYKELNVPEAMAYVMEVVGQGKVAGAIAAGAVIGLMAVIFSNMYAATRVFFAMSRDGLLPKSFAKVNKKTGAPTFITGLAGIGSSIIAGFIDLKELVNLVNIGSLVTFALVCLSVIMLRKSHPNLKRGFMVPFVPVLPCVAIVCCVFLMLNLPLSTWVYFSIWITIGGVIYFLYSIKHSNLNEETISKLHDKIAR

SEQ ID NO: 36672 - DNA, 1287 bp, Bacillus cereus ZK
  CDS (1)..(1287)
atgaaaaataaagccattggattatttcaaggaattgcgttatacatttcagctattttaggatcaggtgtcctatttttatcaggggtaacggcctcaatagcgggccctgcatctattgtatcctggtttatcgttattataattagttttccgcttgcttattcctttgctagtttggcacggatatttcctgattccggtggagcagcaacctttgttagaaattcttttggatatcatcttggcaatatcgttgggtggttttactttgtaacagcagcagttggtcaaacgattgtatctttaactggtgctttttacgtcagtcaggcatttggattttcgcattttgaaacaattttaattgccgtctttattttggtaattgcaggtgtttccaattattacggcgtaaatgttagtggtaaagttgcattgattttaagttctttattactgattcttttagcgtcagctgtatttgtggcgtttccaagaatacaatggggaaattttaatccctttgttccaaatggatggttttctgtcgggaacgctataacggttatcttttggtcatttttcggttgggaggcgatttgtaatctggctgagcattttaaaaggccagaaaaagatattgtcaaaggagcagttattagtgtagttgtcattggattattatttttagcgctaagccttgtcactattggaacggccacgtatggcagtcaagaaagcaacctgtctcctattggtgttataatgggagatacagtaggcggaggtgccaaagtcgttacagctgttttagctttaattatttgtacagggacagcgaatgcttttgtagccagcctaacgcaattaggatattctttaagcagagatggtgctttcccaaaatttttctcaaggctgcatgcaactactcaaattccaagacagatggtattgtttgttatctgtttttcggtagcaggtgtgttagtgacaaaagctttgtcactaacgtttgatgatattttgtttataccgacttctcttgggattctagtttatgttctttcaatggcagcaggcgttaaattatttaggaagaacacaccggcatggtgggcatcgttaatctctttcattttatgtttgctggtgattccattttttcaattgtatatatttgttccgttaattgtcgtggctatatatacgatttatatgattttgagtaataagattttcgcctacaagggaggattaaaatctaatgaaggatcaaaataa

SEQ ID NO: 36673 - protein, 428 aa, Bacillus cereus ZK
MKNKAIGLFQGIALYISAILGSGVLFLSGVTASIAGPASIVSWFIVIIISFPLAYSFASLARIFPDSGGAATFVRNSFGYHLGNIVGWFYFVTAAVGQTIVSLTGAFYVSQAFGFSHFETILIAVFILVIAGVSNYYGVNVSGKVALILSSLLLILLASAVFVAFPRIQWGNFNPFVPNGWFSVGNAITVIFWSFFGWEAICNLAEHFKRPEKDIVKGAVISVVVIGLLFLALSLVTIGTATYGSQESNLSPIGVIMGDTVGGGAKVVTAVLALIICTGTANAFVASLTQLGYSLSRDGAFPKFFSRLHATTQIPRQMVLFVICFSVAGVLVTKALSLTFDDILFIPTSLGILVYVLSMAAGVKLFRKNTPAWWASLISFILCLLVIPFFQLYIFVPLIVVAIYTIYMILSNKIFAYKGGLKSNEGSK

SEQ ID NO: 36674 - DNA, 1317 bp, Bacillus cereus ZK
  CDS (1)..(1317)
atgcatcatgatgagaagaacaaaattggtttaacggtagcactttctatcgtagtaggaacgattattgggtctggtgtgtttatgaaaccagggagcgtattagattactcggggagttctaatatggcgattcttgcttgggtaattggtggtctgttaacgttagcaagcggtttaacagtagctgaaataggagcgcaaatcccgaaaaatggtgggttgtatacgtatttagaggagatttacggaagtttttggggatatttatcaggctggatgcaaacgattgtgtatgggccagctattattggaacattagggctatactttagttctttaatgattaattttttctatttagataaagtatggaatttaccaatcgcaattggaacagttgtgttccttggcgttgtaaatagtatgggaacaaaatacggaggtatcgttcaaacgatcacgacaatcgggaaaatgattccaatcgtattaattgttgtgttaggtttttggaaagggaatagcgatatctttaacgtagttgtgccgatatcagaaaatcaaagtatcgggatggcgattttagcaacattatttgcttatgacggctggattctacttgcgtcaattggcggagaaatgaagaatccaacaaagttattaccgaaagcaatgacagttgggattttaattgtaacagctgcttacgtattaattaatttggcactattaaatgtattaccagcagtggaaattgtggaccttggagaaaatgcaacagcgacagctgcgggcatgttacttggagaatatggtggaaaaattattagtatcggtattatcgtgtctattttcggttgtttaaatggaaagattttaacgttcccacgtatcccgatgtcgatggcagaacgtggacaacttccatttgctaagtttattgcaaaagaaagtccaagatttaaaacaccagcaaatgcaattactgttgaaattattttaggaattattttaatgattattagtgatccgaataagctatctgagatttccgtattcattatttatattttctacgtaatgacgtttatcggtgtctttattttaagaaaacgtaataagaataaagagcgtgcatacagtgtaccgttattcccaatcgtaccaatcgttgcgattttcggttcgctctttgtaattggtagtgcgattatcaacgatccactaagttgtttcttatccattggaattgtctttacgggactgccggtgtattggtatttaaacaagaagaacaaaactgaagtgtcataa

SEQ ID NO: 36675 - protein, 438 aa, Bacillus cereus ZK
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPAVEIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAIFGSLFVIGSAIINDPLSCFLSIGIVFTGLPVYWYLNKKNKTEVS

SEQ ID NO: 36676 - DNA, 1329 bp, Bacillus licheniformis ATCC 14580
  CDS (1)..(1329)
atgaatgcagaagcaaacggactaaaaaaagagataggcttgttatttgcgctatctcttgtgattggaacgatcatcggttccggcgtgtttatgaagcccggcagcgtgctttcctattccggaaacgcacaaatcgctcttttcgcctggcttctcggcggaatcttgacgcttgccggcgggctgaccatcgctgaactgggcgcacagattccgaaaacaggcggtctttacacatatcttgaagaaatttacggcgagttctggggcttcttatgcggctgggtgcagatcatcatctacggaccggccatcatcggcgcacttggattatatttcggctcgcttgtggccaacttgttttcctgggataaatcctggactgcactcatcggcatcatcaccgtcgcctttttatgcatcgtcaacatcgtcggaacaaaatacggcggagcggttcagacgatcacaacgatcggaaagctgattcccattgtatgtatcattgtgttcggtctatggcagggcgatgaatatattttcagttcggtcacggagagcatcgccagccaaaacttcggggcggcggtattggcgacgctattcgcgtatgacggctggatccttcttgcagcactcggcggagaaatgaagaatccggaaaaagtgcttccgaaagcgatgacaggcggcatactgatcgtcactgcctgctatctgttcattaacttggcgctgcttcacattcttcctgccgatcagattgtcaagctcggcgaaaatgcgacaagcacagccgcgaccatgctgttcgggccgctcggcggcaagctgatatccatcggaattatcgtcagcatcttcggctgcttaaacggaaaggttctgtcttttccgcgcgtgatctttgcgatggctgagaaaaaacagctgcctttctcccgctggatctcgcatgttcatccggcattccatacgccttggatcgcagtcatcgtccagatgattatcgctgtcattttaatgatcatcagcaatcctgaaaagctgtcagaggtttcgatttttatgatttacatcttctatgtcatggcgtttttcgcggtatttattttgcggagacggaagaacggccaaggaagatcttacagcgtgccgctctatccttacctgcctgtagcggcgattctcgggtcattgtttgtccttgtcagcacgctcatcacagacttctacagctgcctgtggtcgatcttgatcggtctcgtcggtctcccggtttatttttggatgaaaaaaagaaataaaaacggctcagctgcctga

SEQ ID NO: 36677 - protein, 442 aa, Bacillus licheniformis ATCC 14580
MNAEANGLKKEIGLLFALSLVIGTIIGSGVFMKPGSVLSYSGNAQIALFAWLLGGILTLAGGLTIAELGAQIPKTGGLYTYLEEIYGEFWGFLCGWVQIIIYGPAIIGALGLYFGSLVANLFSWDKSWTALIGIITVAFLCIVNIVGTKYGGAVQTITTIGKLIPIVCIIVFGLWQGDEYIFSSVTESIASQNFGAAVLATLFAYDGWILLAALGGEMKNPEKVLPKAMTGGILIVTACYLFINLALLHILPADQIVKLGENATSTAATMLFGPLGGKLISIGIIVSIFGCLNGKVLSFPRVIFAMAEKKQLPFSRWISHVHPAFHTPWIAVIVQMIIAVILMIISNPEKLSEVSIFMIYIFYVMAFFAVFILRRRKNGQGRSYSVPLYPYLPVAAILGSLFVLVSTLITDFYSCLWSILIGLVGLPVYFWMKKRNKNGSAA

SEQ ID NO: 36678 - DNA, 1578 bp, Bacillus licheniformis ATCC 14580
  CDS (1)..(1578)
ttgtcaaatcagggcaatttcaaaaaaacgatctctctgcttgacctgattttgatcggcatgggtgcgatattcggatcggcttggctgtttgccgtcagcaatgtcgcttcaaaagccgggcccgctggaagcttttcgtggattatcggcggcgtcattatccttttaatcggcctcgtttatgccgagctgggagctgcgttgccgcggacgggcgggattatccgctatccggtgtatacccacggccaccttgtcggatatttgatttcatttatcacgattgttgcctatacaagcctgatttcgatcgaagtgacggctgtcaggcaatacgtagcctattggtttcccggtttgacgataaaaggttctgaatcgccgacgattatcggctggcttttgcagtttgcgctgctttgtttgttctttttactgaattattggagtgtcaaagcgtttgcgaaatcaaatttaattatttcggtttttaagtattttgttcctttgacaatcatcatcgtgttgatattccattttaaatcggcgaactttgcgggagaatttgcgccgtttggctttggcggggttcagacatccatttcgaccggcggggtgatgttcgcatacctcggtctacatccgatcgtttcggtcgccggcgaagtgaaaaatccgcagcggaacatcccggttgctctgctgatttgcatcattgtttcggcttgcgtctatacgatactgcaagtggtgtttatcggagccataccgactgatatgctaaatgacggatggaaagcgatcggcagggaattttctcttccgtttaaagatatcgcggtgctgctcgggatgggctggcttgccactcttgtcgttctggatgcgattttatcacccggcggaaacggcaatatttttatgaatacaacatcgcgcttggtttatgcatgggcgcggaacggcacattgttcaaaatctttgccaaggtgaataaaccaacgggaattccgcgtccgtcgttgtggctgtcgtttgcgctcgccgttttttggacgcttccgtttccgtcttgggacgcgctcgtcaatgtttgctctgttgccctgatcctctcctatgcgattgctccggtttcagcagcggcgctgaatgtgaatgccaagcagcttaaaaagcctctgcaaatcaaaggaatggctgtcatcgctcctgtctccttcatatttgcgtcgtatatcgtctattggtcagggtggaacaccgtgtcatggctgctcggatcacagcttgtgatgtttgctgtttattgcgcgtgtaaaaaatacgttccgcaggacgatgtttcgtttgcacagcagcttaaatcaagctggtggatcgtcggatattatgtgatgctcctgattttatcgtttctgggctcattcggtaacggccttggcctattgagaacgccggtcgatttaatcttgatcgcgctaggatcgattgcggtattttactgggcgaaatatacggcgctgccaaaggcagtcattgattatgatgagaaaaaagaagaaaccgtttaa

SEQ ID NO: 36679 - protein, 525 aa, Bacillus licheniformis ATCC 14580
MSNQGNFKKTISLLDLILIGMGAIFGSAWLFAVSNVASKAGPAGSFSWIIGGVIILLIGLVYAELGAALPRTGGIIRYPVYTHGHLVGYLISFITIVAYTSLISIEVTAVRQYVAYWFPGLTIKGSESPTIIGWLLQFALLCLFFLLNYWSVKAFAKSNLIISVFKYFVPLTIIIVLIFHFKSANFAGEFAPFGFGGVQTSISTGGVMFAYLGLHPIVSVAGEVKNPQRNIPVALLICIIVSACVYTILQVVFIGAIPTDMLNDGWKAIGREFSLPFKDIAVLLGMGWLATLVVLDAILSPGGNGNIFMNTTSRLVYAWARNGTLFKIFAKVNKPTGIPRPSLWLSFALAVFWTLPFPSWDALVNVCSVALILSYAIAPVSAAALNVNAKQLKKPLQIKGMAVIAPVSFIFASYIVYWSGWNTVSWLLGSQLVMFAVYCACKKYVPQDDVSFAQQLKSSWWIVGYYVMLLILSFLGSFGNGLGLLRTPVDLILIALGSIAVFYWAKYTALPKAVIDYDEKKEETV

SEQ ID NO: 36680 - DNA, 1668 bp, Bacteroides fragilis YCH46
  CDS (1)..(1668)
atgggattattcataaagaaaccctttgaagccctattggcagaggccaatgcgtcgggcagtaaatcattaaaacgagtattaggcccctggagtctggtagcactgggcgtcggtgttatcatcggagcaggactcttctcaatcaccggcaccgtagcagcgggctacaccggaccggccatcaccctttcattcgccatagctgcactcggatgctgcttcgcaggactctgctacgctgagttcgcttctatgattccggtggcaggcagtgcttatacgtattcatacgccaccatgggcgaactgatagcctggatcatcggctgggatctcgttctcgaatataccgtagcagccactaccgtcagtatcagttggagccgatatctcgtcgtctttcttgaaggactcgatatacatctgccgcaagccctgaccgcctgcccatgggatgggggaatcgtcaatatcccggcgttcctgatcgtagtgttgatgagcatcttcctgattcgcggaacagaaggcagctccatcttcaacggcatcgttgtatttctcaaagtatcggtgatcgccatattcgttgtcctgggctggaaatatatcaatgccgacaactatactccatacatccccgccaatacaggtacacttggcgaatacggtctctcgggtgtcctgcgtggagccgccatcgttttctttgctttcctgggattcgatgccgtcagtacggctgcacaggaaacaaaaaatccgaaacggaatatgccgatcggtatcctggtatcactcttggtatgtaccgtactttatatgctgtttgcccacgtaatgacaggagtagcccattataccgaatttagcggccagcagggcatcgcaccggtagccattgccatcgaacacatgggacatgccgatgcaacaggcatcattcatccggattatccgtggctgaaccgtgccatcgttcttgccatcctgttcggctattgttcggtcattatggttactttattggggcaaagccgtgttttcctgagcatgagccatgacggactacttccccccttcttttcgcacatcaacgagaagttccgtacaccggcgcgcagcaacctcctgtttatgctgatagtgggcctgctcgccgcatttgttccagcacgcctggcgggagagatgaccagcatcggtacactgatggctttcacactggtatgcgcagccgtcctcgtagtgcgaaagaccatgccgaacgtaccccgttcatttaaaactccgtttgtgcctctcgtccccattttgggaatactcacttgtctgtgcatgatgcttttccttccggccgatacctggatacgattagtactgtggatgctgatcggactggacatctatgtcggctacggcatgaaacacagtaaactggaacatggtgtgaaaaatcgccggggacaatcggcattgaacatgatcggcattgcactgtctctgctttgtgtcattaccggcttatggcatcagcagactgtaggttggaatgaaagtaaagtattgctgatcatctcgtttgttttcgcatttacgcattgtgcatattatatgatgcggatatggaaagggacaacaaaacaaacgaatgacaacggttaa

SEQ ID NO: 36681 - protein, 555 aa, Bacteroides fragilis YCH46
MGLFIKKPFEALLAEANASGSKSLKRVLGPWSLVALGVGVIIGAGLFSITGTVAAGYTGPAITLSFAIAALGCCFAGLCYAEFASMIPVAGSAYTYSYATMGELIAWIIGWDLVLEYTVAATTVSISWSRYLVVFLEGLDIHLPQALTACPWDGGIVNIPAFLIVVLMSIFLIRGTEGSSIFNGIVVFLKVSVIAIFVVLGWKYINADNYTPYIPANTGTLGEYGLSGVLRGAAIVFFAFLGFDAVSTAAQETKNPKRNMPIGILVSLLVCTVLYMLFAHVMTGVAHYTEFSGQQGIAPVAIAIEHMGHADATGIIHPDYPWLNRAIVLAILFGYCSVIMVTLLGQSRVFLSMSHDGLLPPFFSHINEKFRTPARSNLLFMLIVGLLAAFVPARLAGEMTSIGTLMAFTLVCAAVLVVRKTMPNVPRSFKTPFVPLVPILGILTCLCMMLFLPADTWIRLVLWMLIGLDIYVGYGMKHSKLEHGVKNRRGQSALNMIGIALSLLCVITGLWHQQTVGWNESKVLLIISFVFAFTHCAYYMMRIWKGTTKQTNDNG

SEQ ID NO: 36682 - DNA, 1404 bp, Burkholderia mallei ATCC 23344
  CDS (1)..(1404)
atgtctctcttccgcaagaaaaacgtcgaccgcatgatcgccggcgcgcaagcggccggcctcaagaaggcgctcggcgcggtcgacctcacctttctcggcatcggcgcgatcatcggcaccggcatcttcgtgctgagcggcacgggcgccgtgcaggccgggccggcgctgatgctgtcgttcgtgatcgcggcgatcgcgtgcggcctcgccgcgctgtcgtacgccgaattcgcgtcgacgatccccgtcgccggctcgatctacacgtattcgtacgcgactctcggcgagctcgtcgcatggatcatcggctgggacctgatgctcgagtacgggctcgccgcgtccgcggtgtcggtcggctggtccggctacctgcaatcgctgctgcagggcttcggcgtgtcgctgccgacggcgctcaccgccgcgccgggcgcgctgccgggcgtcgtcacgtatttcaacctgcccgcgttcgtcgtgatgctcgtcatcacgacactgctgtcgatcggcatccgcgaatcgacgcgcgtgaacaacatcatggtgttcatcaaggtcgccgtcgtgctgctcgtgatcgcggtcggcgtcttccacgtgacgcccgtgaactggaagccgttcatgccgcacggctggaacggcgtgttcggcgcggcggccgtgatgttcttcgcgttcatcggcttcgacgcggtgtcgtcggccgccgaggaggtgaagaacccgaagcgcgatctgccggtgggcatcatcgcctcgctcggcgtgtgcgcgttcctgtatgtcgcggtcgcggcgatcgcgacgggcatcgtgccgtgggcccagtacgcgaacgtctcgcatccgatctcgtacgcgctgcaggtggcgggcgagaagtgggtggcgggcttcatcgatctcggcgccgtcatcggcatgttgaccgtgatcctcgtgatgagctacggccagacccggatcatcttcgcgatgtcgcgcgacggcctgctgcccgccgcgctctcgcgcgtgcacccgcgcttcgcgacgccgttcctgacgacctggctcgtcggcctgttcttcggcctgatcgccgcgctgattccgctgaacgtgctcgccgagctgatcaacatcggcacgctcgccgcgttctcgatggtgtcgatcgcggtgctcgtgctgcgccgcacgcacccggatctgccgcgcgcgttccgctgcccgggcgtgccgctcgtgccgatcctcgcggtggccgcgtgcctgttcctgatgctgaacctgcagccggtcacgtggatcgcgttcctgacgtggctcgtgatcggcctgttcgtgtacttcgcgtactcgcgcagccgctcgaagctcgcgcacggcgcgcagcagcactga

SEQ ID NO: 36683 - protein, 467 aa, Burkholderia mallei ATCC 23344
MSLFRKKNVDRMIAGAQAAGLKKALGAVDLTFLGIGAIIGTGIFVLSGTGAVQAGPALMLSFVIAAIACGLAALSYAEFASTIPVAGSIYTYSYATLGELVAWIIGWDLMLEYGLAASAVSVGWSGYLQSLLQGFGVSLPTALTAAPGALPGVVTYFNLPAFVVMLVITTLLSIGIRESTRVNNIMVFIKVAVVLLVIAVGVFHVTPVNWKPFMPHGWNGVFGAAAVMFFAFIGFDAVSSAAEEVKNPKRDLPVGIIASLGVCAFLYVAVAAIATGIVPWAQYANVSHPISYALQVAGEKWVAGFIDLGAVIGMLTVILVMSYGQTRIIFAMSRDGLLPAALSRVHPRFATPFLTTWLVGLFFGLIAALIPLNVLAELINIGTLAAFSMVSIAVLVLRRTHPDLPRAFRCPGVPLVPILAVAACLFLMLNLQPVTWIAFLTWLVIGLFVYFAYSRSRSKLAHGAQQH

SEQ ID NO: 36684 - DNA, 1404 bp, Burkholderia pseudomallei K96243
  CDS (1)..(1404)
atgtctctcttccgcaagaaaaacgtcgaccgcatgatcgccggcgcgcaagcggccggcctcaagaaggcgctcggcgcggtcgacctcacctttctcggcatcggcgcgatcatcggcaccggcatcttcgtgctgaccggcacgggcgccgtgcaggccgggccggcgctgatgctgtcgttcgtgatcgcggcgatcgcgtgcggcctcgccgcgctgtcgtacgccgaattcgcgtcgacgatccccgtcgccggctcgatctacacgtattcgtacgcgactctcggcgagctcgtcgcatggatcatcggctgggacctgatgctcgagtacgggctcgccgcgtccgcggtgtcggtcggctggtccggctacctgcaatcgctgctgcagggcttcggcgtgtcgctgccgacggcgctcaccgccgcgccgggcgcgctgccgggcgtcgtcacgtatttcaacctgcccgcgttcgtcgtgatgctcgtcatcacgacactgctgtcgatcggcatccgcgaatcgacgcgcgtgaacaacatcatggtgttcatcaaggtcgccgtcgtgctgctcgtgatcgcggtcggcgtcttccacgtgacgcccgcgaactggaagccgttcatgccgcacggctggaacggcgtgttcggcgcggcggccgtgatgttcttcgcgttcatcggcttcgacgcggtgtcgtcggccgccgaggaggtgaagaacccgaagcgcgatctgccggtgggcatcatcgcctcgctcggcgtgtgcgcgttcctgtatgtcgcggtcgcggcgatcgcgacgggcatcgtgccgtgggcccagtacgcgaacgtctcgcatccgatctcgtacgcgctgcaggtggcgggcgagaagtgggtggcgggcttcatcgatctcggcgccgtcatcggcatgttgaccgtgatcctcgtgatgagctacggccagacccggatcatcttcgcgatgtcgcgcgacggcctgctgcccgccgcgctctcgcgcgtgcacccgcgcttcgcgacgccgttcctgacgacctggctcgtcggcctgttcttcggcctgatcgccgcgctgattccgctgaacgtgctcgccgagctgatcaacatcggcacgctcgccgcgttctcgatggtgtcgatcgcggtgctcgtgctgcgccgcacgcacccggatctgccgcgcgcgttccgctgcccgggcgtgccgctcgtgccgatcctcgcggtggccgcgtgcctgttcctgatgctgaacctgcagccggtcacgtggatcgcgttcctgacgtggctcgtgatcggcctgttcgtgtacttcgcgtactcgcgcagccgctcgaagctcgcacacggcgcgcagcagcactga

SEQ ID NO: 36685 - protein, 467 aa, Burkholderia pseudomallei K96243
MSLFRKKNVDRMIAGAQAAGLKKALGAVDLTFLGIGAIIGTGIFVLTGTGAVQAGPALMLSFVIAAIACGLAALSYAEFASTIPVAGSIYTYSYATLGELVAWIIGWDLMLEYGLAASAVSVGWSGYLQSLLQGFGVSLPTALTAAPGALPGVVTYFNLPAFVVMLVITTLLSIGIRESTRVNNIMVFIKVAVVLLVIAVGVFHVTPANWKPFMPHGWNGVFGAAAVMFFAFIGFDAVSSAAEEVKNPKRDLPVGIIASLGVCAFLYVAVAAIATGIVPWAQYANVSHPISYALQVAGEKWVAGFIDLGAVIGMLTVILVMSYGQTRIIFAMSRDGLLPAALSRVHPRFATPFLTTWLVGLFFGLIAALIPLNVLAELINIGTLAAFSMVSIAVLVLRRTHPDLPRAFRCPGVPLVPILAVAACLFLMLNLQPVTWIAFLTWLVIGLFVYFAYSRSRSKLAHGAQQH

SEQ ID NO: 36686 - DNA, 1296 bp, Burkholderia pseudomallei K96243
  CDS (1)..(1296)
atgaatgcccccgccgagcccggcgccacaaccgtgccgcaccgtgccggctcgctcacgatcctccagggcgccgcgctctatatcggcgcggtgctcggcaccggcgtcatcgcattgcccgcgctcgcggcggaggtcgcgggccccgcgtcgctgctcgcgtgggcggcgctcgtcatgctgtcgattccgctcgccgccaccttcgccgcgctcggcgcccgctatccggacgcgggcggcgtctccacctatgtgcgcaaagcgttcggcccgaaagcggcggccgtcgtcggctggtgcttctatttcgcggtgccggccggcgcccccgccgccgcgatgttcggcggcgcctacgtcgccgccgtcacgggcggcgcacacgcgacgatgatcgcatcggcggccgtgctgatcgcgctcgtcgcggccgccaacgcgttcggcgtcaccgtgtcgggccgcatgcagctcgtgctgtccgcgctgctcgtcgcgctgctcgtggccgccgtgctcgcctccgccccgcacgcgcgcgccgcgaacctgcatccgttcgcgccgcacggctggctcgcggtcggcgaggccgccgcgctgctcgtctggagcttcgccggctgggaggcgatcacgcatctcgccgccgaattccggcgccccgcgcgcgatctgccgcgctcgacgggcatcgcggtcgcggtggtcgggctgctgtacctgtcggtcgcggccgcgagcgtgctcgtgctcggtcccgccgcgggcgaatccggcgcgccgctcgcggcgctgatcgcgcgcgggatcggcggcaacgcgcaactgatcgcgacggcggccgcgctgctgctcacgctcggcacgatgaacgcctatttcgcgggcgcggcgaagctcggcgccgcgctcggccgcgacggcgcgctgccccgctggttcgcgcagggcagccagacgggcggcgtgccgcggcgcagcctcgccgtcatcgccgcgctcgccggctgcgcgctcgtcgcggccgtcgcgacgggcatgggaccgaagccgctcgtgctcgcgacatcgggcaatttcgtgatggtctacgtgctcggcgcggcggcggccacgaggctcctgccgcgcggcgggctcgcgcatcgcgcatcgatcgtcgcgctgctgtcggcgctcctgctgctcgcgacgacgggctggtatctgctgtggccgctgctgctgaccgcgtcggcaatcggctatcttttcatcacgggcaggcgggcggcggcgaagcggtga

SEQ ID NO: 36687 - protein, 431 aa, Burkholderia pseudomallei K96243
MNAPAEPGATTVPHRAGSLTILQGAALYIGAVLGTGVIALPALAAEVAGPASLLAWAALVMLSIPLAATFAALGARYPDAGGVSTYVRKAFGPKAAAVVGWCFYFAVPAGAPAAAMFGGAYVAAVTGGAHATMIASAAVLIALVAAANAFGVTVSGRMQLVLSALLVALLVAAVLASAPHARAANLHPFAPHGWLAVGEAAALLVWSFAGWEAITHLAAEFRRPARDLPRSTGIAVAVVGLLYLSVAAASVLVLGPAAGESGAPLAALIARGIGGNAQLIATAAALLLTLGTMNAYFAGAAKLGAALGRDGALPRWFAQGSQTGGVPRRSLAVIAALAGCALVAAVATGMGPKPLVLATSGNFVMVYVLGAAAATRLLPRGGLAHRASIVALLSALLLLATTGWYLLWPLLLTASAIGYLFITGRRAAAKR

SEQ ID NO: 36688 - DNA, 1398 bp, Methylococcus capsulatus str. Bath
  CDS (1)..(1398)
atgcgaatctttcgaaccaaggcagtttccacagacgactgctcaggcggcagcctcaaacgctgtctgggcgcgctcgacctgaccctgctcgggatcggcgcgatcatcggcaccggcatcttcgtgctgaccggcatcgccgccgccacccaggccggccccgccgtggttctgtccttcgtcttcgccggactggcctgcgccttcgccgccctggcctacgccgaactggcggcctgcgtcggcggctgcggcagcgcctatggatacagttacgcggctttcggcgagctgatcgcctggataatcggctgggacttgattctggagtacgcaatctcggtggccgcggtcgccaacggttggtcgggctatttcgccaacgcgctgaccgccgtcggtctggaattgccggactacctgaccaaggcgcccgagaagggggggatcatcaacctgccggcctcggcgatcatcatcctgctgatggctctgctcatcgccggagtgaaggagagcgcccgcctcaacaccgtcatggtgtcggtcaaagtactggccatcgcggtgttcgtcgccgtcgccagcgcccatgtcgatcccgcccattgggatccgttcctgccgttcggctggttcggccacgatgccgaaggcagaccgaccggcgtgctggccggagcgtcgatcgtgttcttcgcctacgtgggattcgatgcggtctccaccgccgcggaggaagcgcgcaacccgatgcgcgacgtgccgatcggcatcatcggttcgctggtgttctgcaccctgatctacatcgtggtggcgggactcctcaccggcgtcgtgccctacaccgaactcaacgtttcctcgccggtcgcgcatgcgctgcagctgctgggcatccgctgggcttccgggctggtcgccacgggagtgatcgcggggctcaccacggtcatgctggtgctctattacgcgctgacccggatcatcttcgccatgtcccgcgacgggttgctgtcgccctggttttccgccgtcaacacccgcacccagaccccggtacgggtgatcgtcctgtgcggcctgttcatctccctggtcgccggcttcgtgccgctgggcgaactggccgaactcgtcaacatcggcaccctgttcgccttcgtcctggtgtgcctgggtgtgatcgtgctccgcgtcacccggccggagctccaccggcccttcaagacacccgtcgtgccctggtttccgatcctgggcgccctctcctgcggcgccctgatggccttcctgccggccctgacttggctgcgtttcgtggtctggctgctgctggggatcgggatctatttcgcctactcctaccgccacagcaggctggcggactaa

SEQ ID NO: 36689 - protein, 465 aa, Methylococcus capsulatus str. Bath
MRIFRTKAVSTDDCSGGSLKRCLGALDLTLLGIGAIIGTGIFVLTGIAAATQAGPAVVLSFVFAGLACAFAALAYAELAACVGGCGSAYGYSYAAFGELIAWIIGWDLILEYAISVAAVANGWSGYFANALTAVGLELPDYLTKAPEKGGIINLPASAIIILLMALLIAGVKESARLNTVMVSVKVLAIAVFVAVASAHVDPAHWDPFLPFGWFGHDAEGRPTGVLAGASIVFFAYVGFDAVSTAAEEARNPMRDVPIGIIGSLVFCTLIYIVVAGLLTGVVPYTELNVSSPVAHALQLLGIRWASGLVATGVIAGLTTVMLVLYYALTRIIFAMSRDGLLSPWFSAVNTRTQTPVRVIVLCGLFISLVAGFVPLGELAELVNIGTLFAFVLVCLGVIVLRVTRPELHRPFKTPVVPWFPILGALSCGALMAFLPALTWLRFVVWLLLGIGIYFAYSYRHSRLAD

SEQ ID NO: 36690 - DNA, 1422 bp, Methylococcus capsulatus str. Bath
  CDS (1)..(1422)
atgccgtcgccagacagagggccacaggagctcaggcgtgtcctgggctggaccagcgcgggcgcgatcatggcgggttccgtgatcggtactgccatattcctggtaccttcgaccatcgtccgcgaactcgactcggtgggctggacatttttcgtctgggtgttgggtggcttgttgtcgctgggcggggcgctcagctacgccgaattgggcgccgccttccccgaagcagggggcgagtacgcctttctccgccgcgcctatggcccgttgtggggctttctgttcggctggcagcaggtcgtcatcggcaagaccggttccatcgccaccatcgcgaccggcttcgccctgttcctcgggtttttcgtcgacggcttgcagcgggaatggctgcatctgtcctggggcgaggtcggctggggcgtgacgggcctccaattcgtcgcgatgacggcggttgcatcgttctccctgatcaactgtttcggtgtcggccgcggcggtgcggtgcagagtttcctgacggtactgaaggtcgcggccattgtggctttggccgtgctggtgctcggcgccggcgggggttcctgggaccatttccggcaggctccggaacaccctgcgtggaccggctggggtgctttcgccgccgcactggccgcagtgctttgggcctacgacggctggaacaacctgaccctggtgggctcggaaatccgcgaccctgatcgcaccattccgagggtgttcctgttgggcttgctgggcgtgatgggggtttatctgctggccaatttggcctatttctatgccctaccgccggaagccttgaagcgctcggagcgggtggcgcaggacgtggcgcagctggtgttcggtgacttcgggggcgccgcgatcaccgccgccgccgtcgtatcgaccctggcggcgctcaacggctcgatcctgtcgggcgcccgggtgtcttatgcgatggcgcgggacggactgttcttcagcccgctggcgcgcctccatccggtccaccggacgccggtcaatgccctgatcgtccaggcgtcgttcgcgagtttcctgattctgctgttcgggcaggaccgtgccggtttcgaccggctgttcaactatgcagtgttcgggctctgggcgttttatggcatcaccgcgctcgccgtgatcgtactgcggcgcacctcgccggaggtggttcggccttaccgcgtggcgggttatccgtgggtcccgctgattttctttgcggtcgccggtttgttctgcctcggcatgatcttccagaatccctcagaaaccgccatcggcctggttttcctgctgctgggcatccctttctatctttactggtgctccggcggcaaggccgaggctcatcgtaagtcgagtccaggggaatga

SEQ ID NO: 36691 - protein, 473 aa, Methylococcus capsulatus str. Bath
MPSPDRGPQELRRVLGWTSAGAIMAGSVIGTAIFLVPSTIVRELDSVGWTFFVWVLGGLLSLGGALSYAELGAAFPEAGGEYAFLRRAYGPLWGFLFGWQQVVIGKTGSIATIATGFALFLGFFVDGLQREWLHLSWGEVGWGVTGLQFVAMTAVASFSLINCFGVGRGGAVQSFLTVLKVAAIVALAVLVLGAGGGSWDHFRQAPEHPAWTGWGAFAAALAAVLWAYDGWNNLTLVGSEIRDPDRTIPRVFLLGLLGVMGVYLLANLAYFYALPPEALKRSERVAQDVAQLVFGDFGGAAITAAAVVSTLAALNGSILSGARVSYAMARDGLFFSPLARLHPVHRTPVNALIVQASFASFLILLFGQDRAGFDRLFNYAVFGLWAFYGITALAVIVLRRTSPEVVRPYRVAGYPWVPLIFFAVAGLFCLGMIFQNPSETAIGLVFLLLGIPFYLYWCSGGKAEAHRKSSPGE

SEQ ID NO: 36692 - DNA, 1293 bp, Methylococcus capsulatus str. Bath
  CDS (1)..(1293)
atgcacgaagtacgtcgattgggtctgccttccgccagcttgctggtggtggccagcatggtcggttccggtgttttcaccaccggtggcttcctgctggaggcgttgcggtcgccttggctggtcttgctggcctggctggccggcggagcgatcgccgcctgcggcgccctgagttacggcgcgctggcgcagcgtttcccggaatcggggggagaatatctgtttctgtcccgtaccctgcatcccgccgccggcaatgtggccgggtgggtgtccgtggtggtgggtttttccgcgcccatggctgccgccgcctacggtttcggtgagtacctggcgccctggatgccctggcatgcgcctcggctcaccggaacgctgctgctggccgcgttcgccttgctccacggcgcacacggtccagcgggtgcctgggtgcagaacttcgccgtcgtgttcaagcttgcgctcatggcgggtttcgtcctgctggcatggccgcgactggcccttgaagcgggcgccgcggcgcgcggcgaggggggaggcttcggcgcttttttttctgcgctcatctgggtatcgttcagctattccggctggaacgccgccgtctacctcggcggcgaagtgcgcgatcccgaacgcaacctgccgcgggcgttgctgctgggcaccggcctggtcaccgtgctttatctggcgctgaatactgccttcatgttttctgccgctcccgaggcgctggcgggcaaggcggacatcggccgcgccgcggcgctcgccctgggcggctccgtctgggcggatttcatgaccctgctggtggctttcgccttgtccctctcggtctcggccatgatgatggccgggccccgcgtcagtgcgtgcatggcgcgggacggccatctgccaccctggctgtcgctgcatgaagatggtacgccccgacgggcgaccttccttcaatgcgctctgtctttgctgctgctgtggagcgcgggcttcaaggacttgctgacctacaccggttttaccctcgggttgagcactgcggcgacggtctgcggcctgatccggctccggctcaaggaaggcgatgcctgtcccgtcatcggctggccctgggcgccgctgatctacctgctggcggtcctcgccatgaccgccgccgccttggtccgccagccccaggccgccctcggaggtctggccacgttgccggcggtgtgggtgcttcggcgcatcggtgcgagctggtctggaaatgcccgctccgaaacccggtag

SEQ ID NO: 36693 - protein, 430 aa, Methylococcus capsulatus str. Bath
MHEVRRLGLPSASLLVVASMVGSGVFTTGGFLLEALRSPWLVLLAWLAGGAIAACGALSYGALAQRFPESGGEYLFLSRTLHPAAGNVAGWVSVVVGFSAPMAAAAYGFGEYLAPWMPWHAPRLTGTLLLAAFALLHGAHGPAGAWVQNFAVVFKLALMAGFVLLAWPRLALEAGAAARGEGGGFGAFFSALIWVSFSYSGWNAAVYLGGEVRDPERNLPRALLLGTGLVTVLYLALNTAFMFSAAPEALAGKADIGRAAALALGGSVWADFMTLLVAFALSLSVSAMMMAGPRVSACMARDGHLPPWLSLHEDGTPRRATFLQCALSLLLLWSAGFKDLLTYTGFTLGLSTAATVCGLIRLRLKEGDACPVIGWPWAPLIYLLAVLAMTAAALVRQPQAALGGLATLPAVWVLRRIGASWSGNARSETR

SEQ ID NO: 36694 - DNA, 1338 bp, Nocardia farcinica IFM 10152
  CDS (1)..(1338)
gtgcgccggggtatccgacccggtatgccgatgaccttgaaacgggtggtgcgcacgccgctgctgtacttcttcatcctcggtgacgtgctgggggcgggagtgtacgtgctggtcggtcagatcgcggcggcctcgggcggcgcggtgtgggtgccgctgctgaccgcgctggtgctggcctgcctgaccgcgggctcgtatgccgaactggcgacccgctttccgcgggcgggtgggtcggcccactacgtgacgctggcgttcgggcccgcggcgggcagtttcatcgggttctgcatgctggccgcgggggtggtgtcggtcggcgcgctggcccgcggcttcgcctccgattacctggccgagctggtgacgctgccgacggtcgtcgtcgtggtggtgttcctgctcgcgctggccgcgctgaacctgcgcggcatcaaggagtcgctgggtgccaacgtcgccgccaccgcggtcgaactgggcgggttgctgctggtgatcggcctgggcacctgggtgctggtgcgcggtgacggcgatccgggccggctcacccagctgggtaccgccgagcagggcgtggtcggggcgacgctggcgggcgcggtgctggcctactactccttcgtcggcttcgagacctcggtcaatctcgccgaggaggtcagcgatccgcgccgcacctacccgcgcgcgttgttcggcgcgctgctgaccgccggtgcggtgtacgtggcgatcggcgtggtcgccgcggccgcggtgcccaccgatgtgctggcgaactccaccggcccgctgctggaggtggtgcgggtggccggcggtgtgcccgagcggctgttcgctgtcatcgcgctggtcgccgtcgccaacggtgcgctgctcaccgggatcatggcctcgcggttggcctacggcatggcccgcgacgggctgctgcccgcggcgctgggccgggtgctcgcggtgcggcgcaccccgtgggtcgcgatcctgtcgacctcggcggtgtcgctggtcctcgcgctgaccggcgaggtggccgcgctcgccgccaccctggtgctgttgctgctggtcgtgttcggcgcggtgaacatcgccgtgttgatcctgcggcgcgaacccgcgaccggcgaccacttccgggtgccgacggtggtgccgtggctgggactggcgtcgtgcctgttcctgttcacccgcatcgaggcggaggtgtgggtgcgcggggccgtgctgctcgggctcggtctggcgctcggcgccgtcaacgccgtgcgcgggcgtgtccgggcccggcgcgagcccgagccggtgggttga

SEQ ID NO: 36695 - protein, 445 aa, Nocardia farcinica IFM 10152
MRRGIRPGMPMTLKRVVRTPLLYFFILGDVLGAGVYVLVGQIAAASGGAVWVPLLTALVLACLTAGSYAELATRFPRAGGSAHYVTLAFGPAAGSFIGFCMLAAGVVSVGALARGFASDYLAELVTLPTVVVVVVFLLALAALNLRGIKESLGANVAATAVELGGLLLVIGLGTWVLVRGDGDPGRLTQLGTAEQGVVGATLAGAVLAYYSFVGFETSVNLAEEVSDPRRTYPRALFGALLTAGAVYVAIGVVAAAAVPTDVLANSTGPLLEVVRVAGGVPERLFAVIALVAVANGALLTGIMASRLAYGMARDGLLPAALGRVLAVRRTPWVAILSTSAVSLVLALTGEVAALAATLVLLLLVVFGAVNIAVLILRREPATGDHFRVPTVVPWLGLASCLFLFTRIEAEVWVRGAVLLGLGLALGAVNAVRGRVRARREPEPVG

SEQ ID NO: 36696 - DNA, 1488 bp, Nocardia farcinica IFM 10152
  CDS (1)..(1488)
atggcgatctcgagtccgcgccgccgtagcagcctgctacgtaccaagtcggtcgagcaatcgatccgcgacaccgacgaacccgattccaagctgcgcaaggacctgaccgcctgggatctgacgatcttcggtgtcgcggtcgtcgtcggcgccggcatcttcaccctcaccgcgcgcaccgcgggcaacgtcgcgggcccctcggtctcgctggccttcgtcttcgccgccatcgcctgcggtctcaccgcgctctgctacgccgagttcgcctccaccgtgccggtcgcgggcagcgcctacaccttctcctacgccaccttcggcgagctggccgcctggatcatcggctgggacctgttcctggaattcgccctcgcggtatcggtggtgtccaaaggctggtcgcagtacctcggcgaggtactgaacatcaccccgatcgtcgacctcggcgggctcgacttcgactggggcgcggtgcttctcatcgccgtgctgtgtgtgctgctggcgatgggcaccaagctctcctcgcgcgtctcggccatcgcggtcgcgatcaagctcgcggtgatcgcgctggtgatcgccgtcggcctcgcctacttcgacaccgacaacctctcgccctacatcccgccgtcggaggcaggccagggcggcgagggcatccaccagtcgctgttctcctacctgaccggcgccggcaacagcaccttcggctggtacggcctgctcgccgccgccagcctggtgttcttcgcgttcatcggcttcgacgtggtcgccaccaccgccgaggagaccaagaacccgcagcgcaacgtgccccgcggtatcctcggctcgctggccgtggtgaccgtgctctacgtcgccgtctccctggtgctcaccggcatggtctcctacaccgaactctccggcgagaacgccaccctggccaccgccttcggcctgcacggcgtcacctgggcggagaagatcatcgccgtcggcgccctggccggtctcaccaccgtggtcatggtgctctacctcggccagacccgcgtgctgttcgccatgtcccgcgacggcctgctcccgcgcccactcgcccacaccggccgccacggcaccccggtgcggctcaccatcatcgtcggcgtcgcctgcgccgtgctcgccgggttcgtcgacatgggcgcgcttgaggaaatggtgaacatcggcaccctgttcgcgttcgtcctcgtcgccatcggcgtcatcatcctgcgccgcacccgccccgacctgccccgcggcttccgcgtcccgctggtcccgctcgtccccatcctggccgtactcgcctgcctgtggctgatggtcaacctcaccgtcgaaacctggatccgcttcatcatctggatggcgctgggcctgatcatctacttcgcctacagccgccggaactcgttgctcggcaaggaggaagtcagcctccgcaaggagtga

SEQ ID NO: 36697 - protein, 495 aa, Nocardia farcinica IFM 10152
MAISSPRRRSSLLRTKSVEQSIRDTDEPDSKLRKDLTAWDLTIFGVAVVVGAGIFTLTARTAGNVAGPSVSLAFVFAAIACGLTALCYAEFASTVPVAGSAYTFSYATFGELAAWIIGWDLFLEFALAVSVVSKGWSQYLGEVLNITPIVDLGGLDFDWGAVLLIAVLCVLLAMGTKLSSRVSAIAVAIKLAVIALVIAVGLAYFDTDNLSPYIPPSEAGQGGEGIHQSLFSYLTGAGNSTFGWYGLLAAASLVFFAFIGFDVVATTAEETKNPQRNVPRGILGSLAVVTVLYVAVSLVLTGMVSYTELSGENATLATAFGLHGVTWAEKIIAVGALAGLTTVVMVLYLGQTRVLFAMSRDGLLPRPLAHTGRHGTPVRLTIIVGVACAVLAGFVDMGALEEMVNIGTLFAFVLVAIGVIILRRTRPDLPRGFRVPLVPLVPILAVLACLWLMVNLTVETWIRFIIWMALGLIIYFAYSRRNSLLGKEEVSLRKE

SEQ ID NO: 36698 - DNA, 1296 bp, Legionella pneumophila str. Paris
  CDS (1)..(1296)
atggatatggatattaaacataagcctttgaagcgtgaactcagtctatttggcgctactatgatggggcttggctctattgtcgggacgggtgtttttgtcagcatcggaattgcggcgggtgtcacaggaccatccgtcattcttgctattgctttggcagcacttgttgctacctgtaatgcattctccagcgctcaacttgctgcaaatcatgctgttagtggaggtacttatgaatatggatatcgttatttacatcctgcttttggttttactgccggttggatgtttttatgtgcgaagagtgcttctgctgcaacggcagcgcttggttttgccggttattttattcacctgtcaggtttagagacggtgcctgtcatacctatcgctttagcagtgtctatcacgttaatacttttagtcttaagtggactcagaagaacaaatacagtgaatattattattgtaatgattacattgataaccttaaccgtttttataataagcggattacctgatttcatgcaaaggggaactgctaatctgaggcccttctttcctgtttcaaaacaagaaggattaagtcattttttttatgccactgctttaatgtttgtggcttataccggttatgggagaattgcaacattagcggaagaggttaaaaatccaggaaaatttattcctgcagcgattattatcactctgatggtgagcgccgtactttatattctggtgggtcttgttgctattggagctgtaggggttgaaaaactggcccaagtgactgaaacaaacgcaactcctttagagagcgcggcacaagccattggtatccccggattgagtgttctggtctccattggggcatgcacggccatgttaggggtattactcaatttaatacttgggttatctcgtgtggctttagctatgggtagaaaaggagatttaccgaagattttttgctatgtatcagaaacaagacatgttcctgtttcctctgtcattggagttggagttgtaattattgctctggtgttgactggaagtgttgaaacaacatggacattcagtgcgtttacagttttaatctattatgcaattactaacctcgctgccttacatttgcctaaagaggagcaattgtatccacctctgtttgctatcggaggcttactgtcctgccttttcctggcgttttgggttccaattggagtatggataacgggaatcagtttacttgtcctggggcttctttggaaagttgttgccaatcgctttttataa

SEQ ID NO: 36699 - protein, 431 aa, Legionella pneumophila str. Paris
MDMDIKHKPLKRELSLFGATMMGLGSIVGTGVFVSIGIAAGVTGPSVILAIALAALVATCNAFSSAQLAANHAVSGGTYEYGYRYLHPAFGFTAGWMFLCAKSASAATAALGFAGYFIHLSGLETVPVIPIALAVSITLILLVLSGLRRTNTVNIIIVMITLITLTVFIISGLPDFMQRGTANLRPFFPVSKQEGLSHFFYATALMFVAYTGYGRIATLAEEVKNPGKFIPAAIIITLMVSAVLYILVGLVAIGAVGVEKLAQVTETNATPLESAAQAIGIPGLSVLVSIGACTAMLGVLLNLILGLSRVALAMGRKGDLPKIFCYVSETRHVPVSSVIGVGVVIIALVLTGSVETTWTFSAFTVLIYYAITNLAALHLPKEEQLYPPLFAIGGLLSCLFLAFWVPIGVWITGISLLVLGLLWKVVANRFL

SEQ ID NO: 36700 - DNA, 1185 bp, Legionella pneumophila str. Paris
  CDS (1)..(1185)
atgcacttaaaacgaactttatcattaacactgctagccttttatgggcttggaactatattgggcgcaggaatttatgcccttgttggtgaggtcgcaaaagaggcggcacaatttaccccactatcattcttaattgcgtccatcatcgcgctttttactgccatttcttacgcagaattaagctcaaggttaccgcatagcgcaggctctgctctttacgtgcgtagggcattccatcaaaaatggctatctggcttaataggctggatcgtggtcctaacaggtatcatttcagcagccaccctatcccatggttttgtcaaatattttcaattgttctttccattaccaccttctctcatcatcactatattaactgtcattttagcgggggttgctatttggggtattcgtgaatcagcgactcttatcctgttcatgacgctcatggaagtgggtggattattgatgattatttattacggtcgttattcattagcctctatcgacatcaaatccttctcttttcctcattcttttgatggagtgcttattggagcttttattgcgttttatgcttttattggttttgaagatatggttaataccgccgaagaaacaataaatcctgaaaaaactcttccaaaagctatttttcttgctttaatatccgcaaccattttatatattgcagttgcctgggttatcgtcttgaccataccatccaatactttagtcaaaacagacatgccccttattgaaattattaagcttcagggacaatctcccttgttgttttcaatcattgcattaatttctattaccaatggaattctggtgcaaattattatggcttcacggcttatttatggtatggccaatcaacaaaatgcccctcaaatattctcttctgtctattccaaaactcaaacaccagtccactcgaccttgctggtatttcttatgattttactctttgcctatgctctccccattactaccttagccaaattaaccagcagtatcatattatgtatttttatcatcattcatgcctcgctaattaaaattaaactgacagaaaagaaaccaacaaacgccatttcattccctattgttttcccgatgatttcgattttattaaccctggcctttttgatcatacagttttttttaaagtag

SEQ ID NO: 36701 - protein, 394 aa, Legionella pneumophila str. Paris
MHLKRTLSLTLLAFYGLGTILGAGIYALVGEVAKEAAQFTPLSFLIASIIALFTAISYAELSSRLPHSAGSALYVRRAFHQKWLSGLIGWIVVLTGIISAATLSHGFVKYFQLFFPLPPSLIITILTVILAGVAIWGIRESATLILFMTLMEVGGLLMIIYYGRYSLASIDIKSFSFPHSFDGVLIGAFIAFYAFIGFEDMVNTAEETINPEKTLPKAIFLALISATILYIAVAWVIVLTIPSNTLVKTDMPLIEIIKLQGQSPLLFSIIALISITNGILVQIIMASRLIYGMANQQNAPQIFSSVYSKTQTPVHSTLLVFLMILLFAYALPITTLAKLTSSIILCIFIIIHASLIKIKLTEKKPTNAISFPIVFPMISILLTLAFLIIQFFLK

SEQ ID NO: 36702 - DNA, 1185 bp, Legionella pneumophila str. Lens
  CDS (1)..(1185)
atgcacttaaaacggactttatcattaacactactggccttttatggacttggaaccatattaggcgcgggaatttatgcccttgttggtgaagttgcaaaggaggcagcacaatttacccctctatccttcttaatcgcctccatcatcgctttttttactgccatttcttatgcggaactaagctccagattaccgcttagtgcaggctccgctctttacgtgcggagagcattccagcaaaggtggctatctggcttaatcggttggatagtggttttaacaggtgtgatctcggcagccaccctatcccatggctttgtcaaatattttcaattgtttttacccttaccgccttcccttatcatcactattttagttgtcattttagcgggagttgctgtttggggtattcgtgaatcagcgactcttatcctgttcatgacacttatggaagtgggtggattattgatgattatttattacggtcgttattcattagcttctatcgacatccaatctttctcttttcctcattcttttgatggggtgcttatcggagcttttattgcgttttatgcttttattggttttgaagatatggtgaataccgccgaggaaacaataaatcctgaaaaaactcttccaaaagctatttttcttgctttaatatccgcaaccattttatatgttgtggtcgcttgggttatcgtctcgaccataccatcccatactttagtcaaaacggacatgccccttattgaaattattaagcttcaggggcaatcccccttgttgttttcaatcattgcgctaatttctattaccaatggaattctggtgcaaattattatggcttcgcgacttatttatggtatggctaatcaacaaaatgcccctcaaatattctcctttgtttattccaaaacgcaaacaccagccaactcgaccttactggtgtctcttattattttactatttgcctatgccctccctattacaaccctggctaaattaaccagcagcatcatattgtgtatttttatcatcattcatgcctcattaattaaaatcaaactgacagaaaaaaaatcaccagaggctatttcattccctattgttttcccgatgatttccattttattaaccctgacatttttaggcatacagttttttttaaagtag

SEQ ID NO: 36703 - protein, 394 aa, Legionella pneumophila str. Lens
MHLKRTLSLTLLAFYGLGTILGAGIYALVGEVAKEAAQFTPLSFLIASIIAFFTAISYAELSSRLPLSAGSALYVRRAFQQRWLSGLIGWIVVLTGVISAATLSHGFVKYFQLFLPLPPSLIITILVVILAGVAVWGIRESATLILFMTLMEVGGLLMIIYYGRYSLASIDIQSFSFPHSFDGVLIGAFIAFYAFIGFEDMVNTAEETINPEKTLPKAIFLALISATILYVVVAWVIVSTIPSHTLVKTDMPLIEIIKLQGQSPLLFSIIALISITNGILVQIIMASRLIYGMANQQNAPQIFSFVYSKTQTPANSTLLVSLIILLFAYALPITTLAKLTSSIILCIFIIIHASLIKIKLTEKKSPEAISFPIVFPMISILLTLTFLGIQFFLK

SEQ ID NO: 36704 - DNA, 1455 bp, Haloarcula marismortui ATCC 43049
  CDS (1)..(1455)
atgagtaagagccagacgcggtcgcccgaagctgaacttgggctacttgacgcgacgatgatcgggatgggtgcgatgatcggggccggtattttcgtgttaacggggttggccgccgaaatcgctggaccagccgcgatcctcgttttcgcactgaacggcgtcgtgacggcattcacgggactgtcctacgcggagcttgccgcctcgattccgaagagcggcggtggctacgcgttcgtgcgggagatattcgacgacttcgcctcgttcatcatgggttggatgctctggttcgcctacatgattgcgggggcactgtatgcgctgggctttgcgccgaactttctcgaactgttgcacgtctacgacgtggtcccgtcaccggacgagatcggcgctgttgcagttccggtcattgatgtcgggctcccaccggcctttttgctggcgtttatcgcggttctgggcctcgtggcgctcaacgccgtctcgacggctgccagcggtagtgtcgagacgattttcacaatcatcaaagtctccattctggtcgtgttcgtcgcgttcgggctcacttcaccgatgttttcgggggccgaatttcagccgctgtttccggaagggagtggagcggctgccgtcttgccggcgatgggactcactttcatcgctttcgagggatacgacctcatcaccactgtcacggaggaagtacagaacccgcgggaaaacatccccaaagcgatttttattagcctcgctgtgactgtcgtcgtctatctggccgttgtgacagtcgccatcgggacgctcggggccgagggactcgccgacgctggcgaagccggcatcgccacggcagcaacatcgttcatgccgaccgggttaccgattatccagaacggtggggcactcatcgtctttggcgctgtgttctcgacgctcactgccctcaacgccgtcgttatcgcgtcgtcacgcgtcgcgttctcgatggggcgtgaagggcagttactcccctcgattggccagatacaccatcgctacgggacgccgttcgtcgccatcctcaccagtgccatcgtgatgcttggctcagtcgcactgccgacacagagcgccggcaatatgtcgagcctgttcttcctgctctcgtttatcatcgtcaacgtcgcggtcatcagactccgcagggaacgaccgaacatgaaccggccgtacgagatgccgttctacccggcaccgccgataatcggtatcgcactcaatctgattctgacgggggtgctgatagagttcctgctccggacggatccactggcactgggactcagcgtcgcatggatcttgctcggcgcagtcgtgtatttcgccctcaaacggataagacagcaatcggaccgtgaacaagcgactgccgtcagcgaaataaaacccgaggctgaagactaa

SEQ ID NO: 36705 - protein, 484 aa, Haloarcula marismortui ATCC 43049
MSKSQTRSPEAELGLLDATMIGMGAMIGAGIFVLTGLAAEIAGPAAILVFALNGVVTAFTGLSYAELAASIPKSGGGYAFVREIFDDFASFIMGWMLWFAYMIAGALYALGFAPNFLELLHVYDVVPSPDEIGAVAVPVIDVGLPPAFLLAFIAVLGLVALNAVSTAASGSVETIFTIIKVSILVVFVAFGLTSPMFSGAEFQPLFPEGSGAAAVLPAMGLTFIAFEGYDLITTVTEEVQNPRENIPKAIFISLAVTVVVYLAVVTVAIGTLGAEGLADAGEAGIATAATSFMPTGLPIIQNGGALIVFGAVFSTLTALNAVVIASSRVAFSMGREGQLLPSIGQIHHRYGTPFVAILTSAIVMLGSVALPTQSAGNMSSLFFLLSFIIVNVAVIRLRRERPNMNRPYEMPFYPAPPIIGIALNLILTGVLIEFLLRTDPLALGLSVAWILLGAVVYFALKRIRQQSDREQATAVSEIKPEAED

SEQ ID NO: 36706 - DNA, 2265 bp, Haloarcula marismortui ATCC 43049
  CDS (1)..(2265)
atgagcgacgacgaactggcgaaagacctcgggctggtgtcggcgatgaccatcggcattggaacgatgatcggtgccggaatcttcgtccttcctggtgtggccgcgaacgcggctggcccggttgtcgtggtctccttcgtcgtcgggggactgattgcgatggtaaacgcactctcagtgtcggaactcggcacagcgatgccgaaagccggcggcgggtactactacatcaacaagtctctcgggccgctgtttggctcgatagctgggatgggtgactggatggggttggccttcgcctcggccttctactgtatcgggttcggccagtatctcgccgtcttcgtcccgctgccggaagtcgcattcctcaatcccatccagataggagcgctcatcgcgggggcaatattcgtcgctgtcaactacatcggcgcgaaggaaaccggtggtgttcagacggtcattgtctttattctgctctcgattctcactgtctttgccgttgcgggctttttcgccttcgactacgcgacgctcgccggcgcagacggcttagcaccgttcgggaccggcgcgattcttccggcgacggcactcgtgttcgtctccttcctagggtacgcaaagatcgcgaccgtggctgaggaactcaagaatccggggcggaacctcccaatcgctatcatcggcagtgtcggcatcgtgacggtcatctacgctatcctcgtgtcgatgatgctgggcgtcgttccgtggccggagcttagtcaggacgcgccggttgcacaggccgcacaactcgcgttcccggaatccatcggtccaatcggtggtgtcgccgccggtgcggcagcggtgatgacggttggcgcgttattggcaacggcgtcctctgcgaacgcgtcgattctcgcctcggctcgtatcaatttcgcgatgggccgggataagatcgtcacgaactggctcaacgagattcacccgaactacgccacgccatatcgctcgatcctcgtcaccggcggactcatcatcgtgttcatcgcgttcctcgggcgggacatcgaggtgctggcgaaggcggctagcgtcctgcacctcatcgtttacgccctgctgaacgtggggctcatcgtcttccgcgagaccgatgcgccggagtacgacccggatttcacggtgccactgtaccccatcaccccgatactcggtgcggtcctctcgctcggcctcgtcgcattcatggatagcatcgaaatcgcactgtcggccggtttcgtgctcgtcgcggtcgtgtggtacttcgtctacgcgcgcgggaaaaccacgcaaaaaggcgtgctctctgactatatcagcgaccgggaggaacagctcccggaccaagtggtgaacgcggccgacgcggtcgcaccgaacggagctggcggaccgactatcatggtcgctctggcgaacccacgtaccgagagcgcactgattaccctcgcaagcgcgctggcgcaacacgaggacggccgggtactcgcaacccacatcgcgactgtcccggaccagaccgcgctcgaaaccgccgccgcgaacagagaccggatcgacgcaacatcagagagcctgctggacaccgcgaaggccgatgccgaggcgttcgatgttccgatagagacgaagacgattctctcacaccggggtatcgaggaagtgtttgatgcggcccggacgaaccacgccgacaccgttgtcatgggctacggcgggactcagtttgccggcggccgcgccgaaggcacgctggatgaactggcccacgacttgccctgtgatttcctcgtgctggacgggcaggacctcgacctcagtgatgtcttggttccgaccgctggtggtctctcatcagacctctcggctgcggtcgccaaagctctcgaagaaacgttcggtgtggccgtctcactgctccacgttgtcgaccccggcgaggaggagagcggccgccagttcatgtacgagtgggcggctgagcacggcctgtcggacgccgaactccgtatcgagaccggtgacatcgaagccactattgaacgtctcggtcgtgactacagtctggttattgttggtgccacagagcggggattgctgtcacgtattgtccgtggctcgctggtgttcgatgtcatcgagacgctcgatacaccagtattactggccgagcgcccgtcgtcgcggtccctccgggagcggctgtttggtcgggagtaa

SEQ ID NO: 36707 - protein, 754 aa, Haloarcula marismortui ATCC 43049
MSDDELAKDLGLVSAMTIGIGTMIGAGIFVLPGVAANAAGPVVVVSFVVGGLIAMVNALSVSELGTAMPKAGGGYYYINKSLGPLFGSIAGMGDWMGLAFASAFYCIGFGQYLAVFVPLPEVAFLNPIQIGALIAGAIFVAVNYIGAKETGGVQTVIVFILLSILTVFAVAGFFAFDYATLAGADGLAPFGTGAILPATALVFVSFLGYAKIATVAEELKNPGRNLPIAIIGSVGIVTVIYAILVSMMLGVVPWPELSQDAPVAQAAQLAFPESIGPIGGVAAGAAAVMTVGALLATASSANASILASARINFAMGRDKIVTNWLNEIHPNYATPYRSILVTGGLIIVFIAFLGRDIEVLAKAASVLHLIVYALLNVGLIVFRETDAPEYDPDFTVPLYPITPILGAVLSLGLVAFMDSIEIALSAGFVLVAVVWYFVYARGKTTQKGVLSDYISDREEQLPDQVVNAADAVAPNGAGGPTIMVALANPRTESALITLASALAQHEDGRVLATHIATVPDQTALETAAANRDRIDATSESLLDTAKADAEAFDVPIETKTILSHRGIEEVFDAARTNHADTVVMGYGGTQFAGGRAEGTLDELAHDLPCDFLVLDGQDLDLSDVLVPTAGGLSSDLSAAVAKALEETFGVAVSLLHVVDPGEEESGRQFMYEWAAEHGLSDAELRIETGDIEATIERLGRDYSLVIVGATERGLLSRIVRGSLVFDVIETLDTPVLLAERPSSRSLRERLFGRE

SEQ ID NO: 36708 - DNA, 2205 bp, Haloarcula marismortui ATCC 43049
  CDS (1)..(2205)
atggccaaggacctggaacgcgacctcggactgctgtcagtagtagcgatatctatcggcgcgatggttggcagtggcatcttcattttgccggcgctggcggtgaaagacgccggagccggcatcattgccgcctacctgctcgcgggcgtgcttgtgcttcctgccgcactcagcaaggccgaaatggcgacagccatgccggaggccggcggcacatacgtctatatcgagcggtcaatggggccgctgcttggcaccgtctccggcctcggcacatggttctcgctctcgtttaagggcgcgctcgcactcgtcggtggcgtgccgtacctcgttcttctcttcgacctgccgatccgcccggttgcaatcacgctcgccgccgtcctcatcctcgtcaacatcctcggcgcggaacagaccggacgactccagatcggcatcgtcgcagtcatgctcgtggcgatcggctggttcgtcgccggcggcgggccggcagtcaacaccgcgacgtacggcgggatgtgggagtacggcgtcgaaggcatcttcgccgcgaccggcctcgtgtttgtctccttcgctggcgtgacgaaaatcgcctctatcgccgaggaggtcgaggacccggaccgcgtcattccgctcgggatgctgggctcgctcgccttcaccacgctgctgtacgtactcgtcgtcgccgtcgtcgtcggcgtcattccgctcgaccagctcgccgggagcacgacgcccatcgctgatgcagccgaggcaacgctcggtaccgctggcgtcgcggccgtcgttctggcggcgattctggcgctggtcagcacggccaacgccggtatcctctcctcgtcgcgctacccgttcgccatgagtcgtgacgggctcgcgcccgacctgctcagtacggtcagcgaccgcttcggcacgccggtgactgccatcacgctgaccggcggcgtcatgttgctcctcatcctcttcgttccgattctggaaatcgccaagctcgcgagcgcgttcaagatccttgtgttcgcgctcatcaacgtcgcgctcatcggcttccgtgagagcgacgctcccgactacgacccctccttcgaggttccgctgtacccgtggacgccgatattcggcaccctgaccggtttcgccctgctaacgcagatgggccttatcgcgattgtcggggccgtcggcattgtcatcgccagtgtcgtctggtatctgggctacgtccgaccgcgagtcaccagagagggcgcgatcaaggaatccgtccgccggagtatcggcgaccgcgcgctcgaccggaccgaggagacgctcgatgagacagcagagacctccgtccttgtcgcactccccgagggcgcttcgcggcagagcgaagccacactgcttgaagtcggggccgcgctttcgcccactgacagcagcctctctgtcgtccagttcgacgaagtgcctgaccagcagcccctcgattatgcctccggcgtgcagtctccagacgacctcgaattcgagtgtcggaccgatacgctggcggctgccctcgatacccctgtcgagtacggcgaactcgtcagccaccatcctgagcgggccgtcgccaacgctgtcgacgagcgtggcgtcgatgtgctgctggtggaacgcggtgcgtcgttcgaagactcgctactgggtgacagtatcgaccgcatccggaaacaggccgactgtgacactatcgccgtcgacgcacagccgcttgacgcgctggagacgatcacgctgatcacgacccgcggcccgtacgacccgctgaaagtccgcgtcggcaacgctgtcgcgacggcaaccgggacggacctccagttcctctacccgctcgacgagcgccagtccgccgaggaacgccagcaactcgaagcgtaccacgacgacctgctggatctctgtgacgtgccgacagagcggaccttcgtcgaccgagacgacctttcagcggcgatggacgcggctgacaacgacagaacgctcctgatccacgcaagcaacggtgggctttcagcccgtacgtcaaacgacaacgggaccacgcagtcggcaattcaagatagcaaccacgcgtcgatggaagtagacacgaaacgccaccccggcggcgtcgtcggtcggctgctcgaacggctggcgttctag

SEQ ID NO: 36709 - protein, 734 aa, Haloarcula marismortui ATCC 43049
MAKDLERDLGLLSVVAISIGAMVGSGIFILPALAVKDAGAGIIAAYLLAGVLVLPAALSKAEMATAMPEAGGTYVYIERSMGPLLGTVSGLGTWFSLSFKGALALVGGVPYLVLLFDLPIRPVAITLAAVLILVNILGAEQTGRLQIGIVAVMLVAIGWFVAGGGPAVNTATYGGMWEYGVEGIFAATGLVFVSFAGVTKIASIAEEVEDPDRVIPLGMLGSLAFTTLLYVLVVAVVVGVIPLDQLAGSTTPIADAAEATLGTAGVAAVVLAAILALVSTANAGILSSSRYPFAMSRDGLAPDLLSTVSDRFGTPVTAITLTGGVMLLLILFVPILEIAKLASAFKILVFALINVALIGFRESDAPDYDPSFEVPLYPWTPIFGTLTGFALLTQMGLIAIVGAVGIVIASVVWYLGYVRPRVTREGAIKESVRRSIGDRALDRTEETLDETAETSVLVALPEGASRQSEATLLEVGAALSPTDSSLSVVQFDEVPDQQPLDYASGVQSPDDLEFECRTDTLAAALDTPVEYGELVSHHPERAVANAVDERGVDVLLVERGASFEDSLLGDSIDRIRKQADCDTIAVDAQPLDALETITLITTRGPYDPLKVRVGNAVATATGTDLQFLYPLDERQSAEERQQLEAYHDDLLDLCDVPTERTFVDRDDLSAAMDAADNDRTLLIHASNGGLSARTSNDNGTTQSAIQDSNHASMEVDTKRHPGGVVGRLLERLAF

SEQ ID NO: 36710 - DNA, 1386 bp, Streptococcus thermophilus LMG 18311
  CDS (1)..(1386)
atgagtatttttcgtaaaaaggatgttggtttgtctcaaaccgagatgaaacggcatctgacccttagggatgtagtccttctgggaatcggtgccatggttgggacaggaatctttacgattactggtaccgcggcatcaaccttggcaggtccagccctgattatttcggttttgatttcagccgtttgtgtgggtatgtcggcgattttctttgctgagtttgcctcacgctatccatccgctggtggtgtttatggttatctctatgcttcttggggtgagtaccctgcttggatgggcggatggcttacaatgatcgttttcatgaacgccgtgtctagtgttgcctctggttggggagcctacctcaaggggctcttggcaagctttggtctacagctccccaaggctatcagtggcccttttaatccgagtcaggggacctatattgacctattgccagtcttggttttggtgcttgtgacggctcttctcctcatggattccaaacaagtccttcgtttgaactcactcctagtagtgcttaagttctctgccttggcggttttcatcctagttggtcttttccatctgaatccggacaactgggctaactttgcaccatttggcttcggccaaatttatggtgggaagacggggattatggcaggtgcttctctcatgttctttggttttcttggatttgaatccatttctatgacagtagatgagattaaggaaccacaaaagaatgttcctcgaggtataattctcgctttgattatcgtcgcttcactttatgcagtggtttcattagtcttgacgggagttgtccactataccaagttaaatgtcgacgatgccgtagcttatgcccttcgttatattggtgtgtcttgggcagccaattatgtatcggtagttgccattatgaccttgattaccgtatgtatttccatggcctatgcccttagtcgcatggtttatagcttggcgcgtgatggatttcttccacaaacttttcaaaaggtttcaaagacccataaggttccacattatgcgacacttttgactggaatcctttctgccatctcatcaggcatcttttctttggctaatatggcatccttggttaatatttcgactttggcttatttggtcctcttggctattgctcttatcattcttcgtaaagacaagggcttgccacagaaggatgagtttaaggtcccatttgttcctgtcttaccaatcctttccatcatcgtctgtctctcatttatgagtcagtacagttggcaaacctggtcagcctttggcatagcagtgctaattggttcggctatttatgccttttacggttacaaacattctaagtattaa

SEQ ID NO: 36711 - protein, 461 aa, Streptococcus thermophilus LMG 18311
MSIFRKKDVGLSQTEMKRHLTLRDVVLLGIGAMVGTGIFTITGTAASTLAGPALIISVLISAVCVGMSAIFFAEFASRYPSAGGVYGYLYASWGEYPAWMGGWLTMIVFMNAVSSVASGWGAYLKGLLASFGLQLPKAISGPFNPSQGTYIDLLPVLVLVLVTALLLMDSKQVLRLNSLLVVLKFSALAVFILVGLFHLNPDNWANFAPFGFGQIYGGKTGIMAGASLMFFGFLGFESISMTVDEIKEPQKNVPRGIILALIIVASLYAVVSLVLTGVVHYTKLNVDDAVAYALRYIGVSWAANYVSVVAIMTLITVCISMAYALSRMVYSLARDGFLPQTFQKVSKTHKVPHYATLLTGILSAISSGIFSLANMASLVNISTLAYLVLLAIALIILRKDKGLPQKDEFKVPFVPVLPILSIIVCLSFMSQYSWQTWSAFGIAVLIGSAIYAFYGYKHSKY

SEQ ID NO: 36712 - DNA, 1386 bp, Streptococcus thermophilus CNRZ1066
  CDS (1)..(1386)
atgagtatttttcgtaaaaaagatgttggtttgtctcaaaccgagatgaaacggcatctgacccttagggatgtagtccttctgggaatcggtgccatggttgggacaggaatctttacgattactggtaccgcggcatcaaccttggcaggtccagccctgattatttcggttttgatttcagccgtttgtgtgggtatgtcggcgattttctttgctgagtttgcctcacgctatccatccgctggtggtgtttatggttatctctatgcttcttggggtgagtaccctgcttggatgggcggatggcttacaatgatcgttttcatgaacgccgtgtctagtgttgcctctggttggggagcctacctcaaggggctcttggcaagctttggtctacagctccccaaggctatcagtggcccttttaatccgagtcaggggacctatattgacctattgccagtcttggttttggtgcttgtgacggctcttctcctcatggattccaaacaagtccttcgtttgaactcactcctagtagtgcttaagttctctgccttggcggttttcatcctagttggtcttttccatctgaatccggacaactgggctaactttgcaccatttggcttcggccaaatttatggtgggaagacggggattatggcaggtgcttctctcatgttctttggttttcttggatttgaatccatttctatgacagtagatgagattaaggaaccacaaaagaatgttcctcgaggtatagttctcgctttgattatcgtcgcttcactttatgcagtggtttcattagtcttgacgggagttgtccactataccaagttaaatgtcgacgatgccgtagcttatgcccttcgttatattggtgtgtcttgggcagccaattatgtatcggtagttgccattatgaccttgattaccgtatgtatttccatggcctatgcccttagtcgcatggtttatagcttggcgcgtgatggatttcttccacaaacttttcaaaaggtttcaaagacccataaggttccacattatgcgacacttttgactggaatcctttctgccatctcatcaggcatcttttctttggctaatatggcatccttggttaatatttcgactttggcttatttggtcctcttggctattgctcttatcattcttcgtaaagacaagggcttgccacagaaggatgagtttaaggtcccatttgttcctgtcttaccaatcctttccatcatcgtctgtctctcatttatgagtcagtacagttggcaaacctggtcagcctttggcatagcagtgctaattggttcggctatttatgccttttacggttacaaacattctaagtattaa

SEQ ID NO: 36713 - protein, 461 aa, Streptococcus thermophilus CNRZ1066
MSIFRKKDVGLSQTEMKRHLTLRDVVLLGIGAMVGTGIFTITGTAASTLAGPALIISVLISAVCVGMSAIFFAEFASRYPSAGGVYGYLYASWGEYPAWMGGWLTMIVFMNAVSSVASGWGAYLKGLLASFGLQLPKAISGPFNPSQGTYIDLLPVLVLVLVTALLLMDSKQVLRLNSLLVVLKFSALAVFILVGLFHLNPDNWANFAPFGFGQIYGGKTGIMAGASLMFFGFLGFESISMTVDEIKEPQKNVPRGIVLALIIVASLYAVVSLVLTGVVHYTKLNVDDAVAYALRYIGVSWAANYVSVVAIMTLITVCISMAYALSRMVYSLARDGFLPQTFQKVSKTHKVPHYATLLTGILSAISSGIFSLANMASLVNISTLAYLVLLAIALIILRKDKGLPQKDEFKVPFVPVLPILSIIVCLSFMSQYSWQTWSAFGIAVLIGSAIYAFYGYKHSKY

SEQ ID NO: 36714 - DNA, 1416 bp, Geobacillus kaustophilus HTA426
  CDS (1)..(1416)
gtgaatttgtttcgtaaaaaaccgattcagttgctcatgaaagaatcgggggcaaaaggagcttcgctgcgaaaagagttaggcgcatttgatttgacgatgctcggcatcggcgccattatcgggacaggcattttcgtcctgaccggggtggcggcggcggaacacgctggtccggctctcgttctttcgttcattttgtctgggttggcgtgtgtgtttgcggcgctttgttacgcagaatttgcctcaaccgtgccagtgtcggggagcgcttacacttacagctatgccacgtttggtgagctcatcgcttggattttgggatgggatttgattttggaatacggggttgcttcgtcggcggtcgctgttggttggtccggctatttccaggggttgctttccggttttggcatcgagctgccgaaggcgctaacgagtgcgtatgatccggcgaaaggaacgttcatcgatttgccagcgattatcatcgttctgttcattacgtttttgttgaatttaggtgcgaaaaaatcggctcgttttaatgcggtgatcgttgccattaaagtggcggttgtgctgctctttttggcggtcggtgtttggtacgtcaaaccggagaactggacgccgtttatgccgtatggcttctctggcgtggcgaccggcgcggcgacggtgtttttcgcttacatcggctttgatgcggtgtcgacggcggcggaagaagtgcgcaatccgcagcgtgatatgccgattggcatcatcgtctcgttgcttgtgtgcacattgttgtatattgcggtttcactcgtattgacaggcatcgttccgtacgagcagctcaacgtgaaaaacccagtggcgtttgcgttaaactatatccaccaagactgggtggcgggctttatttcgctcggggcgatcgccggcattacgaccgtgctccttgtgatgatgtatgggcagacgcgtctcttctacgccatcagccgcgacggtttgctgccgaaagtgtttgctcgcatcagcccgacgcgccaagtgccgtatgtcaatacgtggctgacgggagcggctgtagcggtattcgccggcatcatcccgctcaacaaattggcggaactgacgaacattggcacactctttgcctttatcaccgtctcgatcggcgtgttggtgttgcgtaaaacgcagccggacttaaagcgggcattccgcgttccgtttgtcccggtcgtcccgattttggctgtcttattctgcggctacctcgttcttcagcttccggcgatgacatggatcggttttgtctcgtggctgctgatcggtctagtgatttactttatctacggccgcaagcatagtgagctgaatgaaatggcacggacggaagaaaaggctggatga

SEQ ID NO: 36715 - protein, 471 aa, Geobacillus kaustophilus HTA426
MNLFRKKPIQLLMKESGAKGASLRKELGAFDLTMLGIGAIIGTGIFVLTGVAAAEHAGPALVLSFILSGLACVFAALCYAEFASTVPVSGSAYTYSYATFGELIAWILGWDLILEYGVASSAVAVGWSGYFQGLLSGFGIELPKALTSAYDPAKGTFIDLPAIIIVLFITFLLNLGAKKSARFNAVIVAIKVAVVLLFLAVGVWYVKPENWTPFMPYGFSGVATGAATVFFAYIGFDAVSTAAEEVRNPQRDMPIGIIVSLLVCTLLYIAVSLVLTGIVPYEQLNVKNPVAFALNYIHQDWVAGFISLGAIAGITTVLLVMMYGQTRLFYAISRDGLLPKVFARISPTRQVPYVNTWLTGAAVAVFAGIIPLNKLAELTNIGTLFAFITVSIGVLVLRKTQPDLKRAFRVPFVPVVPILAVLFCGYLVLQLPAMTWIGFVSWLLIGLVIYFIYGRKHSELNEMARTEEKAG

SEQ ID NO: 36716 - DNA, 1365 bp, Geobacillus kaustophilus HTA426
  CDS (1)..(1365)
atggcgcaacttgaaacgaacacatcggtcgagtcgcttggttataaacaggaattaaaacggtcgctcacatttgttgatttgttgatttacggaatggtgttcatggtgccgatcgctcctttcggcatttacgggtatgtagcgcaagggtcaaaagggatggtcgccttagcatacttaatcggaatggtggggatgattttcaccgccttgagctacgccagaatggccgaggcgtttccaatcgctggttccgtgtattcctacgcccagcggggaatgaatgaatatgtcggttttatggcaggctgggtcattttgcttgattacattttcgttccggctcttctctatttggtcagcgctgctgccttagccgatattgtgccgcaagtgccgatttccgtgtggctcgttctgtttattgccatgaatacggtcattaatattctcgggatcgagatgacggccaaagcgaacaaagtgattgttgttttagagctcatcgtccttgcagtgtttgtgatcacaggaattattgcgattataaaaggtgtcaatggagcgcagtttacgttcaaaccgctgtacgatcctaatcatttcagcgcggagacggtgatgggggcggtgtcggtggccgtcttgagcttccttggttttgatgcggtgtcgacgctggctgaggaaacaagggacgggaaatcatcgatcggcaaagcgatcattttcgctttgctcgttgtcggtgcgcttttcatcgtgcaaacatgggtcgccgctctcatttggcctgattatacgacgtttaaaaacgcggacgtggcgttttatcagattgcggagctggcaggcggaccatggctgaaatggacaacgatcgtcgccaccgcgctttcgtgggggatcgcgaacgcgctcgtcgcccaagcagccatctcccgcattttgtacagcatgggtcgcgaccgtaaactgcccagtgtgctggctaaagtgcatccgaaatttcaaacgccatacgtcagcacattgcttgtcgctgtgatttcgctcattgtcacgacggtgttcgcctcacaaattgataaactcgcttcgcttgtcaactttggcgccctgacggctttcctctttttgcatgtgtcggtgatgaactatttcttgcgcaaacaaaagagtaacgattatattaatcatctcttgtttccgctcatcggttttgttatcatcggctatgtatggatgaatctggacccgctcagcaaaaagctaggattgatttggatcgcgattggactcgtttatctggtctttttgcgactcacgaacaaagactcccgtctaagcggggaactgtag

SEQ ID NO: 36717 - protein, 454 aa, Geobacillus kaustophilus HTA426
MAQLETNTSVESLGYKQELKRSLTFVDLLIYGMVFMVPIAPFGIYGYVAQGSKGMVALAYLIGMVGMIFTALSYARMAEAFPIAGSVYSYAQRGMNEYVGFMAGWVILLDYIFVPALLYLVSAAALADIVPQVPISVWLVLFIAMNTVINILGIEMTAKANKVIVVLELIVLAVFVITGIIAIIKGVNGAQFTFKPLYDPNHFSAETVMGAVSVAVLSFLGFDAVSTLAEETRDGKSSIGKAIIFALLVVGALFIVQTWVAALIWPDYTTFKNADVAFYQIAELAGGPWLKWTTIVATALSWGIANALVAQAAISRILYSMGRDRKLPSVLAKVHPKFQTPYVSTLLVAVISLIVTTVFASQIDKLASLVNFGALTAFLFLHVSVMNYFLRKQKSNDYINHLLFPLIGFVIIGYVWMNLDPLSKKLGLIWIAIGLVYLVFLRLTNKDSRLSGEL

SEQ ID NO: 36718 - DNA, 1407 bp, Salmonella enterica subsp. enterica serovar Paratypi A str. ATCC
  CDS (1)..(1407)
atggataccctgcaacaaccaccgccagcagagcccgaaggcggtctgcggcgtaacctgaagaagcggcatctgctgatgatgttgttgggcggcacgattggcaccggcttatttatcggcattgccgaaccgttaagcagcgtcgggccggcgggaaccttactggcctatctgtttgccggaaccattatgctggcgacgatgatgtgtcttggcgaattatcatgcgcctttcctcactccggttcatttcaacattacgcgctgatgtttatgccgtcaccttgctggagctataccattggctggctttactggtttagctgggtcttttccctggcagccgacctcactgccgcagggtttattgctcaccagtttttccccgcggttccggtatatatgttctgcctggcgattctgctcatcctgacggccatcaatctcacctccgcaaaaagttttggcgaatgcgaatactggctttcggccattaaggttttcgcgatcgtgctgtttatctgcgcgggcggggtcatgatctactcgctaatgggccatagtgactggcacccgacgttaaaaacagacggaatgtggtttccccacggttgggagcaaattgtggtctgtatgacgatcgtgatttactccttccagggggtggaactggtaggaaatgcggcaggggagaccgaatcgccgcacattattttaccgaaggtgatcctggggatcggtctcagaatcattttattttacggcctggcgattgcggtgctggcgctggtctatccgcatgaactgacgccaaatggacaaagtccctttgtatgggtattctcccacgcgggcattccgggggcggatacgctgatgacgctggtaatcttttccgccgcggtttctgccgctaactcggccatttacgccagttcgcgtatgctgtggtctatggcgggcgatcgctttgcgccagcctgctttggtaaaacgaacggcggcggcgtgccggtgtatgctattttaatcacggccttgctggcgttggtgtcgttgctgacccgctatattcccgcacagcaattttatttatatctgatcgccagtaccgggcaggtgggttgcctggcatggataaccattggatggtgccagtatcgcttccggcaatcggtgcgtaatggcacgtacgccagcgatttgctacgctatcgatcgccgcttttcccctggacggcccgatttgtcattatcaccaattttgccattatggtcggcacctggtttagtgagcagggggtagtgataatgttggttgagctggcttttatgatagggattcttttgtcatggtatctcttcagacccactttgagccgattacgtaacacagtgggatga

SEQ ID NO: 36719 - protein, 468 aa, Salmonella enterica subsp. enterica serovar Paratypi A str. ATCC
MDTLQQPPPAEPEGGLRRNLKKRHLLMMLLGGTIGTGLFIGIAEPLSSVGPAGTLLAYLFAGTIMLATMMCLGELSCAFPHSGSFQHYALMFMPSPCWSYTIGWLYWFSWVFSLAADLTAAGFIAHQFFPAVPVYMFCLAILLILTAINLTSAKSFGECEYWLSAIKVFAIVLFICAGGVMIYSLMGHSDWHPTLKTDGMWFPHGWEQIVVCMTIVIYSFQGVELVGNAAGETESPHIILPKVILGIGLRIILFYGLAIAVLALVYPHELTPNGQSPFVWVFSHAGIPGADTLMTLVIFSAAVSAANSAIYASSRMLWSMAGDRFAPACFGKTNGGGVPVYAILITALLALVSLLTRYIPAQQFYLYLIASTGQVGCLAWITIGWCQYRFRQSVRNGTYASDLLRYRSPLFPWTARFVIITNFAIMVGTWFSEQGVVIMLVELAFMIGILLSWYLFRPTLSRLRNTVG

SEQ ID NO: 36720 - DNA, 1371 bp, Salmonella enterica subsp. enterica serovar Paratypi A str. ATCC
  CDS (1)..(1371)
atggaaagcaataataagctaaagcgtgggctgagcacccggcacattcgctttatggcattaggttcggcaatcggcaccggcctgttttacggctcggcggacgccatcaaaatggcggggccgagcgtgctgttggcctatattattggcggggtcgcggcatatatcattatgcgcgcattgggggaaatgtccgttcacaaccctgccgctagctcattttcgcgctatgcgcaggaaaacctcggcccgcttgcgggctatattaccggctggacctactgttttgagatcctgatcgtcgccattgccgacgtgaccgcgttcggcatttatatgggggtctggttccccgccgtgccgcactggatttgggtacttagcgtggtgctgatcatttgcgccatcaacctgatgagcgtcaaggtgttcggcgagctggagttttggttctccttcttcaaagtcgccaccattattatcatgattgtcgcgggtatcggcatcattgtgtggggaattggcaacggcgggcagccgaccggcattcataacctgtggagcaacggcggcttcttcagcaatggctggctgggaatgatcatgtcgctgcaaatggtgatgttcgcttatggcgggattgagattatcggtatcaccgccggggaagcgaaagacccggagaaatccattccgcgcgccattaactcagtaccgatgcgtatcctggtattttatgtcggcacgctgttcgtcattatgtctatctatccgtggaatcaggtcggcacaaacggcagcccatttgtgctgacgttccagcatatggggattacctttgccgccagcattctgaactttgtggtattgaccgcctcgctttccgctatcaactccgatgtgtttggcgtaggccgtatgctgcatggtatggcggagcaggggagcgcgccgaaaatctttgccaaaacgtcacgccgtggtattccgtgggtcactgtgctggtgatgacgattgcgctgctgtttgcggtttacctgaactacatcatgccggaaaacgtcttcctggtgattgcttcgctggcgacgtttgcgacggtatgggtatggattatgatcctgctgtcacaaatcgccttccgccgtcgtttaccgccggaagaggtaaaagcgctgaaatttaaggtgccgggcggtgtcgtaacgacgatagcgggtctgattttcctggtcttcattattgcgcttatcggctaccatccggatacccgcatctcactgtatgtgggcttcgcctggatagttctgctgttgattggctggatatttaaacgccgtcgcgaccgtcaattggcgcaggcgtag

SEQ ID NO: 36721 - protein, 456 aa, Salmonella enterica subsp. enterica serovar Paratypi A str. ATCC
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKIFAKTSRRGIPWVTVLVMTIALLFAVYLNYIMPENVFLVIASLATFATVWVWIMILLSQIAFRRRLPPEEVKALKFKVPGGVVTTIAGLIFLVFIIALIGYHPDTRISLYVGFAWIVLLLIGWIFKRRRDRQLAQA

SEQ ID NO: 36722 - DNA, 1311 bp, Idiomarina loihiensis L2TR
  CDS (1)..(1311)
atggcagaacacaatcatgaacacggacatcaggattatcagaaaagcagcctgagtctttggggggcggtgtcgctggggactggtgtgatgattggcgctggtatttttgcactgaccggacaagttgctcagctggcaagagagtggtttgtcctggcgtttgtgtgcggcggtatcattgccggctttagcgcttactcttacgttaagttggcgaaagcctatccgtcagcgggcggtattgcgatgttcctcagtaaagcttatggaaaaggaagtgtgacggcgatattcgcactcttgatgtacttttctatggtgattaatgaaagtttagtcgctcggacatttgcgtcttataccagccagttaatttcttttgaagcgcagtggcttatccctttgttggcggtgggtttgctggtctttgcgttttttatcaatattttgagtaatcagtttattcaaacgttctcgttttttatggcctttgttaagactttagggttggtcattttagcggctggtggtttgtgggcctcaggcattcagtttgaatcgatatcggctattccagaagaagctacgggtggcggtattttagcgggtattgctttaagcatacttgcgtacaaagggtttacaacaataaccaatagtggcggtgaaattgttgagcctaagagaaatgtcgggcgtgccattattatttcgctgattatctgcgcgttaatatacgttctggtcactctggcggttggctcgagcctgtccatagatgagattgtgaaagcgaaagactacgcgctttctgaagcagccagacccgtctatggcgagaccggactatgggtgacggtcgcttttgcaattgtagcaacggtatcaggagtgattgccagcgcgtttgccgtttcaagaatgttagccatgttgaccaatatgaagcttgttccacacagtcattttggcatgccaggttccattcagaagcatacgctggtttacaccattgttatggctatgatcttagcggcattcttcgatttgagtcgaattgcgtcactgggcgctattttttatatcgtgatggacattgcgatccactggggcgtattacggcatctaaggcaaaaggtgaatgccaatatttacatacttgtcagcgcaatcacgctagacgtcatcgttttagtcgcttttatatgggtgaaatggacgagcgatccgctggtgatttgggcgtctcttatcggtatggcattgattgccgctggtgagattttgtttttacgtaaaaagcgttaa

SEQ ID NO: 36723 - protein, 436 aa, Idiomarina loihiensis L2TR
MAEHNHEHGHQDYQKSSLSLWGAVSLGTGVMIGAGIFALTGQVAQLAREWFVLAFVCGGIIAGFSAYSYVKLAKAYPSAGGIAMFLSKAYGKGSVTAIFALLMYFSMVINESLVARTFASYTSQLISFEAQWLIPLLAVGLLVFAFFINILSNQFIQTFSFFMAFVKTLGLVILAAGGLWASGIQFESISAIPEEATGGGILAGIALSILAYKGFTTITNSGGEIVEPKRNVGRAIIISLIICALIYVLVTLAVGSSLSIDEIVKAKDYALSEAARPVYGETGLWVTVAFAIVATVSGVIASAFAVSRMLAMLTNMKLVPHSHFGMPGSIQKHTLVYTIVMAMILAAFFDLSRIASLGAIFYIVMDIAIHWGVLRHLRQKVNANIYILVSAITLDVIVLVAFIWVKWTSDPLVIWASLIGMALIAAGEILFLRKKR

SEQ ID NO: 36724 - DNA, 1221 bp, Idiomarina loihiensis L2TR
  CDS (1)..(1221)
atgagtcaacaactcgtgcgttccacctcgctggccggagctatagttttagggctgggttccattttaggtaccggtgcgttcgttagtgtgggtattggtgcggatattgccggtggtgccgttttatgggccattctcattgcggcagtaacggctttatgcaatggcctgtcttcggctcagttagcttccgcacattcagtaagcggcggcacctatgaatatggttatcggtttctgaccccggcttatggcgtaacggcgggtagcttgttcgtagtagcaaaaagtgcgtcagcggcaaccgctgcgctggcggtaggctggtatgtgacgaatgtcacggcaatacctgaatatttagcacagtggatagccgccgcagtattggtgctatttacgttattagtactggggggcgttaagcgcacaaactgggttaatgcagccattgttacggtgagcatagtggctctgttggcttttattattacaggtcatcaacaaaccgccgttgttgagcgggcttcggtcgagtggtggcacgttttgcaggcggcagctctgctttttgttgcctacacaggttacggacgtattgccaccatgggggaagaggtacaaaatccgcgtcaggttattccgctggccgttattttaactctggcggttgtgacgcttctgtatttgggggttggtagcgcgctcttgcattttcccagcatagcggacttccaggcggagcacttctctttggcgagtttgttgccaactggacctatacaatggttggtcaccgcgggtgcagtggtcgctatgggcggagttattctcaacttaattttgggggtgtcgcgggtggttctggccatggggcgcagagccgatttgccaatgcgctttgctaacttaaatgaccaacaaacctcggcgccaccggcaacctggttaacttgttttgtcatgctggtgttggtcgcaattggtgatataaagaccgcatggtcgttcagtgccttcacggttttagtgtattatggcatcacgaatttagcggcactgaaggtcacaaaaagtgatcgttttgtgcctaaatgggtatccatactaggtttagtcagttgtcttgggctggccgtttttgttccctggcaggtattgttgtcagggcttatttttattgtcgtagttctgctgatacatcagctgagacgctaa

SEQ ID NO: 36725 - protein, 406 aa, Idiomarina loihiensis L2TR
MSQQLVRSTSLAGAIVLGLGSILGTGAFVSVGIGADIAGGAVLWAILIAAVTALCNGLSSAQLASAHSVSGGTYEYGYRFLTPAYGVTAGSLFVVAKSASAATAALAVGWYVTNVTAIPEYLAQWIAAAVLVLFTLLVLGGVKRTNWVNAAIVTVSIVALLAFIITGHQQTAVVERASVEWWHVLQAAALLFVAYTGYGRIATMGEEVQNPRQVIPLAVILTLAVVTLLYLGVGSALLHFPSIADFQAEHFSLASLLPTGPIQWLVTAGAVVAMGGVILNLILGVSRVVLAMGRRADLPMRFANLNDQQTSAPPATWLTCFVMLVLVAIGDIKTAWSFSAFTVLVYYGITNLAALKVTKSDRFVPKWVSILGLVSCLGLAVFVPWQVLLSGLIFIVVVLLIHQLRR

SEQ ID NO: 36726 - DNA, 1497 bp, Zymomonas mobilis subsp. mobilis ZM4
  CDS (1)..(1497)
atgatattcgggcgtgtgaagcctctcgacgccattttagaaacagctaaaaagaaatctctccatcgttctttaggcgcttttcagctaactatgctgggtattggcgccattatcggtaccggtatttttgtgttaacggcggaagccgcacaaaaagcaggccccggaatgatgttgagctttattattgctgcctgcgtttgtggggtggcagctttttgctatgctgaaatggccgctatggtacccgtatcagggtcagcttatacctatagctatgccgtcatgggcgaacttgttgcatggatggtcggctgggcgcttattcttgaatatgctgtggcggccagtgcggtttctgtcggttggtcaggctatgttgtcggtttaattgagcatctaacaggctctcatttgccagcttccgtccttgtctttaccaaagggccttttaatggcggtattatcaaccttcccgctgcctttattgctcttttaatcatgtctttattgatacgtggtaccaaagaaagcgctactgccagcgctattctggttgttatcaaaataacggcactttctctttttatctttttggctattccagccatgaagatggaaaattttcatcctttcgcacctttgggtttttcaggtatatctgcggcggcggcttctatcttttttgcctatgtcggttttgatgctgtttctacggcagccgaagaaaccaaggatcctcaacggaatatgccgattggcttggtcggctcacttgctatttgtactttgttttatatgttggtttcggcaggcgttattggtggcgtgggggcgcaacctgtttttgatgccgctcatcagcatgcgttacccgcaggtagtagtgaaatggccgccgcctgttctactttgaaagacagccatgtcgtctgctctaatgaagccttagcatggagccttcgtaaaatcggatggaataaagtcggcaatctgattgcgttggctgccggttttgccttgccgtccgttattctgatgatgatttttggtcagacccgcatcttttttgtgatgagccgtgacggtttgttaccgggattttttgctaaagtgcatccccgtttcaaaacgccttatatcgtgactgtcatgaccggcttggccgttgctactttttcggctttcttccctgtcggtattcttgctgacatttctaatgcaggcacgttattcgcgtttgctatggttgctattgctgtcttggtcttgcgtcataccgatccgaaaagacatcggcctttcaaaacgccttgtgtttatttgattgcgcctctggccgccttgggctgtctgtatctttttgtcagtctgcctttaatgacattaaaaatgttctttggctggacggtcgtcggactggttgtctattttctctatggctatcgtcacagtaatattgctcgcaatatttcagacgatgaagaagcctaa

SEQ ID NO: 36727 - protein, 498 aa, Zymomonas mobilis subsp. mobilis ZM4
MIFGRVKPLDAILETAKKKSLHRSLGAFQLTMLGIGAIIGTGIFVLTAEAAQKAGPGMMLSFIIAACVCGVAAFCYAEMAAMVPVSGSAYTYSYAVMGELVAWMVGWALILEYAVAASAVSVGWSGYVVGLIEHLTGSHLPASVLVFTKGPFNGGIINLPAAFIALLIMSLLIRGTKESATASAILVVIKITALSLFIFLAIPAMKMENFHPFAPLGFSGISAAAASIFFAYVGFDAVSTAAEETKDPQRNMPIGLVGSLAICTLFYMLVSAGVIGGVGAQPVFDAAHQHALPAGSSEMAAACSTLKDSHVVCSNEALAWSLRKIGWNKVGNLIALAAGFALPSVILMMIFGQTRIFFVMSRDGLLPGFFAKVHPRFKTPYIVTVMTGLAVATFSAFFPVGILADISNAGTLFAFAMVAIAVLVLRHTDPKRHRPFKTPCVYLIAPLAALGCLYLFVSLPLMTLKMFFGWTVVGLVVYFLYGYRHSNIARNISDDEEA

SEQ ID NO: 36728 - DNA, 1434 bp, Zymomonas mobilis subsp. mobilis ZM4
  CDS (1)..(1434)
atgttaaaaaaatattttggctctcgtaaaaaatttcgttcactttcttcacaacagtctcaccctcataaaaaagaccaagcgctttcccgtaatttgtcatggccgcatcttattgccttaggtgtcggcgcgattgtcgggacaggtatctatacattggtaggtgtcggcgctgatcgggcgggacctgctgttgttattgcctttattattgccggccttatctgtgctacggctgcccttggctatgccgagttatccacattgataccggaagccggtggcgcttacacttatgcctatatggcgattggccgccatatggcatggattgtcggatggagcctcatccttgaatattcactggcaagctcgaccgtcgccgttggatggtcggcctatcttgtcggatggcttcattcttttggtatcaatttacccgcggcactattggcggggccgcatgatggcgggattatcaatttaccagcggttatcgtggccttgtctatcgccctattattgaccgcaggtgccaaggaaagcgcgactctgactttggcgctggttattttaaaattatccgccttggtcttatttgtcgttttgacaatgcccgctttccattttgaatattaccatcctttcatgccttacggttttgtcagccatatttcgccggatggaaaagtcagaggcgttatggcagctgcggctattctgttttttgccttttatggatttgatactgtcgccacagcggcagaagaaaccaaaaatcccaagcgggatttgaccatcggtattattggttcgatgactatttcggttctgatctatattggtgtagcggcctgcttattgggagctgcaccctttagcgaatttatcaaaagcggcgaaccgcttgcccttattcttagaaatttacatcatgagacggcagcaaaatggattgcggcggctgcgcttgttgccttgccttcggttattatggcgatgatttacggacaaagccgcgtcttttttgtgatggcgcgagatcatctgttgccgccttttctggcaaaagtaaacaagcatggcacccccagtcaggtgaccctgtttacgggtattgtcattgctttaattgccggttttttccgattggatgaattggcagaattagccaacgctggcactttggtggcctttatcgctgtcggtctctctttgattattctgcgtgttcgagaaggggaaaggacgcggcgtttttcttgtccatttccttttgtgataggcagcgtcaccgttatcggttgcctttatttattcaccagcctgccgcttcatacgacgatccgcttcttgttatggaatgcgatcggccttgttttttacggcagctataatttgtataagcgcaaaaaacagaaatctttgtaa

SEQ ID NO: 36729 - protein, 477 aa, Zymomonas mobilis subsp. mobilis ZM4
MLKKYFGSRKKFRSLSSQQSHPHKKDQALSRNLSWPHLIALGVGAIVGTGIYTLVGVGADRAGPAVVIAFIIAGLICATAALGYAELSTLIPEAGGAYTYAYMAIGRHMAWIVGWSLILEYSLASSTVAVGWSAYLVGWLHSFGINLPAALLAGPHDGGIINLPAVIVALSIALLLTAGAKESATLTLALVILKLSALVLFVVLTMPAFHFEYYHPFMPYGFVSHISPDGKVRGVMAAAAILFFAFYGFDTVATAAEETKNPKRDLTIGIIGSMTISVLIYIGVAACLLGAAPFSEFIKSGEPLALILRNLHHETAAKWIAAAALVALPSVIMAMIYGQSRVFFVMARDHLLPPFLAKVNKHGTPSQVTLFTGIVIALIAGFFRLDELAELANAGTLVAFIAVGLSLIILRVREGERTRRFSCPFPFVIGSVTVIGCLYLFTSLPLHTTIRFLLWNAIGLVFYGSYNLYKRKKQKSL

SEQ ID NO: 36730 - DNA, 1347 bp, Silicibacter pomeroyi DSS-3
  CDS (1)..(1347)
atgaccagaacaccacagacccatgaggccgcgcccgggggcgcgggcagcatcagcctgaccaacgcggttgccatgggcaccggggtgatgatcggggcggggatatttgccctgaccggacagatcgccggtcttgcagggcctttgttcccgctctctttcgtgctgggcgcggtggtgacgatgttcagcgcctacagctatatcgtgatgtcgaacacctggccctcgtccggcggtatcgcgatgatcctgaccaaggcctatggccccggtgccgtggcggcggcggcctcggtgctgatggcgctgtcgatggtcatcaacgaaagcctggtggcgcgcacctttgccacctatgcactgcgcccctttggcattcaggacgggccgctggtgcccgcgattggcgttgcgctgatcgtgatggcctatctggtcaacgtctcgggcaatcgcgcggtggggctgtggtcactggtgatgtcggcggtcaagatcggcggtatcgcgctgttcggcatcgccgccctgtgggccagcggtatcgagaactggtcacccgccgcgcgattgtcgcaaaacgggatcacaggttttgccgcctcggtggcgctgtcgatcctggcgttcaaggggttcacgacgatcaccaacagcggtggcgaaatcaccgatcccaggcgcaatgtcgggcggacgatcctgctttcgatcgcggtctgtgttgtcgtctacctgctggtggcgctggcggtcggctcggcattgacgcccgtgcaaatccagcaggcgcgcgattatgccctggcagaggcggcgcagccggtgctgggccagaccgggttctatctgacggtggcgcttgccatggtggccaccgcatcgggcctgatcgccagcgtctttgcggtgtcgcgcatgctgaccatgctgaccgagatgaagatgatcccgcacagccactttggcatgcccggcggcatccgctcccatatgctgatctatacggttgtgatcgccggtgccctgaccgtgttgttcgatctgggccggatcgcctcgctgggcgctttcttctatctggtgatggatatggtggtgcattggggtgtgtggaagaacctgcggcatcggatcggcgcacggggctgggtcatcctgaccgcactgacactggacgccgctgtactggccgccttcacgctgttcaaatggcgtgccgatcccactatcgtcatcgttgcccttgtcaccatgctggccgccctgctggccgagcggctgtatctcggcgggttcgtatcagatggtggcgagggcaaacacacaggacatcgctaa

SEQ ID NO: 36731 - protein, 448 aa, Silicibacter pomeroyi DSS-3
MTRTPQTHEAAPGGAGSISLTNAVAMGTGVMIGAGIFALTGQIAGLAGPLFPLSFVLGAVVTMFSAYSYIVMSNTWPSSGGIAMILTKAYGPGAVAAAASVLMALSMVINESLVARTFATYALRPFGIQDGPLVPAIGVALIVMAYLVNVSGNRAVGLWSLVMSAVKIGGIALFGIAALWASGIENWSPAARLSQNGITGFAASVALSILAFKGFTTITNSGGEITDPRRNVGRTILLSIAVCVVVYLLVALAVGSALTPVQIQQARDYALAEAAQPVLGQTGFYLTVALAMVATASGLIASVFAVSRMLTMLTEMKMIPHSHFGMPGGIRSHMLIYTVVIAGALTVLFDLGRIASLGAFFYLVMDMVVHWGVWKNLRHRIGARGWVILTALTLDAAVLAAFTLFKWRADPTIVIVALVTMLAALLAERLYLGGFVSDGGEGKHTGHR

SEQ ID NO: 36732 - DNA, 1209 bp, Silicibacter pomeroyi DSS-3
  CDS (1)..(1209)
ttgctgcaccggagagggatcatggccgcgccattgaaacgacggatcggattgggcctgctgaccgcctatggcgtcggcgtcatggtgggcgcgggcatctatgttctggtcggtgcggtggcgggcgatgccggtgtctgggcgccggttgcctttctgctggccggtctcatcgcggcgcccaccgcgctcagctatgccgagttttccacccgcctgcccgaggcggcgggcgaggccgcctatgtgggcaccgggctcaacagccagtcgctggcgctgttggtggggcttgccgtggtggtggcgggcaccgtttcggccggcgcggtgctgcgcggcggggtcggctatctgagtgcggtgaccgagatcaacccggtctgggcgatgatcggcctcggcggcgcgctgacgctggtggccgttgccggggtgttggaaagcctggcgctggcggcggtgttcaccgtggtcgaactggccgggctggcgctggtggtctgggccgggctgggggccgacccctcgcccgactgggttgccccggcaccgccggtctggaccggtatcgggctgggcggcgtgctggccttcttcgccttcatcggcttcgaggatatcgtcaacatggccgaggaggtcgaggcgcccgagcgcaccctgccgcgcgccattctgatttcgctggtggtcacctcggtgctgtatgcgctggtcgcctgggcagcggtgcgggcggtgccgcttgacgtgctgggccagtccgaaagcccgctggcgctggtttggcaatacgggcgcggcagcggtgcgggctttctgtcggccatcgcggtgtttgcggccctgaacggtattctggcgcagatcgtgatggcgacccgggtcctttacggtctgggcgggcgcaccaaggcgctggcgctgttccacacggcccatccccggttcggcaccccggtgctggcgacgtttctggtgggggcggcggtgatcttctgcgcgctctatgtgccggtcgagacactggccgagaccacctcctcgatcctgctggcggtgtttgcgctggtcaacggcgccttgatcgttcaaaaaagacgcgcgcccgaggcgcggttccgcgttcccatggcggtgcccgttctggggctggtgctgtcgctggcggcgctttcggttgcggtaaggggaattctatga

SEQ ID NO: 36733 - protein, 402 aa, Silicibacter pomeroyi DSS-3
MLHRRGIMAAPLKRRIGLGLLTAYGVGVMVGAGIYVLVGAVAGDAGVWAPVAFLLAGLIAAPTALSYAEFSTRLPEAAGEAAYVGTGLNSQSLALLVGLAVVVAGTVSAGAVLRGGVGYLSAVTEINPVWAMIGLGGALTLVAVAGVLESLALAAVFTVVELAGLALVVWAGLGADPSPDWVAPAPPVWTGIGLGGVLAFFAFIGFEDIVNMAEEVEAPERTLPRAILISLVVTSVLYALVAWAAVRAVPLDVLGQSESPLALVWQYGRGSGAGFLSAIAVFAALNGILAQIVMATRVLYGLGGRTKALALFHTAHPRFGTPVLATFLVGAAVIFCALYVPVETLAETTSSILLAVFALVNGALIVQKRRAPEARFRVPMAVPVLGLVLSLAALSVAVRGIL

SEQ ID NO: 36734 - DNA, 1443 bp, Xylella fastidiosa Dixon
  CDS (1)..(1443)
atgtcattcttgccatcgtttctaaagcgcaagtccattgatctaatcaccgtgcatgaagaaggacgacgcctggtccctacactgagctggccacatctgatcgcatttgggattggtgcaatcgttggcactgggatctacaccttaatcggggtcggggcagaaaaagcggggccagcagtcctcctctcattcgtcatcgctggggtcatctgtgcctgcgcagcgctggcatatgccgagatggcgacactgatgccagtggcaggcagcacttatacgtacagctatgtggccctcggtgaggggattgcctggatcgtggggtggagtctcatcttagagtactcactggtggtcagcactgttgcggtgggatggtccgggtacatgactgggtttctcaagagcgtaggggtcgatatgccgctggcgctcaccgccggaccgtatgctggcgggataatcaatcttccggcggtagtgatcacctgcgttgtggctggactgctgatcgtcggcacaaaagaaagcaccacactcaacgcggttctggtggtggttaagatcattgcgctctctgtgttcgtcgtgatcgcgctaccacattttgatatggctcatctgaaaccgttcatgccctatgggtttaccaagtcaatcgacaccggaggtgtggaacgcggggttatggccgctgcagcaatcattttttttgctttctatggtttcgatgcaatctccaccgcagccgaggaaactaagaatccaagccgcgatctgtccatcggcatcatcggttctatgatcggatgcaccttaatttacgtattagtggcactagctgcgatcggtgcaatgcactacaccgtgttcggtcccagtactgaaccgctggcgctgattctgcggcaacttgaccagggcaacaccgccaggctcatcggagcagctgcgattatcgcgctacccactgtactgttggcctttttatatggacaaagccgcattttgttcgtgatgtctcgagatgggctgctgccacgtggattgtcgacggtgaatgaacgcacaggaacaccgatcgccacgacactgttcaccgcaattctcgtcgcaacggcagcagggttggtgccattgggcgagattgccgcgctggctaatgctggcacgctgactgcgttcatcgcagtggctttatgcctgctggtaatgcgggtacgtgaaccacagcgcgtgcgtgcattccgtacaccactggcttgggtcgtcgggccaatcgcaattgctggttgtttgtatctgttctggagtctaccaaagatgacacagtctctttttctgctgtggaacgcactgggattgtgtgtgtatctggtctatgggcgccacaccagcctgctatcaaagggggtaagcatcgacacgccaagataa

SEQ ID NO: 36735 - protein, 480 aa, Xylella fastidiosa Dixon
MSFLPSFLKRKSIDLITVHEEGRRLVPTLSWPHLIAFGIGAIVGTGIYTLIGVGAEKAGPAVLLSFVIAGVICACAALAYAEMATLMPVAGSTYTYSYVALGEGIAWIVGWSLILEYSLVVSTVAVGWSGYMTGFLKSVGVDMPLALTAGPYAGGIINLPAVVITCVVAGLLIVGTKESTTLNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNERTGTPIATTLFTAILVATAAGLVPLGEIAALANAGTLTAFIAVALCLLVMRVREPQRVRAFRTPLAWVVGPIAIAGCLYLFWSLPKMTQSLFLLWNALGLCVYLVYGRHTSLLSKGVSIDTPR

SEQ ID NO: 36736 - DNA, 1443 bp, Xylella fastidiosa Ann-1
  CDS (1)..(1443)
atgtcattcttgccatcgtttctaaagcgcaagtccattgatctaatcaccgtgcatgaagaaggacgacgcctggtccctacactgagctggccacatctgatcgcatttgggattggtgcaatcgttggcactgggatctacaccttaatcggggtcggggcagaaaaagcggggccagcagtcctcctctcattcgtcatcgctggggtcatctgtgcctgcgcagcgctggcatatgccgagatggcgacaatgatgccagtggcaggcagcacttatacgtacagctatgtggccctcggtgaggggattgcctggatcgtggggtggagtctcatcttagagtactcactggtggtcagcactgttgcggtgggatggtccgggtacatgactgggtttctcaagagcgtaggggtcgatatgccgctggcgctcaccgccggaccgtatgctggcgggataatcaatcttccggcggcagtgatcacctgcgttgtggctggactgctgatcgtcggcacaaaagaaagcaccacagtcaacgcggttctggtggtggttaagatcattgcgctctctgtgttcgtcgtgatcgcgctaccacattttgatatggctcatctgaaaccgttcatgccctatgggtttaccaagtcaatcgacaccggaggtgtggaacgcggggtgatggccgctgcagcaatcattttttttgctttctatggtttcgatgcaatctccaccgcagccgaggaaactaaaaatccaagccgcgatctgtccatcggcatcatcggttctatgatcggatgcaccttaatttacgtattagtggcactagctgcgatcggtgcaatgcactacaccgtgttcggtcccagtactgaaccgctggcgctgattctgcggcaacttgaccagggcaacaccgccaggctcatcggagcagctgcgattatcgcgctacccactgtactgttggcctttttatatggacaaagccgcattttgttcgtgatgtctcgggatgggctgctgccacgtgtattgtcgacggtgaatgaacgcacaggaacaccgatcgccacgacactgttcaccgcaattctcgtcgcaacggcagcagggttggtgccattgggcgagattgccgcgctggctaatgctggcacgctgactgcgttcatcgcagtagctttatgcctgctggtactgcgggtacgtgaaccacagcgcgtgcgtgcattccgtacaccactggcttgggtcgtcgggccaatcgcaattgctggttgtttgtatctgttctggagtctaccaaagatgacacagtctctttttctgctgtggaacgcactgggattgtgtgtgtatctggtctatgggcgccacaccagcctgctatcaaaggcggtaagcatcgacacgccaagataa

SEQ ID NO: 36737 - protein, 480 aa, Xylella fastidiosa Ann-1
MSFLPSFLKRKSIDLITVHEEGRRLVPTLSWPHLIAFGIGAIVGTGIYTLIGVGAEKAGPAVLLSFVIAGVICACAALAYAEMATMMPVAGSTYTYSYVALGEGIAWIVGWSLILEYSLVVSTVAVGWSGYMTGFLKSVGVDMPLALTAGPYAGGIINLPAAVITCVVAGLLIVGTKESTTVNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRVLSTVNERTGTPIATTLFTAILVATAAGLVPLGEIAALANAGTLTAFIAVALCLLVLRVREPQRVRAFRTPLAWVVGPIAIAGCLYLFWSLPKMTQSLFLLWNALGLCVYLVYGRHTSLLSKAVSIDTPR

SEQ ID NO: 36738 - DNA, 1437 bp, Xylella fastidiosa Ann-1
  CDS (1)..(1437)
atgttcaaacaactctgggccaccaaactctctcaacccagccaggacagtgccgaaggactcagcctgcaacgcgtccttggagtgtgggggttaactgcactgggtatcggtgcggtgattggcggcggcatctttgtcattaccgggcaagccgcggccaatcacgccggaccagccattatgctgtcgttcgcactcgcggcgatctgctgtacgttctgtgcgctggcgtatgccgaattcgcggcgatggtgccggtctctgggagcgcctacacctatacctatgccactttcggtgagctggcagcctggttcatcggttggatgctggtattggaatatggggtttctgccgcggcggtggcggtgagctggagcggctatttcctcagcttgttacagcatctgggcatccatctgcccgcagcactagtgaatgcgccattggacggcacgctgcacgccactggagccattgccaatctgccggcagccaccatcgtgctgctgctgacttggttgtgctacttcggcatccgtaagtcctcgaagatcaatatcgcaatggttgcactcaaaagcgggctgatcttgctgattattggcgtcggctggaaatacgtgaaccctgattactggcaaccgttcatcccgaccaatcaagggccgggcaaatacggatggaatggtgtgttacatggcgcgtcaatggtgtttttcgcctacatcggttttgaagcggtgtcggtggccgcgcaggaatcgcaccgtccacagcgcgaccttcctatcagcatgatgagtgcgttagcgatctgcaccgtgctgtacatcatgatggccgccgtcatgactggattagtcccttacacgcaactgggcacagatgagccagtcgtcaccgcagtcgccgcacacccccaactgggctggctgcgcgtcgtggtcgaaatcggtgcattggtcggactgtcttcggtcgtgttggtgatgctcatcggacaaccgcgcatctttatgatcatggccggtgatggcctgctgccaccgatattcagcacaatccactccaagcaccgcactccgcacatcaacacggtgatcaccggactaggtattgcgttgctcgcagcgttgctcgcagcggtgttcccactggatgtactcggcgaactcacctcaatggggacgttgattgcctttaccgccgtctgtgccggcgtgctgattctgcgctgtactcggccagatctgccacgcccattccgaatgccggcagcatggttattttgctccgctggtgtactcagttgcattaccttattgtcagcaatgaccaggcacaattggatgctgatgagcgtgtggactgttcttggtttttccctgtacttcagttacggatatcaccacagcaaactgcatcaataa

SEQ ID NO: 36739 - protein, 478 aa, Xylella fastidiosa Ann-1
MFKQLWATKLSQPSQDSAEGLSLQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIHLPAALVNAPLDGTLHATGAIANLPAATIVLLLTWLCYFGIRKSSKINIAMVALKSGLILLIIGVGWKYVNPDYWQPFIPTNQGPGKYGWNGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAALLAAVFPLDVLGELTSMGTLIAFTAVCAGVLILRCTRPDLPRPFRMPAAWLFCSAGVLSCITLLSAMTRHNWMLMSVWTVLGFSLYFSYGYHHSKLHQ

SEQ ID NO: 36740 - DNA, 1491 bp, Xylella fastidiosa Ann-1
  CDS (1)..(1491)
atgactcacgcgaccatctatcagggggaggaacgtcgcatgctcaaaaaacatttattcatcgtcaaaccgatcgagccgacaaatcacacagggacaggtaaaggcggaacgcaactcaaaagatcgctaacggcaggacagttagtgatgctcggcatcggggccgtgattggcgctggtattttcgtgctcagcggacacgctgccgccgagtatgccggcccagccgtggtactgagctacattctggcgggaattgcctgtgctttggctgggttgtgttatgcggagttcgcggcaatgctgccggtctccggttccgcttactcttatgcctacgcgacgctcggggaattcacggcttggttcatcggttggaatctgatcctggaatatatgttctctgcctcaaccgtggcggtcggctggtccggttatctcaatagtttcctgagcagtttcggttatgggctgccagcctcgctatctagtgcacctctggacgtagtcgatgggcggctgatttatagcggtggcctgatcaatctgccggcagtcgcgattgtggccgcgatcagtgggctgtgctacgtcgggatcactcaatcggccttcgtcaactccatcaccgtggcgatcaaggtcagtgtcatcgtgctgttcatcgctttcgccgcacgctatgtcaacccggacaactgggtccccttcgtcccggacaacgtggcaccaggcaagtacggcattgaaggggtgatccgcggtgcagccgtggtgtttttctcctatatcggctttgatgcagtctccaccactgcgggggaagccaagaatccacaacgtgacatgcccatcggcatcctcggctcgctcgccatctgtacggtgatctacattgccttctccggtgttctcaccggcctgatgcactactcgcagttggatacgcccaaacccgtggccaccgcgctggaaacctacccaacgctgtcatggctcaagcatgtcgtagaaatcggcgcgattgcagggctgagttcaacgatgctgatgatgctaatggcacaaccgcggattttctacgcgatgtcgcaggatggcctgctgcccaagttgctttctaaagtgcatccaaaattccagactccccacgtaggtacgctcatcgtcggtgcctgtgcctgtgctttagccggactgtttccaatcagtctgcttggcgatctggtctccatgggcacgctgctagcattcgcgacggtctgcattggcatcgtggtactacgccgtacccgcccggatctgcctcgccccttccgggtccccatgtactgggtgatcgcccctacaggtgcggcagcctgtctgtacctgttctggcagccgttcaccgagcactggccgctgatggtcggttggacggtactcggcttggtgatgtatggcttatacggctatcaccacagtaaattacgacatggtggctaa

SEQ ID NO: 36741 - protein, 496 aa, Xylella fastidiosa Ann-1
MTHATIYQGEERRMLKKHLFIVKPIEPTNHTGTGKGGTQLKRSLTAGQLVMLGIGAVIGAGIFVLSGHAAAEYAGPAVVLSYILAGIACALAGLCYAEFAAMLPVSGSAYSYAYATLGEFTAWFIGWNLILEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNVAPGKYGIEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLIVGACACALAGLFPISLLGDLVSMGTLLAFATVCIGIVVLRRTRPDLPRPFRVPMYWVIAPTGAAACLYLFWQPFTEHWPLMVGWTVLGLVMYGLYGYHHSKLRHGG

SEQ ID NO: 36742 - DNA, 1329 bp, Lactobacillus gasseri
  CDS (1)..(1329)
ttgaaaggaaagcacatattgaaaagacaaattagcttcggacaggcgctggctacagtggtaggaactgtaattggcgggggcgtcttctttaaaatcggtagcattagtcatgaaacaggcacaccatctttaactctttttgtttggattttagccggtatcgtttctattgcttctggtctaacagtttctgaaattgctgctgcacttccagttactggcggatcaattaaatatattgaatatacttatgggaaagtttggggctttttatttggctgggcacaaatgctagtctactttcctgccaatatcgccgctttaagcgtggtatttgggcaacaatttgctgtcttatttggtttccctactaaatatgcaaccctgattgctttattgctcgctctttttttaatgagtttaaattttatttctaccaaattttcaaccagaatgcagtcagcgatgacaattctgaaggctattccaattgcattaattgtaatttttggcctttttaattcaactaaaattaatgtcaacttacttcccttaagttctggccataatatttctttttgggctggtttaagtggcggtttactagctgctttatttgcatacgacggctggatcaatgtcaccaatctagctggtgaagttaaagaaccagaaaagaacttgtcaagagccattattattggactatccgcaattactttaatttatgtgttagtaaattatgctttcttaactgcaattccctttaaagaaataattggcaaccaaaatactgcttatcttgcctccttaaagctctttggcagtctagggggcaaattaattacaatcggaattttaatttctgtttatggagcaattaatggctttatgcttacaggaatgagaattccatatactctagcaaaagataaaatgttgccattttccaataaaatcggtcgcactaacattaatacaggtgtaccgacaattagtgctttgattattttgaccgtttccttaataatgatttttttaggaacttttgatctcttaactaatatgttggtatttgttatgtggacctttacgacattaatttcaattgcggtggtaattctacgctatcgtgagcctaaactagaacggccatatgttgttccttggtacccaattattccaatcatttcaatcggcggtggtctttttattgtaattagtaccgtaattaatgaattctggctttcaataactggaattggtttaacagctttgggattacctgtttactactatatgaagaaacataatcatcagaattaa

SEQ ID NO: 36743 - protein, 442 aa, Lactobacillus gasseri
MKGKHILKRQISFGQALATVVGTVIGGGVFFKIGSISHETGTPSLTLFVWILAGIVSIASGLTVSEIAAALPVTGGSIKYIEYTYGKVWGFLFGWAQMLVYFPANIAALSVVFGQQFAVLFGFPTKYATLIALLLALFLMSLNFISTKFSTRMQSAMTILKAIPIALIVIFGLFNSTKINVNLLPLSSGHNISFWAGLSGGLLAALFAYDGWINVTNLAGEVKEPEKNLSRAIIIGLSAITLIYVLVNYAFLTAIPFKEIIGNQNTAYLASLKLFGSLGGKLITIGILISVYGAINGFMLTGMRIPYTLAKDKMLPFSNKIGRTNINTGVPTISALIILTVSLIMIFLGTFDLLTNMLVFVMWTFTTLISIAVVILRYREPKLERPYVVPWYPIIPIISIGGGLFIVISTVINEFWLSITGIGLTALGLPVYYYMKKHNHQN

SEQ ID NO: 36744 - DNA, 1401 bp, Lactobacillus gasseri
  CDS (1)..(1401)
atgaatgagaatgaaacaagtaaattaggcttttggtcgattgttcttttagccattaattcgattattggttcaggaatattcttgacaccaggtagtgttgttcaacaggctggttcaaaagcattaattgtgtactttatagctgcaatttttgcttctattttagctatttcttttgcagcagctgcaaaatatgtaactaaatctggtgctgcttatgcgtattcaaaggcagctttcggaaataatgtaggtttctatatggggattttacgttacttttctgcaagtgtagcttggggcgttatggcagttggggttatcaaatcaacaatttctatttttggcggtaatccaaataaaacgatgagtgtgactatcggctttttgattttaatggctgttattacgattattaacttatttggtcaaaaggttgttaagtatgtcatgaatttagcaacaattggtaagttagctgccttagtattaattattgttgctggagtagtcttgttaattatgactggtgcttcaagtaacctaaatgaagtagatcaaattactcaaaatggtcaaaagattgtaccaactttaactactacaggttttgtaatggcaattgtatcagcattttatgcctttactggatttgaatcagttgcttcgggttcagatgatatgaaaaatccagctaagaacttgccacgtgctattcctttagcaattattgtaattgcaatagtttatattggcgttgttgcagttgcgatgatgcttgatcctaagtcgttgatgacaactaagcaggttgtagcgattgcagcaatttttaaaaatgaaattttaagggatgttattctagtaggtgctttaatttcaatgtttggtattaatgttgcttcaagctttaacgcaccaagaattttagaagctatggcacgtgaaaatcaattctcgaagagtctgactaagagaaccaaaaataattttccaattagaacgttctttatttcagtattacttgcaattttaattccaatggcatttgaatataacatggttaacttgattacattaagtgctatggtacgttttctaggtttcattgtagttccgttagcagttatccaattttatcgtggaaagactgcagaaactgtcttaaatgcccagaagaacatatggactgatattgttgttccaattctttcaattgtcttggttatcttcctattagtcgaatataactggaaagcacaatttggtgtggttaatgcaagtggacaagtaactggaattaattggtatgcaatagcaatgatgatttttggatttattgttttaccactaattatgttctttatctctagaaaagatcgtaaggctagtaaataa

SEQ ID NO: 36745 - protein, 466 aa, Lactobacillus gasseri
MNENETSKLGFWSIVLLAINSIIGSGIFLTPGSVVQQAGSKALIVYFIAAIFASILAISFAAAAKYVTKSGAAYAYSKAAFGNNVGFYMGILRYFSASVAWGVMAVGVIKSTISIFGGNPNKTMSVTIGFLILMAVITIINLFGQKVVKYVMNLATIGKLAALVLIIVAGVVLLIMTGASSNLNEVDQITQNGQKIVPTLTTTGFVMAIVSAFYAFTGFESVASGSDDMKNPAKNLPRAIPLAIIVIAIVYIGVVAVAMMLDPKSLMTTKQVVAIAAIFKNEILRDVILVGALISMFGINVASSFNAPRILEAMARENQFSKSLTKRTKNNFPIRTFFISVLLAILIPMAFEYNMVNLITLSAMVRFLGFIVVPLAVIQFYRGKTAETVLNAQKNIWTDIVVPILSIVLVIFLLVEYNWKAQFGVVNASGQVTGINWYAIAMMIFGFIVLPLIMFFISRKDRKASK

SEQ ID NO: 36746 - DNA, 1332 bp, Leuconostoc mesenteroides subsp. mesenteroides ATCC 8293
  CDS (1)..(1332)
atgggaaataatgaacagaaattgaatcgtggttttggattaacagcatcattagctttagttgttggaacaatcattggttctggtatattttttaagcaaggcagtgtcttagaatcagcaggtagtacaaacgcagcgatgctagcgtggattgctggaggtcttttaacgctagcgtcaggaatcagcgtagctgaaattggctctcaaatggacaaaactggtggcatttatatttatatcgagaaaatttatggtaaggtttggggtttcttagctgggtggatgcaagtggtattttacggcccagcaatgatgggatctattgcagcatattttggcattttatttgttgatttatttggattatctaagtctttagctataccatccgcaattattgcattatcttttgtaggtcttattaactcaattccaaaccgattcagtgccggttttcaaataataacaactacagtgaaaatgttgccgattattgcattaatcatttttggccttttttttggacagcatgatgcgattggacagactgttgctcaggtttcgcagagtggccaaggtggcttcggagtggctgtattagccaccttatttgcttacgatggttgggttactctagctaatataagtggtgaaattaaaaatccacaaaaagtattacccaaggctattatttttggtattttgattgttctagttgcctatgttggtgtgagttttggcgtttatcagagtttgcccgctaatactattgttaagttgggacaaaacacaacgttatacatggctacaaatgcatttggtattattggtggcaggttattgagtatcgctgtattaatttctttacttggaacactaaacgggaaaatcgtttcattccctcgggtgttgtttgcaatggctaacgatggattgtttccgtttgccaaacaatttgccaaaatcaatatgcgttctcgaacacctaataagtccatttggtttatgatttttcttggcattttaatgattgtctttacaaatccagatagattaaccgatattgcgatttttacaacctttttattttatatacttgtttttgctggtgtttttaaattacgcaaaaaggatccttttggagagaagcgtagcttttctatgccgctgtatccttggataccaatcgtcgctatttgtggttcactctatgttgaaatctctgagattatgcacgatttgtctggtgtaataatttctatagcaattgtcgctgctggttaccctgtttatatattcttatctcgccgcacgaataaggagtaa

SEQ ID NO: 36747 - protein, 443 aa, Leuconostoc mesenteroides subsp. mesenteroides ATCC 8293
MGNNEQKLNRGFGLTASLALVVGTIIGSGIFFKQGSVLESAGSTNAAMLAWIAGGLLTLASGISVAEIGSQMDKTGGIYIYIEKIYGKVWGFLAGWMQVVFYGPAMMGSIAAYFGILFVDLFGLSKSLAIPSAIIALSFVGLINSIPNRFSAGFQIITTTVKMLPIIALIIFGLFFGQHDAIGQTVAQVSQSGQGGFGVAVLATLFAYDGWVTLANISGEIKNPQKVLPKAIIFGILIVLVAYVGVSFGVYQSLPANTIVKLGQNTTLYMATNAFGIIGGRLLSIAVLISLLGTLNGKIVSFPRVLFAMANDGLFPFAKQFAKINMRSRTPNKSIWFMIFLGILMIVFTNPDRLTDIAIFTTFLFYILVFAGVFKLRKKDPFGEKRSFSMPLYPWIPIVAICGSLYVEISEIMHDLSGVIISIAIVAAGYPVYIFLSRRTNKE

SEQ ID NO: 36748 - DNA, 1401 bp, Leuconostoc mesenteroides subsp. mesenteroides ATCC 8293
  CDS (1)..(1401)
atgtcacttcttgcgcgagcttttaagcgggaatctgttgataattacctgagtgcagattcacatatgtcgcgtgttttaacaacgcgcgacttgattagtctaggagtaggcacagtcattggtacaggaatatttattttacccggccacgaagccgctgatcatgcaggtccagcagtcgctattgcatttctaattgctgcaattttctctggattatcaggtatggcttttgctgagttctcagcagccatgccagttgctggctcagcttactcatacgggggtgctatttacggagaaatcattggttggctattgggttggtcattaattgttgaatatttcttagcagtatcagcaattgcaaccggattttcagcctaccttggtaatttattagctatatttggcattcacatccctaaatatctatctgccggtccaatggagggcggaattgtcaatttatttgcagtattaattattttattcgtcgctgctatactatcacgaggattaaacacctcaaagaaagttgaaaatggcgcagtcgttatcaaaattgccattttaatcttgttcattgttggcggatcattttttattaaaacaagcaattatgtaccattttaccctaaagaatttcacagtggattgggcggtttgaacggaatttgggccgcaaccgccagcattatttttgcttttctaggctttgataccatcgccgcccacgctgctgaagttaagaacccacaaaagacaatggccaagggtattgttggtacggttattatttcagccctattatatacactcttctctatagtgttaacgggaattgtcaattataaaaaacttggtgttgatgacccagcagcatttgctctgcaagttgtccatcaaacacagttctctatcgtcattactattggtgcgttaatcggtatgttcacagctgtattagccttgatctatgcttcatcccgtttaacttattccttcgggcgtgacggtttgctcccccgcagcctaggtaaaatatccccaggatcgcatttaccagtaaatgcactaattttggcagttgccgttgaggttatttttgcgggccttatccccctcagcacattggctagtttaattaatgcaggtactttaacagcattcgcctttatcaattttggtatcttaatccttcgtcgtcgtaaagatttagctcacgatggtttcaaagtacctggctatccaattgtaccgtttattgcgggtatgataagtttgttctttattacacagctatctgccgagacactcaaaatgtttggcctctggttactacttggtgttatctggtacttctcctatggcattaagcattctaaattatcataa

SEQ ID NO: 36749 - protein, 466 aa, Leuconostoc mesenteroides subsp. mesenteroides ATCC 8293
MSLLARAFKRESVDNYLSADSHMSRVLTTRDLISLGVGTVIGTGIFILPGHEAADHAGPAVAIAFLIAAIFSGLSGMAFAEFSAAMPVAGSAYSYGGAIYGEIIGWLLGWSLIVEYFLAVSAIATGFSAYLGNLLAIFGIHIPKYLSAGPMEGGIVNLFAVLIILFVAAILSRGLNTSKKVENGAVVIKIAILILFIVGGSFFIKTSNYVPFYPKEFHSGLGGLNGIWAATASIIFAFLGFDTIAAHAAEVKNPQKTMAKGIVGTVIISALLYTLFSIVLTGIVNYKKLGVDDPAAFALQVVHQTQFSIVITIGALIGMFTAVLALIYASSRLTYSFGRDGLLPRSLGKISPGSHLPVNALILAVAVEVIFAGLIPLSTLASLINAGTLTAFAFINFGILILRRRKDLAHDGFKVPGYPIVPFIAGMISLFFITQLSAETLKMFGLWLLLGVIWYFSYGIKHSKLS

SEQ ID NO: 36750 - DNA, 1332 bp, Leuconostoc mesenteroides subsp. mesenteroides ATCC 8293
  CDS (1)..(1332)
atggcagagaataaaataacattatcacgatcactttccacaaaagatttggttgtttacggcattatattcatgatcccagtagcgcctatcgccttttacggttcatttctatcgccagcccatggtatggtggcgctagcttatctaatcggaatgattgctatgttatttactggatttagttatgctagcatggctagtgagtttccttactctggttcggtgtatacttacgttcaaaaaggaacaaatcctgtgttaggttttctatcaggatggggtataacgcttgattatattttaattcccgttataacctatcttatcagcgcgtctttcggtcagtcattgttgccggctgttcctttctgggtttggattctaggcatagccatatttaatacagttatcaatttattagggattaaagttgtatcgaaattcagttggttactttttgggttacagggcgtggttttaatagctttcatcgtggggactattgttgccttagcgaatggtacagttagttttaatgtcagttcgttttataatgctagtcattttgatttgtccggagttgttcaagcgactgggattgttattgtcagttatttaggttttgatgccattagtactttatcagaagaagctaacgatccaactaaatcaattggaaaagcgattgtgttgtcaattattttaatcggctcattattcgtcatcgttacattctttgcaggttttgttgcaccaaattatagtgaattaaatccagatacagcatttttaactattttgggaaaagtgggtggtagctggttagtgcatttagctgaattcactttagttttatcatttggtttggcgggtggtcaagaagggcagactgcggtatcaagaattttgtattcaatgggacgagacggtattttaccaaagcgcttatcctacttgcatccccgttataacacgccgtgggttgccattatacttgtggggattgtatctgttgccctttccctatcattatcgttaaccacagtatcaaatttaattagctttggcgccctatttggttttttgtcattaaacatagctgttatttggcatttttatatcaagcgtcctgataaaaatattgagtcgtttgtaaagtatttagtgtcacccttcattgggttttcagtgagtttgtggatatttttgagtttagctcttgaagcaaaattaactgggttattttggttaatcattggactcgttattttagtatataaaacgagtatttttaaaaaacctgtaccccagtttgatttttcagaataa

SEQ ID NO: 36751 - protein, 443 aa, Leuconostoc mesenteroides subsp. mesenteroides ATCC 8293
MAENKITLSRSLSTKDLVVYGIIFMIPVAPIAFYGSFLSPAHGMVALAYLIGMIAMLFTGFSYASMASEFPYSGSVYTYVQKGTNPVLGFLSGWGITLDYILIPVITYLISASFGQSLLPAVPFWVWILGIAIFNTVINLLGIKVVSKFSWLLFGLQGVVLIAFIVGTIVALANGTVSFNVSSFYNASHFDLSGVVQATGIVIVSYLGFDAISTLSEEANDPTKSIGKAIVLSIILIGSLFVIVTFFAGFVAPNYSELNPDTAFLTILGKVGGSWLVHLAEFTLVLSFGLAGGQEGQTAVSRILYSMGRDGILPKRLSYLHPRYNTPWVAIILVGIVSVALSLSLSLTTVSNLISFGALFGFLSLNIAVIWHFYIKRPDKNIESFVKYLVSPFIGFSVSLWIFLSLALEAKLTGLFWLIIGLVILVYKTSIFKKPVPQFDFSE

SEQ ID NO: 36752 - DNA, 1314 bp, Pseudomonas syringae pv. syringae B728a
  CDS (1)..(1314)
atggccactgccgagacttcatcgctgcgccgggcaatcacggcgcccatgctgaccctgttcatccttggcgacgtgctgggggctggcgtctacgcattggctggcacgatcgccggacgcgtcggcggagccatctgggcgcccttgctgattgccctgtgctttgccttgttgaccgcagcgtcctacgccgaactggtgaccaaatacccgcgtgcgggtggtgccgcggtgtacgccgaaaaagccttcggcaagccgctgctgtcgtttctggttggcttttccatggtcgcggcaggtgttaccagcgctgccgggttggccgttgcgtttgccggcgactacttccaggcactgctcgactggcctgcgcagtgggtctgcgtggcatttctggtcaccgtcggcctgctcaatgcacgcggtatcaaggaatcgctttcagccaatctggtcatgacggtcatcgagctgagcggcttgctgatggtgatcgcggcagcgatctggttcgtcagccaggggcaaggcgtgccgcaacgggtgttcgaactggatagcgcctcgcctgcgacggcgattctcggcgcatcgctgctggcgttctattcgttcgtggggtttgaaacctcggccaaccttgccgaagagatcaaggacgtgcgcaaggtctatccacgtgccctgttcggcgcgctgctggcggcgggtgcggtgtacatactggttggcatgggcgcagcgatggtcctgcccgtcgagcaactcaaggattcgcaagcccccctgatggacgtggtcagtgcctcgggcctcggcatacctgcgccgtggtttgcggtgattgcgctgattgcggtggccaacggcgcactgctgaccatgatcatggccagccgactgaccttcggcatggcgcgcgaaggcctgttacctgcggtgatgggttcggtgctgcccaagcggcgcacgccggggctggcaattctggcgaccacactggtggccattgccctgtccttcaccagcaccctgaccatcctcgccgaaaccgtcgtgctgttgctgctcttcgtgtttctcagcgtgaacatcgccgtgctggtactcaagcgcgacaaggtcgaagccgggcactttcaggtccactgggttatcccgctgctgggcattctttcgtgcctgttgctgctcactcagcaaggtccggaaacctggctgcgggcaggcatcatgctggcggtcggtgctgcgctttacggactgacccggctgggcagctcggcgctggcgtcgcatcctcgctga

SEQ ID NO: 36753 - protein, 437 aa, Pseudomonas syringae pv. syringae B728a
MATAETSSLRRAITAPMLTLFILGDVLGAGVYALAGTIAGRVGGAIWAPLLIALCFALLTAASYAELVTKYPRAGGAAVYAEKAFGKPLLSFLVGFSMVAAGVTSAAGLAVAFAGDYFQALLDWPAQWVCVAFLVTVGLLNARGIKESLSANLVMTVIELSGLLMVIAAAIWFVSQGQGVPQRVFELDSASPATAILGASLLAFYSFVGFETSANLAEEIKDVRKVYPRALFGALLAAGAVYILVGMGAAMVLPVEQLKDSQAPLMDVVSASGLGIPAPWFAVIALIAVANGALLTMIMASRLTFGMAREGLLPAVMGSVLPKRRTPGLAILATTLVAIALSFTSTLTILAETVVLLLLFVFLSVNIAVLVLKRDKVEAGHFQVHWVIPLLGILSCLLLLTQQGPETWLRAGIMLAVGAALYGLTRLGSSALASHPR

SEQ ID NO: 36754 - DNA, 1284 bp, Rickettsia sibirica 246
  CDS (1)..(1284)
atgtcacaaaaattaggtttctgggcggtttttgccttagtaaccggcagtcaaatcggtactagcgtttttatattgccgttaagtttagcaccgttcggtatatacagcatttggggctgggtactttcattattcggtgctatgagtatagcacttgtattttctaccctttgtgcaaaatttcctaaaacaggaggtccgcacgtttatgtacgggaaaatttcggggataaaatagcttttttcaccggttggacttactgggttatatcctttgtcagtacaagtatagtagtcatttcggcaataggttatctaacgcctttttttaaatcacaagcgattttagacttaatattacagatcatattattaggtgctattatggttttaaatttaaaaggtcctgaagtagcaggaaaagcagagttttatttaactctcttaaaatttgttccattgcttatagtaggtttatgtgctttatcacattttaatatagataatataactattgccgaggaagtagagaatttaagcattccgagcattatgggaagagttgtacttcttactttttggggatttatcggcatagaatgtgcaactaccacggcaggtgcggtaaaagatccggcaaaaaccattccacgagccataatagttggaactttttgcgtagcagtgttatatattattaatagcataggtataatgggattaatccctgcttctgaacttgtcagtgctaaagctccttatgccgatgccgcttcattattattcgggggtaaatggtcaagcgtaattacggttatagcctcgattatatgtataggtacgctcaatgcttgggtgctaactagcggacagatagctcttgggcttgcagaagacggtttattaccgaaattttttgctaagaaaaatagcaataacgctccaactcacggaattattgtaagctgccttggcattgtgccgttattagtctttacggcaaatgataattttgccaaacagattacacaaataatagatttctcggcaatcacattcttattcgtctatttaatttgtagcttagcttttttaaaggtgatttttagctcaaaagaaaatttttcttattattatttacttatagctataatatcgattatcttttgtgcatgggttatctatgaaacacctgttaaaactctgattatagctagtgcttttactatctttggtattcctttgtattatggatggtataaatgtcatgcccgtctatga

SEQ ID NO: 36755 - protein, 427 aa, Rickettsia sibirica 246
MSQKLGFWAVFALVTGSQIGTSVFILPLSLAPFGIYSIWGWVLSLFGAMSIALVFSTLCAKFPKTGGPHVYVRENFGDKIAFFTGWTYWVISFVSTSIVVISAIGYLTPFFKSQAILDLILQIILLGAIMVLNLKGPEVAGKAEFYLTLLKFVPLLIVGLCALSHFNIDNITIAEEVENLSIPSIMGRVVLLTFWGFIGIECATTTAGAVKDPAKTIPRAIIVGTFCVAVLYIINSIGIMGLIPASELVSAKAPYADAASLLFGGKWSSVITVIASIICIGTLNAWVLTSGQIALGLAEDGLLPKFFAKKNSNNAPTHGIIVSCLGIVPLLVFTANDNFAKQITQIIDFSAITFLFVYLICSLAFLKVIFSSKENFSYYYLLIAIISIIFCAWVIYETPVKTLIIASAFTIFGIPLYYGWYKCHARL

SEQ ID NO: 36756 - DNA, 1443 bp, Psychrobacter sp. 273-4
  CDS (1)..(1443)
atgtctgaattaaaaaaatcgttagggacgctggatgttatcgctttagcgtttggcgctatggtaggttggggctgggtcgtcttggctggtggttggattttatccgctggtacttggggtgcgatgctagcattctttataggcggtttggcagtgatactgattggtgtgacttatgctgagcttgctgcatcaatgccaatcactggtggtgagcatacgtatacgcatcgcgcgctaggagtaaacgtctcctttatctgctcatggagtattttatttggttatttctccgtggtcgcttttgaggcagtcgcattaccgacagtcgtagagtattttattcccaattataatcaagggtatctctggaccatcgctgggtgggatgtctacgctacatgggtcggggttgggatgctaggttccgtcattgtaacatggctaaatatccgcggtatggaagtcagcgcatggttccaaaaaaccgcagtactgggtattctattcgtcgggactttgctatttattggtgcagtactttataaccctgacacctctacagcaatacaatcgccagccttcattggtggtgtcggtggcatgatggccgttattgtcatggtgccctttatgttcgtgggttttgacgttattccacaagcggcagaagagattgatttaactcgtcctaatattggtaagtttttgattatctctatcgtcgttgcggtgatgtggtatgtgggtattgcttggagtgttgggacgactttgccgcttgtacaagcagagagctcgaccttagccactgctgatgccatgaccaatgcttggcaaggcaaatgggcgggtattctgttggttatcggcggtgtactgggtattttatcaagctggaatgcgttcttaattggtggtagtcgtctgctgtatgcgatgtccaaagcgcgtatgttgccagcctttttaggtaagttacatccaaaatataaaaccccttcaaatgcgattttattgattggtggtttagcgacgctagcaccattgtttggtcgtaaaatgttggtttggatcgttgatgccggtggttttggtatcgttattgcttatacctgtgtcgctatttcattcttagtactacgctaccgtgagcctgatatggtacgtccatttaagataccagcaggtaagcttgtcggtatggtaacgattgtacttagtgttggtttattaatgttatatatgccaggtatgccatcagcactgactgccgtcgaatggtggattttctttggttggaccatgttaggtatcgtgttatacggttatgcaagggtgaaatatccaggcattagtgaatcgattatggcagaagagctacgtgaattaaagattgtcaatcagctgtggttaaaggataattcaactaagaagtaa

SEQ ID NO: 36757 - protein, 480 aa, Psychrobacter sp. 273-4
MSELKKSLGTLDVIALAFGAMVGWGWVVLAGGWILSAGTWGAMLAFFIGGLAVILIGVTYAELAASMPITGGEHTYTHRALGVNVSFICSWSILFGYFSVVAFEAVALPTVVEYFIPNYNQGYLWTIAGWDVYATWVGVGMLGSVIVTWLNIRGMEVSAWFQKTAVLGILFVGTLLFIGAVLYNPDTSTAIQSPAFIGGVGGMMAVIVMVPFMFVGFDVIPQAAEEIDLTRPNIGKFLIISIVVAVMWYVGIAWSVGTTLPLVQAESSTLATADAMTNAWQGKWAGILLVIGGVLGILSSWNAFLIGGSRLLYAMSKARMLPAFLGKLHPKYKTPSNAILLIGGLATLAPLFGRKMLVWIVDAGGFGIVIAYTCVAISFLVLRYREPDMVRPFKIPAGKLVGMVTIVLSVGLLMLYMPGMPSALTAVEWWIFFGWTMLGIVLYGYARVKYPGISESIMAEELRELKIVNQLWLKDNSTKK

SEQ ID NO: 36758 - DNA, 1446 bp, Rickettsia rickettsii
  CDS (1)..(1446)
atgagagacaattcacaaaaaataagctcactaaaacaggagaaactaatgagttttttaaggaagaaaagttttgaatcagtaaaagagataggcagttcaagcggttttagcaagacacttggagcattcgatttaatattactgggtcttggtgcgatgatcggcacaggcgtattcgtcgttaccggtataattgctgctaaatattcaggacctgcagtaatgttatcttatgcgattgcaggtattacctgtatctttgtagcgcttgtttatactgaacttgctgcaatgcttccgacatcaggaagtatttacacttattcctatgtagcgtttggcgaagtatttgcttggatgatcggtagtgttataatattagaacttggttttgctgcaggaatagtagctgcaggctggtcgggctacgtacaaggaatactagcagcaggtggaatcaatttaccgaaagaattaactactgtaccgacaaacggcggtataataaatttaccggcatttttaatctcgggatttattggatttattttatatttaggtactaaagatagtaagagactaaatgcaattttagttttcataaaaatgactgcaatatttgtatttatactcgctgctgcccctcattttgatgctactaactggagtaattttatgcctttcggttttagtaatgttttagtaggtgcgtctattttattcttagcttttacgggttttggaacgattgcaaccgcagctgaggagtgtaaaaatccaaaacgcgatataatgatcggtattattggctcacttgttctaactactatagtttatgtaacaatggcagggcttgttaccggtattgcaccttttgatcagttaaataacgatcaaccgcttgcttatgctttaactatcaataatagcaagatcggctctgctattgttgcaaccggagcagtttgcggtatgatgacggtgttgatgatgaatatttacggtacttctcgtattttttatgctattgcacgtgacggtttactaccgaaaagttttgcaaagctgcacccaaaatatgatagtccgtatattacgattataatatttgcttctttagccgctatccttggaggattttgttctacggaattattaacgcaattaacttcaatgggagctcttattgattatataaccgttacaataatagtggtattatttagggtaacgctacctgatgctcaaagaccttttagatgtcctttagtatttattatcgtaccgtttattttaattgcttgtgcatatttactatttattcaaatatatgacggtgaatttaatctattaaccgcaggtcgtgtattaatatattggtttattacaatatttgttttatatattataagatcgttttttatgcaaaaagagcagaattaa

SEQ ID NO: 36759 - protein, 481 aa, Rickettsia rickettsii
MRDNSQKISSLKQEKLMSFLRKKSFESVKEIGSSSGFSKTLGAFDLILLGLGAMIGTGVFVVTGIIAAKYSGPAVMLSYAIAGITCIFVALVYTELAAMLPTSGSIYTYSYVAFGEVFAWMIGSVIILELGFAAGIVAAGWSGYVQGILAAGGINLPKELTTVPTNGGIINLPAFLISGFIGFILYLGTKDSKRLNAILVFIKMTAIFVFILAAAPHFDATNWSNFMPFGFSNVLVGASILFLAFTGFGTIATAAEECKNPKRDIMIGIIGSLVLTTIVYVTMAGLVTGIAPFDQLNNDQPLAYALTINNSKIGSAIVATGAVCGMMTVLMMNIYGTSRIFYAIARDGLLPKSFAKLHPKYDSPYITIIIFASLAAILGGFCSTELLTQLTSMGALIDYITVTIIVVLFRVTLPDAQRPFRCPLVFIIVPFILIACAYLLFIQIYDGEFNLLTAGRVLIYWFITIFVLYIIRSFFMQKEQN

SEQ ID NO: 36760 - DNA, 1284 bp, Rickettsia rickettsii
  CDS (1)..(1284)
atgtcacagaaattaggtttctgggcggtttttgccttagtaaccggcagtcaaatcggtactagcgtttttatcttgccgttaagtttagcaccgttcggtatatacagcatttggggctgggtactttcattattcggtgctatgagtatagcacttgtattttctaccctttgtgcaaaatttcctaaaacaggaggtccgcacgtttatgtacgggaaaattttggggataaaatagcttttttcaccggttggacttactggattatatcctttgtcagtacaagtatagtagtcatttcggcaataggttatctaacgcctttttttaaatcacaagcgatttcagacttaatattacagatcatattattaggtgctattatggttttaaatttaaaaggtcctgaagtagcaggaaaagcagagttttatttaactctcttaaaatttgttccattgcttatagtaggtttatgtgctttatcacattttaatatagataatataactattgccgaggaagtagagaatttaagcattccgagcattatgggcagagttgtacttcttactttttggggatttattggcatagaatgtgcaactaccacggcaggtgcagtaaaagatccggcaaaaaccattccacgagccataatagttggaactttttgcgtagcagtgttatatattattaatagcataggtataatgggattaatccctgcttctgaacttgtcagtgctaaagctccttatgccgatgccgcttcattattattcgggggtaaatggtcaagcgtaattacggttatagcctcgattatatgtataggtacgctcaatgcttgggtgctaactagcggacagatagctcttgggcttgcagaagacggtttattaccgaaattttttgctaagaaaaatagcaataacgctccaactcacggaattattgtaagctgccttggcattgtgccgttattagtctttacggcaaatgataatttggccaaacagattacacaaataatagatttctcggccatcacattcttattcgtctatttaatttgtagcttagcttttttaaaggtgatttttagctcaaaagaaaatttttcttattattatttacttatagctataatatcgattatcttttgtgcatgggttatctatgaaacacctgttaaaactcttattatagctagttcttttactatctttggtattcctttgtattatggatggtataaatgtcattcccgtctatga

SEQ ID NO: 36761 - protein, 427 aa, Rickettsia rickettsii
MSQKLGFWAVFALVTGSQIGTSVFILPLSLAPFGIYSIWGWVLSLFGAMSIALVFSTLCAKFPKTGGPHVYVRENFGDKIAFFTGWTYWIISFVSTSIVVISAIGYLTPFFKSQAISDLILQIILLGAIMVLNLKGPEVAGKAEFYLTLLKFVPLLIVGLCALSHFNIDNITIAEEVENLSIPSIMGRVVLLTFWGFIGIECATTTAGAVKDPAKTIPRAIIVGTFCVAVLYIINSIGIMGLIPASELVSAKAPYADAASLLFGGKWSSVITVIASIICIGTLNAWVLTSGQIALGLAEDGLLPKFFAKKNSNNAPTHGIIVSCLGIVPLLVFTANDNLAKQITQIIDFSAITFLFVYLICSLAFLKVIFSSKENFSYYYLLIAIISIIFCAWVIYETPVKTLIIASSFTIFGIPLYYGWYKCHSRL

SEQ ID NO: 36762 - DNA, 1359 bp, Anabaena variabilis ATCC 29413
  CDS (1)..(1359)
atgagtagacatacagattacagttcgctagagcaaatacagacgactggtgcagctgcacccaagccattattaacactatcagacgcggttgctctcattgtcgggattgtcattggtgcaggtatttttcaaacccctgcgctggtagctagccaagcaggcagtgatattgctgtactgttattgtggctagctggtggcctagtatctatcgtcggtgcattgtgttacgcagagttggcgacgacttaccctaatgttggtggagtctactattacttaaagcgagcatttggacaaaaaattgcctttctatttgcctgggcaagactgacagtgattcaaactggttctattgccctgcttgcatttgtctttggcgattacgcctcggaaattttgcggctcggcacattttcatcatctgtgtatgccacagtggtgattgtgctgttaacaatcttgaatatagtgggtttgcaacagggaaagtggacgcaaaacttactaacggtagccaaagtcctgggtttgctgctagtggtagtattcggattgggtgccactgccaattctgtagctccgatagaatctactcctccagggagttggggactagcaatggtgtttgtgctactttcctatggtggttggaatgaggcggcgtatatttccgcagagatacaaaatagacaacggaatatagtgcgatcgctagtgtggagtattggcattatcaccgcaatttacttgctaatcaatctagcttacctacgaggtttgggattagctaacatggcggactcatcggcagtcgcggcagatttaatgcgtactatttggggtacaccaggagctttatttattagcgtcttgattgccatttgtactctaggggcaatcaacgccactatttttactggcgcacgtactaactatgccttaggacaagatttcactctgtttggcttcatgggtagctggcgacaactccccagtactcctgggactgccttattagtccaaggggcgatcgctctcgccttagtgctattaggtacattcacccgtaaagggtttgaaacaatggtggactataccgcacccgtgttttggtttttctttctactttctggcatatcactactaatattgcgccggaaggaaccacatatactgcgcccattccgtgtgcctttttatcctgttaccccactactcttttgtgctgtttgtggctacctactatattccagtgtggtttatacaaacgtgggtgctgtagtcggtgttttggtggtgatagcaggtatccccatattgttctggaatcgctaccgccaaggtaaggcttag

SEQ ID NO: 36763 - protein, 452 aa, Anabaena variabilis ATCC 29413
MSRHTDYSSLEQIQTTGAAAPKPLLTLSDAVALIVGIVIGAGIFQTPALVASQAGSDIAVLLLWLAGGLVSIVGALCYAELATTYPNVGGVYYYLKRAFGQKIAFLFAWARLTVIQTGSIALLAFVFGDYASEILRLGTFSSSVYATVVIVLLTILNIVGLQQGKWTQNLLTVAKVLGLLLVVVFGLGATANSVAPIESTPPGSWGLAMVFVLLSYGGWNEAAYISAEIQNRQRNIVRSLVWSIGIITAIYLLINLAYLRGLGLANMADSSAVAADLMRTIWGTPGALFISVLIAICTLGAINATIFTGARTNYALGQDFTLFGFMGSWRQLPSTPGTALLVQGAIALALVLLGTFTRKGFETMVDYTAPVFWFFFLLSGISLLILRRKEPHILRPFRVPFYPVTPLLFCAVCGYLLYSSVVYTNVGAVVGVLVVIAGIPILFWNRYRQGKA

SEQ ID NO: 36764 - DNA, 1365 bp, Ralstonia eutropha JMP134
  CDS (1)..(1365)
atgctggtgaacagccacgttggcggcctgaagaaggtcctgggtccggtggaccttgtactgatgggcatcggtgccatcatcgggaccggcatttttgtgcttaccggaacgggcgccttgaccgccggtcccgcactcaccatatctttcgtcattgccgccatggcctgcggcttcgccgcactgtgctatgccgagttcgcctccgccatccctgtgtcgggatcgatctacacctatagctatgcgacgctgggcgaaatcatcgcgtggatgatcggctgggatcttctgctcgaatacggcctcgctacctcggcggtgtcagtgggctggtcgggatacttccagtcgttggccgcaggtttcggcctgcatttgccggcggcgctgacagcagctccaggcgcagtgccgggcgtgcagaccttgttcaacctgccggccttcctgatcatgctgattaccacgtgggtggtgtcctgcggcgtgcgtgagtcggcgcgcctcaacaacgtgatggtggcgatcaaggttgcagtggtcgtgttgttcatcgcagtcggcgtctggcacgtcaaaccggccaactggcagccattcgcgccgttcggggtatccggcatcttcaatgctgcagcgctggtgttcttcgccttcatcggcttcgacgcggtgacgtcggccgccgaggaagtacgcaatccgcaccgcgacctgccggtcggcatcatcggctcgctggcggtctgcacagtgctatacgtgattgtcgcggccatcatgaccggcgtcgttcccttcgccaagttcgccggcatcgaccatccggtgtcgctggttctgcagtacgcgggacagaactgggtggccggctttgtcgacctgggcgcgattctcggcatgaccactgtgatcctggtcatgacctttggccagactcgcgtcatctttgccatgtcgcgcgacggcctgttgcccgccaggctgtcgtcagtacacccggtacacgccacgccattctttgccacctggactgtcggtatcgtattcgcgatgatcgccgcattcgtgccgctcaatgtgctggccgagttgatcaatatcggcacgctctccgccttcacgctgatttcgatcgcggtgctggtgcttcgccggacccgtcccgaactgcatagggccttccgatgccccggcgtgccggtggttccgctgctatcggtgggcttctgcctgtttctgatggcacaccttcaagcgctgacctggatcgcatttctcacctggctggcgatcggactatcggtctacttcctgtacgcgcgccgcaatgcggtgctacacgaaggcagcaggtag

SEQ ID NO: 36765 - protein, 454 aa, Ralstonia eutropha JMP134
MLVNSHVGGLKKVLGPVDLVLMGIGAIIGTGIFVLTGTGALTAGPALTISFVIAAMACGFAALCYAEFASAIPVSGSIYTYSYATLGEIIAWMIGWDLLLEYGLATSAVSVGWSGYFQSLAAGFGLHLPAALTAAPGAVPGVQTLFNLPAFLIMLITTWVVSCGVRESARLNNVMVAIKVAVVVLFIAVGVWHVKPANWQPFAPFGVSGIFNAAALVFFAFIGFDAVTSAAEEVRNPHRDLPVGIIGSLAVCTVLYVIVAAIMTGVVPFAKFAGIDHPVSLVLQYAGQNWVAGFVDLGAILGMTTVILVMTFGQTRVIFAMSRDGLLPARLSSVHPVHATPFFATWTVGIVFAMIAAFVPLNVLAELINIGTLSAFTLISIAVLVLRRTRPELHRAFRCPGVPVVPLLSVGFCLFLMAHLQALTWIAFLTWLAIGLSVYFLYARRNAVLHEGSR

SEQ ID NO: 36766 - DNA, 1383 bp, Ralstonia eutropha JMP134
  CDS (1)..(1383)
ttgaaacacctgcaacgtaacctgggcgcgcggcacatccgctttcttgcgcttggctcggctattggcacgggcctgttctatggctccgcatcggccatccaactcgctggcccggccgtcattctggcctatatcctgggcggagcggccgtctacatggtcatgcgcgcgctcggcgaaatggcggttcgcgagccagtatccggttccttcggacggtatgcaagcgagtatcttgggccgctcgcaggctttctcaccggatggacctatatcctcgaaatgatcatcgtttgcctcgcagacgtgaccgcattcggcatctacatgggattctggttcccggaagtcccgcaatggatatgggtgctcggcatcgtcatgctgatctgtgggttgaacctgtgcaacgtgaaggtgttcggggaactggagttctggcttgcgttggtgaagatccttgccatcggcgcgatgatcattggcggcaccctgatcctgtttctaggcgtcaagatgaatggcgaacactctccgggcctgaccaatctgtgggcgcacggcggtttcctcccgcatggcgcaggagggctgatcgcctcgctggcggtggtgatgtttgcgtacggtggcatcgagatcatcggcatcaccggcggcgaagcaaaggagccggagaaggtcattccaagggcgatcaatgccgtacctgcacggattctgctgttctacgtactgacgatggtcgtcctgatggcaatctttccgtggaccggcatcggcggtcagggcagcccgtttgtacagatattctcgggactgggcatcaagtctgccgcagcgattctcaacctgatcgttatttccgccgccatctcggcaatcaatagcaacatctttggtgccggacggatgatgttcggcatggcagagcagggccaggcaccccgtctttttgcgatcacctcgcgtcaaggtgtgccttgggtgacggtgctggcgatggctgccgcattgctcggcggcgttgtgctgaactacctgattcccgagcaggtgttcgtgatcattgcgtcgatcgcgacctttgcgaccgtatgggtctggctcatgatccttctgtctcaggttgccatgcggcgtcgcctgtcggccgaagaggttcgcgcgctcaagttcaaagtgccaatgtggcccgtcggtccggcgcttgcaattgccttcatgttgtttgtcatctgtgtgctgggctatgtcgaagacacgcgcgtagcgctttatatcggtgcgggttgggttgccctgctgtccctcgcctggtacctcagggctaagcctcatgaagaccgcattctcaccggggagtccagcgcattgtga

SEQ ID NO: 36767 - protein, 460 aa, Ralstonia eutropha JMP134
MKHLQRNLGARHIRFLALGSAIGTGLFYGSASAIQLAGPAVILAYILGGAAVYMVMRALGEMAVREPVSGSFGRYASEYLGPLAGFLTGWTYILEMIIVCLADVTAFGIYMGFWFPEVPQWIWVLGIVMLICGLNLCNVKVFGELEFWLALVKILAIGAMIIGGTLILFLGVKMNGEHSPGLTNLWAHGGFLPHGAGGLIASLAVVMFAYGGIEIIGITGGEAKEPEKVIPRAINAVPARILLFYVLTMVVLMAIFPWTGIGGQGSPFVQIFSGLGIKSAAAILNLIVISAAISAINSNIFGAGRMMFGMAEQGQAPRLFAITSRQGVPWVTVLAMAAALLGGVVLNYLIPEQVFVIIASIATFATVWVWLMILLSQVAMRRRLSAEEVRALKFKVPMWPVGPALAIAFMLFVICVLGYVEDTRVALYIGAGWVALLSLAWYLRAKPHEDRILTGESSAL

SEQ ID NO: 36768 - DNA, 1398 bp, Ralstonia eutropha JMP134
  CDS (1)..(1398)
atgagtctgttccgcaccaagaatatcgacgccatgctcgccgtggcacacaacgacggcctgaagaaggtcctcgggccgatggatctcgtgatgatgggcatcggcgccatcatcggcaccggcattttcgtgctgaccgggaccggtgccctgaccgcggggcccgcacttaccgtgtcattcgtgattgccgcgatggcctgcggttttgccgcgctgtgctacgcggagttcgcgtcggccattcccgtctcgggttctatctacacctatagctatgccacgctcggcgagatcatcgcctggatgatcggctgggacctgttgctcgaatacggcctcgccacgtcagcggtgtcggtgggctggtccggctatttccagtcgctggtgtccggattcggcgtgaagttgccggccgcgctgaccgcggcgcccggtgcggtgcccggtgtcgagaccatggtgaacttgccggccgtgctgatcatgctggcgattacgtggatcgtgtcgtacggcgtgaaggaatcggcgcggttgaacaacgtgatggtggcgatcaagatcggcgtggtgctgctgttcatcgcggtcggcgtatggcacgtgaagccggccaactgggagccgttcgcgccgttcggcatgactggcgtgttcaatgcggcggcgctcgtgttcttcgctttcatcggcttcgatgccgtgacctcggccgccgaagaggtacgcaatccgagcaaggacttgccgattggcatcatcggctcgttggccgtctgcacggtgctctacgttgtcgtggccgcgatcatgacgggcatcgttccgttcgccaagttcgcgggcgtggatcaccccgtgtcgctggcgctgcagtacgcgggaaagaactgggtggcgggctttgtcgatcttggtgccattctcggcatgaccacggtgatcctggtgatgacctacggccagacccgcatcatcttcgcgatgtcgcgtgacggcctgctgcccgagcgactgtcatcggtgcatccggtgcatgccacgccatacttcgccacgtggaccgtcggcatcgtgtttgccgcgattgccggcttcgtgccgctcaatgtgctggcggagttgatcaacatcggcacgctggcagcattcacactgatctccatcgccgtgctggtgctgcgccgcacgcgccccgatctgccgcgtgcattccgctgccctggcgtgcccgtggtgccgctgctgtcggccggtttctgcctgttcctgatggcgcatctgcaggcactcacgtggatcgcattcctggtctggctcgtgatcgggctggcgatctatttcctctacgcgcggcgcaacgccgtgctgcataaccacggcggctga

SEQ ID NO: 36769 - protein, 465 aa, Ralstonia eutropha JMP134
MSLFRTKNIDAMLAVAHNDGLKKVLGPMDLVMMGIGAIIGTGIFVLTGTGALTAGPALTVSFVIAAMACGFAALCYAEFASAIPVSGSIYTYSYATLGEIIAWMIGWDLLLEYGLATSAVSVGWSGYFQSLVSGFGVKLPAALTAAPGAVPGVETMVNLPAVLIMLAITWIVSYGVKESARLNNVMVAIKIGVVLLFIAVGVWHVKPANWEPFAPFGMTGVFNAAALVFFAFIGFDAVTSAAEEVRNPSKDLPIGIIGSLAVCTVLYVVVAAIMTGIVPFAKFAGVDHPVSLALQYAGKNWVAGFVDLGAILGMTTVILVMTYGQTRIIFAMSRDGLLPERLSSVHPVHATPYFATWTVGIVFAAIAGFVPLNVLAELINIGTLAAFTLISIAVLVLRRTRPDLPRAFRCPGVPVVPLLSAGFCLFLMAHLQALTWIAFLVWLVIGLAIYFLYARRNAVLHNHGG

SEQ ID NO: 36770 - DNA, 1407 bp, Methylobacillus flagellatus KT
  CDS (1)..(1407)
atgttggcacagctgttccgcacgaaaccggttgaaataggtcaccacagcggcctgaagaaatgcctgtcggcattcgaccttgccctgctcggaataggctgcgccattggcactggcatcttcgtgcttaccggtattgcagccgccgtatattctggcccggccgtagtgatttccttcgtcattgccgggtttgccgccgcctttgccgggtttgcctatgcagagctcgcctcctccgtgggcggctccggcagcgcctatggttacagttatgtcgctttcggtgaattcattgcttgggtcattgcatggatactgctgctggaatatggcgtaggtgccgccgcggtggccaacggctggtccggctatttcatcaataccctggccaatttcggcattgccatcccggaagcctggaccaaggcaccaagccagggcggcatcatcaatctgcccgccttcggcattatctggctgctggtattcatcttgatcagcggcgtcaagcaaagctccaccgtcaacaacatcatggtggcgatcaagctcagcaccatcgccattttcctcgccatcgccgtcggccatatcaatagcgacaactggcaccccttcatgccgttcggctggttctccagccaggcggatggcagcaatatcggcatcctggcgggcgcttccctggtctttttcgcctatttcggctttgatgccgtctccaccgctgccgacgaagcacgcaacccgcaacgcgacctgcccataggactgattgcctctgtcacattctgcaccctcatctatatcctggtctcgggcgtactgactggcgtggtgcactattccgacctcaatgtctcctcacccgttgcctacgcactgagcaagcttggatacagctggtcgtccagtttggtcgcgaccggcgtgttggcaggcttgatcacggtactactggtattactgtacggcctcacccgcatcctctacgccatgagccgcgacggactgattcccgcagccttctccaaggtcaacccggaccgccagtccccaacccgcgtgatcctgttctgcggcagtatcatctccatcgtcgccggcttcttcccgctcggcaccctggccgagaccgtcaacatcgggaccctcgccagcttcgtcatggtatgcgtcggcgtcattgtcctgcgcaaacgccagcccgacttgcaccgaccattcaagaatccaggcggccccatcattcccctcctgggcatcatctcctgcagcgccctcatggcattcctgcccggcgaaacctggcaccgcttcctgatatgggtgggcatcggcatcatcatgtatttcgcctactccatgcatcacagcaagctcaggcaacgcaacagttag

SEQ ID NO: 36771 - protein, 468 aa, Methylobacillus flagellatus KT
MLAQLFRTKPVEIGHHSGLKKCLSAFDLALLGIGCAIGTGIFVLTGIAAAVYSGPAVVISFVIAGFAAAFAGFAYAELASSVGGSGSAYGYSYVAFGEFIAWVIAWILLLEYGVGAAAVANGWSGYFINTLANFGIAIPEAWTKAPSQGGIINLPAFGIIWLLVFILISGVKQSSTVNNIMVAIKLSTIAIFLAIAVGHINSDNWHPFMPFGWFSSQADGSNIGILAGASLVFFAYFGFDAVSTAADEARNPQRDLPIGLIASVTFCTLIYILVSGVLTGVVHYSDLNVSSPVAYALSKLGYSWSSSLVATGVLAGLITVLLVLLYGLTRILYAMSRDGLIPAAFSKVNPDRQSPTRVILFCGSIISIVAGFFPLGTLAETVNIGTLASFVMVCVGVIVLRKRQPDLHRPFKNPGGPIIPLLGIISCSALMAFLPGETWHRFLIWVGIGIIMYFAYSMHHSKLRQRNS

SEQ ID NO: 36772 - DNA, 1389 bp, Exiguobacterium sp. 255-15
  CDS (1)..(1389)
atgagtttgcttcgtaagaaagatgtcagtgtgatgatggatcaaaagagccattctaaactggcacggcatttatcaggctttgatttagtgttacttgggattggtgcaatcatcggaacagggatttttgtcctgaccggaacaggagcattgtatgcaggacccgcattaccggttgcctttattatttctgctatcgtctgtgcattagctgctctctgttacgctgagttttcatcgatgattcccgtctcaggcagtgtgtacacgtacacgtatgccacgatcggggaactggtcgcctggatcatcggttggtgtttgatcctggaatacgggttagcatcaagtgccgttgcaacaggttggtccggttatttccaatcactattatccggattcggaatcagtctgccgacagcgttaacggcagcgccgggtgctgtaccgggaagcgaaacattcttcaacttaccggcgttcttgatcttgatggtcatcacgctgttgctctcaatgggtattaaagaaacaaaacgcgtcaacaatatcatggttcttgtaaaagtagccgtcgttgtcttgttcatcgtcgtcgggatctggtatgtcgagccgggcaactatacaccgttcgcaccgttcggtatcagtggtgtcctgcaggcttcagccatcgctttcttcgcttacctcggttttgatgccgttacgtcagcagcagaagaagtaaaagatccgggccgtaacttaccgatcgggatcttaggatcacttgccatcgttaccgtattatacgtcgtcgtatccgccatcatggtcggaatcgtaccattcaaacagtttgaaggggtcgacagtccggtttcgttagctttaaaagtagccggtcaagactgggttgcaggtttcgtcgacttaggtgccatcgttggtatgacaacggttatcctcgttatgacatttggtctggtacgtctcttgttcgcgatgagccgtgacggattattgccgaaaatcttctcggacgtgaatgaaaaatcacatacgcctgtcaaagcaacatggattcttggaacgacagccggtttaatcgcaggtttcgtgccgctcggtacattggcagaattgatcaatatcggaacactcgcagcattcgctctgatttcaattgccgtcgtcatcttacggaaaacgcgtcctgatctgaagcgggcgttcaaagtgccatgggttccattcttaccgattctttccgtccttgcctgcatcatgttgatgttgaaccttcaaacattcacatggattgctttcttcatctggacagcgatcggtctgctcgtctacttcggatacggaagatcacgttcaaaattacaacaataa

SEQ ID NO: 36773 - protein, 462 aa, Exiguobacterium sp. 255-15
MSLLRKKDVSVMMDQKSHSKLARHLSGFDLVLLGIGAIIGTGIFVLTGTGALYAGPALPVAFIISAIVCALAALCYAEFSSMIPVSGSVYTYTYATIGELVAWIIGWCLILEYGLASSAVATGWSGYFQSLLSGFGISLPTALTAAPGAVPGSETFFNLPAFLILMVITLLLSMGIKETKRVNNIMVLVKVAVVVLFIVVGIWYVEPGNYTPFAPFGISGVLQASAIAFFAYLGFDAVTSAAEEVKDPGRNLPIGILGSLAIVTVLYVVVSAIMVGIVPFKQFEGVDSPVSLALKVAGQDWVAGFVDLGAIVGMTTVILVMTFGLVRLLFAMSRDGLLPKIFSDVNEKSHTPVKATWILGTTAGLIAGFVPLGTLAELINIGTLAAFALISIAVVILRKTRPDLKRAFKVPWVPFLPILSVLACIMLMLNLQTFTWIAFFIWTAIGLLVYFGYGRSRSKLQQ

SEQ ID NO: 36774 - DNA, 1401 bp, Exiguobacterium sp. 255-15
  CDS (1)..(1401)
atgattgctgcgagtcagcgtaacagtggacttgctcgaaatcttggcgcaatggatttaacgtttttaggaattggcgccatcattggtacagggattttcgtcctaaccggaacaggagcattgacagcaggacctggtcttatcgtctcattcattttatctgccattgcctgtgggttagcagcactcgcttatgcggaattcgcttcgacgattccggtcagtggttccgtctacacgtatacgtatgccacgatgggagaaattttcgcttggatcatcggttggaacttaatcttggaatatggactcgcctcgagtgccgttgcggcagggtggtcaggttacttccagtccttactcggtggattcggtattcatcttccgacagcactctcagcagctcctggcgcggtagaaggtgctaaaacattcttcaacttaccggccttcctgattttactcgcaattacaggtcttttatcaatgggaatcaaggaaacaaaacgtgtcaacaacatcatggttatcattaaattggcagtcgttgttttattcatcgtcgttggtgtcggctatgttgaacctacgaactgggcaccatttacaccgttcggatggggcggcgtattctctggagcagccatcgtcttctttgcttacatcggatttgatgctgttacatcggcagcagaagaagtacgtgagccgcaaaagaacttgccacgcggtatcatcggttcccttgctgtctgtacagttctttacgtcatcgttgcagccatcatgacaggaatcgtcccgtaccaaaaatttgcgggtgtcgatcacccggtctcactcgccattcaaatggctggacaaaactgggttgcaggattcatcgatttaggtgccatcctcgggattacaaccgttatcctcgtcatgacatacggaatggtacgtttagcgttcgccatctcacgtgacggcatgttcccgaaagtattttcggaagtacatccaaaatacaaaacaccgttcaaagcaacatggatgattggtcttggtagtgcgacagtcgcaggactcgttccactcgatgtcatcgcaaacctcgttaacatggggacactcgcagcattcgtcttaatctctgttgcggtcttgatccttcgtaaaacacaaccggatcttccacgtgcattcaaatgcccgggaatgccgtacgtgccgatcgcagcaatcgcttcttgtctcttcttgatgttcaacttgaaactcgaaacatggattgctttcttcatctggctggcgattggacttgtcctgtacttcgcctttgcccgaaagaactcgaatctggaaccgggaaatatgccggctgccgaactcgcagcttcagacgacaaataa

SEQ ID NO: 36775 - protein, 466 aa, Exiguobacterium sp. 255-15
MIAASQRNSGLARNLGAMDLTFLGIGAIIGTGIFVLTGTGALTAGPGLIVSFILSAIACGLAALAYAEFASTIPVSGSVYTYTYATMGEIFAWIIGWNLILEYGLASSAVAAGWSGYFQSLLGGFGIHLPTALSAAPGAVEGAKTFFNLPAFLILLAITGLLSMGIKETKRVNNIMVIIKLAVVVLFIVVGVGYVEPTNWAPFTPFGWGGVFSGAAIVFFAYIGFDAVTSAAEEVREPQKNLPRGIIGSLAVCTVLYVIVAAIMTGIVPYQKFAGVDHPVSLAIQMAGQNWVAGFIDLGAILGITTVILVMTYGMVRLAFAISRDGMFPKVFSEVHPKYKTPFKATWMIGLGSATVAGLVPLDVIANLVNMGTLAAFVLISVAVLILRKTQPDLPRAFKCPGMPYVPIAAIASCLFLMFNLKLETWIAFFIWLAIGLVLYFAFARKNSNLEPGNMPAAELAASDDK

SEQ ID NO: 36776 - DNA, 1506 bp, Rubrobacter xylanophilus DSM 9941
  CDS (1)..(1506)
atggggataatgaggaccaagtccatcgagcaatccatccgggacacggaccacccggacttcaggctacgcaaggcgctgggggcgctagacctgacgctcttcggcatcggggtcatcatcggtaccggcatcttcgtgctgaccggggtggcggcggccacgaacgcggggccggcgatcgcgctctccttcgtggtggcgggggtggcctgcgccctggcggcgctctgctacgcggagttcgccagcaccgtgccggtggccgggagcgcctacaccttctcctacgcggcgctgggcgagtttctggcctggatcatcggctgggacctggtgctggagttcatcgtgggcgcctccgccgtctcggtggggtggtcgggctacttcaacagcgtgctgcagagcttcttcgggataaccctgcccgagtcgctgctcgccgcccccggagacggcggcgtcgtgaacctgccggcggtgggcatcgtcgtgctcctggtcatcgtgctggtgttggggatcacgctcagctcccgcgtcaaccaggtcataaccaccataaagctcttggtggtcctcttcttcatcgtctacggcatctggttcgtcaacccggagaactggtcgccgttcctcccgccgcgggagccggcgccggccggcgaggggttctccttcagccagacgacgctgtgggagctgctgttcggcagcgcgggctccttcgggttcaccggcatgatcaccggggcctccatcgtgttcttcgcctacatcggctttgacatcgtggccaccaccgccgaggagacccgcaacccccagcgggatctgccgatcggcatcctgggctcgctcgccatctgcacggtgctctacgtgctggtctccctgatcatgaccgggctggttccctaccagcagctgaacaccgcctcccccatggccaccgccctctcccgcctgggcctcgactgggccgccgggctggtctccatcggggccatctgcggcctgacgacggtgaccatgatcctgatgctcggccagagccgggtggccttcgcgatgagccgcgaccggctgctgcccccctggttcgccaaggtccacccccgcttcaggacgccctaccggatcaccataaccaccggcgtggtggtcgccctgctggccggcttcgtgcccctggggaccctcgccgagctggtgaacatcggcaccctcttcgccttcgtgctggtctccataggggtcatcgtcctgcgccgcacccggcccgacctgcaccgggcgtttaggacgccgcttgtgccggtggtgcccatcctcgcggcgctggtgtgcatctacctgatgctcaacctggcggtgggcacctggatccggttcctggtctggatggcgatcgggctcgtcctctacttcgtctacagcatgcaccacagccggctggccgtcggggaggacatcgaggaggtggcggaggaggcccggtaa

SEQ ID NO: 36777 - protein, 501 aa, Rubrobacter xylanophilus DSM 9941
MGIMRTKSIEQSIRDTDHPDFRLRKALGALDLTLFGIGVIIGTGIFVLTGVAAATNAGPAIALSFVVAGVACALAALCYAEFASTVPVAGSAYTFSYAALGEFLAWIIGWDLVLEFIVGASAVSVGWSGYFNSVLQSFFGITLPESLLAAPGDGGVVNLPAVGIVVLLVIVLVLGITLSSRVNQVITTIKLLVVLFFIVYGIWFVNPENWSPFLPPREPAPAGEGFSFSQTTLWELLFGSAGSFGFTGMITGASIVFFAYIGFDIVATTAEETRNPQRDLPIGILGSLAICTVLYVLVSLIMTGLVPYQQLNTASPMATALSRLGLDWAAGLVSIGAICGLTTVTMILMLGQSRVAFAMSRDRLLPPWFAKVHPRFRTPYRITITTGVVVALLAGFVPLGTLAELVNIGTLFAFVLVSIGVIVLRRTRPDLHRAFRTPLVPVVPILAALVCIYLMLNLAVGTWIRFLVWMAIGLVLYFVYSMHHSRLAVGEDIEEVAEEAR

SEQ ID NO: 36778 - DNA, 1341 bp, Rubrobacter xylanophilus DSM 9941
  CDS (1)..(1341)
atggacgcttccgaagccaggggggagagggccggggatcacccggcgctgcggcgggcggtcacgccgctgcttctgctgttcttcatcgtgggggacatggtgggcggcgggatctacgcgctcgtgggggaggtgggggccatcaccggcggggcgatctggtcggccttcctgctcgccctcgtgctcgccctcttcaccgccttcgcctacgcggagctggtctccaagtacccccgggccgggggcgcggccagctacgtccaccgggcgttcaagacccccttcttcaccttcatggtggccttcgccgtggtgatgtccggggtgacctcggcctcggcgctctccatcgccttcggcggggactacctggccgagttcatcgcggggcccacggtgatcatcgcgctggtctttatcctggtggtgggcttcgtgaacttctacggcatccgcgagtcggtgaccctgaacgccatcttcacctgcatagagctcggggggctgctgctcatcgtcctgatcggcgtcgtggcgctcgtgagcgggtcgggggagccctcccgggcgttcgagttcagggagggggtgagcgtcccgctcgccgtgctctccggggcggcgctctccttctacgccctcatcgggttcgaggactcggtgaacgtcgccgaggaggtgcaagacccgcagcggagcttcccgcgcgccctcttcggggggatactgctcgccgggatcatctatttgctcgtgaccttcaccgcggcgatggtcgtcccggtggagcggctcgccgcctccagcgggccgctgctggaggtggtggaggccagccccctcggggtcccgacctggctcttcgccctcatcgcgctgttcgccctctccaacggggcgctcatcaacatgatcatggcctcgcgcctgatctacgggatgggcgaccagggggtgatgccctcggtcttcgcccgggtgcatccgctgcgccgcaccccgtgggtgtccatcgcgttcaccaccctgatcgcggtcggcctgatctcgacgggcgacatcgaggatctggcgagcactacggtggtgctgctgctcctggtgttcgtggtggtgaacgccacggtgctcgtgctccggcgcgaccgggtggagcacgagcacttccgggcgccctccgtcttcccggtgctcggcatcctggtgtgcgtgggcctgctcacccagcaggaggcggacatctggctgagggcgctggtgctgctggtggtcggggcggtcctctacggggtgaactacctggcgacccgctacctggaccgccgcggcgcctag

SEQ ID NO: 36779 - protein, 446 aa, Rubrobacter xylanophilus DSM 9941
MDASEARGERAGDHPALRRAVTPLLLLFFIVGDMVGGGIYALVGEVGAITGGAIWSAFLLALVLALFTAFAYAELVSKYPRAGGAASYVHRAFKTPFFTFMVAFAVVMSGVTSASALSIAFGGDYLAEFIAGPTVIIALVFILVVGFVNFYGIRESVTLNAIFTCIELGGLLLIVLIGVVALVSGSGEPSRAFEFREGVSVPLAVLSGAALSFYALIGFEDSVNVAEEVQDPQRSFPRALFGGILLAGIIYLLVTFTAAMVVPVERLAASSGPLLEVVEASPLGVPTWLFALIALFALSNGALINMIMASRLIYGMGDQGVMPSVFARVHPLRRTPWVSIAFTTLIAVGLISTGDIEDLASTTVVLLLLVFVVVNATVLVLRRDRVEHEHFRAPSVFPVLGILVCVGLLTQQEADIWLRALVLLVVGAVLYGVNYLATRYLDRRGA

SEQ ID NO: 36780 - DNA, 1422 bp, Rubrobacter xylanophilus DSM 9941
  CDS (1)..(1422)
atgagcgagctgctgcgcaagaaggacatccccacgctgcagcgggaggccgcgggggacaccggcctgaagcgcaccctcggggtgtggagcctcacgttcatcgggctggggggcatcatcggggtcggggtcttcgtgctcacgggcgtcgtcgccgcgaaccaggccggcccggcggtcgcgctctctttcgtcgtcgccgggatcgccagcgccgccgccgcgctgtgctacgcggagttcgccggcatgatcccggtctccggcagcgcctacacctacgggtacgcggtgctcggggagttcttcgcctgggtcatcggctgggacctcctgatcgagtacaccctcgtcgtcgcggtggtcgccataggcatctcgggctacataaacgagctgctctccgggctcggggtgggggtgcccgagtgggcggcctcggctcccggcgggggagacggcggcgtggtgaacctgttcgccgtgctgctctgcctgttcatagccgggctgcagatccggggcatccgcgagagcgccaacttcaacaacgcgatggtcgtcctgaagctcgcgatcatcgcggtcatcatcgccctcggggcgttcttcgtggacccggccaacctcacgcccttcttcccgtacgggatcgggggggtcttcaccggggccgcggtcgtgttcttcgcggtcttcggctacgacaccctcaccaccgcggcggaggaggcgaccgatccgcagcgcgacctgccgcgggcggtgatcctctcgctggcgatagcgctggtgctctacgtgctcatgagcctggtggtgaccggcatggtgccctacaggcagctggacaccccggccccggtggccgtggcctttcaggaggcgggcctgccgtgggtggcgcgggtgatctcggtggcggccatcgcggggatcatcagcgtgctcttcgccttcatgctgggggcggcccgcgtctggttcgccatgagccgcgacggcctgctgccccgctggttctgccggctgcaccccgcctaccgcacgccctacaggccgacggcgatcctcggggtggccacggccctggtggcggggttcttccccataaccgccgtcgcggagctggtgaacatcggggtgctctcggcctttatcatcgtgtgcgcctcggtctgggtcctgcggcacacccgccccgacctgccccgggccttcaggacgccgctggtgcccctggtcccgatcctcgggatggcgttctccgccgtgctgatcgcgagcctgcccccggcgacctggctccggttcgtggcgtggatggcggtggggctcgtgatctactttctctactcccggcgccggagcctcctggcccgcggcgagctgggcatcgagcgggacctggtggagtaa

SEQ ID NO: 36781 - protein, 473 aa, Rubrobacter xylanophilus DSM 9941
MSELLRKKDIPTLQREAAGDTGLKRTLGVWSLTFIGLGGIIGVGVFVLTGVVAANQAGPAVALSFVVAGIASAAAALCYAEFAGMIPVSGSAYTYGYAVLGEFFAWVIGWDLLIEYTLVVAVVAIGISGYINELLSGLGVGVPEWAASAPGGGDGGVVNLFAVLLCLFIAGLQIRGIRESANFNNAMVVLKLAIIAVIIALGAFFVDPANLTPFFPYGIGGVFTGAAVVFFAVFGYDTLTTAAEEATDPQRDLPRAVILSLAIALVLYVLMSLVVTGMVPYRQLDTPAPVAVAFQEAGLPWVARVISVAAIAGIISVLFAFMLGAARVWFAMSRDGLLPRWFCRLHPAYRTPYRPTAILGVATALVAGFFPITAVAELVNIGVLSAFIIVCASVWVLRHTRPDLPRAFRTPLVPLVPILGMAFSAVLIASLPPATWLRFVAWMAVGLVIYFLYSRRRSLLARGELGIERDLVE

SEQ ID NO: 36782 - DNA, 1302 bp, Methanococcoides burtonii DSM 6242
  CDS (1)..(1302)
atgaatgatgtatcttctgagaaatctataggatatttgtctgcagtttctataggcattgggggtatggttggcgggggtatctttgcagttcttggccttgctgttgagattggaaaaggtggaacacctattgcatttggacttgccggcatagtcgcattgatcacatcatattcatatgcaaaactatctgttagatatccttcagaaggaggaactgtcgaatttttgaatcaggcatttggttcagggttggttacaggagggctaaatattcttctatggttaagttatgttgtgatgctctcgctttatgcctatgcttttggaagctatggttccacgttttttcccgattcgatgcaagcggtcttaagacatgtactcaccagcattattattgtatcattaactgtggtgaatattgttggtgcaaaagtagttggaaaattggaaacgtggattgttggctttaaagttgctattttgttaatattcattggtgtaggtatatggagtgttaaatcccagccgtttcaaccaacaattagttctaatccacttcagcttgtagctggaggtatgattatttttttggcttatgaagggtttgaactgatagcaaacaccgcaaaggatgtgaaaaatcctggaaaaacacttccttgcgcctattattcagcagttgtctttgttattgtactttatgtattaattgcttttattaccgttgaaactgtatcaatcgattccataatacaagctaaagattatgctcttgctgtagctgcaaaaccttttttgggaaattttggtttcaaccttattgcagttgcagccctcttgtctacagcttcagctattaacgcaactttgtatggtgcttcacgtgtgagctttactattgccaaagatggggaattgcctgaaatattggaagaaaaaatatggaatcgaccaattgaaggcctattgatcacctctgctctcacattgattgtagcaaatacatttaatttagccagtatctcaataatgggaagcgctggatttttgttaatctttggagctgtaaacgcttctaacgcttgcctgtatcagaagacagcaagttacagatggatttcaataacagggatcattgtctgttctattgcactgtttacattgatctggtacactttgaacaattccccaaaagatattttcatattggcctttatgctttgctcagcatttgccatcgaagcaatttatagaaggtttacaggcaggtacataaagaaaatccatgaatga

SEQ ID NO: 36783 - protein, 433 aa, Methanococcoides burtonii DSM 6242
MNDVSSEKSIGYLSAVSIGIGGMVGGGIFAVLGLAVEIGKGGTPIAFGLAGIVALITSYSYAKLSVRYPSEGGTVEFLNQAFGSGLVTGGLNILLWLSYVVMLSLYAYAFGSYGSTFFPDSMQAVLRHVLTSIIIVSLTVVNIVGAKVVGKLETWIVGFKVAILLIFIGVGIWSVKSQPFQPTISSNPLQLVAGGMIIFLAYEGFELIANTAKDVKNPGKTLPCAYYSAVVFVIVLYVLIAFITVETVSIDSIIQAKDYALAVAAKPFLGNFGFNLIAVAALLSTASAINATLYGASRVSFTIAKDGELPEILEEKIWNRPIEGLLITSALTLIVANTFNLASISIMGSAGFLLIFGAVNASNACLYQKTASYRWISITGIIVCSIALFTLIWYTLNNSPKDIFILAFMLCSAFAIEAIYRRFTGRYIKKIHE

SEQ ID NO: 36784 - DNA, 1374 bp, Burkholderia cepacia R18194
  CDS (1)..(1374)
atgatcgccggcgcgcatgccgccgggctcaagaaagcgctcggcgcgatcgacctcaccttcctcggcatcggcgcaatcatcggcaccggcatcttcgtgctgaccgggaccggcgccgtgcaggccggccctgcactgatgctgtcgttcgtgatcgccgcgatcgcgtgcggcctcgccgcgctgtcgtacgcggagttcgcgtcgacgatccccgtcgccggctcgatctacacgtattcgtacgccaccctcggcgagctcgtcgcgtggatcatcggctgggacctgatgctcgaatacggcctcgcgtcgtcggccgtgtcggtcggctggtcgggctacctgcagtccctgctgcagggcttcgggctgacgctgcccaccgtgctgacggccgcgcccggcgcggtgccgggtgtcgtcacgtggttcaacctgcccgcgttcctcgtgatgatcgtgatcacgacgctgctgtcgatcggcatccgcgagtcgacccgcatcaacaacatcatggtgttcatcaaggtgtcggtcgtgctgctcgtgatcgcggtcggcgtgttccacgtgacgcccgcgaactggaagccgttcatgccgcacggctggaacggcgtgttcggcgcggcggccgtgatgttcttcgcgttcatcggcttcgacgcagtgtcgtcggcggccgaggaagtgaagaatccgaagcgcgacctgccgatcggcatcatcgcgtcgctcgcggtgtgcgcggtgctgtacgtgacggtcgccgcggtcgcgaccggcatcgtgccgtcggcccagtacgcgaacatctcgcacccgatctcgtacgcgctgcagaaggccggcgagacgtgggtcgccggcttcatcgatctcggcgcggtgctcggcatgctgaccgtgatcctcgtgatgagctacggccagacgcgcgtgatcttcgcgatgtcgcgcgacgggctgctgccggcggcgctgtcgcgcgtgcacccgcgctacgcgacgccgttcctgacgacctggctcgtcggcctgttcttcgggctgatcgccgcgctcgtgccgctcaacgtgctcgccgagctgatcaacatcggcacgctcgccgcgttctcgatggtgtcgatcgcggtgctcgtgctgcgtcgcacgcaccccgacctgccgcgtgcgttccgctgccccggcgtgcccgtggtgccgatcctcgcggtcgcgtcgtgcctgttcctgatgctgaacctgcagcccatcacgtgggccgcgttcggcatctggctcgtgatcggcctcgtgatctacttcctgtactcgcgtcaccactcgaagctcgcgcacggtcaccacgacgcgcactga

SEQ ID NO: 36785 - protein, 457 aa, Burkholderia cepacia R18194
MIAGAHAAGLKKALGAIDLTFLGIGAIIGTGIFVLTGTGAVQAGPALMLSFVIAAIACGLAALSYAEFASTIPVAGSIYTYSYATLGELVAWIIGWDLMLEYGLASSAVSVGWSGYLQSLLQGFGLTLPTVLTAAPGAVPGVVTWFNLPAFLVMIVITTLLSIGIRESTRINNIMVFIKVSVVLLVIAVGVFHVTPANWKPFMPHGWNGVFGAAAVMFFAFIGFDAVSSAAEEVKNPKRDLPIGIIASLAVCAVLYVTVAAVATGIVPSAQYANISHPISYALQKAGETWVAGFIDLGAVLGMLTVILVMSYGQTRVIFAMSRDGLLPAALSRVHPRYATPFLTTWLVGLFFGLIAALVPLNVLAELINIGTLAAFSMVSIAVLVLRRTHPDLPRAFRCPGVPVVPILAVASCLFLMLNLQPITWAAFGIWLVIGLVIYFLYSRHHSKLAHGHHDAH

SEQ ID NO: 36786 - DNA, 1275 bp, Burkholderia cepacia R18194
  CDS (1)..(1275)
atgccctcgcatgtcgattcgcccgccgctcatcacgcgggctcgctgacgattttccagggcgctgcgctctacatcggcgcggtgctcggcaccggcgtgatcgcgctgcccgcactcgccgccgaggtcgcgggcccggcctcgctgctcgcctgggctgcgctggtcgtgctgtccgggccgctcgcggccaccttcgccgcactcggcgcgcgctatcccgacgcgggcggcgtatcgacctatgcgcggcgcgcattcgggccgaaagctgcggcaatcgtcggatggtgcttctacttcgcggtaccggccggcgcaccggctgccgccatgttcggcggcgcatacgtcgcggccgtcacgggcggcgggcacacgacgatcatcgtcacggctgccgcgctgatcgcgaccgtgtcggccgcgaatgcattcggcgtcaccgtgtcgggccgcatgcagctcgtgttgtcggcactgctcgtcacgctgctgcttgccgcggtgctcgcctccgcgccgcatgcgcgcaccgcgaacctgcatccgttcgcgccgcacggctggctcgcggtcggccaggcggccgcgctgctcgtgtggagtttcgccggctgggaagcgatcacgcatctcgcggccgaattccgccggcccgcgcacgacatgccgcgctcggccgggatcgcggtcgtggtggtcgggttcctgtatctgtcggttgctgccgcgagcgtgacggtgctcgggccgaccgcgggcggatcgggtgcgccgctcgccgaactgatcgcgggcggcatcggcggccatgcgcaggtgctggccgccgtggccgcactgctgctcacgctcggcaccatgaacgcgtatttcgcgggcgcggccaagctcggcgcggcgctcgggcgcgacggcgcgttgcccgcgtggctcgcgcaaggcagccaggtcggcggcgtcccgcgccgcagcctcggcgtgatcgccctgctcgccgtggtcgcactggcggcgacgacgctgtcggacgtcgggccgaagccgctcgtgctcgtcacgtccggatgcttcgtgatggtgtacgggctcggcgcggccgccgcgctgaaactgctgccgcgtggcggcatcgcttaccgttgtgcatggatttcgttggtcgcggtggccgggctgttcctgacgaccggctggtacatcctgtgccctttgctgctcgcgggcggtgcgctgctctatctgcaggtggccgggccgcgtcagtga

SEQ ID NO: 36787 - protein, 424 aa, Burkholderia cepacia R18194
MPSHVDSPAAHHAGSLTIFQGAALYIGAVLGTGVIALPALAAEVAGPASLLAWAALVVLSGPLAATFAALGARYPDAGGVSTYARRAFGPKAAAIVGWCFYFAVPAGAPAAAMFGGAYVAAVTGGGHTTIIVTAAALIATVSAANAFGVTVSGRMQLVLSALLVTLLLAAVLASAPHARTANLHPFAPHGWLAVGQAAALLVWSFAGWEAITHLAAEFRRPAHDMPRSAGIAVVVVGFLYLSVAAASVTVLGPTAGGSGAPLAELIAGGIGGHAQVLAAVAALLLTLGTMNAYFAGAAKLGAALGRDGALPAWLAQGSQVGGVPRRSLGVIALLAVVALAATTLSDVGPKPLVLVTSGCFVMVYGLGAAAALKLLPRGGIAYRCAWISLVAVAGLFLTTGWYILCPLLLAGGALLYLQVAGPRQ

SEQ ID NO: 36788 - DNA, 1359 bp, Burkholderia cepacia R18194
  CDS (1)..(1359)
ttgcagcgccacctgagtgcgcggcacatccgctttctcgcgctgggttcggcgatcggcacgggcctgttctacggttcggcgtccgcgatccagctcgcgggcccggccgtgatcctggcgtacatcctcggcggcgcggccgtctacatggtgatgcgcgcgctcggcgagatggccgtgcgcgacccggtcgccggctcgttcggccactacgcgaccgagaacctcggcccgttcgccgggttcgtcaccggctggacctacacgctcgaaatggtgatcgtcgcgatcgccgacatcaccgcgttcggcatctacatgggcttctggtttccggatgtcccgcaatggatctgggtgctcggcgtcgtcgcgatcatctgcgggctgaacctgtgccatgtgaaggtgttcggcgagctcgaattctggctgtcgatcatcaaggtcggcgcgatcgtcgcgatgatcggcggcggcgtcgcgatcctgctgaccggcatgcacttcggccactcggccgacgtgccgacgttcgcgaacctgtggaaccacggcggcttcctgccgaacggcgtcggcgggctgatcgcgtcgctgtcggtcgtgatcttcgcgtacggcgggatcgaggtgatcggcatgagcgccggcgaggcgaaggatccggaacgcgtgattccgcgcgcgatcaacgcggtgcccgcacgcatcctgctgttctacgtgctgacgatggtcgtattgatgtcgatcagcccgtggacgggtgtcggcaacgaaggcagcccgttcgtgcagatcttctcggcgctcggcgtgaagtcggccgcgacgatcctcaacctggtggtgatcagcgcggcgatctccgcgatcaacagcgacatcttcggcgcgggccggatgatgttcgggatggcgcgccagggccaggcgccgcgcgtgctgatgacgacgtcgcggcacggtgtgccgtgggtcacggtggtcgtgatggcagccgcgctgctcgtcggcgtgctgctcaactacctgatgccgaaggacgtgttcctgatggtcgcggcgatcgcgacgttcgccaccgtgtgggtgtggctgatgatcctgctgtcgcaggtcgcgatgcgccgccggctgtcgagcaccgaagtcgcggcgctgaagttcaaggtgccgttgtggccggtcgcgccggcactgacgatcgcgttcatgggcttcgtgatcgtgatgctcggctggttcgaggacacgcgcgtcgcgctgtatgtcggcgcggcctggctcgcgctgctcgcgctcgtgttctacgcacggatccgcccgaaattcgcacctgcgtcacgttga

SEQ ID NO: 36789 - protein, 452 aa, Burkholderia cepacia R18194
MQRHLSARHIRFLALGSAIGTGLFYGSASAIQLAGPAVILAYILGGAAVYMVMRALGEMAVRDPVAGSFGHYATENLGPFAGFVTGWTYTLEMVIVAIADITAFGIYMGFWFPDVPQWIWVLGVVAIICGLNLCHVKVFGELEFWLSIIKVGAIVAMIGGGVAILLTGMHFGHSADVPTFANLWNHGGFLPNGVGGLIASLSVVIFAYGGIEVIGMSAGEAKDPERVIPRAINAVPARILLFYVLTMVVLMSISPWTGVGNEGSPFVQIFSALGVKSAATILNLVVISAAISAINSDIFGAGRMMFGMARQGQAPRVLMTTSRHGVPWVTVVVMAAALLVGVLLNYLMPKDVFLMVAAIATFATVWVWLMILLSQVAMRRRLSSTEVAALKFKVPLWPVAPALTIAFMGFVIVMLGWFEDTRVALYVGAAWLALLALVFYARIRPKFAPASR

SEQ ID NO: 36790 - DNA, 1407 bp, Burkholderia cepacia R1808
  CDS (1)..(1407)
atgtccctcttccgcaagaaaaacgtcgatcgcatgatcgccggcgcgcacgccgccgggctcaagaaagcgctcggcgccatcgatctcaccttcctcggcatcggcgcgatcatcggcaccggcatcttcgtgctgaccggcaccggcgccgtgcaggccggccccgcgctgatgctgtcgttcgtgatcgccgcgatcgcgtgcggcctcgcagcgctgtcgtatgccgagttcgcgtcgaccattccggtcgccggctcgatctacacctattcgtacgcgacgctcggcgagctggtcgcgtggatcatcggctgggacctgatgctcgaatacggcctcgcggcatcggccgtgtcggtcggctggtcgggctacctgcagtcgctgctgcagggcttcgggctgtcgctgccgaccgtgctgaccgccgcgccaggcgcgatccccggcaccgtcacgtggttcaacctgcccgcgttcctggtgatgctggtgatcacgacgctgctgtcgatcggcatccgcgaatcgacccgcatcaacaacgtcatggtgttcatcaaggtgtcggtggtgctgctcgtgatcgccgtcggcctgttccacgtgacgcccgcgaactggaagccgttcatgccgcacggctggaacggcgtgttcggcgcggcggccgtgatgttcttcgcgttcatcggcttcgacgcggtgtcgtcggcggccgaggaagtgaagaacccgaagcgcgacctgccgatcggcatcatcgcgtcgctggccgtgtgcgcggtgctgtacgtgacggtcgcagccgtcgcgaccggcatcgtgccgtcggcgcagtacgcgaacgtgtcgcacccgatctcgtatgcgctgcagatcgccggcgagaagtgggtggccggcttcatcgacctcggcgcggtgctcggcatgctgaccgtgatcctcgtgatgagctacggccagacgcggatcatcttcgcgatgtcgcgcgacgggctgctgccggcgatgctgtcgcgcgtgcatccgcgctacgcgacgccgttcctgacgacctggctggtcggcctgttcttcgggctgatcgcggcgctcgtgccgctgaacgtgctcgccgagctgatcaacatcggcacgctcgcggcgttctcgatggtgtcgatcgcggtgctggtgttgcgccgcacgcaccccgagctgccgcgcgcgttccgctgccccggcgtgccggtggtgccgatcctcgcggtcggcgcgtgcctgttcctgatgctgaacctgcagcccatcacgtgggccgcgttcggcatctggctcgtgatcggcctcgtgatctacttcctgtactcgcgccaccactcgaagctcgcgcgcggccagcacgacgcgcactga

SEQ ID NO: 36791 - protein, 468 aa, Burkholderia cepacia R1808
MSLFRKKNVDRMIAGAHAAGLKKALGAIDLTFLGIGAIIGTGIFVLTGTGAVQAGPALMLSFVIAAIACGLAALSYAEFASTIPVAGSIYTYSYATLGELVAWIIGWDLMLEYGLAASAVSVGWSGYLQSLLQGFGLSLPTVLTAAPGAIPGTVTWFNLPAFLVMLVITTLLSIGIRESTRINNVMVFIKVSVVLLVIAVGLFHVTPANWKPFMPHGWNGVFGAAAVMFFAFIGFDAVSSAAEEVKNPKRDLPIGIIASLAVCAVLYVTVAAVATGIVPSAQYANVSHPISYALQIAGEKWVAGFIDLGAVLGMLTVILVMSYGQTRIIFAMSRDGLLPAMLSRVHPRYATPFLTTWLVGLFFGLIAALVPLNVLAELINIGTLAAFSMVSIAVLVLRRTHPELPRAFRCPGVPVVPILAVGACLFLMLNLQPITWAAFGIWLVIGLVIYFLYSRHHSKLARGQHDAH

SEQ ID NO: 36792 - DNA, 1392 bp, Listeria monocytogenes str. 1/2a F6854
  CDS (1)..(1392)
atgacgaaagttaattcttttttcagaaaaaagagttttcataacccagcgactgataaacatcatttgaacaaatcgttaggagcgtttgatttaacgatgcttggagtcggagcggttgttgggggagggatatttattcttccaggacaggtagcttctgtcattgcgggaccaggaattattatttcttttattattgcgggaattgcttgctgtttggcggcattatgttattcggaatttgcttctaaattaccagtcgcaggtagcgcatatacttacagttatcatgtgttcggggaaggtgttgcgtggattttagggtggtcgctgattttagaatacggtctggctgttgcagcaatcgcaagtggttggtcttcttatatgaagagtctactagcaggatttgacttacatattccaacggcaatttcttcagcatatgacccgagtgcaggaacttattttgatttacttgcatttgtagtggttatggtaattggtattttacttagtttcggtattcgtgaatccacacgggtgaataatattatggttttagtaaaaattgcggtggttgtattatttattttagtaggagctttctatgtgaaacctaataattggacgccgttcttgccgtttggtgtacaaggggtcattacaggagcttccacagtcttctttgcttatatcggctttgatgctgtatcaagtgccgcggaagaagtgaaaaatccacaaaaaaatatgccaataggaattatttcttcactggcagtctgtacacttctttatattttactttctgcagtactaacaggagttgttccatatacagatttagttgatgttagtgcacctgttgcctttgcgcttcaagcaattaatcaaaactggattgctgggttactgtcagttggtgcgattgttgggatgacaacggttgtacttgttatgtcttatggtggtacacgcttgttattcgcaatgggacgtgacggattattaccaaaatcgttctcaaaaatcagcaaaaatgacacacctgttagaaatacgatgatttttgcgacagtaatgggactaattgcttctactgtaccgatggcagatttagcacaattaattaacattggtactttgtttgcttttgcgatggtttctattgggattttcttcttacggagaaatccagacttgaatcaaaaaggatttaaaacgccattttatccagtagtaccagcactttcctttttactttgtgtatatttaatgattaacttatctaaaacaacatggattgcattcggtatttggtttgtgataggaatactagtgtatacattctatggaagaaaacattcagcattgcgtataaaataa

SEQ ID NO: 36793 - protein, 463 aa, Listeria monocytogenes str. 1/2a F6854
MTKVNSFFRKKSFHNPATDKHHLNKSLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTAISSAYDPSAGTYFDLLAFVVVMVIGILLSFGIRESTRVNNIMVLVKIAVVVLFILVGAFYVKPNNWTPFLPFGVQGVITGASTVFFAYIGFDAVSSAAEEVKNPQKNMPIGIISSLAVCTLLYILLSAVLTGVVPYTDLVDVSAPVAFALQAINQNWIAGLLSVGAIVGMTTVVLVMSYGGTRLLFAMGRDGLLPKSFSKISKNDTPVRNTMIFATVMGLIASTVPMADLAQLINIGTLFAFAMVSIGIFFLRRNPDLNQKGFKTPFYPVVPALSFLLCVYLMINLSKTTWIAFGIWFVIGILVYTFYGRKHSALRIK

SEQ ID NO: 36794 - DNA, 1461 bp, Bacillus cereus G9241
  CDS (1)..(1461)
atgggctcatactacattcgcagttatggaaatgaaaaaacggggggagagtccaaagtgaagtcattattacgaaaaaaagcgcttagtactgaatcaccaaagcagctagatagaacattaactgcacttgatttaacgtttttaggaattggcgccgtaattgggacaggcatctttgtattaacaggtattgttgcagcgaaacattctggtcctggtatcatgctatcatttcttattgctgcatttacttgtgcttgtgtagccttttgttatgccgaatttgcttcttctattcctgtctcaggaagtgtgtatacttacgcatacatgacagtcggagaagttgtcgccttcatcgtcggatggtgtttaatgctcgaatatttacttgccgttgcagcagtagctgtcggttggtctggttatttacaatctttactacaaggatttaacgtccatcttcccgccataatcgcctcggctcctggcgtaggaaaaggtggtctcattgatttaccagctgtttgtattttactcatcattactggacttttaagttttggtatacgcgaaagcgcacgcattaataatattatggttcttattaagttagccgttattatcgcctttatcgtagcaggtgcaaaatatgtaaaacctgaaaattggacaccgttcatcccattcggatatgacggtattattactggggctgctactgtattcttcgccttcttaggatttgatgcaatcgcaaccgctgcggaagaaacgaaaaaaccacagcgtgatttaccaatcggcattattggctctcttcttatttgcactgttttatatatgatcgtatctttcgttttaacaggtatggttccttatacacaattagatgtttctgatccagttgcgtttgccttacatttcgttggcgaagatacaattgcaggactactcgctgttggagcgatgactggaatgacaaccgttctcttagtcgttatgtatggacaagttcgcgtttcgtatgcgatgagccgtgacggtttacttccaaaagcgttagcacgtgtaaataaaagagtgaaaatccctttattaaatacgtggattactggtgttgttgccgctttattagcaggacttttagatctacacgtattagcgaatttagtaaacatcggtacattaacagcctttacattcgtttgctgcgcagtacttattttacgaaaaacacaccctgacttaaaacgcggattccgcacacctttcgtacctgtactaccagttgtcgcgattctttgctgcttatatttaatgatcaatttgtctaaaacaacatggattagctttgccgtttggcttatagtcggcttatgcttctatttcttctactctagaaagcatagtcacttagctaccgaaaaaacgaatgatgaaaagaaaaaagcataa

SEQ ID NO: 36795 - protein, 486 aa, Bacillus cereus G9241
MGSYYIRSYGNEKTGGESKVKSLLRKKALSTESPKQLDRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNVHLPAIIASAPGVGKGGLIDLPAVCILLIITGLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMINLSKTTWISFAVWLIVGLCFYFFYSRKHSHLATEKTNDEKKKA

SEQ ID NO: 36796 - DNA, 1317 bp, Bacillus cereus G9241
  CDS (1)..(1317)
atgcatcatgatgagaagaacaaaattggtttaacggtagcactttctatcgtagtaggaacgattattggatctggtgtgtttatgaaaccagggagcgtattagattactcggggagttctaatatggcgattcttgcttgggtaattggtggtctgttgacgttagcaagtggtttaacagtagctgaaattggagcgcaaatcccgaaaaatggtgggttgtatacgtatttagaggagatttacggaagtttttggggatatttatcaggctggatgcaaacgattgtttatgggccagctattattggaacattagggttatactttagttctttaatgattaattttttctatttagataaagtatggaatttaccaatcgcaattggaacagttgtgttccttggcgttgtaaatagtatgggaacaaaatacggaggtatcgttcaaacgatcacgacaatcgggaagatgattccaatcgtattaattgttgtgttaggtttttggaaaggaaatagcgatatctttaacgtagttgtgccaatatcagaaaatcaaagtatcgggatggcaattttagcaacgttatttgcttatgacggctggattttacttgcttcgattggtggagaaatgaagaatccaacaaagttattaccgaaagctatgacagttgggattttaattgtaacagctgcttacgtattaattaatttggcgttactgaatgtattaccagcaacacaaattgtagaccttggagaaaatgcaacagcgacagctgcaggaatgctacttggagaatatggcgggaaaattattagtatcggtattatcgtttctattttcggttgtttaaatggaaagattttaacgttcccacgtatcccgatgtcgatggcagaacgtggacaacttccatttgctaagtttattgcaaaggaaagtccaagatttaaaacaccagcaaatgcgattactgtggaaatcattttaggaattattttaatgattattagtgatccgaataagctatctgagatttccgtattcattatttatattttctatgtaatgacgtttattggtgtcttcattttaagaaaacgtaataaaaataaagagcgtgcatacagtgtaccgttattcccaatcgtaccaatcgttgcgattttaggttcgttctttgtaattggtagtgcaattatcaatgatccgataagttgtttcttatcaattggaattgtatttactgggcttccggtatattggtatttaaataagaagaataaaaatgaagtatcatga

SEQ ID NO: 36797 - protein, 438 aa, Bacillus cereus G9241
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPATQIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAILGSFFVIGSAIINDPISCFLSIGIVFTGLPVYWYLNKKNKNEVS

SEQ ID NO: 36798 - DNA, 1320 bp, Bacillus cereus G9241
  CDS (1)..(1320)
atgctagggattggtgcgataatcggtacaggagtactagtattaacaggattagtagcagcaagagatgctggtccagcagttattttttcattcatgattgcagcgattgtttgtggatttgcagcgttgtgttatgcagaagttgcatctacacttccggtttcaggtagtgtgtacacatattcatatgcgacaattggtgagtttattgcccacctaatgggatggacattactatctgtatatgtcgtaacaactgctgcagtagctggtggatggacaggttatttcaataacttagtgagtggatttggattagaaattccaacagagctgttaaagattccatcacaaggtggaattgtgaatttaccagcagtagtcattactctagttttaacttggttattatcaagaggtacgaaagaaagtaaacgtgtgaataacataatggtattaattaaaattggtattgttattttattcattgcagttggtgcgttttatgtacaaccagaaaactggacaccatttgcaccatacggcattagcggaatctttgccggaggagcagcagtattctttgctttcttagggtttgatgcattagcaacttctgctgaagaagtaaaaaatccacaacgtgatttaccgattggtattattgcttcgttaattatttgtacaatcatttatgttgtagtttgtctcgttatgacaggtatggtttcttataaagagttagatgtaccagaggctatggcatatgtgttagaagttgtaggacaagataaagtagcaggtgtaatcgcagttggagctgtaattggtattatggctgtaatctttgcttacatttatgcaacgacacgtgtattcttcgcgatgagccgtgatggtttattaccgaaatcctttgcgaaaattaataagaaaacagaagcgccagtattctcaacttggttaacaggtattggtagtgctttaattgccggatttatcgatttaaaagaattgtcgaatttagcgaatattggagcgttgttaacatttgcgatggtaggtgtgtcagttattattcttcgtaaaacacatccgaacttaaaacgtggctttgtggtaccacttgtaccaacgctaccgattatttcaatcgcatgttgtctattcttaatgtttaacttaccattaacaacatggatctacttcggtatttggttagcaattggagtagttgtatactttgtttattcgaaaaaacatagtcatttaaaagacgatggaagttcgcaggataatttagaacaagctaattaa

SEQ ID NO: 36799 - protein, 439 aa, Bacillus cereus G9241
MLGIGAIIGTGVLVLTGLVAARDAGPAVIFSFMIAAIVCGFAALCYAEVASTLPVSGSVYTYSYATIGEFIAHLMGWTLLSVYVVTTAAVAGGWTGYFNNLVSGFGLEIPTELLKIPSQGGIVNLPAVVITLVLTWLLSRGTKESKRVNNIMVLIKIGIVILFIAVGAFYVQPENWTPFAPYGISGIFAGGAAVFFAFLGFDALATSAEEVKNPQRDLPIGIIASLIICTIIYVVVCLVMTGMVSYKELDVPEAMAYVLEVVGQDKVAGVIAVGAVIGIMAVIFAYIYATTRVFFAMSRDGLLPKSFAKINKKTEAPVFSTWLTGIGSALIAGFIDLKELSNLANIGALLTFAMVGVSVIILRKTHPNLKRGFVVPLVPTLPIISIACCLFLMFNLPLTTWIYFGIWLAIGVVVYFVYSKKHSHLKDDGSSQDNLEQAN

SEQ ID NO: 36800 - DNA, 1416 bp, Bacillus cereus G9241
  CDS (1)..(1416)
atgaagcaaatttttcaaaagaagcctattgcgaagttaatgcaagagagtaaacaaaagacgttagcaagaacattgggcgcactagatttaacgatgcttggaatcggggcaattgttggaacaggtatttttgttctaacgggcgtggtagcagcgaaacattctggaccagctattatattatcatttgcgatagccgcgttagcctgtgcttttgctgcattttgttatgctgaattcgcttcttcagttcctgtctcaggcagtgtgtatacgtacacatatgcgacgatgggagaagtattcgcatttttaattggatgggacttaatgcttgagtatttacttgctacatctgctgtggcaaacggttggtccgcttatttccaatctttattaaagggatttggaatccatattcctaccattctctcctcggcccctggtacaggaaagggtggaataattgatttacctgcagttctaattattttagtgatgactgttcttttatctagaggtgttcgtgaaagtgcacgtgtaaataatattatggtatttattaaaatagcggttgttcttatttttatctttgctggttttaattatgtaaaacctgaaaactggacgccttttatgccgtttggtttagatggtgtaatggctggagctgctacagtgttctttgcattcatagggtttgatgcagtttcaacagcggcagaagaagtgaagcgcccccagcgtgatttaccaattggtattattgcatcgttattaatttgtacagttctttatatcgttgtttcgcttattttgacaggaattgttccatacggacagctaaatatatcagatccagttgcttttgcacttcaatttattggacaagatggtttagcgggagtaatttcagtaggagcaattacaggaatcacgacagtaatgctagttatgatgtatgggcaagtacgtgtttcgtatgcaatgagtagagatggattattgccgaaacgtcttgctaaagttcacccgaaatttaaaacaccgtttttaaatacgtggacaacgggaattattgcagcacttatttcaggattaatagatttaaatgtattagcgcatcttgtaaatatggggactttatcagcctttgcacttgtagctgttgctgttattgtaatgagaagaacacatcctgatttaccaagagcatttaaggcgccgcttgtaccaattttaccagcgttaacagtaattttttgtttatacttaatgcttcaattatccggaacggcttggattagttttgggatatggatggttatcggtattgcagtttacttcttatatagccgtaaacatagtgctttaaataatagtaaggacgaagaagatgtagcaaatctataa

SEQ ID NO: 36801 - protein, 471 aa, Bacillus cereus G9241
MKQIFQKKPIAKLMQESKQKTLARTLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLKGFGIHIPTILSSAPGTGKGGIIDLPAVLIILVMTVLLSRGVRESARVNNIMVFIKIAVVLIFIFAGFNYVKPENWTPFMPFGLDGVMAGAATVFFAFIGFDAVSTAAEEVKRPQRDLPIGIIASLLICTVLYIVVSLILTGIVPYGQLNISDPVAFALQFIGQDGLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPILPALTVIFCLYLMLQLSGTAWISFGIWMVIGIAVYFLYSRKHSALNNSKDEEDVANL

SEQ ID NO: 36802 - DNA, 1377 bp, Bacillus cereus G9241
  CDS (1)..(1377)
atgagtcttttaataaagaaaacaatggatgaagaaaagaaaaaagtattgaatcaaactttaggtgccattgacctaactcttttagggattggagcaattattggtacaggaattttcgttttaacaggtattgtagcggcaaaacatgctggcccagccattgtattatcgtttatattagcgtccattgtatgtgcgtgcgtagctttctgctatgctgaatttgcatctacagttccagtttcgggaagtgtatattcatatacatatatgacactaggtgagatttttgcatttatagtcggttggtgtgttatgttggagtacttactagcgacttctgcggtagcagcaggatggtcagcgtattttcagtcattgctactaggatttaatattcacattcctacaatttttgcttcggcacctggtatggggaagggtggaattattgatttaccagcagttctcattattttagttgttacatttttattaagtcgtggtgcaaaagaaagtgcacgaataaataatataatggttattattaagctggctgttattgtaggatttattgttgtaggaacacaatatgtaaagccagagaattggcaaccatttctaccgttcggttttcacggtgtggtaggaggcgctgctactgtattttttgcttttttaggatttgatgcagttgcaacagccgcagaggaagtgaagcgtccacaacgtaacgtgccaattgggttacttgtttccttattcatttgtaccgttctatatgtaggtgtttcatttgtgttaactggaatggttccgtttacggaattaaatgttgctgatccggttgcatatgcgttgcgcactgtaggagaagatagaattgctggattgttatcggtgggagcaatagcagggctaacaacagttctgttagtagctatgtttgcgtttgttcgtgtatcttactcgatgagtcgagatggattgttaccaaaaagactttcaagtgtgcataaacgtttacaaactccattttttaatacgtgggttacaggtatattagcagctttattagcgggattagtggatttgaatttactagctaatttagtgaatatgggaacgataacagcatttgtgtttgtatctatagctgtcattgtattaagaaagacacaccctaatatgaagaggccattccgtgcgcccctagtaccttttttacctatcgtttcaatagtaagttgtatatatttagctttgaacctttctaagcttactttaattagttttgtggcatggattataataggtgttttcatatattttgtatatgctaaaaaacatagtaatgttagaaatagagtatag

SEQ ID NO: 36803 - protein, 458 aa, Bacillus cereus G9241
MSLLIKKTMDEEKKKVLNQTLGAIDLTLLGIGAIIGTGIFVLTGIVAAKHAGPAIVLSFILASIVCACVAFCYAEFASTVPVSGSVYSYTYMTLGEIFAFIVGWCVMLEYLLATSAVAAGWSAYFQSLLLGFNIHIPTIFASAPGMGKGGIIDLPAVLIILVVTFLLSRGAKESARINNIMVIIKLAVIVGFIVVGTQYVKPENWQPFLPFGFHGVVGGAATVFFAFLGFDAVATAAEEVKRPQRNVPIGLLVSLFICTVLYVGVSFVLTGMVPFTELNVADPVAYALRTVGEDRIAGLLSVGAIAGLTTVLLVAMFAFVRVSYSMSRDGLLPKRLSSVHKRLQTPFFNTWVTGILAALLAGLVDLNLLANLVNMGTITAFVFVSIAVIVLRKTHPNMKRPFRAPLVPFLPIVSIVSCIYLALNLSKLTLISFVAWIIIGVFIYFVYAKKHSNVRNRV

SEQ ID NO: 36804 - DNA, 1410 bp, Ralstonia metallidurans CH34
  CDS (1)..(1410)
atgagtctctttcgcaccaaaaacatcgacgccatgctggaagtcagcgagcacgacggattgcgaaaggtgctgggggcggtggatctggtgctgatgggtatcggggccatcatcggcaccgggattttcgtgctgactggcaccggggcgctgaccgcgggccccgcgctgacggtgtcgttcgtgatcgcggccatggcctgcggcttcgcggcgctgtgctatgcggagttcgcttccgcgatccccgtatcgggttcgatctacacgtatagctacgccacgctcggcgagatcgtggcgtggatgattggctgggacctgctgctcgagtacgggctggccacgtcggcggtgtcagtagggtggtccggctacttccagtcgctgatcgccgggttcggcatccatctgccgaccgtgctgactgccgcgccgggcgcggtgcccggtgaacacacgctgttcaacctgcccgcctgcctgatcatgctggcgatcacctggatcgtttcatacggcgtcaaggagtcggcgcgactcaacaacgtgatggtggcgatcaagatcggcgtcgtgctgctgttcatcgccgtcggcgtctggcacgtgaagcccgccaactggcagccgttcgcgccgttcggcatgaccggcgtcttcaacgccgccgcgctcgtcttcttcgcgttcatcgggttcgatgcggtgacgtcggccgccgaggaagtgcgcaacccgcgccgtgacctgccgatcggcatcatcggctcgctggcggtttgcaccatcctttacgtgaccgtggcagccatcatgaccggcatcgtgccattcatgaagttcgagggcgttgaccatccggtgtcgctggcgctgcaatacgcggggcagaactgggtggccgggtttgttgatctgggcgccatcctcggcatgaccaccgtgattctggtgatgacctacgggcagacgcggatcatcttcgccatgtcgcgcgacgggttgctgccggaagcgttatcgacggtgcacccggttcatgcaacgccgtacacggccacgtggaccgtcggcatcgtgttcgcggcgatcgccgccttcgtgccgctgaacgtactggccgaactgatcaacatcggcacgctggccgcgttcacgctgatctcgatcgcgatccttgtgttgcgccgcacgcgcccagatttgcggcgcggcttccgctgcccgggcgtgcccgtggtgccgctgctggccgttggcttctgcctgttcctgatggcccatctgcaggcgctgacctggattgcattcctgtgctggatcgggctgggtctgatcatttacttcgcttactcgcgccgcaacgcggtgctgcacaaccacggcggcgacgccgagggctga

SEQ ID NO: 36805 - protein, 469 aa, Ralstonia metallidurans CH34
MSLFRTKNIDAMLEVSEHDGLRKVLGAVDLVLMGIGAIIGTGIFVLTGTGALTAGPALTVSFVIAAMACGFAALCYAEFASAIPVSGSIYTYSYATLGEIVAWMIGWDLLLEYGLATSAVSVGWSGYFQSLIAGFGIHLPTVLTAAPGAVPGEHTLFNLPACLIMLAITWIVSYGVKESARLNNVMVAIKIGVVLLFIAVGVWHVKPANWQPFAPFGMTGVFNAAALVFFAFIGFDAVTSAAEEVRNPRRDLPIGIIGSLAVCTILYVTVAAIMTGIVPFMKFEGVDHPVSLALQYAGQNWVAGFVDLGAILGMTTVILVMTYGQTRIIFAMSRDGLLPEALSTVHPVHATPYTATWTVGIVFAAIAAFVPLNVLAELINIGTLAAFTLISIAILVLRRTRPDLRRGFRCPGVPVVPLLAVGFCLFLMAHLQALTWIAFLCWIGLGLIIYFAYSRRNAVLHNHGGDAEG

SEQ ID NO: 36806 - DNA, 1392 bp, Burkholderia fungorum LB400
  CDS (1)..(1392)
atgtccctgtttcgcaagaagagcgtcgagcacatgatcgccgcaagtgctcagaacgccggtttgaagaaagcgctcggcgcgctcgatctgaccttcctcggcgtcggcgccattatcggcaccggtattttcgtgctgaccggcacgggcgccgtgcaggccggcccggcgctgatgatctcgttcctgatcgcggcgctcgcctgcggcttcgccgccctcgcctacgcagaatttgcctcgacgattccggtggcgggatcgatctacacgtactcgtatgcgacgctcggcgaactggccgcatggatcatcggctgggacctgatgctcgaatacgggcttgccacctccgctgtctcggtgggctggtcgggttatctgcaatcgttgctgtcgggcttcggcgtgtccttgccggttgcgttgacggcggcgccaggtgcgttgccaggtcacgacacgctcttcaacctgcccgcgttcctcgtgatgatggcgatcacggcgctgttgtcgttcggcgtgcgcgagtcggcgcggatcaacaacatcatggtcgcgatcaaggtgatcgtggtgttgctggtcatctgcgtgggcgtctttcatgtgacgccggccaactggcatccgttcatgccgaatggctggaacggcgtgttcggcgcggcggcggtgatgttcttcgcgttcatcggtttcgactccgtgtcgtccgcggcggaagaggtgaagaatccgaagcgcgatctgccgatcggaatcattgcgtcgctgggcgtttgcgcggtgttgtatgtggcggtggccgccgtcgtcaccggcatcgtgccgtcggcgcagttcgcgaatatttcgcacccggtctcgtacgcgttgcaggttgcggggcaaaagtgggtggcggggtttatcgacctcggcgccgtgctgggtatgttgacggtgattctggtgatggcttatggccagacccgggtgattttcgccatgtcgcgcgacgggttgctgccggcgcggctttcgcgggtgcatccgcggttcgctacgccgttttttactacgtggctcgtggggattttctttggattgatcggggcggtggtgccgttgaatgtgctggccgagttgatcaatatcggcacgttggccgcgttttcgatggtgtcgattgcggttctcgttttgcggaagacgcatcctgaattgccgcgggcgttccggtgtcctggggtgccggttgtgccggtgttggcggttgcttcctgccttttcctgatgattaatcttcaggctgttacgtgggtggcgtttgtggtttggttgctcgttgggatggttgtttattttgggtattcgcggaggcattccaggttgagcagctaa

SEQ ID NO: 36807 - protein, 463 aa, Burkholderia fungorum LB400
MSLFRKKSVEHMIAASAQNAGLKKALGALDLTFLGVGAIIGTGIFVLTGTGAVQAGPALMISFLIAALACGFAALAYAEFASTIPVAGSIYTYSYATLGELAAWIIGWDLMLEYGLATSAVSVGWSGYLQSLLSGFGVSLPVALTAAPGALPGHDTLFNLPAFLVMMAITALLSFGVRESARINNIMVAIKVIVVLLVICVGVFHVTPANWHPFMPNGWNGVFGAAAVMFFAFIGFDSVSSAAEEVKNPKRDLPIGIIASLGVCAVLYVAVAAVVTGIVPSAQFANISHPVSYALQVAGQKWVAGFIDLGAVLGMLTVILVMAYGQTRVIFAMSRDGLLPARLSRVHPRFATPFFTTWLVGIFFGLIGAVVPLNVLAELINIGTLAAFSMVSIAVLVLRKTHPELPRAFRCPGVPVVPVLAVASCLFLMINLQAVTWVAFVVWLLVGMVVYFGYSRRHSRLSS

SEQ ID NO: 36808 - DNA, 1350 bp, Enterococcus faecium
  CDS (1)..(1350)
atggaagaatatcaagccacgccagtaaaagaagtaaaaatagaaaatgaattaaaacgtacgatgggattttttactgctttatcgactgttatgggcacagtgatcggtgcaggggtattttttaaagccgcaagcgtagcagaagttacaggatccgccagtttgcatatgttttcttggtttctcggtggtatgatttctgtctgtgcaggactaacaggagctgaactggcagctgctattccagaaacaggagggatgattaaatatatcgaacggatttacggaaatacagcagcttttttattgggctgggcgcaagtcgtgatttattttccagcaaatgtagcagccttgtcgatcattttcggtacacagttcgtcaatctatttggtctttcccagtcaatgattgttcccgtagctgttacagctgctgtatcgatcctgttgatcaattttttaggttctaaagctggaggggcttttcagtcgattacgcttgtctgcaagcttattcctttgtttgtgatcgtcattttcggtttgttccgacaagaaggagtagacttccaactgtttccgatccaagcaggagaaaatctttcatttttctcagccttgggagcgggcttgctagcaacgatgttcgcatacgacggttggatacacgtaggaaatatttcgggagaattgaaaaagccggcgaaagatttgccaaaagcaatttctttaggaatcatcggaatcatgatcgtttatttattagtaaatgcggtgttcttaagaaccgcatctatcgacggagtcgcaggaaacagcaatgcggcaagtgacgttgcaaaaatgatttttggcggcttcggtggaagactggtcacagttggtatcttgatttctgtttatggaaccatcaatggctatacccttactggaatgcgtctcccttatgttatggcaaaagaaaacaacctgccttttagcaagctctttgctaaacttcatgataaaactaaagttcctgtagccgcaggtatcttagagctagtcatcgctattggcatgatgatgatcggtggttttgatacactaacggatatgctgatctttgtcatttggattttttatacgatggtctttgttggtgtcattcttcttcgtaaaaaagaacctgatttgtttcgaccatacaaagttccaatgtatccgtttattccactagtagcaatcattggagggacttttatcgtatcaagcacgcttatcactcagacctttttagcttcgatggggatagtattgacacttgctggtatcccgatttatctctatttaaaacgtagatag

SEQ ID NO: 36809 - protein, 449 aa, Enterococcus faecium
MEEYQATPVKEVKIENELKRTMGFFTALSTVMGTVIGAGVFFKAASVAEVTGSASLHMFSWFLGGMISVCAGLTGAELAAAIPETGGMIKYIERIYGNTAAFLLGWAQVVIYFPANVAALSIIFGTQFVNLFGLSQSMIVPVAVTAAVSILLINFLGSKAGGAFQSITLVCKLIPLFVIVIFGLFRQEGVDFQLFPIQAGENLSFFSALGAGLLATMFAYDGWIHVGNISGELKKPAKDLPKAISLGIIGIMIVYLLVNAVFLRTASIDGVAGNSNAASDVAKMIFGGFGGRLVTVGILISVYGTINGYTLTGMRLPYVMAKENNLPFSKLFAKLHDKTKVPVAAGILELVIAIGMMMIGGFDTLTDMLIFVIWIFYTMVFVGVILLRKKEPDLFRPYKVPMYPFIPLVAIIGGTFIVSSTLITQTFLASMGIVLTLAGIPIYLYLKRR

SEQ ID NO: 36810 - DNA, 1356 bp, Enterococcus faecium
  CDS (1)..(1356)
atggaactcaaggaagatttgggtgtaaagagtaaaagtactgagttaaaacgaaagctagggcttggtactgtaattgcccttggagtcggaacaactgttggttcaggaattttctcttctttatctgaggtggcgggagctgccggaagtagtttaattctcgttttatcatttcttattggtggattggttcaaattccagcgaatttatgttatgcagaattagcatcggcatatccagaagatggcggaggatatatttactttagagaggcgggctctaaaccgttagcgtttcttggtggttggattagtttttgggcaactgatcctccatcaatttcaattatggctttagcaattgctaattatttaggatttttcatcccaatcagtggcctatctttgaaattagtgtctgtactttttgtgctagtatttatgtatcttcatattagaactgttgaaggtggaggaacttttcaaaatattattacggtgctaaaaattcttccttttattttgattattggaattggattgttcaatttaaatggagaattactcctttcttcaacaccgttacaaggcgcttctacaggctttatggcattaattgcagggatttctgctactacttggtcttttgatggaatgtcagctccggtatatatgtctggagagattaaaaatccaaagaagaatatacctaaaggattaatttttaccacttttatcgtgttagcgatttatgttggactaacatttgtagcttctggaattttgagtgttgatgaattagctagttcagatgcaccgattgcgttattagcttcgaaaatccctgtgattggtagttttgcaggcacatttgttgcagtgacagccgtaatagtgattatcggctcactctcaagctgcatcatgtttcaaccgcgaattgaatatgctatggcaaaagacggattgttcttcaagtcctttgggaaagtacatcctaaatacgaaacaccatacttttccattatgattcaatgtttctatgcgattgtattgatttttgcaacagatatttcgggtttattgggttactttactcttgttgcattgttaaaaagctttttaacctttggaacaatttttatcctaagaaggaaaaaatctggatatgatccttcatataaaacgccatttggctatttaatgccggttgttgcgatgtttatgaatggaactttaatttattcaacatttttatgggcacctgttggtggtttaatagcagctgtagtagctgtagcgactggtttgccagcgttttatttttggaacaaaagaaatagtgttggttag

SEQ ID NO: 36811 - protein, 451 aa, Enterococcus faecium
MELKEDLGVKSKSTELKRKLGLGTVIALGVGTTVGSGIFSSLSEVAGAAGSSLILVLSFLIGGLVQIPANLCYAELASAYPEDGGGYIYFREAGSKPLAFLGGWISFWATDPPSISIMALAIANYLGFFIPISGLSLKLVSVLFVLVFMYLHIRTVEGGGTFQNIITVLKILPFILIIGIGLFNLNGELLLSSTPLQGASTGFMALIAGISATTWSFDGMSAPVYMSGEIKNPKKNIPKGLIFTTFIVLAIYVGLTFVASGILSVDELASSDAPIALLASKIPVIGSFAGTFVAVTAVIVIIGSLSSCIMFQPRIEYAMAKDGLFFKSFGKVHPKYETPYFSIMIQCFYAIVLIFATDISGLLGYFTLVALLKSFLTFGTIFILRRKKSGYDPSYKTPFGYLMPVVAMFMNGTLIYSTFLWAPVGGLIAAVVAVATGLPAFYFWNKRNSVG

SEQ ID NO: 36812 - DNA, 1377 bp, Enterococcus faecium
  CDS (1)..(1377)
atggatttgtttcgtaagaaagagatcaatctcaatcatacgagtgagatgaaaaaagaactaaaaacgtctgatttgatcatgcttggaattggtgcgatcatcggtacgggaatatttgtggtgacaggggttgcggccaatcaaaatgctggtccagcactgtcactttcatttgtcttagctgcaatcgttgtcattttgtctggactaagtttcgcagaatttgcttcgcgagtgccagtgattggtgggccatatgcctatctgtatgttgtatttggtgaatttgctgcctggctgacagggtggttgttgatcggggaatttttactagcggtttcctctgttgcttccggatggtctggctatatgcaaggttttttgaaaagtttaggggccgaacttccacaagcattaactggcgggtacaatccggaaaatggtacatacattgacttgattgcggtgctcgtagtgatattcgtcacttacatcgtgtcgcttgaagccaagaaagcattacgtttgaataatgccatggtatatgtcaaatttggtatcatcgcgttgtttatcattgtaggaatatttttcgttaaacctgataactggcagccattcatgccttttggtttttccggtgtgctagatggtgcagctcttgtgttttttgctttcttgggatttgatgccgttgcaatggcagccgaggaagtcaaaaacccgcaaaaagatgtgccaagaggaatcattggttcgatactgattgctactgtcctttacatcatcgtgacgctgatcttgacaggaatcgttccgtatactgaactaggagtcaatgacccagtggcttttgcaatgaggtatgtaggacatggaacagtgggcgcggtgatcgctgtaggggcaattttaacgctactgacggtaacgatctcgatgatgtattcacttgctcgtttactgtttgctgtcagcaaggatggcttacttcctaagtttatgacagaaatcgatcaaaagcatcgtacaccgaaaaaagcgacttatgccgctggtgtggcagctgtattctttgccggatttttcccattgaatgtattagcggaactaacgaatatcatggcgctcgcctatttgatgcttgttagtctaggcttactgaagttgagaaaaatgtttggcaaaccaaaagctggagaattcaaagtgccattcgttccgctattgccaatcgtctccatcttgacttgtattgtattgatgcttcgtctgcaaactgtgacatggatcgtgttcggtatcgtaatggttattggactgatcatttattttggctatggctatggacacagcaagatgaatgagaaatag

SEQ ID NO: 36813 - protein, 458 aa, Enterococcus faecium
MDLFRKKEINLNHTSEMKKELKTSDLIMLGIGAIIGTGIFVVTGVAANQNAGPALSLSFVLAAIVVILSGLSFAEFASRVPVIGGPYAYLYVVFGEFAAWLTGWLLIGEFLLAVSSVASGWSGYMQGFLKSLGAELPQALTGGYNPENGTYIDLIAVLVVIFVTYIVSLEAKKALRLNNAMVYVKFGIIALFIIVGIFFVKPDNWQPFMPFGFSGVLDGAALVFFAFLGFDAVAMAAEEVKNPQKDVPRGIIGSILIATVLYIIVTLILTGIVPYTELGVNDPVAFAMRYVGHGTVGAVIAVGAILTLLTVTISMMYSLARLLFAVSKDGLLPKFMTEIDQKHRTPKKATYAAGVAAVFFAGFFPLNVLAELTNIMALAYLMLVSLGLLKLRKMFGKPKAGEFKVPFVPLLPIVSILTCIVLMLRLQTVTWIVFGIVMVIGLIIYFGYGYGHSKMNEK

SEQ ID NO: 36814 - DNA, 1503 bp, Thermobifida fusca
  CDS (1)..(1503)
atgagtatctggcgcacgaagagcatcgaacagtccatccgggacaccgacgaacccgggtatcggctccgccgggacctcaacggcttcgacctgatcgtcttcggcatcggagtcatcatcggaaccggcatcttcgtcgtcacgggacggcaggccgccgagaacgccggccccgccatcgtcctgtccttcctcgctgccggagctgtatgcgcactggctgccatgtgctacgccgaattcgcctccaccgtgccggtcgccgggagcgcgtacacgttcggctacgccacgctaggggaattcgtcgcctggatcatcggctgggacctcatcttggagttcaccctggcggcctctgtggtctccgtgggctggtcggaatatgccggagacctcctcgccctgccgaccacggtcaccctcgccggtctcccggtgaacctcggcgccgtggccatcgccgtcctcctgggccttgtcggcatgctgggagccaaactgtcgggccgggtcaccgcggtcgtggtggcgatcaaagtcggcatcgtgctcttcatcatcgccgtgggcgcagcctacgtcgaccccgccaactggacgccgttcatcccacccgcgcagcccgcggccgcggacaccaccggggtgagcgatgccacgctcacccacgtcctcttcggcttggaacccacctccttcggcccgtggggagtggtcgccgccgcatcagtggtgttcttctccttcatcggcttcgacatcgtcgccaccaccgctgaagaaacccgcaacccgcggcgggacatccctgtcggcatcttcggctccctgctcatcgtcaccctgctgtacatggcggtggccgcagtcgtcacagggatgcgcccgtacacggaactcaacgtgaccgcacccctctccgacgccttccgctctgtcggcgccgactgggcggcgaccctgatctcgctgggcggggtcatcggcatcaccaccgtcatcctggtgctgatgatgggtcaggcccgggtcgcgttcgccatgtcccgcgacgggctgctgccccgagcgctctcccgtatccacccgcggttcggcaccccgtatgtgaccaccctgctgaccaccgcggccgtggcactgctcggcggcctcgttcccatcagcacgcttgaagagatggtcaatatcggcacgctgttcgcgttcgtcgtagtgtctgtgggcgtggtcgtcctgcgttctctccgccccgacctgccgcgggcattccgcgtgccctggtctccggtactgccgctgctggccgcgctctcctgcctctggctgatgctcaacctgaccgcgctcacctggatccggttcgcggtatggctcgtgatcggggtcgccatctacttcctctacggaatccaccacagcaggctcgccgcgcctcccgcacagcccagcggtgaagaaggagaaggggtgggcgaggggtttctcggcgcataa

SEQ ID NO: 36815 - protein, 500 aa, Thermobifida fusca
MSIWRTKSIEQSIRDTDEPGYRLRRDLNGFDLIVFGIGVIIGTGIFVVTGRQAAENAGPAIVLSFLAAGAVCALAAMCYAEFASTVPVAGSAYTFGYATLGEFVAWIIGWDLILEFTLAASVVSVGWSEYAGDLLALPTTVTLAGLPVNLGAVAIAVLLGLVGMLGAKLSGRVTAVVVAIKVGIVLFIIAVGAAYVDPANWTPFIPPAQPAAADTTGVSDATLTHVLFGLEPTSFGPWGVVAAASVVFFSFIGFDIVATTAEETRNPRRDIPVGIFGSLLIVTLLYMAVAAVVTGMRPYTELNVTAPLSDAFRSVGADWAATLISLGGVIGITTVILVLMMGQARVAFAMSRDGLLPRALSRIHPRFGTPYVTTLLTTAAVALLGGLVPISTLEEMVNIGTLFAFVVVSVGVVVLRSLRPDLPRAFRVPWSPVLPLLAALSCLWLMLNLTALTWIRFAVWLVIGVAIYFLYGIHHSRLAAPPAQPSGEEGEGVGEGFLGA

SEQ ID NO: 36816 - DNA, 1269 bp, Methanosarcina barkeri str. fusaro
  CDS (1)..(1269)
atgaaaagggagtcagaactgaaaaaggaactaaatctgctggaggttactctggtaggaattggagatattctcggagccggaatctacgtacttatgggaaaagctgcagggcttgcaggcaatatggtctggttttcttttctgtttgccggagcaacggccacactttctgcctttagctatatggaactcgcttccatgtttccaaaggctggagcagaatatggattcgtaagaagagcttttggagaacgtattggattatttattgggctgcttgtcatatattttgtggcaataacgagttctgcggttgcccttggatttggcaggtatttcagcaacctttttgggaatggatatttgacagggactttaggcttgtttatccttctcagcctcatcatggtttacgggataaaggaatctgccaggctggccattttcattagttttatcgaagtttcagggcttctaattgtaatttatacaggtctcccttaccttggaacggtaaactatttcgaaactccagatctggcaggaatatttaaagcttcaactctgatttttttcgcatttcttggttttgaggatatcgtgcgattatctcaagaaacgaaagaagctgaaaagacaactccaaaagccctgcttattgccatcttttttacagtcttcctgtacatgtgcgtggcaataactgccgtaagtatgcttgactttcgagttctcggactttcaggagctccccttgcggatgtcgtggcgatttctctgggaaataaggcttttgtcctcatgtcctggatcgcccttttttccactatgaatactgtacttgtggttatgcttggagggtcaaggattgtctatggtatggcagattcaggggcgctccctagatttctctccagagtccaccccggttaccggacaccatgggtcgcaattttaggagtttcctttctctcagccttgtttgtactattcagggatgttgcaatcgtagcaaatatttctaattttatgatttttattatcttttttatggtcaatctctctctaataaaacttcgttatactgatcccggaagaaatcgcccttttaaggttcccctgaatattggccgttttcccttgcttccgtttcttggagccctttctactgtatttcttttttttcagctaagtctggaagttataacttacggtctcgtttttataggaatcgggatactgatagtgctgttcagaaccagataa

SEQ ID NO: 36817 - protein, 422 aa, Methanosarcina barkeri str. fusaro
MKRESELKKELNLLEVTLVGIGDILGAGIYVLMGKAAGLAGNMVWFSFLFAGATATLSAFSYMELASMFPKAGAEYGFVRRAFGERIGLFIGLLVIYFVAITSSAVALGFGRYFSNLFGNGYLTGTLGLFILLSLIMVYGIKESARLAIFISFIEVSGLLIVIYTGLPYLGTVNYFETPDLAGIFKASTLIFFAFLGFEDIVRLSQETKEAEKTTPKALLIAIFFTVFLYMCVAITAVSMLDFRVLGLSGAPLADVVAISLGNKAFVLMSWIALFSTMNTVLVVMLGGSRIVYGMADSGALPRFLSRVHPGYRTPWVAILGVSFLSALFVLFRDVAIVANISNFMIFIIFFMVNLSLIKLRYTDPGRNRPFKVPLNIGRFPLLPFLGALSTVFLFFQLSLEVITYGLVFIGIGILIVLFRTR

SEQ ID NO: 36818 - DNA, 1578 bp, Novosphingobium aromaticivorans DSM 12444
  CDS (1)..(1578)
atgttcggtcgcgtcaaaccgctcgacgccattcttgcaactgcagaaaagaaatcgttgcaccgctcgctgggtccggtccagctcactcttctcggtgtcggtgccattatcggtaccggcattttcgtgcttacggccgccgccgcgcaaaaggccgggccgggcatgatgtggagcttcgtgatcgcgggcttcgtctgcgcggttgcggctctgtgctattccgagctggcctcgatggtcccggtctcgggttcggcctatacctacagctatgccgtggtcggcgaaatgctggcctggatggtcggctgggcactgatcctcgaatatgccgtggccgcgtccgccgtgtcggtcgggtggtccggctatttcatgggacttctcaagagtttgaccgggtttgaattaccggcgatgctacaagctgggccaacctggacgatgaacggcctgctgccccacgctgatttctccactggcctgatcaacgtgcccgcaatcgtcgtggcactgctcgtcacctggctgctcatgctcggcaccaaggaaagcgccacgttcaacgcgatcctcgtggcgatcaaggtcgcggcgctgaccatgttcatcgtgctgaccctgccggcgatcgagcgcgagcacttcgccccattcgcccccaacggctggttcggccctgccggaacgaccgggatgggcatcgtcggcgcggcgtcgtcgatcttctttgcctacgtcggcttcgacgcggtctcgaccgctgccgaagaaaccaagaacccgcagcgcaacgtgccgatcggcctgatcggaagccttgcgatctgcaccgtgttctacctgctggtcgccgctggcgcgattggttcgatcggtgcgcagccgaccgctctgggcgtcgcgccgggttcggccgagttcacccagcagtgcgccgcgctgcttgcttcgggccaggaaccgctggtctgctcgaacgaggctctggcccatgtcctgcgcgccatcaactacacctatgctggcgacctgatcggccttgcggccaacctcgcgctgccgtcggtcatcctgatgatgctctacggccagacgcgcatcttcttcgtcatggcgcgcgatggcctgcttccggagaaactggccaccgtccaccccaagtggaaaacgcctcacatcgtgaccgcaatgaccggcgtattcgtcgccatcgcggcggcgctgcttccggttggtcagcttgccgacatctcaaattcgggcacgctcttcgcgttcttcatggtcgcgatcgcggtcatgctgctccgcgcccgcgacccgaaccgcgtccgtccgttccgcacaccggcggtgtgggtcgtcggcccgatcgccgcgattggctgtatcttcctctactggaacctgccgttcgaggcgaagatggtccttcccgtctggggcgccatcgggctcgtgttctacttcgcctacggctatcgcaagagccacgtcggccagggccacgtcgaagtccacgagggtgacgccgacgtcccgccgatgccggtcccgccgatcgactga

SEQ ID NO: 36819 - protein, 525 aa, Novosphingobium aromaticivorans DSM 12444
MFGRVKPLDAILATAEKKSLHRSLGPVQLTLLGVGAIIGTGIFVLTAAAAQKAGPGMMWSFVIAGFVCAVAALCYSELASMVPVSGSAYTYSYAVVGEMLAWMVGWALILEYAVAASAVSVGWSGYFMGLLKSLTGFELPAMLQAGPTWTMNGLLPHADFSTGLINVPAIVVALLVTWLLMLGTKESATFNAILVAIKVAALTMFIVLTLPAIEREHFAPFAPNGWFGPAGTTGMGIVGAASSIFFAYVGFDAVSTAAEETKNPQRNVPIGLIGSLAICTVFYLLVAAGAIGSIGAQPTALGVAPGSAEFTQQCAALLASGQEPLVCSNEALAHVLRAINYTYAGDLIGLAANLALPSVILMMLYGQTRIFFVMARDGLLPEKLATVHPKWKTPHIVTAMTGVFVAIAAALLPVGQLADISNSGTLFAFFMVAIAVMLLRARDPNRVRPFRTPAVWVVGPIAAIGCIFLYWNLPFEAKMVLPVWGAIGLVFYFAYGYRKSHVGQGHVEVHEGDADVPPMPVPPID

SEQ ID NO: 36820 - DNA, 1317 bp, Novosphingobium aromaticivorans DSM 12444
  CDS (1)..(1317)
atgaacaaggttcgtggaagcaaggttcgcggcctggggttctggatgacgctggcgctggtcgtgggcaacatgatcggctcgggcatctacatccttcccgcgacgctggcgccgttggggttcaaccagttgatcggctgggcagtcactcttgccggggcgctgtgccttgcggctgcctttgcaagaatgggagcaaggttgccgctggcgggcgggccctatgcctatgcccaggccgcattcggaccgatcccgggcttcgtgacggcatggtcgtactggaccatgctgtgggcgggcaatggcgcggtcgcggtagcgctggtcagcaacctcagcctgatcgcgccctggatcggcgcgacgccagccgtccccgcgctgctttcagtcggtttcgtgtggctgctgacgctggtcaacattcgcggcgtgcgcgcggcgggggacgtgtcggtggtgacgaccgcgctgaagctcgtgccgctggccgggctgataggcctggcgatctggctgctgatcacgggcgcgccaacggtggtccagcccgaggtcccgttgtcgggcggggtgatcgccaccgccgcgggacttaccttctggggcttcctcggccttgaatccgccaccgtccccgccgacaaggtggagaatgcgcggacagtggtgccgcgcgcgacgctgatcggcgttgcaatcaccggcctcgtctacatgggcatttcaggcgccttcgcgctctacatgccaatggcggatgctgccgcctcccctgccccggtggccgatttcctcgcacgcttcttcggctcgggcatgggccaggtcgtcgccctattcgccgcgatcagcgcgttcggcacgctgaacggcttcatcctgctgcaaggcgaagtgccgtgggccatggcgcgcggcggcgtctttccccggtggttcgccgccgaaggcccgcgcggtacgccggtgcggtcgcacgtggtgtcgagcatactgctgagtatcgtgaccctgctcaactacgggcgcgggatgggcgacctgttcgccttcatcgcctcggtcagcctcgccgcagggatgctgtcctatttcgtcgcgatgctcgcagccgtgcgcctgctacccgacgagcgcccgatggtgatcgcggcactcgtcggtgcggcattcatcgcatgggcggcgtggggacttggcgcggaggcgctgacctatggggcaggcttcgtcgcgctaggcctgcccgtgtacctctggatcaggcgcgatggagcagcttccacaacagcgaacgatcccggatga

SEQ ID NO: 36821 - protein, 438 aa, Novosphingobium aromaticivorans DSM 12444
MNKVRGSKVRGLGFWMTLALVVGNMIGSGIYILPATLAPLGFNQLIGWAVTLAGALCLAAAFARMGARLPLAGGPYAYAQAAFGPIPGFVTAWSYWTMLWAGNGAVAVALVSNLSLIAPWIGATPAVPALLSVGFVWLLTLVNIRGVRAAGDVSVVTTALKLVPLAGLIGLAIWLLITGAPTVVQPEVPLSGGVIATAAGLTFWGFLGLESATVPADKVENARTVVPRATLIGVAITGLVYMGISGAFALYMPMADAAASPAPVADFLARFFGSGMGQVVALFAAISAFGTLNGFILLQGEVPWAMARGGVFPRWFAAEGPRGTPVRSHVVSSILLSIVTLLNYGRGMGDLFAFIASVSLAAGMLSYFVAMLAAVRLLPDERPMVIAALVGAAFIAWAAWGLGAEALTYGAGFVALGLPVYLWIRRDGAASTTANDPG

SEQ ID NO: 36822 - DNA, 1596 bp, Ferroplasma acidarmanus
  CDS (1)..(1596)
atggttgatattgaaactcagaataatgttgttaaaagtaaatacaaaaaggatctgggactctggagtgttattatgctggcacttggtggaattttagggcctgccgtcgcctatgcacctgtgtacacacttgcctatgctggacctataggcatactggcgtggccaatagccatggttatgataattcccataggactggtatacgctgaactgggtacaacatggccaaaggcaggtggtgttgcatattatccttctaaaagcaatgggcctatagtaggagcgataaatggttggtcatccatggttggatatctatttgtaggaccggtcatagtatttgcagttgtggaatatttgagtttttattttccatcactctatgcaaacgggacattaacatatcttggaataattgtggcggaaatagtactcatacttgtatttcttgttaatatactgaggataaagcatatgggtgctataaacctcattctcacagcaattacacttttgcttattggtgttgtgatcattgcccttgctttctattttaaactatccaatattacttccaccgcaggaggagttataccatacggcttcaccgggtttttcggagcaataaccctgaccgtattcggttacggaggattcaggcaacctatagattattcagaggaagtcaaaaatccaggcaaaagcataccaatagcaattatagtagcactgcttgtttctggtcttgtattttctcttgaatcacttgtattcgcaggtgctatcaatttctctaaacttggaataagtacgggtaattggtctgcgttgtttgcctacagttctccgtatgctacactatcgaaagtacttgtattgcccgccatagtaataattgcaataattgttgcacttatagccacgtttaaggatggtgttatatattatggtggcactgctagagtgggagaagttctggcaagggaagataaatttcttccaaagctatttgacaggatgaatgtaagaggaataccggtatattctatcgttcttgtattaataatcacaatagttttagtagcactggggaggtcactggcaacaattataggcattatggttgatggctttttattatcatacgcccctggagccattagcttaatggtattcagaaaaacagatatggttacaaagaggccatttaagcttccatttgctaaaatacttgcacccatagcatttattgttgccaatcttctggtatactggtcaggatgggcagcagttgagattatcattccattggatttcgccggtatactgcttgtacttgtttacagccactacacaaaaattgacatgaagtatgcaatgtatggaatatggatgccagtataccttatatttatacttataatgtcccgtataggaagtagcctgttccacggattaaattatatcgcgtttccatatgatacaatagtttttattattgttacaatggtgttctattttgtaggtgtaaatctaggagtaaaaagtgtaaattatataactaataaaaaagcgggcaacccggaatga

SEQ ID NO: 36823 - protein, 531 aa, Ferroplasma acidarmanus
MVDIETQNNVVKSKYKKDLGLWSVIMLALGGILGPAVAYAPVYTLAYAGPIGILAWPIAMVMIIPIGLVYAELGTTWPKAGGVAYYPSKSNGPIVGAINGWSSMVGYLFVGPVIVFAVVEYLSFYFPSLYANGTLTYLGIIVAEIVLILVFLVNILRIKHMGAINLILTAITLLLIGVVIIALAFYFKLSNITSTAGGVIPYGFTGFFGAITLTVFGYGGFRQPIDYSEEVKNPGKSIPIAIIVALLVSGLVFSLESLVFAGAINFSKLGISTGNWSALFAYSSPYATLSKVLVLPAIVIIAIIVALIATFKDGVIYYGGTARVGEVLAREDKFLPKLFDRMNVRGIPVYSIVLVLIITIVLVALGRSLATIIGIMVDGFLLSYAPGAISLMVFRKTDMVTKRPFKLPFAKILAPIAFIVANLLVYWSGWAAVEIIIPLDFAGILLVLVYSHYTKIDMKYAMYGIWMPVYLIFILIMSRIGSSLFHGLNYIAFPYDTIVFIIVTMVFYFVGVNLGVKSVNYITNKKAGNPE

SEQ ID NO: 36824 - DNA, 1323 bp, Ferroplasma acidarmanus
  CDS (1)..(1323)
atgaaggataagaaatttatcagtgttcctgtggcaacggcagttggactgggggctataataggcgcgggcatatttgttttaagtgggactaccatagcactggcaggggctaatgcacttatagcttttgttcttgtaggagtacttgcaattattattgcaatggaattaggtgaattgggttcaataatgccccatgccaaaggtgcttccttttcctatatttatgaggcttttggcagtgaaatgggttttattactggcatattattatattttagcttctccacagccatagcagcaattgcattgggcttcgggtcatatcttggctccctggtagggttgcacaccggctattaccctatcatatttgccattatcttgatatttgtacttgcaattgtaaatattgtaggaataaaaaaggctgcaaaagcagatttttaccttgttatggtcaaattagctatattaacaatatttgtaatagctgcagttattctcgcatacacaaccaaatcactaaacacttcaaattttgttacgccggttgctaaagacaatatatcggctatatttgctgccagcattgcagtgttttttgcatattcaggtttccagtccatttcaacatttacatcagatataaagggtggagccaataaggcagcaaaggccataattctatccgtgcttatcagtatggtattttatattttagtggtactggcccttatactcatggtgcctgcttctaaatataccatatcggctgacccgcttgcatttgccttaaaatatgtccatgcaccctattcaatctatgcgcttgtgaccatcggtgcccttattgcaacaacttcagctacactcgccatgattatgacctcttccagaatattataccagattggtgacaacaagcttttgccgaaatttttccgtaagttcaactataaaaaggatgtttcggttaacggtgtaattatttcatcattaatcgggatagttatgctattctccggaaatatttacattatagccgcaataagcaattttggattgcttttatcgtatttggtagcaagctttgcaataatacatttcaggagaattaagaaattcgggagctttaaaactccactgtatccatttaccattattgccggaataatactgctgattgtattcatacttgggatgcccagggaggcactggatataggggttgtaataatactattgctgtttatgctatattatttctttattgaacttagaagggataaggtaattaaagaggaactattcaaataa

SEQ ID NO: 36825 - protein, 440 aa, Ferroplasma acidarmanus
MKDKKFISVPVATAVGLGAIIGAGIFVLSGTTIALAGANALIAFVLVGVLAIIIAMELGELGSIMPHAKGASFSYIYEAFGSEMGFITGILLYFSFSTAIAAIALGFGSYLGSLVGLHTGYYPIIFAIILIFVLAIVNIVGIKKAAKADFYLVMVKLAILTIFVIAAVILAYTTKSLNTSNFVTPVAKDNISAIFAASIAVFFAYSGFQSISTFTSDIKGGANKAAKAIILSVLISMVFYILVVLALILMVPASKYTISADPLAFALKYVHAPYSIYALVTIGALIATTSATLAMIMTSSRILYQIGDNKLLPKFFRKFNYKKDVSVNGVIISSLIGIVMLFSGNIYIIAAISNFGLLLSYLVASFAIIHFRRIKKFGSFKTPLYPFTIIAGIILLIVFILGMPREALDIGVVIILLLFMLYYFFIELRRDKVIKEELFK

SEQ ID NO: 36826 - DNA, 1365 bp, Ferroplasma acidarmanus
  CDS (1)..(1365)
atggaaacatatggcctaaaaaggattcttggattgcggtcagccataattattaatttaggggcgataattggcgcaggtatattcgtaattataggcatcgctgcggggaaggccggccccgcaattataatttctatctttgtttcagcaatcatagctatatttacggggctgagtttttctgaaatagcccagcacacatccaaagaaggcggcgtttatgagtacgcaaaagaatcatttgccccatcggccggatttataggcggaacaatgtggacattctccaatatgattgccatttcagcagtatcattgagcactggcagttacattaactccctttttcatcttcatatagatctcatagtttttggcattcctataatcataatgtttgcaatcctgaatatgcttggcataaagaattctgcaaagaccttatctattcttgtcgggataaatatcgcaatactgattatttttgtagtttccggcttattttattttaaattaacagatttttctaatttcgaccctcacggatttaccggaataatggagggttctgccctgatatttttcgcttttacgggattttcccggataacaactattggagatgaagttaagaatcctgaaaaaaatataccgaaagccattatcatttccataattatatcatctgccctttattctattgtagctgtagtggcaataggattaatcccatcatccaatcttgcatcagcttcagcgcccctctcagccgcaatagcagttttgcacaattcctatattcttataattgtagctatagggggaatcactgcaactgccggtgtagtattaacaggtatactgggtaccagcagggtgctctacgcgatgggaagggatagggaaataccaggtaccttcggcaggatagataaatttgggacgcctttttattccatattgctttctatggcgattagcttattattcgtttattttgttggctttgcaacaataatagaagcgtcaaatgtatcagtgctcatagcatattcaataatagatttttcagcaataatgctctggagaaaggtaaaaagagaaaatcccaaacatatgagggaacagaagtatttttttatcataccactgataggcatggctacaatattcattacgatcagttatcttggccttcatgcaatagaaataagccttgcagttctggcgctggtttcaggtatttatggcataaagcatgtcatggaatccggaggctatatcaggaaagcgaaacaaataattccaggatatagcaaagtaaggttgtttggcaggagcaggcaacaaattaaaaaatga

SEQ ID NO: 36827 - protein, 454 aa, Ferroplasma acidarmanus
METYGLKRILGLRSAIIINLGAIIGAGIFVIIGIAAGKAGPAIIISIFVSAIIAIFTGLSFSEIAQHTSKEGGVYEYAKESFAPSAGFIGGTMWTFSNMIAISAVSLSTGSYINSLFHLHIDLIVFGIPIIIMFAILNMLGIKNSAKTLSILVGINIAILIIFVVSGLFYFKLTDFSNFDPHGFTGIMEGSALIFFAFTGFSRITTIGDEVKNPEKNIPKAIIISIIISSALYSIVAVVAIGLIPSSNLASASAPLSAAIAVLHNSYILIIVAIGGITATAGVVLTGILGTSRVLYAMGRDREIPGTFGRIDKFGTPFYSILLSMAISLLFVYFVGFATIIEASNVSVLIAYSIIDFSAIMLWRKVKRENPKHMREQKYFFIIPLIGMATIFITISYLGLHAIEISLAVLALVSGIYGIKHVMESGGYIRKAKQIIPGYSKVRLFGRSRQQIKK

SEQ ID NO: 36828 - DNA, 1560 bp, Ferroplasma acidarmanus
  CDS (1)..(1560)
atgcctaaaaaggaaaatctcaagagagatattggtttagtagggcttgtcggaattggtgttggtggggttataggatcaggtatttttgccctgccggcaattatgggagctgttgcggggccgggatttgtcatatcagttgttgctgttggaatcattatacttattctggggctcatttatgccgaactgggatcaacatacaccatgaccggtgggccctattcccttccaaggaaagcgcttgggaatgatacaggattcgtgctgggttggggatattttatatatgcttttacagggactgctgccataatagatatatttattacataccttggattttatgttcctggactctcagtagggcttgtgcttacaccactgggcatagggatatctctagtcgcactggctatatttacaataataaatgtatttggagttaaatttggggctttgttctctgtgattacaacaataggcaagataataccgctggtaatatttgcggtaattgggtttttagtcttcaaaattgcaaatttcaccccattcctgccctatggccttggtggccttggactggcaatggcacttgactttttcgcatttacagggtttgaaagtgttgtaataccctcaggagaggttaagaatccttcaaaagtcataccaagggcaatgatatttacaatattaatagttatagcagtctatgctataatgtctattgcattcacgggaatgttcaactggagcgctgccgggataccagtaggagattggggagctattgggaatctttcatccccatttgcaacagcggctgactctatagggcttcctgtactggcagcgatcgtggtagctggtgttataataagcacacttggggcaggggaggactgggtgcttcttcaagcaaggataccctatgcaatggcagacaacgatcttttctgggcacctatgggcaaggtcaatgaaaagtataaaacccctcagaacgcattaatattctcatcggttctcacaggagtgacgatgatactgctcccctcgtttccggaggttgcacttctcgcatcaatcacaacactggtgccatatgcagccgccgcattgtcgctgcccatcctgagaaaaaccgataaggatacaacacggccattcaagctatatggtggaacaatttttgcattctttggttttgttctgagcacttttttgatatactttgcatcatggccatggacaataattggaggaattctgattctaataggttatgtgctttacatattcgtgaaaaaggaaaaaacatttgaattaaagaggaacctctggctaatagtgtatcttgtcggtatagttgtaatatcctatatcggaagcaagacgtacatatatgataatatcctgcccatagccccgctgggaatattaaattcaccatacgatttgataacactcgggatctttgcctcaataatatttgtatgggcatattttgaaaatataaagtacaagcccctggctgaccaggtagaataa

SEQ ID NO: 36829 - protein, 519 aa, Ferroplasma acidarmanus
MPKKENLKRDIGLVGLVGIGVGGVIGSGIFALPAIMGAVAGPGFVISVVAVGIIILILGLIYAELGSTYTMTGGPYSLPRKALGNDTGFVLGWGYFIYAFTGTAAIIDIFITYLGFYVPGLSVGLVLTPLGIGISLVALAIFTIINVFGVKFGALFSVITTIGKIIPLVIFAVIGFLVFKIANFTPFLPYGLGGLGLAMALDFFAFTGFESVVIPSGEVKNPSKVIPRAMIFTILIVIAVYAIMSIAFTGMFNWSAAGIPVGDWGAIGNLSSPFATAADSIGLPVLAAIVVAGVIISTLGAGEDWVLLQARIPYAMADNDLFWAPMGKVNEKYKTPQNALIFSSVLTGVTMILLPSFPEVALLASITTLVPYAAAALSLPILRKTDKDTTRPFKLYGGTIFAFFGFVLSTFLIYFASWPWTIIGGILILIGYVLYIFVKKEKTFELKRNLWLIVYLVGIVVISYIGSKTYIYDNILPIAPLGILNSPYDLITLGIFASIIFVWAYFENIKYKPLADQVE

SEQ ID NO: 36830 - DNA, 1443 bp, Cytophaga hutchinsonii
  CDS (1)..(1443)
atgttctcatccctttttaaaacgaaaagcattcaatccattcttaaagaagaaaaaggagagctcaaaaaaacccttaccgcaacaagccttgtattactaggaatcggtgcaattatcggtgccggaattttttcccttacaggtatcgccgcagctgaaaatgctggtccggctgtaaccatttcctttgttgttgccggattaggctgtgcgtttgccggattatgttatgcggaatttgcttctatgttaccgattgccggaagcgcatacacctattcatacgctactcttggcgaatttatcgcctggatcataggctgggatctggttcttgaatatgccgtaggcgcagctaccgttgccataagctggtcacgttacttaattaagctgcttgaaaaacttggtgtagatcacattccttatcaatggatgatgtcaccgtttgaaacacatagggtaaacggaacagaattgcatggcatcgttaacattcccgcaatttttatcacgtgcctgatgtcattagtcctgatccggggaatgaaagaatctgcaaaattgaacaatgttattgtagcattaaaaataaccgttgtaattgcattcattattttaggctggagctacatggacccaatcaaccatgctgattatgtaccggacaatacaggtgtttttgagcactttggctggacaggcgtaatgaccggcgctgcagttgtatttttctcttttattggttttgatgccgtttccaccgctgcacaggaagctaaaaatccacagcgcgatatgcctatcggcatactgggctccctggttatctgcacgatcttatatgtattgttttcctatgtaatgactggccttgaaaattatcagaactttaaaggtgaagcagcaccggttgccttagcgatcgcggctacgccatatgcctttttccaggaactgattatcatagcaattcttgcaggttacacatctgtgatcatggtattattaatgggtcagtcccgtgtgttctttagcatgtctaaagatggtcttgtaccggcaatcttttcagaagtacatccgaaataccagacaccatggaaatcaaatattctgtttgccatattggtgagtttgtttgcaggcctggtgcctgtttcagtagtaggagagatgacaagcattggcaccttgttcgcttttgtactggtatgtataggtgtattggtgctgcgcaaaaagcagccggatgcaccaagagcgttccgtacaccatgggtaccgtttgtgccaatcatgggtattgttgtgtgcctgtacctgatgtacgcgcttccaatagacacctggatccgtttgattgtatggatggcaattggtatcgctatttactttttatacagcagacaccatagtaagatccgtaacagtaattaa

SEQ ID NO: 36831 - protein, 480 aa, Cytophaga hutchinsonii
MFSSLFKTKSIQSILKEEKGELKKTLTATSLVLLGIGAIIGAGIFSLTGIAAAENAGPAVTISFVVAGLGCAFAGLCYAEFASMLPIAGSAYTYSYATLGEFIAWIIGWDLVLEYAVGAATVAISWSRYLIKLLEKLGVDHIPYQWMMSPFETHRVNGTELHGIVNIPAIFITCLMSLVLIRGMKESAKLNNVIVALKITVVIAFIILGWSYMDPINHADYVPDNTGVFEHFGWTGVMTGAAVVFFSFIGFDAVSTAAQEAKNPQRDMPIGILGSLVICTILYVLFSYVMTGLENYQNFKGEAAPVALAIAATPYAFFQELIIIAILAGYTSVIMVLLMGQSRVFFSMSKDGLVPAIFSEVHPKYQTPWKSNILFAILVSLFAGLVPVSVVGEMTSIGTLFAFVLVCIGVLVLRKKQPDAPRAFRTPWVPFVPIMGIVVCLYLMYALPIDTWIRLIVWMAIGIAIYFLYSRHHSKIRNSN

SEQ ID NO: 36832 - DNA, 1314 bp, Microbulbifer degradans 2-40
  CDS (1)..(1314)
atgcagcattcacattcaccacattatcaaaaaaatagtttaaccctggctggtgccgttgccatgggtaccggcgtaatgatcggcgcgggtatatttgctttaacaggtcaagttgcggagatggctagagagtggtttccactggcattcttacttgccgctgttatttcgggtttcagcgcctattcctatgtgaaaatgtcgagcgcgtacccgagtgcgggcgggattgccatgtttttggaaaaggcttatggaaaaggcacaacgacggctgtgtgcgccttgctcatgtacttttcaatggtaattaatgaaagtttggtcgcaagaaccttcgccacttataccttgcaaatattcgatgcaactgctgttgattggcttgtgcctgcgttgggttctgcattgctgctcttcgcatttatcgtcaatattctaggcaatcggtttattcaaacattctcgtttgtgatgggctttatcaaaattggtggtctggcgttgctcgctattggtgggctttgggtatcgggctttaatttcgaaagcatttcggttaagccagaggatacgaccatcagcgggtttttaggggcaattgccttgggtatcctggcatataaggggtttaccaccattaccaacagcggtggtgaaattaaagacccgcacaaaaatattgggcgagccataattctgtcgatctcaatttgtttggttgtgtatatgctggtcgccttcgcggtgggcggaaacctgagcatcaatgaaattgtacaggcgaaggattatgtattagccgaagcggcacgcccggcctttggccagtacggcgtgtggattactgtgggattcgccatagtcgcaacggtttccggtgtgattgccagtgtgttcgcagtctcgcgaatgcttgccatgctgaccgacatgaaacttgttccgcactcgcatttcggtatgcctggcagcatccagcaacacactctggtgtataccatcgtagtggcgatgtttttaacaatattttttgacttaagtcgaatcgcgtctctgggagctattttttatatcgttatggatatcgccatacattggggcgttttgaaaaatttgagaaaggacgttaaggcaagccccacgatacttaccttggcaattggattggatgtgttggtgctaattgcatttatttgggtaaaaattcagaccgacatgctggtgatttgggcatcactcattggatttataggtattttcctaggagagtattttttcctcaagcactatcgaacacaggataaataa

SEQ ID NO: 36833 - protein, 437 aa, Microbulbifer degradans 2-40
MQHSHSPHYQKNSLTLAGAVAMGTGVMIGAGIFALTGQVAEMAREWFPLAFLLAAVISGFSAYSYVKMSSAYPSAGGIAMFLEKAYGKGTTTAVCALLMYFSMVINESLVARTFATYTLQIFDATAVDWLVPALGSALLLFAFIVNILGNRFIQTFSFVMGFIKIGGLALLAIGGLWVSGFNFESISVKPEDTTISGFLGAIALGILAYKGFTTITNSGGEIKDPHKNIGRAIILSISICLVVYMLVAFAVGGNLSINEIVQAKDYVLAEAARPAFGQYGVWITVGFAIVATVSGVIASVFAVSRMLAMLTDMKLVPHSHFGMPGSIQQHTLVYTIVVAMFLTIFFDLSRIASLGAIFYIVMDIAIHWGVLKNLRKDVKASPTILTLAIGLDVLVLIAFIWVKIQTDMLVIWASLIGFIGIFLGEYFFLKHYRTQDK

SEQ ID NO: 36834 - DNA, 1359 bp, Oenococcus oeni PSU-1
  CDS (1)..(1359)
atgaaaaatagggatgtttcggtttcgagtgctcaggggatgcatttgtcgaagactttaaatattgttgaaacggtttcactggctgcttctgatatttctcctacttcgggtgtttttttaaatatgccggttgcgatcgcaatggtagggactggctcttttttggtttctttaatggccgggattattgcgatctgtgttgcgctcacgatggcggagattggttcggcttttcctaaatctggtggaatttactcggtaatccacagagttatggggaagaaagttggtttccttgcacttgtcgcttatttagtcgagggagtttttatccctgctgtgacatcgatgggttctgctacttatttagctgcagtatttccagcgttgaaagttaatctgcttgcgccggcgttgatgctgattgcaatgcttatttcaattgcaaatatttcttcgactggaaaatttacgacttttttgcttgctttggaattattagttgttctcacaattacaattgcttgtttgctaaatctaaagcagccggtttcggtacttttttcaacacaagttattcatggaaattctttttcaaatgtgtcttggccaaccattttttcgactatcgccgtaatgcttttttcatttaatggttttgattctgctttaaatttttctgaagaaatgtctgggaatcaaaaaagcatcggccgttcagtatttggtgcggcctcgatcggaattatagctcaattgattcctttagcagttatattgctggcagcaccgtctttaaaaggttttttgaaatcatcgaatccaattctttatgtgtctaatgatgttcttgggccgacaatgcatgatttcttaagtttgggaatatctttagcaatgtttgcctgcacgatttcagttttgttgcagttttcccgtgtcctttataccagtggaagggataatatgtggcctaaaacaattaatcattttcttcaaagcattcatccgaaattcaaaactccttggaaggcaaccctttttcttggcgtagttgatattttcttaaatttcgtttccaatcttggcgatctgatttcctttacatctgtcttggttgttttgctttatgcgttgattggaatttgcgatattattgctcgcggtaaaaaagtttctttcccatataaaaatacctttggtatcatggcaccaattattacgatcgttgcgtctgtatatgtcctttctagacaaacttttattaatttgttaatttctttggttatattggcggtttcttttatttatgtttccctatttaaaaaagccgatacaatagatttgaatttgtag

SEQ ID NO: 36835 - protein, 452 aa, Oenococcus oeni PSU-1
MKNRDVSVSSAQGMHLSKTLNIVETVSLAASDISPTSGVFLNMPVAIAMVGTGSFLVSLMAGIIAICVALTMAEIGSAFPKSGGIYSVIHRVMGKKVGFLALVAYLVEGVFIPAVTSMGSATYLAAVFPALKVNLLAPALMLIAMLISIANISSTGKFTTFLLALELLVVLTITIACLLNLKQPVSVLFSTQVIHGNSFSNVSWPTIFSTIAVMLFSFNGFDSALNFSEEMSGNQKSIGRSVFGAASIGIIAQLIPLAVILLAAPSLKGFLKSSNPILYVSNDVLGPTMHDFLSLGISLAMFACTISVLLQFSRVLYTSGRDNMWPKTINHFLQSIHPKFKTPWKATLFLGVVDIFLNFVSNLGDLISFTSVLVVLLYALIGICDIIARGKKVSFPYKNTFGIMAPIITIVASVYVLSRQTFINLLISLVILAVSFIYVSLFKKADTIDLNL

SEQ ID NO: 36836 - DNA, 1437 bp, Oenococcus oeni PSU-1
  CDS (1)..(1437)
atggatatctttagaaaaaaagacgtcggtgagattttaaaacattcgacgcctttaaaaaggactttgcgaacgtgggatttaactttccttggtatcggagcaattatcggtaccggaatcttcgttctaaccggaaagggagcgttaacagctggaccggcaatctcggtatcatttctggttgcggcaatctgctgtggctttgccggtctctgttacgctgaatttgcttcaatggcaccagtggccggttcggcttacacatactcttacatcgcttttggtgagattattgcttttattatcggttgggatttaattttggagtatacattaggagcggcaaccgtctctgtcggctggtcaggatatttcgccaatttgcttggcaatctgggaattcatattccgaccgttttaacggcagcagctggcacaaccgctggcgttacgagctattttaatttaccagcctttttaattgttttattgattacttggattatttcaattggtattacgcaaacaaaaagagcaaacgatacgatggttattgtcaagttagctgtcatcctactctttatcgtctgcacaatttggttcattaagccacataactggcagcctttttctccttatggtttgtattctttccataacggtacggcagccggaattattccagcggcttcaattgtatttttctcgtttatcggttttgattccgtttcttctagtgctgaagaaacaatcaatccaagcaagactcttcctcgtgggatcttgttgtccttatttatctcaacggttctatatatcattatgactttgattatgaccggtgttgtgaagttcactgtttttgcaaaatatttaaatgcaccggttttggcggttctgcattcaaccgggcagacttggttatcaatcattgtaagtatcggtgctattttgggtataacgaccgtcatcctggttcagctttatggacaatctagaattagttattcaatgtcgcgcgatggtttgtttccaaagttttttggagatgttaatatgaaataccaaactccctttaaaggtacttggttctttggtatcattacagcgattgccggtggtttgataaacttgaatattctagccgaactagttaatatcggaacattaactgcctttattctcgtttcagctggtgtcctttggatgcgtcattcccacccggaagttcatcgaggtttcaaggcaccaggggttccatttactccaatcatcgcaattattttctgtttggttttgattgcaggtttgaattgggaaacctggattagatttatcgtttggttcgctattggtatgattctttattttggatacgccaaaaagcattccaagttaaattcttttaaaccacaagataagggagctgattga

SEQ ID NO: 36837 - protein, 478 aa, Oenococcus oeni PSU-1
MDIFRKKDVGEILKHSTPLKRTLRTWDLTFLGIGAIIGTGIFVLTGKGALTAGPAISVSFLVAAICCGFAGLCYAEFASMAPVAGSAYTYSYIAFGEIIAFIIGWDLILEYTLGAATVSVGWSGYFANLLGNLGIHIPTVLTAAAGTTAGVTSYFNLPAFLIVLLITWIISIGITQTKRANDTMVIVKLAVILLFIVCTIWFIKPHNWQPFSPYGLYSFHNGTAAGIIPAASIVFFSFIGFDSVSSSAEETINPSKTLPRGILLSLFISTVLYIIMTLIMTGVVKFTVFAKYLNAPVLAVLHSTGQTWLSIIVSIGAILGITTVILVQLYGQSRISYSMSRDGLFPKFFGDVNMKYQTPFKGTWFFGIITAIAGGLINLNILAELVNIGTLTAFILVSAGVLWMRHSHPEVHRGFKAPGVPFTPIIAIIFCLVLIAGLNWETWIRFIVWFAIGMILYFGYAKKHSKLNSFKPQDKGAD

SEQ ID NO: 36838 - DNA, 1422 bp, Pediococcus pentosaceus ATCC 25745
  CDS (1)..(1422)
ttgcataatttcatcaaaaattttattaaaaaagaaaatcctgctatttatgaagataaagattctcatttgactcgtaccctagtagtcaaagactttttagctcttggggttgggacgatcgtttccacctccatcttcacacttcctggtgtggttgcagctcaacatgctggtccagccgtcgtactttcattcttagcagcagctgtagttgccggcctagtagcctttgcttatgccgaaatggcttccgctatgccatttgctggatctgcatactcttggattaacgtaatcttaggtaaagggtttggttgggtagccggctgggctttgttagcggaatatttcatcgccgtagccttcgtggcctccggactttcagctaactttaggggactgctttcctcaattggaatccaaattcccaaacagcttgcaaatcctctaggtactaatggtggaatcattgatattactgcgttgatcgtcgttattgcggtagcgttacttttagctcatggaactacaggagccgctcgcatcgaaaatgcactcgttgttttaaaggttgttgctattttagtatttattattgtgggactttcagctatccatattcaaaactacctaccatttatccctaaatatcataccaacccagacggaacttcctttggtggatggaaaggtatctattcgggaatttcaatgatttttctttcctatattggttttgattcaattgctgctaatgccggagaagctaaaaaccctgaaaaaactatgcctcgcggtattttaggatcgttaataattgctgttatcctttttattgcagtttcgctagtgctagttggaatgtttcattacacgaattacgctaataatgctgaacctgtcggttgggccttacgacacgctggtcacggagtaattgctggtgtgattcaagcaattgccgtaattgggatgtttacagcattaattggcatgatgatggctggttctcgtctgctatactcatttggacgtgatggtatgctacctaaatggttaggtcaagtaaatccaaaaggtcttcctaaccatgcattaagccttttaacaattatcggcattattattggttccatgtttccttttgctttcttagcgcaattaatctcagctgggaccttaatcgcctttatgtttgtatcgttagggatctatgtcctgcgacctcgtgaaggtaaagatattgctattccaagcttcaaaatgccgctctaccctgttcttcctgccttggctttcttaggctctctggcagttttctggggactagacgcccaagctaaattatactcactagtttggtttatcattggaattattgtttacactttctacggagcaagacatactacagattaa

SEQ ID NO: 36839 - protein, 473 aa, Pediococcus pentosaceus ATCC 25745
MHNFIKNFIKKENPAIYEDKDSHLTRTLVVKDFLALGVGTIVSTSIFTLPGVVAAQHAGPAVVLSFLAAAVVAGLVAFAYAEMASAMPFAGSAYSWINVILGKGFGWVAGWALLAEYFIAVAFVASGLSANFRGLLSSIGIQIPKQLANPLGTNGGIIDITALIVVIAVALLLAHGTTGAARIENALVVLKVVAILVFIIVGLSAIHIQNYLPFIPKYHTNPDGTSFGGWKGIYSGISMIFLSYIGFDSIAANAGEAKNPEKTMPRGILGSLIIAVILFIAVSLVLVGMFHYTNYANNAEPVGWALRHAGHGVIAGVIQAIAVIGMFTALIGMMMAGSRLLYSFGRDGMLPKWLGQVNPKGLPNHALSLLTIIGIIIGSMFPFAFLAQLISAGTLIAFMFVSLGIYVLRPREGKDIAIPSFKMPLYPVLPALAFLGSLAVFWGLDAQAKLYSLVWFIIGIIVYTFYGARHTTD

SEQ ID NO: 36840 - DNA, 1302 bp, Trichodesmium erythraeum IMS101
  CDS (1)..(1302)
atggcatctacacctcaacttcggcgagaaattggcgtgtttggcgctaccctcatgggtaatggttccattcttggtaccggagtatttgtcagtattggtattgctgctagcattgcaggtccgtcggtaattattgcagtagcggtagctggtgttgttgctacctgcaatgcttttaatagtgcccagttagcggcaaaccatcccgtgagtgggggtacttatgaatatggttacaaatatctaaataattggttgggttttattgccggatggatgtttctattcgctaaaagtgcttctgctgctactgctgctttaggttttgctggttatttccttaatgcttttggtgtgaataataacacttggttagtattgactgctttaactgcggtggttgtattaactatagttgtgttaagcggaattcgtcgttctaatgttactaatattattattgtttctattaccttattttctctagttctgtttattctggcaggggtacctcaagtggtcttctctgaagggaagaatttaatgcctttctttccaggggataaacctatagcatctttactgcaagccactgctttaatgtttgtcgcttatactggttatggtcgtattgccactttgggcgaggaagtaaaggaaccacgacgtactattcctagagcgatcgctctaactatgatttttacctgtgtattatacatatctaccgctatagttagtgtatttgcgggtcaagaagtaattcaaaaattatctcaggcagatgtaagtctagttgcacctttagaagttattgctaaagtgggaggtttgggtattcctgttattcctaagttaattgctattggtgctattacggcaatgttgggagtactgctaaatctgattttggggttgtcgcgggttttgttagcaatggggaggcgacgagatgtacctaaagttgttgctaggttggatagtgggcaaactacaccttatatagctgtagtaatagtaggagtagcgatcgcttgtttagttttaattggagatgtgaaaactacttggtcttttagtgcttttaatgtattaatttattatgctattactaattttgctgccctccacctttctccagaagaaagactttatcctaaatggttaggttggctaggtttagcttcttgtttatttttagctttttgggtagaaaagcaaatttggttagtaggtttaggattaattcttattggtttaatttggcatagtttgattcatagatttataactgattag

SEQ ID NO: 36841 - protein, 433 aa, Trichodesmium erythraeum IMS101
MASTPQLRREIGVFGATLMGNGSILGTGVFVSIGIAASIAGPSVIIAVAVAGVVATCNAFNSAQLAANHPVSGGTYEYGYKYLNNWLGFIAGWMFLFAKSASAATAALGFAGYFLNAFGVNNNTWLVLTALTAVVVLTIVVLSGIRRSNVTNIIIVSITLFSLVLFILAGVPQVVFSEGKNLMPFFPGDKPIASLLQATALMFVAYTGYGRIATLGEEVKEPRRTIPRAIALTMIFTCVLYISTAIVSVFAGQEVIQKLSQADVSLVAPLEVIAKVGGLGIPVIPKLIAIGAITAMLGVLLNLILGLSRVLLAMGRRRDVPKVVARLDSGQTTPYIAVVIVGVAIACLVLIGDVKTTWSFSAFNVLIYYAITNFAALHLSPEERLYPKWLGWLGLASCLFLAFWVEKQIWLVGLGLILIGLIWHSLIHRFITD

SEQ ID NO: 36842 - DNA, 1566 bp, Moorella thermoacetica ATCC 39073
  CDS (1)..(1566)
atggccacggcaacagaaaaattggagctccgccgggaggttaccgtgtggggctcctacatgtggggttacgcggatgtcggtgccgacatttatgccgccctgggactggttatgctctgggctaaaggtgctaccagcctggccttcgccttggccggtctggtttacatcatgatcggcctggcttataccgagcttgccgccgcttaccccgttgccggcggtggccagttttttaccttgcgcgggctgggtgatttctggggttttgtagccggggcagctttgctcttggactacaccatagatatcgccctttttgcgactgcttccgctggctacatcaacttctttctgccttaccttttcggggtcaatattgactctctggccgtcagcatcggtcccctgcaccacgtcaacctggtgtggatggcagaggccctggccctggtgttcttccttattgccctcaatattcgcggtatgagggaatcttctttgctcaatgaagtcctgggtgctattgatatcttgacggaatcaaccattatcgtctttgggtttctctttgcctggcggccggaactcctggcccatcagtgggtgactcagttcccgacttttaaggaatttgcctatggctcctccctggctattatctcctttgtcggcctggagtctatctcccaggcggcccaggaaaccaaacggccggcgactgtcgttccccgaacttctgtcggcctgatctttactgtattcattttcgccaccgccttttctaccatgagcctgggagtcctaccctggcaggatatcgctaaagccgtcggcgatccggtggctaccctggcccatgccatcccctttattggcattattgccggcccttttgccgccctgctgggggctaccatcctgctcatttcggccaactccggggtcatgagcgcttcccggttgacctttgccatgagccagtttaattttatcagcgactggttcaacgccgtgcaccctcgttaccggactccttaccgcactatccttgtcttctcgggcattggtatccttcagttagttctttctttcctgacgcccaatgctatggataccctgggtaacatgtatgccttcggggctaccacaggctatatcctggtttttattgccctgattaaactacgcttcaccgatccctatgcaccccggccctataaagtgcctttaaacataaagataaattatcgtggccgggtggtggagttccccatcctgggggtaatcggtaccctgggtatcagcactatactcttcgaagtcattcttacccatgccattggccgtatcgccgggccggcgtggattatcctctgtttcctctactacgcttattatcgccggagcaagggctaccccattttcggcaacatcccccgggactgggaagcccagcaaataaaggtcctggaagcggccgaagagtacgaccttctcgaggaatacaagcaggctcttgcagaacgggaacgcctggaggctaaggcccatgtcaagtga

SEQ ID NO: 36843 - protein, 521 aa, Moorella thermoacetica ATCC 39073
MATATEKLELRREVTVWGSYMWGYADVGADIYAALGLVMLWAKGATSLAFALAGLVYIMIGLAYTELAAAYPVAGGGQFFTLRGLGDFWGFVAGAALLLDYTIDIALFATASAGYINFFLPYLFGVNIDSLAVSIGPLHHVNLVWMAEALALVFFLIALNIRGMRESSLLNEVLGAIDILTESTIIVFGFLFAWRPELLAHQWVTQFPTFKEFAYGSSLAIISFVGLESISQAAQETKRPATVVPRTSVGLIFTVFIFATAFSTMSLGVLPWQDIAKAVGDPVATLAHAIPFIGIIAGPFAALLGATILLISANSGVMSASRLTFAMSQFNFISDWFNAVHPRYRTPYRTILVFSGIGILQLVLSFLTPNAMDTLGNMYAFGATTGYILVFIALIKLRFTDPYAPRPYKVPLNIKINYRGRVVEFPILGVIGTLGISTILFEVILTHAIGRIAGPAWIILCFLYYAYYRRSKGYPIFGNIPRDWEAQQIKVLEAAEEYDLLEEYKQALAERERLEAKAHVK

SEQ ID NO: 36844 - DNA, 1521 bp, Moorella thermoacetica ATCC 39073
  CDS (1)..(1521)
atgggcatctggcgaaccaaaaaaatagctgacctgatgcaggaagctggagacaatcaaaagctcaagcggagcattggcacgccggaactagtcgccctgggtgtaggggcaattatcggctccgggatttttgtcctgacgggagtggctgccgccaactacgccggcccggccctggttttctcctttatcctctccggcctggcggcaggcctggcggccctcgtttacgctgaaatggccgccatgatcccggtgaccggcagcgcctatacctatgcttacgcttccctgggcgagattatcgcctggctcgtgggctggaacctggtactggaatacctggtggcctcgggggccgtggctgtaggctggagcggttacatcaccgatatgctggcgtctgtgggggtctttctgccccgggccctggtcaattctcccttaagcggcggcctggttaacctgccggctatcttgatcaccgtcgttatgaccggagtggccattgtcggcaccaccaccagtgcccggactaataagattatcgtcggggtaaaaatcctggtgatcctggccttcctggccttaggcgccccgcgggtaaacccggcctactggcaccccttcctccccttcggcgtcaccggtgtcgtccacggggcggctattatctttttcgcctacatcggcttcgatgccgtggctactgccgccgaggaggtgcgcgacccggcacgggaattacccctgggaatcatcggctccctggccctcgccactatattatatgtggccgttaccattgttctgactggtttgacgccctacaccaacttgaacaccccttccccggtgaccaccggcctgctggctgccggcgtccgtggagcttcccttattgtgggcaccggcgccctggccggtttgacaagcgtcctgctggtaaacatctttgcccagagccgggtctttatggccatgggccgcgacggcctgctgccccctctctttaccagggtccaccctcgcttccataccccctggctgacaacattaatcgtcggcgcctttatcaccctcatcggcggcttcctgccggtggatatcattgccgagctggccaatgtaggtaccttgtctgccttttttgtggtttccgtgggcgtcatggtcctgaggcgcacccagccggacctgaaacggcccttcaaagtgcccctgatgccctggacgcccctcctggccatagcatttgccgtttaccttttcttcaacctgccaggtctaacctggattcgtttcggcgtctgggtaaccctgggactggtggtttatttcgcctacggccgtcgccatagcgtcctggcccgggaggaggaatctaaagccgtcccccggccgacctaccggccctcacccctggagatgcccgcaccggctcgaaagcctttccccttcaagctaccggccccggacctcttgcgtatgttccttccccggtggcggcgggattaa

SEQ ID NO: 36845 - protein, 506 aa, Moorella thermoacetica ATCC 39073
MGIWRTKKIADLMQEAGDNQKLKRSIGTPELVALGVGAIIGSGIFVLTGVAAANYAGPALVFSFILSGLAAGLAALVYAEMAAMIPVTGSAYTYAYASLGEIIAWLVGWNLVLEYLVASGAVAVGWSGYITDMLASVGVFLPRALVNSPLSGGLVNLPAILITVVMTGVAIVGTTTSARTNKIIVGVKILVILAFLALGAPRVNPAYWHPFLPFGVTGVVHGAAIIFFAYIGFDAVATAAEEVRDPARELPLGIIGSLALATILYVAVTIVLTGLTPYTNLNTPSPVTTGLLAAGVRGASLIVGTGALAGLTSVLLVNIFAQSRVFMAMGRDGLLPPLFTRVHPRFHTPWLTTLIVGAFITLIGGFLPVDIIAELANVGTLSAFFVVSVGVMVLRRTQPDLKRPFKVPLMPWTPLLAIAFAVYLFFNLPGLTWIRFGVWVTLGLVVYFAYGRRHSVLAREEESKAVPRPTYRPSPLEMPAPARKPFPFKLPAPDLLRMFLPRWRRD

SEQ ID NO: 36846 - DNA, 1401 bp, Moorella thermoacetica ATCC 39073
  CDS (1)..(1401)
atggccagcagtatcttgcgcaaaaaagatatcgctacagccatggaaatggctgccatggaccaatatcggcttcgccgggagttgaaggccatggatctcttttttctggtaataggtattaccataggtggggggatattcgtcctgccgggggtcatggcggcggaacacgcaggtcccggggttactatttcttttttaatcggcgcggtggtagccatctttaccggcctgtgttatgttgagtttgcttctatggtcccggtggcgggaagcgcttatacttattcttatattgccctgggagagatatttgcctggatcatcggttgggatgtcctcctggagttcaccctggtctgcagcgccgtggctgtgggctggtccggctatatcgttgagttgttaaaggatatgggcctgagtctgcccccggcctttactaccgatatagcccacggcggtatagtcaacctgccggcggttttcatcctcctggtggtggcttatattatttacggcggtatcagcctgacaggtaaggtcaacgatgccattgggattataaagctcctcaccgtggtgttttttattatcgtggccctcccctttgttaaaccggtaaactggcaaccctttttgcccttcggctggcaaggggttatgactgctgccgccctgggcttctttgcttacggtggtttcgacgccgtcacaactgccgccgaggagacccggaaccccaaccgcgatatacccttaggcctgatcctgggactggtggtagtggcttctctttatgttcttgtctccctggtgctgacgggggttattccttacaccaaactcgataccccggcacctgtggcttttgccctctcctacctgggcaaacgctggggcgggagtctggtagccgccggggccatctgcggcctttttacagttatgatgggggctatgctgggtgggagccgcatcctgttcgccctcagccgcgacggtctattgccgccggttttttcccgggtacacgcaaccaggcgtactccctacgttgccacattgatcgtcctgacagtggccgtcctgacaggcggtttcctctccctgggagaattggtggaactggtgaatatcggcatgctcaccgcctacctcctgacctctatttccatcctggtcatgcgcttgagatacccggaaattgaacgacccttcagggttcccgccgtatggttggtggcgccggtagccaccctgggagtcgtggccctgaccttcagcttgccaggagcgacgttggttagatttgccatctggtttatagtcgggatgcttatctactttggctatggtatcaggcactcgaagctggctaaccgggaaaataattaa

SEQ ID NO: 36847 - protein, 466 aa, Moorella thermoacetica ATCC 39073
MASSILRKKDIATAMEMAAMDQYRLRRELKAMDLFFLVIGITIGGGIFVLPGVMAAEHAGPGVTISFLIGAVVAIFTGLCYVEFASMVPVAGSAYTYSYIALGEIFAWIIGWDVLLEFTLVCSAVAVGWSGYIVELLKDMGLSLPPAFTTDIAHGGIVNLPAVFILLVVAYIIYGGISLTGKVNDAIGIIKLLTVVFFIIVALPFVKPVNWQPFLPFGWQGVMTAAALGFFAYGGFDAVTTAAEETRNPNRDIPLGLILGLVVVASLYVLVSLVLTGVIPYTKLDTPAPVAFALSYLGKRWGGSLVAAGAICGLFTVMMGAMLGGSRILFALSRDGLLPPVFSRVHATRRTPYVATLIVLTVAVLTGGFLSLGELVELVNIGMLTAYLLTSISILVMRLRYPEIERPFRVPAVWLVAPVATLGVVALTFSLPGATLVRFAIWFIVGMLIYFGYGIRHSKLANRENN

SEQ ID NO: 36848 - DNA, 1392 bp, Rickettsia akari str. Hartford
  CDS (1)..(1392)
atgagttttttaaggaagaaaagttttgaatcagtaaaagagataggtagctcaagcggtcttagtaagacgcttggagcattagatttaatattactaggtcttggtgcaatgattggtactggcgtatttgtcgttaccggtataattgcagctaaatattcaggacctgcggtaatgttatcttatgcgattgcaggtattacctgtatctttgtagcacttgtttatactgaacttgctgcaatgcttccaacttcaggaagtatctatacttattcctatgtagcattcggcgaagtatttgcttggatgattggtagtgttataatattggagctaggtgttgctgcaggaatagtagctgcaggctggtctggctacgtacaaggaatattagcagcaggcggaatcaatttaccgaaagaattaacgaccgtaccgacaaacggcggtataataaatttaccggcatttttaatctcggtatttattggatttattttatatttagggactaaagatagtaagcgactgaatgcaattttagttttcataaaaatggttgcaatatttgtatttatactcgctgctgctcctcatttcgatgttactaactggagtaactttatgcctttcggctttagtaatgttctagtgggtgcatctattttatttttagcttttacgggatttggaacgattgcaactgcagctgaggaatgtaaaaatccaaaacgtgatataatgatcggtattatcggctcgcttgttctaactactatagtttatgtaacaatggcagggcttgttaccggtattgcacattttgatcaattaaataacgaccaaccgcttgcttatgctttaactatcaataatagcaagattggctctgctatcgtggcaaccggtgcggtttgcggtatgatgacggtgttgatgatgaatatttacggtacttctcgtattttttatgctattgcacgtgacggtttactaccgaaaagttttgcaaagctgcacccaaaatatgacagtccgtatattacaattataatatttgcttctttatccgctatccttggaggattttgttctacggaattattaacgcaattcacttcaatgggagcattaattgattatataacagttacaataatagtagtattatttagagtaaagctacctgacgctcaaagaccttttaaatgtcctttagtatttattattgtaccgtttattttaattgcttgtgcatatttactatttattcaaatatatgacggtgaatttaatatattaatggcaggtcgtgcattaatatattggtttattacgatatttattttatatattataagatcgttttttatgacgaaggaatga

SEQ ID NO: 36849 - protein, 463 aa, Rickettsia akari str. Hartford
MSFLRKKSFESVKEIGSSSGLSKTLGALDLILLGLGAMIGTGVFVVTGIIAAKYSGPAVMLSYAIAGITCIFVALVYTELAAMLPTSGSIYTYSYVAFGEVFAWMIGSVIILELGVAAGIVAAGWSGYVQGILAAGGINLPKELTTVPTNGGIINLPAFLISVFIGFILYLGTKDSKRLNAILVFIKMVAIFVFILAAAPHFDVTNWSNFMPFGFSNVLVGASILFLAFTGFGTIATAAEECKNPKRDIMIGIIGSLVLTTIVYVTMAGLVTGIAHFDQLNNDQPLAYALTINNSKIGSAIVATGAVCGMMTVLMMNIYGTSRIFYAIARDGLLPKSFAKLHPKYDSPYITIIIFASLSAILGGFCSTELLTQFTSMGALIDYITVTIIVVLFRVKLPDAQRPFKCPLVFIIVPFILIACAYLLFIQIYDGEFNILMAGRALIYWFITIFILYIIRSFFMTKE

SEQ ID NO: 36850 - DNA, 1290 bp, Rickettsia akari str. Hartford
  CDS (1)..(1290)
atgtcgcaaaaattaggtttctgggcggtttttgccttagtaaccggcagtcaaatcggtactagcgtttttatattaccgctaagtttagcaccgttcggtatatatagcgtttggggctgggtactttcattattcggtgctatgagtatagccctggtattctcattcttatgtgcacaatttcctaaaacaggcggtcctcatgtttatgtacgagagagttttggggatacaatagctttcttcaccggtttcacttactgggttatatcctttgtcagtacaagtatagtggtcatttcggcgataggttatctaacgcctttttttcaatcacaaacgattttggatttaatattacagataatattattaactgctattgcaattttaaatttaaaaggtcctgaagtagcaggaaaagcagagttttatttgactctcttaaaatttgttccgctgcttgtagtaggtttagctgcattatctcattttaatatagataatatagttattgctaaggaagtagagaatttaagtattccgactattattggaagagttgcactgcttactttttggggatttattggggtagagtgtgcaactactacggcaggagcagtaaaagatccggcaacaactattccaaaagccataatagttggcactttttgcgtatcggggttatatattattaatagtataggtataatgggattaatccctgcttctgaacttattaattctaaagctccttatgccgatgccgctgcattattgttcggtggtaaatggtcaagcgtaattgcagttatagcctcgattatatgtataggtacgctcaacgcttgggttctgactagcggacagattgctctaggacttgcagaagacgggttattgccaaaattttttgctaagaaaaatagcaataacgccccaacttacggaattattctaagttgccttggcattgtgccattattagcctttacgtcaaatgataattttgccgagcagattacgcaaataatagatttttcggtaatagcatttttgtttgtttatttaatttgtagcttagcttccttcaaggtaattcgtagttcaaaggaaaaattttcttcttattatttacttatagccctaatatcgattatcttttgtgcatgggttatctatgcaacacctgttaaaactctaattatagcttgttcattcactatatcaggtattcctttatattatgggtggtatagagggaggaatagaactaaattgtag

SEQ ID NO: 36851 - protein, 429 aa, Rickettsia akari str. Hartford
MSQKLGFWAVFALVTGSQIGTSVFILPLSLAPFGIYSVWGWVLSLFGAMSIALVFSFLCAQFPKTGGPHVYVRESFGDTIAFFTGFTYWVISFVSTSIVVISAIGYLTPFFQSQTILDLILQIILLTAIAILNLKGPEVAGKAEFYLTLLKFVPLLVVGLAALSHFNIDNIVIAKEVENLSIPTIIGRVALLTFWGFIGVECATTTAGAVKDPATTIPKAIIVGTFCVSGLYIINSIGIMGLIPASELINSKAPYADAAALLFGGKWSSVIAVIASIICIGTLNAWVLTSGQIALGLAEDGLLPKFFAKKNSNNAPTYGIILSCLGIVPLLAFTSNDNFAEQITQIIDFSVIAFLFVYLICSLASFKVIRSSKEKFSSYYLLIALISIIFCAWVIYATPVKTLIIACSFTISGIPLYYGWYRGRNRTKL

SEQ ID NO: 36852 - DNA, 1356 bp, Pseudomonas aeruginosa UCBPP-PA14
  CDS (1)..(1356)
atggcggggggagagaaggccggcaagcgcggcatggggttctggacctgcagcgcgctggtgatcggcaacatggtcggttcgggagtcttcctgcttccctccagcctggcggcgttcggcgggctcagcctgttcggctggctggtgtcgagcaccggcgcggtgctgctggcgctgaccttcgcccgcctggcgcgggtcaaccccggcgccggcggcccctacgcctatacccgcgacggtttcggcagcttcgccggctacctgtgcgcctggacctactggaaagccgcctggatcggcaacgcggcgatcgccgtgaccctggtcggctacctgcgggtgttcatcccggcgctggcggatccgctgctgatggtctgcgtggccatcgccgcgatctggctgtgcaccctgatcaacctgcgaggcatcggcaccttcagcgtggtgcagaacctgctgaccatcctcaagctgctgccgttgttgctggtcggtatcctcggctggttccacttcaatcccgagcacctggcgatcccggcgcgcagcgagctgccgaacatgggctatgcccaggcgatcgccaccaccgcggcgctgaccctttggtcgttcatcggcctggagtcggccaccgtgccggccgacgacgtcgaggacccgcgccgcaccattccccgcgcgaccctgttcggcacgctggccgcggcggccctctacatcctctctatcactgcggtgcagggcctgatgccgccggaggtgctggcccgctccacctcgccgttcgccgacgcggcgcggatcctgatgggcgactggggctactacctggtggctgccggggcggtgatcgcctgcctgggcgcgctcaatggctgggtcctgttgcagggccagatcccggtggctccggcgcgcgacgggctgttcccggagtcgctcggccagctcaacaagaacggcgcgccggcccacggcctgctggcctcggggctgctggtgacggcgctggtgatggtcgacgggcatggcgacctggtcgatgtgttcaacgtgatcatcctgctcggcaccatgaccggggtggtcccctacgcgttctgcaccgccgcgctgttgcagctgctggcggtgcgaccggacgagttctcgccgcgttcacgccggcaattgctggtgatcggctcgctgggcttcgcctactcgctatgggcgctgtatggcaccggccagcaggcgatcttctggggcttcctggtgctgatggccggtatcccgatgtacacctggcggcaatggcgcaaccaggtcaacggagtgccgacgctcaaagccaatgactga

SEQ ID NO: 36853 - protein, 451 aa, Pseudomonas aeruginosa UCBPP-PA14
MAGGEKAGKRGMGFWTCSALVIGNMVGSGVFLLPSSLAAFGGLSLFGWLVSSTGAVLLALTFARLARVNPGAGGPYAYTRDGFGSFAGYLCAWTYWKAAWIGNAAIAVTLVGYLRVFIPALADPLLMVCVAIAAIWLCTLINLRGIGTFSVVQNLLTILKLLPLLLVGILGWFHFNPEHLAIPARSELPNMGYAQAIATTAALTLWSFIGLESATVPADDVEDPRRTIPRATLFGTLAAAALYILSITAVQGLMPPEVLARSTSPFADAARILMGDWGYYLVAAGAVIACLGALNGWVLLQGQIPVAPARDGLFPESLGQLNKNGAPAHGLLASGLLVTALVMVDGHGDLVDVFNVIILLGTMTGVVPYAFCTAALLQLLAVRPDEFSPRSRRQLLVIGSLGFAYSLWALYGTGQQAIFWGFLVLMAGIPMYTWRQWRNQVNGVPTLKAND

SEQ ID NO: 36854 - DNA, 1389 bp, Bacillus subtilis
  CDS (1)..(1389)
ttgatgagttcattatttagaaaaaaaccgcttgaaacattgagtgcgcagagcaagtcaaaaagccttgcccgtacgttaagcgcatttgatttaaccttgctcggtatcggttgtgtcatcggtacagggatttttgtcattacaggaacagtggcagcgaccggtgcaggtcccgccctcatcatatcgtttattttagcggggctcgcctgtgcgctggctgctttctgttatgctgagttttcgtcttccattccgatttcgggaagcgtgtactcatactcatacgtgacacttggagagctgctcgcctttttgatcggatgggatctcatgcttgaatatgtcattgcactgtcggcggttgccaccggctggtcttcatactttcaatcactgcttgccggcttcaatcttcatattccggctgcactgacaggagcgccgggaagcatggcgggcgccgtatttaaccttccggctgcggtgatcattctcctcatcactgcgattgtcagcagaggcgtcaaggaaagcacacgctttaacaacgtcatcgtactgatgaaaatcgcgatcatattattgttcattattgtcggcatcggctatgtgaaaccggataactggtctccttttatgccattcgggatgaaaggcgtcatacttagcgctgccactgtattcttcgcgtaccttgggtttgacgcggtttctaacgcatcagaggaagtgaaaaatccgcaaaaaaacatgcccgtcggcattatttcagctctagccgtctgtacggttctgtacatcgcggtatcgcttgtgctgacaggcatgatgccttatgccaaattgaatgtcggagatcctgtatcctttgcgctgaaattcgtcggacaggacgctgttgccggaattatttctgtcggtgcgattatcgggattacgacggtgatgctcgctttgctgtacgcacaggtccgcttgacatttgccatgagcagagacggccttctgcctggattgttcgcaaaggttcatccgtcatttaaaaccccgttccgcaacacatggctgacagggatcgttgcagcgggaatcgccggctttattaacctcggaacgctggcccatctggtgaacatgggaacacttgccgcgtttacggtcatttccattgctgtcattgtgttaagaaagaaacatcctgaaatcaaagcgtccttcagagtgccattcgttccggttgtgccgattatcagcgcaggcatctgcctttggttcatgtacagccttcccggcgtcacatggctttcatttgtcatctggatcgctgtcggaacgctggtttacttcctatattcgagaaaacacagcttattaaacaaataa

SEQ ID NO: 36855 - protein, 462 aa, Bacillus subtilis
MMSSLFRKKPLETLSAQSKSKSLARTLSAFDLTLLGIGCVIGTGIFVITGTVAATGAGPALIISFILAGLACALAAFCYAEFSSSIPISGSVYSYSYVTLGELLAFLIGWDLMLEYVIALSAVATGWSSYFQSLLAGFNLHIPAALTGAPGSMAGAVFNLPAAVIILLITAIVSRGVKESTRFNNVIVLMKIAIILLFIIVGIGYVKPDNWSPFMPFGMKGVILSAATVFFAYLGFDAVSNASEEVKNPQKNMPVGIISALAVCTVLYIAVSLVLTGMMPYAKLNVGDPVSFALKFVGQDAVAGIISVGAIIGITTVMLALLYAQVRLTFAMSRDGLLPGLFAKVHPSFKTPFRNTWLTGIVAAGIAGFINLGTLAHLVNMGTLAAFTVISIAVIVLRKKHPEIKASFRVPFVPVVPIISAGICLWFMYSLPGVTWLSFVIWIAVGTLVYFLYSRKHSLLNK

SEQ ID NO: 36856 - DNA, 1512 bp, Schistosoma mansoni
  CDS (1)..(1512)
atggggaaatctaagaaagaaaacaaagatagcaacgctactgaatcagttgcactgaaaaaggaggtttcagtcctacagggtgtgagtattgttgtcggtgttatcattggttctggtatatttgtttcacctgttggagtcttgaaacatactaaatccgtcggattatcatttattatgtgggccgtcactggattattcagtacattgggtgccatcgtgtatgccgaactaggtgtcactattcctcgatctggtggagaatatgtttacattctccaaacgtttggacctttacttgcctttctagccttttggattacattcgtcgtaatcggatctgcaagttgtgcggcaaatgcacttattttcgcccaatatattcttcgacccgtctacatggactgtgttactcctactatcgtgatacgcaccgttgcagtgctaggactgcttcttctttgcttcgtgcactgttttagcgttaaactggcaacgaaagtcgcggtcgtcttcactgcttgtaaagttacagctttacttattataattggtttcggcctctactatctgggaaaaggtaatgttgagagtttcaaaaatgccttcgaagatagcgaaaaatcacccggtgaacttgcattggggttttaccaagggttttgggctttctctggttggaattacctcaactttttgactggagaagtaaagaatccaggaaggacactaccgatcgtaattatactctccctcacaacagtaacgttcatctatattttgaccaatgtggcctaccttgcagtcttatcaccattagaagtccttgcctcagaaggttctactgcaatagctgtgagttttgcatcacgaactatgggggtggtgggtttggtaatgccagctcttgtaggtgcttcagtctttggcagcataaatggtgaggtattctctatttcccgactagcatttactgctggtgaagaaggacatatgcccgcgcttctttcaatggttaatattgaccgtttaactcctattccatctatattaattgtagtgactctatctgtaatttttcaaatgttcgatgatatactttatttgatcgagttaacgggattcgctttctctgtaatgtctgcaatggctgtttgcagcttactctacattcgtcgtacaaatcctgaaatgaatacatcgggatttaaattacctattttttttcctgtgttgtacttaattgtggacattgctattggaattcttgcaatttatcaaaagcctacagattgtgcagttagtcttggagtaatgttgctaggtgttccagtttacctttttggggtagtatggaagaacaaaccaagatcaatgagatctttaatatatggtgtcacaatcactttacaaaaagttttaaaagttgttgaacaagaaaaagtctctgatataatagaattagatggtcatttaaaacctgttgatagtcaactggatatatcataa

SEQ ID NO: 36857 - protein, 503 aa, Schistosoma mansoni
MGKSKKENKDSNATESVALKKEVSVLQGVSIVVGVIIGSGIFVSPVGVLKHTKSVGLSFIMWAVTGLFSTLGAIVYAELGVTIPRSGGEYVYILQTFGPLLAFLAFWITFVVIGSASCAANALIFAQYILRPVYMDCVTPTIVIRTVAVLGLLLLCFVHCFSVKLATKVAVVFTACKVTALLIIIGFGLYYLGKGNVESFKNAFEDSEKSPGELALGFYQGFWAFSGWNYLNFLTGEVKNPGRTLPIVIILSLTTVTFIYILTNVAYLAVLSPLEVLASEGSTAIAVSFASRTMGVVGLVMPALVGASVFGSINGEVFSISRLAFTAGEEGHMPALLSMVNIDRLTPIPSILIVVTLSVIFQMFDDILYLIELTGFAFSVMSAMAVCSLLYIRRTNPEMNTSGFKLPIFFPVLYLIVDIAIGILAIYQKPTDCAVSLGVMLLGVPVYLFGVVWKNKPRSMRSLIYGVTITLQKVLKVVEQEKVSDIIELDGHLKPVDSQLDIS

SEQ ID NO: 36858 - DNA, 1281 bp, Aeromonas salmonicida
  CDS (1)..(1281)
atgtctgctttgaaaaaggatctcgggctctggcagagaatgggactgctcacaacctcactgctgggtaccggtatcttcgtggtgccggcgacggcggcgtcgctggcgggtggggcctcgctctgggcctgggtgttgctcatcgtgctggtgctgcccatcgccttcaccttcgcccggctggggcgccgttatccccatgcgggcggagcgccgcacttgattggtcttgcctttggcaacggcgccgagcgcttctccgccttcctgtttctgactgtgctgccggtggggttgcctgcggcccttactatcgccgccggtttctggcatgcgctgtttgatctgggggagtggaccctgtgggccatccagctgctgaccctgctcggggtattcctgctggggttgcggggggcgcgctcctccggcaacctgcaactgctgattgccttggccatattggggctgaccctgctcatctggttcaagggggatctcagctggcgcgacgctgcccagccactgccgacggcagctgagtggcccgccatgggcacggcgctggcggtgatgttctggtgcttcgtggggctcgaagctttcgcccacatgggggaggagttcaagcgacctgagcgggactacccgctggccctgctcggcggtgtcttgctggcggggctcatttattgggtccactcgctggtggtgctcaaatatgggctctatggcgacgaggcaaaaaacgccaccgccattccggccctgctctcgctgctgttcggccctaccgccaagtggctggtggcaatcctgggttatctctcctgttttggcagcatcaacatctatctgcaggggtttgcgcgccttatctggagcatggcgcgggagggcaagctgcccacctcgctggctcgtctctcggcccggggggcgccgctcaatgctctgtgctgggtgctcgccatctgccttgtctccatcaccttgatcctctggctgcggctgccactggatgagcttatccgctacgccaacggcaacttcgtgctggtctacctgctctgcatggcggcaggctggcgcctgctcggcggcatgggcaaggggctggcgggattgagtgtcttgctctgcctcgccgtgctggtggcgctcgcctcccaggtgttttatgccgtattgctgagtgcaggttacggcctcttctccctgtggcgccgctatctgcgccgcacccgggccacggagaatatctgcgccatcaagtaa

SEQ ID NO: 36859 - protein, 426 aa, Aeromonas salmonicida
MSALKKDLGLWQRMGLLTTSLLGTGIFVVPATAASLAGGASLWAWVLLIVLVLPIAFTFARLGRRYPHAGGAPHLIGLAFGNGAERFSAFLFLTVLPVGLPAALTIAAGFWHALFDLGEWTLWAIQLLTLLGVFLLGLRGARSSGNLQLLIALAILGLTLLIWFKGDLSWRDAAQPLPTAAEWPAMGTALAVMFWCFVGLEAFAHMGEEFKRPERDYPLALLGGVLLAGLIYWVHSLVVLKYGLYGDEAKNATAIPALLSLLFGPTAKWLVAILGYLSCFGSINIYLQGFARLIWSMAREGKLPTSLARLSARGAPLNALCWVLAICLVSITLILWLRLPLDELIRYANGNFVLVYLLCMAAGWRLLGGMGKGLAGLSVLLCLAVLVALASQVFYAVLLSAGYGLFSLWRRYLRRTRATENICAIK

SEQ ID NO: 36860 - DNA, 1608 bp, Pongo pygmaeus
  CDS (1)..(1608)
atggaagaaggagccaggcaccgaaacaacaccgaaaagaaacacccaggtgggggcgagtcggacgccagccccgaggctggttccggggggggcggagtagccctgaagaaagagatcggattggtcagtgcctgtggtatcatcgtagggaacatcatcggctctggaatctttgtctcgccaaagggagtgctggagaatgccggttctgtgggccttgctctcatcgtctggatcgtgacaggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactatgtgctgcagccactcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaacgcatttgaaaatttccaggaacctgacatcggcctcgtcgcactggctttccttcagggctcctttgcctatggaggctggaactttctgaattacgtgactgaggaacttgttgatccctacaagaaccttcccagagccaccttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacgtttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgccggaagaagcctgatatcccccgccccatcaagatcaacctgctgttccccatcatctacttgctgttctgggccttcctgctggtcttcagcctgtggtcagagccggtggtatgtggcattggcctggccatcatgctgacaggagtgcccgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatagaggagcagcagcagcccatgtaccaacccactcccaccaaggacaaggacgtggcggggcagccccagccctga

SEQ ID NO: 36861 - protein, 535 aa, Pongo pygmaeus
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRATFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRRKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDIEEQQQPMYQPTPTKDKDVAGQPQP

SEQ ID NO: 36862 - DNA, 1608 bp, Pongo pygmaeus
  CDS (1)..(1608)
atgggagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgccggttctgtgggccttgctctcatcgtctggatcgtgacaggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactatgtgctgcagccactcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaacgcatttgaaaatttccaggaacctgacatcggcctcgtcgcactggctttccttcagggctcctttgcctatggaggctggaactttctgaattacgtgactgaggaacttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacgtttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccagtggtatgtggcattggcctggccatcatgctgacaggagtgcccgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccaccaaggacaaggacgtggcggggcagccccagccctga

SEQ ID NO: 36863 - protein, 535 aa, Pongo pygmaeus
MGEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 36864 - DNA, 1455 bp, Xenopus tropicalis
  CDS (1)..(1455)
atggagaataagaaagaaacggacagccagcccttgagtgatggaacttctaggaaagagtcagaaaatgtatgtttaaagcgcgagttggggctgcccagtgctgtgtcactgatcgctggcaccatgattggctcaggaatcttcatgtctccccagtgggtcctttaccatatgggaagcccaggggccagtctgttgatctgggcttcatgtggattgctggccatgttgggggcattatcctatgctgagttgggaacggtcattaaagagtctggaggggaatacatttatattttacggaacagtggacctctgctggcttttctccttgcctacacctctgtcattgtggtaagaccagctggtattgccggaatctccctaagctttgcagagtacgttgtggcttctttttatccagactgcccgtcgccaactgtggctgtcaaattcacggctgctgcatgtatcctagtcttgggcatcatcaactgtctcaatgtcaagctgtccacctccattatgaacatattcaccactgccaaactgttggtgttgcttcttataatagtggggggcatggtattactggccaagggccacactcagggcctgcagaatgcctttgacaacacagctacaggttttggccctgtaggagtggctttttaccaaggactctggtcttatgatggttggaacaacctgaactatgtcacagaggagctgaagaaacctgaggttaatctcccccgagctgtaatgattgccatcccgctggtcacctgtgtgtacctgctggtcaacgtcagctattttgtagctatgacgcccagagaacttctctcttcagacgctgtcgctatcagctggggggtgaagctgctcggcacttggacatggattatatccctgggtgtcgccctctctacgttcggctctgccaatggaaccttctttactgggggccgtttgtgctacgtggcagcgagagaagggcatttgccagacatcttgtcgatggccaacgtgaaacgcctcacgccttcccccgcccttatattcaccaccgccatctctttaatcatgatcataccttcagacttcagcagtattgtgaattttttcagtttcacggcctggctgttctacggtataaccatagctgggctcctgtacatgaagatcaagaaaccggaccttccgcggccatataaggttcccattgtgatcccgatcattgtgcagattgcatcagtgtacctggtgctggcgcccatcattggaagcccccagctggaatacctgtatgtagtgctctttattctcagtgggctcattgtctacattcccgtggtccattacaagtggtctcccaaatgtttccgatcagttactctccagctccagcttctgcttcaggttgcaccgacaaataaaaatgactga

SEQ ID NO: 36865 - protein, 484 aa, Xenopus tropicalis
MENKKETDSQPLSDGTSRKESENVCLKRELGLPSAVSLIAGTMIGSGIFMSPQWVLYHMGSPGASLLIWASCGLLAMLGALSYAELGTVIKESGGEYIYILRNSGPLLAFLLAYTSVIVVRPAGIAGISLSFAEYVVASFYPDCPSPTVAVKFTAAACILVLGIINCLNVKLSTSIMNIFTTAKLLVLLLIIVGGMVLLAKGHTQGLQNAFDNTATGFGPVGVAFYQGLWSYDGWNNLNYVTEELKKPEVNLPRAVMIAIPLVTCVYLLVNVSYFVAMTPRELLSSDAVAISWGVKLLGTWTWIISLGVALSTFGSANGTFFTGGRLCYVAAREGHLPDILSMANVKRLTPSPALIFTTAISLIMIIPSDFSSIVNFFSFTAWLFYGITIAGLLYMKIKKPDLPRPYKVPIVIPIIVQIASVYLVLAPIIGSPQLEYLYVVLFILSGLIVYIPVVHYKWSPKCFRSVTLQLQLLLQVAPTNKND

SEQ ID NO: 36866 - DNA, 1791 bp, Oryza sativa
  CDS (1)..(1791)
atggcgacggcggcggcggcgggagagggagggagtgggcggcggtactggcggtggagtaaggcggacttcttcccggagccgtcgttcgcgagctggcggtcctacggcggcgcgctcgcggccaccgtgccgcggctggttgaccgcgtggggagccgctcgtcggaggcggcggaggccggcacgctgcgcgccgtgagcgagaacccgctgcggcggtgcctgtcgtggctggacctcgcgttcctcgggttcggctccgtcgtcggctccggggtgttcgtgctcaccggccaggaggcgcgcttcgacgccggcccggcgatcccgctcgcgtacgccgcggcggggttctccgcgctgctgtcgtccttctgctacgccgagctcgccacggagatcccctccgcggggggctcgttctcgtacctccgcgtcgagctcggcgacatcgcggcgttcctcgccgccgggaacatactgctggaggccgtcgtcggggcggccgggcttgggaggtcgtggacgtcgtacctcgccgcgctcctcggccgcgacaccgactcgctccgcatccacgtcccggcgctcgccgaggggttcaatctgctcgaccccatcgccgtcgtggtgctcgtcagcacctccgcggtggccatgtccggggcgcgcctcacgtccacgctcaactcgctggcgtcggtggtcggcatcgccatcatcgcgttcgtgctggccgcggggttctcccacttcgacgccggcaacctcgcgccgtccttcttccccttcggcgccgcgggcgtgttccgcgcggcgggggtggtgtactggtcgtacaccgggttcgacatggtggccaccatggcggaggagaccaagaaccccggccgcgacgtgcccctggggctcatctcgtccatgtcctccatcaccgtcgtgtactgcctcatgtcgctggcgctggtcgggatgcagcggtacaccgagatcgacgccaacgccgcctactcggtggcgttcgccgcggccgggatgaggtgggcgcgctacgtggtggctctcggcgcgctcaaggggatgacgagcggcctcctcgtcggcgcgctggggcaggcgaggtacacgacgcagatcgcgcggacgcacatgatcccgccgtacttcgcgctcgtccacccgacgaccggcacgcccatctacgccaccgtcgccgtcacgctcggcgccgcctgcgtcgcgctcttctccagcctcgacgtgctcgcctccgtctcctccatcagcacgctcttcatcttcgcgctcgtcgccgtggcgctcctcgtccgccgctaccacgtcgcgggggcgacgacgccggggcagctgcgcaccttcctcgcgttcctcgcgctcgtcgtgctctcctccatcggcgtctcggcctactacaactcccggtacgcgcggcggtggccagggtacgcggcgttcggctgcgggtgggcggcgggggcggcggggctggcggcgtgcgcggagaagcagcgggcgccgcgggtgtacggcgcgccgctggtgccgtggctgccggccatgtccatcgccaccaacctcttcctgatggggtcgctgggcaccgcggcgtacgcccgcttcggcatctgcacggccgccatgctcgtctactacgtgctcttcggcgtgcacgccacctacgacgtcgcgcacgcggacgacgcggctgccgacaacctcgagcacggcaagatcgcggcggcgcccgcgcccacgacgccggcgtga

SEQ ID NO: 36867 - protein, 596 aa, Oryza sativa
MATAAAAGEGGSGRRYWRWSKADFFPEPSFASWRSYGGALAATVPRLVDRVGSRSSEAAEAGTLRAVSENPLRRCLSWLDLAFLGFGSVVGSGVFVLTGQEARFDAGPAIPLAYAAAGFSALLSSFCYAELATEIPSAGGSFSYLRVELGDIAAFLAAGNILLEAVVGAAGLGRSWTSYLAALLGRDTDSLRIHVPALAEGFNLLDPIAVVVLVSTSAVAMSGARLTSTLNSLASVVGIAIIAFVLAAGFSHFDAGNLAPSFFPFGAAGVFRAAGVVYWSYTGFDMVATMAEETKNPGRDVPLGLISSMSSITVVYCLMSLALVGMQRYTEIDANAAYSVAFAAAGMRWARYVVALGALKGMTSGLLVGALGQARYTTQIARTHMIPPYFALVHPTTGTPIYATVAVTLGAACVALFSSLDVLASVSSISTLFIFALVAVALLVRRYHVAGATTPGQLRTFLAFLALVVLSSIGVSAYYNSRYARRWPGYAAFGCGWAAGAAGLAACAEKQRAPRVYGAPLVPWLPAMSIATNLFLMGSLGTAAYARFGICTAAMLVYYVLFGVHATYDVAHADDAAADNLEHGKIAAAPAPTTPA

SEQ ID NO: 36868 - DNA, 1581 bp, Gallus gallus
  CDS (1)..(1581)
atgtcgggcagcggcggcggcagcagcgcggtgaagaagaggagcccggcgggctcggcctcctccatggcgcaggaggaggagaagcaggcgatggagaagatgctggaggcggctggaggggcgcaggagaacggctgcgcccgcacgccttctcccaccgccgccgccgctgaaggcgagggggtggccttgcagcgctccatcacgctgatcaacggcgtggccatcatcgtggggaccatcatcggctccggcatcttcgtcacccccaccggggtgctgcgggaggccggctcgccggggctgtcgttggtggtgtgggccgtctgcggggcctcctccatcgtgggcgctctgtgctacgccgagctgggcaccaccatcaccaagtccggcggggactatgcctacatgctggaggtgtacggctccctgcccgccttcctcaagctctggatagagctgctcatcatccgaccctcctcgcagtacatcgtcgctctggttttcgccacctacctgctgaagcccatcttccccagctgcccggtgcctgacgaggctgccaagctggtggcctgcctctgtgtcctgctcctcacggcagtgaactgctacagtgtgaaagctgctacccgtgttcaggatgcctttgctgcagccaagctgctggcgctggctttgatcatcattcttggcttcgttcagattgcaacgggtgatgtgaccagcctgactcctgagcactcctttgaaaaaacaaaagtgggtgtggggaacatcgtgctggccttgtacagtggtctttttgcctatggaggatggaattacttgaattttgttacggaggagatgataaacccctacagaaacctgcctctggctatcatcatctcactacctgtagtcactttggtttatgtgctgacaaacttggcttacttcacaaccctgtccacggagcagatgctgaagtccgaagcggtggctgtggactttgggaatcaccaccttggcatcatgtcctggatcatacctgtctttgtgggcttgtcgtgctttggatctgttaatggatctctcttcacctcttcccggctgttctttgttggatcccgagaaggacaccttccttcaattctctccatgattcacccgaggcttctcactcctgtaccatccctcgtctttacgtgtgtcatgaccctgctctacgccttctccaatgacatcttctcagtcatcaacttcttcagcttcttcaactggctgtgtgtggccctggccatcattggtatgatgtggctgcgttacaagaagccagagctggaaaggcccatcaaggtgaacatctgcctgcccattttcttcatcctggcttgcttgtttctcattgctgtttccttctggatgacaccaaaggaatgcgggatcggcttcgccatcatcttcagcgggattcctttttacttgtttggggtcctggtggcaaaacaagcccaagtggatcctccaggcatcttccacgcgacagccatgtgccagaagctgatggaggtggttccccaagaatcgtaa

SEQ ID NO: 36869 - protein, 526 aa, Gallus gallus
MSGSGGGSSAVKKRSPAGSASSMAQEEEKQAMEKMLEAAGGAQENGCARTPSPTAAAAEGEGVALQRSITLINGVAIIVGTIIGSGIFVTPTGVLREAGSPGLSLVVWAVCGASSIVGALCYAELGTTITKSGGDYAYMLEVYGSLPAFLKLWIELLIIRPSSQYIVALVFATYLLKPIFPSCPVPDEAAKLVACLCVLLLTAVNCYSVKAATRVQDAFAAAKLLALALIIILGFVQIATGDVTSLTPEHSFEKTKVGVGNIVLALYSGLFAYGGWNYLNFVTEEMINPYRNLPLAIIISLPVVTLVYVLTNLAYFTTLSTEQMLKSEAVAVDFGNHHLGIMSWIIPVFVGLSCFGSVNGSLFTSSRLFFVGSREGHLPSILSMIHPRLLTPVPSLVFTCVMTLLYAFSNDIFSVINFFSFFNWLCVALAIIGMMWLRYKKPELERPIKVNICLPIFFILACLFLIAVSFWMTPKECGIGFAIIFSGIPFYLFGVLVAKQAQVDPPGIFHATAMCQKLMEVVPQES

SEQ ID NO: 36870 - DNA, 1869 bp, Xenopus laevis
  CDS (1)..(1869)
atgaaaccctatgaaggactatacagcttctacaaaatcctaactagaacaaagcatgtgaccttagagggaaccggtagttctgacctttgccgttgcctctcaactcttgacctggtggctctaggtgttgggagcacattgggtgctggggtgtatgtcttggcaggagaagtggccaaagtggattctgggcccagtatcattatatccttcttaattgcagctctagcctcagtgcttgcaggactgtgctatgcggaatttggtgcacgtgtaccactcacaggatctgcgtatctctacagctacgtgacagttggggaactctgggccttcatcacgggatggaatctcattttatcctatgttataggtacctccagtgtcgcccgggcatggagtgccacttttgatgaactggtgggcaagaagattgggaatttcttaggcaatactatgcacatggatcttccaggacttgctgagtatcctgatatatttgcagtgtgccttataatccttctggcaggccttctctcctttggagtaaaagagtcaactgcagtgaacaaagtcttcacggctattaacatactggtccttctgtttgttattgccagcggctgtgttacaggcaacttaaaatattggaaaatgagcaaggaagacctttgggctaccaagcagagtgtgagtaatcactctataggaaatgaaactggactggactttggggcgggtggattcatgccattcggctttagcggaacactggcaggagctgccacttgcttttatgcctttgttggttttgactgcattgcaacaacaggagaggaggtgaagaatccacaaaaatccattccacttggcatagtgttgtcattgtccatttgcttctttgcctattttggggtctctgcttcccttaccctcatgatgccatatcacctcctggactcgcagagcccattgccagctgcttttgaatatgttggctggaatgtggctaagtatattgtggctgttggatcactctgtgctctaactacaagtctccttggatccatgttccctatgcctcggatactctttgctatggccagagatggattgttatttcaaccactatctagggtcagtagccgtcagagcccagtgatcgccaccattgtatcaggagttgtagcagctcttatggcatttctcttcaacctgaaggctctcgttgatatgatgtctattggaaccctgcttgcctacactttggtgtcaacgtgtgtattattactgaggtatcagccacaaacagatttcgggaaaagcccagatggaaatcttcaggagcagaatatcagctctatatctcacctgccagaaactccttctgtgcactcttcagctcttgtgacacgctgtgtgattgccataactttgctagtttgtgtagcaagtgtggtgtctacagtgggatcacagtgtctgctctcaggaagagcttggtgcctttcgctgcttgtcctgagcctgcttggaataataattgcattagtgattatttggagacagccacagaaccagagtaaagccacgttcatggttccctttgtgccagttcttcctgtggttagtattctggtcaatatatacctgatggtgcagctgagtacggatacctggctccgttatgcagtatggatggcagttgggtttgtcatctattttggctatggaattagacatagcattgagaggctgcatttaaaggagacctgcacacagaaaatggccatcagctcaactgaaactctatgtaaagctcagtgtcttgagctacagcttggggaagccaagcccatggactga

SEQ ID NO: 36871 - protein, 622 aa, Xenopus laevis [sequence omitted]

SEQ ID NO: 36872 - DNA, 1908 bp, Homo sapiens
  CDS (1)..(1908)
atggcccgggggctgcccaccattgctagcctggcacgcttatgccagaagctgaaccgcctgaagccgctggaggactccatcatggagacgtcactgcggcgctgcctgtccacgctggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccatgggcgagctgtgggccttcctcatcggctggaatgttctcctcgaatacatcatcggtggcgccgccgtggcccgtgcctggagtggctacctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccaccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcagatccccatggttcccctgattccagccctgagcatcgtcctcaacatctgcctcatgctgaaacttagctatctgacctgggtgcgcttctccatctggctgctgatgggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtag

SEQ ID NO: 36873 - protein, 635 aa, Homo sapiens [sequence omitted]

SEQ ID NO: 36874 - DNA, 1986 bp, Xenopus laevis
  CDS (1)..(1986)
atggcaaatcgacttccttccgctgcatctcttgttcgattttgtcagaagctgaacagagtgaagacgctggacgatgacttgatggaaacttccttgaaaagatgcctttctacagtcgaccttacacttttaggtgtgggtggaatggttggttctggtttatatgtactgactggtacagttgccaaagagatagctggtccagctgtcattatatccttccttattgctgggtttgcgtcattgctagctgctctttgctacgccgaatttggtgcccgtgtgccaaaaacagggtcagcttatatgtttacatatgtttcagttggtgaaatctgggcctttttaattggctggaatgtcatcctggagtatatgatcggcggtgctgcagtggcacgagcctggagtggatacctggactccatgtttgaccacaaaattaagaactttacagaaactcatgttggcagttggaatgtccagtttctagctcactatcctgacttcttagctgctgggattttgctgattgccacagtatttatttcttttggcgtcagagtatcctcgtggcttaaccacatttttgccgccataagtatggtgattatcttatttattctgatatttggattcattctcgctgaacccaagaactggggtcctgaatttgggggatttgccccttttggcttttctggcattatgtcaggcactgctacatgcttttatgcttttgttggatttgatgtcatagcagcatccagcgaagaagccaaaaatccacaaaaatcaattcctattgcaacagcagtctcattaggacttgctacatcagcctactttttggtgtccacagtactaactttaatggtaccttggaatacacttgtaccggactcagctctttctgatgcattttatagacggggctattcatgggcaggatttattgtggccgctggttccatttgtgcaatgaacactgtcctcttgagtaacctcttctcccttccacggatagtatatgcaatggcggaagatggcttattctttcagtttttttccaaagtcaatccaaccaccaaagtgcctttgattggcattattgtatttggtatattgatggctttattagccctaatctttgacttggaagctctggtgcaatttctatcaattggcacacttttggcctacacctttgttgcagcaagcataattgtcctgagattccagcaagacaagatagaattttcccaaccaacggtgcacgaggcaagtcccatttgccacattggtgctcctattaaaagtgaaaatctggttggagaagaaatgaaggaatatgaatccttctcggacaagcttcagctggtggaaattgacaaaaaagacaatcagcgcagagaaacaggaagactgaaagctgcttttgagccatacctacgcttcttaaatgacttttaccccggagaggttgtcactattgctgttgttacactgatggtctcctgcatatgcttttgctctgttctggtatttgggagtgatcggctgcgccttcctacatgggctttttatttgctgcttgtgatttttatgattggctttttaatcagcctgtgtttaatatgggtgcacgaacagcagaggaaaacctcaacattccaggttccactggttcctcttattccagctttgagtattctgttaaacatttatctcatgctgaaactgaactacatgacatggatacggttctccgtctggcttgcactgggtctcctggtttattttggctatggcatatggcacagtaaggagaacttacgggaacccaaggaccacggcgtcacagcccgttacgtagtctttcccagtagcagcctggaagaaactgtgcaacaagtgcaacctaactcccaggatactatgggaagggctgtggttactgacgaggaatctgaaaagaggtga

SEQ ID NO: 36875 - protein, 661 aa, Xenopus laevis
MANRLPSAASLVRFCQKLNRVKTLDDDLMETSLKRCLSTVDLTLLGVGGMVGSGLYVLTGTVAKEIAGPAVIISFLIAGFASLLAALCYAEFGARVPKTGSAYMFTYVSVGEIWAFLIGWNVILEYMIGGAAVARAWSGYLDSMFDHKIKNFTETHVGSWNVQFLAHYPDFLAAGILLIATVFISFGVRVSSWLNHIFAAISMVIILFILIFGFILAEPKNWGPEFGGFAPFGFSGIMSGTATCFYAFVGFDVIAASSEEAKNPQKSIPIATAVSLGLATSAYFLVSTVLTLMVPWNTLVPDSALSDAFYRRGYSWAGFIVAAGSICAMNTVLLSNLFSLPRIVYAMAEDGLFFQFFSKVNPTTKVPLIGIIVFGILMALLALIFDLEALVQFLSIGTLLAYTFVAASIIVLRFQQDKIEFSQPTVHEASPICHIGAPIKSENLVGEEMKEYESFSDKLQLVEIDKKDNQRRETGRLKAAFEPYLRFLNDFYPGEVVTIAVVTLMVSCICFCSVLVFGSDRLRLPTWAFYLLLVIFMIGFLISLCLIWVHEQQRKTSTFQVPLVPLIPALSILLNIYLMLKLNYMTWIRFSVWLALGLLVYFGYGIWHSKENLREPKDHGVTARYVVFPSSSLEETVQQVQPNSQDTMGRAVVTDEESEKR

SEQ ID NO: 36876 - DNA, 1245 bp, Xenopus laevis
  CDS (1)..(1245)
atgtgctccctctgttacgctgaacttggttctgcattaccttatgctggtggtgaatattatcatgtaaaacgaggacttggatctttacctgccttcattttcatctggacattaatattgttcatattacctgcgtccaatgccgctcgagcgctgacatttgccgaatacgccactcagccattctactctggatgccccacacccgagctgcttaagaaaatagtggcacttgcagttctttgggtgttgggaattataaatatcaagagtgcaaagatgaccacttgggtccagaatgtttttactgtgctgaaaatgttggccttgatccttattgtattttgtggcctcagagaacttggaggaagaaaagagattccaggacacttaaagaatgcgtttagttctcctgatccaaatgcagctcaaatagcagagtctttcttccagagtctatatgcatatggaggttggagcagcttaaattacattgctgaggacattaaaaacccaagaaagaacattccgctctgtacaataacagccgtgtctgcagtgattgtcttttatttgctggtaaacatctcatacctcacagtactgacaccaaaagaaatagtttcttcagctgctgtatctgttacctgggctgttcgaattattccagaggtagcctggataatacctgtctcagtcgctatctcaatattcggttctctaaatggtgatgtgtttgtgcttggacgattaaactatgctgggagcaaggagggtcatttacctgcccttatatcaatgattcatgtaaatcacttgactctggctccggctgcagtcctctcaaccattattgcatcagtattcgtcattccatcagatcttctgtcattaactaattactttggcttttcttcttggcttttgattggactaactgttacaagtctgattgttctacgcttcagagaaccagacattccaagaccatataaggtctttctgccaatcgcctttggagttgtgttagtcgccacatttttagttctagcaccaataatacaatcacccaaagtgcaatatttctatgccttactgtttatgctgagcagcatgatcatttatttcccttttgtttattttaaactgcgtatcccatacttcgatgccattacttgctacttacagctgttgctggaggtgactcccacagatatatttgaagatcccaaaagccaataa

SEQ ID NO: 36877 - protein, 414 aa, Xenopus laevis
MCSLCYAELGSALPYAGGEYYHVKRGLGSLPAFIFIWTLILFILPASNAARALTFAEYATQPFYSGCPTPELLKKIVALAVLWVLGIINIKSAKMTTWVQNVFTVLKMLALILIVFCGLRELGGRKEIPGHLKNAFSSPDPNAAQIAESFFQSLYAYGGWSSLNYIAEDIKNPRKNIPLCTITAVSAVIVFYLLVNISYLTVLTPKEIVSSAAVSVTWAVRIIPEVAWIIPVSVAISIFGSLNGDVFVLGRLNYAGSKEGHLPALISMIHVNHLTLAPAAVLSTIIASVFVIPSDLLSLTNYFGFSSWLLIGLTVTSLIVLRFREPDIPRPYKVFLPIAFGVVLVATFLVLAPIIQSPKVQYFYALLFMLSSMIIYFPFVYFKLRIPYFDAITCYLQLLLEVTPTDIFEDPKSQ

SEQ ID NO: 36878 - DNA, 1713 bp, Rhodococcus erythropolis
  CDS (1)..(1713)
atgaggggggatgacttccagtcaggtgatcatttcggtcagttcgagcgagctgacttgcacacggcgctcaccagtggttccctcatcaggtcgctgagacgcacatcacaacgacgacagtcagccaccgcccgccacccacaaggtcgacgggaaacaaccaaggagcaatacatgcccggagtcggcatatggcgcaccaaatccgtcgagcaatcgatcgcggacaccgacgagcctgagacaaagctcaagaaggaactgaccgcgaaggacctcacggtattcggagtcgccgtcgtcatcggcgcaggcatcttcacgctgactgctcgaaccgcaggcaatgtcgcaggaccctcgatttcactggcattcgttctcgctgcgatcgcctgtggccttgccgcgctgtgttacgcggagttcgcctccaccgttccagtcgcaggcagcgcatacacgttctcctacgcgacgttcggtgagttcgcagcctggatcatcggctgggacctcatcctcgagtttgctctcgcctccgccgtcgtcggcaagggttggtcgctgtacctcggcaacgtcatcggggcgagcggcagcaccaccgcccacatcgggtcgatcagcttcgactggggcgcactgctcatcatcggcgcgatcaccctgattctcgcgatcggcaccaaggtttcctcgcgagtctccgcgatcattaccgcgatcaagatcgcagtagtcctgctcgtcatcgtcgtgggcgcgttctacatcaagaaggagaactactctcccttcatcccgccgtccgaaggatccgagagcgctgcaagcggaatccatcagaccttgttctcctggctgaccggtgcaggcggaagtagctacggcgcctacggattgctcgccgcagccagcctcgtgttctttgccttcatcggcttcgatgtcgtcgccaccacggccgaggaaaccaagaacccgcagaagtcgttgccacgcggaatcttcggctcgctcgccatcgtcaccgttctctacgttgccgtcacactcgtcctgaccggcatggtcaagtacaccgaactcaaggacggcagtcctctggtcggcgattccagcgccaccctcgcaaccgcattcgaggccaacggaatcggttgggcacaaaccgccatcaacttcggtggcctggccggcctcacgacagttgtcatggtcatgatgctcggccagacccgcgtcctcttcgcaatgtcccgtgacggcctcatgccgcgcagcctggccaagaccaacgccaagggcatcccgatgcgcatcacgttgatcgtcggtggcatcgtcgccgtcctggcagccttcttcccgatgggcacgctcgaagagatggtcaacatcggaacgctgttcgcattcgtcctggtttgtgtcggtgtcatcgtcctacgccgcacccgccccgacctgccgcgcggattccgcgtcccactggtgcccttcgtgccgatcgtcgccgtgctcgcctgcggttggctgatgctcaacctctcggtcgagacctggatccggttcctcgtctggatggccatcggtgtgctcgtgtacttcgcctacggtcaccgcaagtcggtcctcggtcgcaagctcaaggacggaacagccatcccgtccgcgaacgccgacccggtactcgtcaaggactga

SEQ ID NO: 36879 - protein, 570 aa, Rhodococcus erythropolis
MRGDDFQSGDHFGQFERADLHTALTSGSLIRSLRRTSQRRQSATARHPQGRRETTKEQYMPGVGIWRTKSVEQSIADTDEPETKLKKELTAKDLTVFGVAVVIGAGIFTLTARTAGNVAGPSISLAFVLAAIACGLAALCYAEFASTVPVAGSAYTFSYATFGEFAAWIIGWDLILEFALASAVVGKGWSLYLGNVIGASGSTTAHIGSISFDWGALLIIGAITLILAIGTKVSSRVSAIITAIKIAVVLLVIVVGAFYIKKENYSPFIPPSEGSESAASGIHQTLFSWLTGAGGSSYGAYGLLAAASLVFFAFIGFDVVATTAEETKNPQKSLPRGIFGSLAIVTVLYVAVTLVLTGMVKYTELKDGSPLVGDSSATLATAFEANGIGWAQTAINFGGLAGLTTVVMVMMLGQTRVLFAMSRDGLMPRSLAKTNAKGIPMRITLIVGGIVAVLAAFFPMGTLEEMVNIGTLFAFVLVCVGVIVLRRTRPDLPRGFRVPLVPFVPIVAVLACGWLMLNLSVETWIRFLVWMAIGVLVYFAYGHRKSVLGRKLKDGTAIPSANADPVLVKD

SEQ ID NO: 36880 - DNA, 1611 bp, Didelphis marsupialis virginiana
  CDS (1)..(1611)
atggaagaaaaggccaggcaccgaaacaacgcagaaaagagccccacaagcaggagcgaatctgatcctggcccagatgccggttctgaagggggtggagtagcgctgaagaaagagattgggttggtcagtgcttgcggcatcattgtaggaaacatcattggctcaggaatttttgtctcaccaaagggtgttctggagaatgcaggctctgtgggccttgctctcattgtatggattataacaggaatcatcacagctgtgggtgcattgtgctatgctgaacttggagttactatccctaaatctggaggtgactactcttatgtcaaggacatctttggaggactggctgggttcctaaggctttggatcgccgtgctagtgatctaccccaccaaccaggctgtcattgctctcaccttttccaattatgtgctgcagccactctttccaacctgttttcctccagagtctggacttcgactcctggctgcagtctgtttattgcttctcacatgggtcaactgtgcaagtgttcgatgggccacccgagtacaggacatcttcaccgctggaaagctcttggcccttggcctgattatcatcatggggattgtccagatctgcaaaggacactatttctggctggagcccaaacatgcatttgagaatttccgaaagccagacatcggcctcatcgcactgtctttccttcagggctcctttgcctatggaggctggaacttccttaattatgtgacagaagaactggtcgatccctacaagaaccttcctcgagctattttcatctccatcccactggtcacgtttgtgtatgtctttgccaacatcgcttatgtcactgcaatgtccccccaggagctactggcctccaatgctgttgctgtgacctttggagagaagcttctaggagtcatggcctggatcatgcccatttcagtggctctgtccacatttggtggagtcaatggatctctctttacatcctctagattattctttgctggagcccgggagggccacctgcccagcgtgctggcgatgattcacataaagcgctgcactccgatccctgcactcctcttcacatgtatctccaccctgttgatgctggtgaccagtgacatatatacactcatcaactacgtaggcttcatcaattacttgttctatggcgtcacaattgctgggcaaattgtcctacgctggaagcagcctaatatcaaccgccctatcaagataagcctgctgttccctgttatctacctgttattctgggccttcctgttgatcttcagtctgtggtcggagcccgtggtgtgtgggattggcctggccatcatgatgacgggtattcccgtctactttctcggggtgtactggcagcacaaaccccagtgtttcaatgacttcatagctttcctgaccacagtgagccagaagttgtgtgtggtcgtgtatcctcagatggatgagagcccatcgagagaggaagaatcatcagatgaagtgaaagaacagtgtcggcccatgtacacatcctctgccccagacgggcaggagtcctcagactcaccccgcccctga

SEQ ID NO: 36881 - protein, 536 aa, Didelphis marsupialis virginiana
MEEKARHRNNAEKSPTSRSESDPGPDAGSEGGGVALKKEIGLVSACGIIVGNIIGSGIFVSPKGVLENAGSVGLALIVWIITGIITAVGALCYAELGVTIPKSGGDYSYVKDIFGGLAGFLRLWIAVLVIYPTNQAVIALTFSNYVLQPLFPTCFPPESGLRLLAAVCLLLLTWVNCASVRWATRVQDIFTAGKLLALGLIIIMGIVQICKGHYFWLEPKHAFENFRKPDIGLIALSFLQGSFAYGGWNFLNYVTEELVDPYKNLPRAIFISIPLVTFVYVFANIAYVTAMSPQELLASNAVAVTFGEKLLGVMAWIMPISVALSTFGGVNGSLFTSSRLFFAGAREGHLPSVLAMIHIKRCTPIPALLFTCISTLLMLVTSDIYTLINYVGFINYLFYGVTIAGQIVLRWKQPNINRPIKISLLFPVIYLLFWAFLLIFSLWSEPVVCGIGLAIMMTGIPVYFLGVYWQHKPQCFNDFIAFLTTVSQKLCVVVYPQMDESPSREEESSDEVKEQCRPMYTSSAPDGQESSDSPRP

SEQ ID NO: 36882 - DNA, 1584 bp, Xenopus laevis
  CDS (1)..(1584)
atggcagaaggtgcaagactgcggaatagtgcggagaagatcccggaggaaaaggaacatgactctgggtcgagttctggtgaagctggcggtgtggctctgaagaaggagattgggttggtgagcgcctgtggcattatagtgggtaatattattggctctggtatattcgtatctccaaagggagtgatggagaatgcaggttctgtgggaatggcactaattgtatggattgtaacaggagtaatcacagcagtaggagccctttgctatgcagagctcggggtcaccatcccaaaatctggaggagactattcatatgttaaagatatctttggtggactagcagggttcctccgactgtggatagcagtcctggtaatatatccaacaaatcaagcagttattgccctgacattctccaattacgtcctgcagcccctcttccctacatgctttgcaccagagtctggacttcgattgctggctgcagtctgtctattgttgctgacatgggtgaactgtgccagcgtgcgctgggcaactcgagtgcaggacatgtttacagctggaaaacttttggcactgggtctaatcattatcatgggaattgtgcagatctgcaaaggagaatatttctggctggaaccaaagaacgcctttgagaatttccaggaaccagacattggcctcattgcactagcctttttgcagggatccttcgcttatggtggttggaacttccttaactatgtcacagaagaactggtggacccctacaagaacttgccccgtgccatctttatctctattccacttgtcacctttgtgtacgtttttgccaatattgcctatgtgactgccatgtccccccaggaactactggcatccaatgctgtggctgtgacatttggtgagaagttgctaggtgttatggcctggatcatgccaatttcggtggctctctccacttttgggggagtcaatggatctctctttacttcatccagattgttctttgccggagccagagagggccatctcccaagtttaatggcaatgatccacatcaagcgttgcactcctattccagcactgctcttcacttgcatctccactctgctgatgttagtgaccagtgatatgtacactcttatcaattatgtgggcttcatcaattacctgttttatggagtaacagtggcaggacagatcgtcctacgatggaagaaaccagacattcctcggcccatcaaggtgaatctgattttcccagtgatctacctcctattttgggccttcctacttgttttcagcttatggtcagagcctgtggtctgtggaattggccttgcaatcatgcttactggggtgcctgtctatttcctgggagtgtactggcagaacaaacccgagtgttttaataaatttgtggatgccatgacacgagctggtcaaaagctatgtgtggttgtctaccctcaaatggacaataaagatgaagatgtgagtgaagagaccaaagagcagagggcgccaatctataaaccaggctctgaggaagaaagtggagcacatgcctga

SEQ ID NO: 36883 - protein, 527 aa, Xenopus laevis
MAEGARLRNSAEKIPEEKEHDSGSSSGEAGGVALKKEIGLVSACGIIVGNIIGSGIFVSPKGVMENAGSVGMALIVWIVTGVITAVGALCYAELGVTIPKSGGDYSYVKDIFGGLAGFLRLWIAVLVIYPTNQAVIALTFSNYVLQPLFPTCFAPESGLRLLAAVCLLLLTWVNCASVRWATRVQDMFTAGKLLALGLIIIMGIVQICKGEYFWLEPKNAFENFQEPDIGLIALAFLQGSFAYGGWNFLNYVTEELVDPYKNLPRAIFISIPLVTFVYVFANIAYVTAMSPQELLASNAVAVTFGEKLLGVMAWIMPISVALSTFGGVNGSLFTSSRLFFAGAREGHLPSLMAMIHIKRCTPIPALLFTCISTLLMLVTSDMYTLINYVGFINYLFYGVTVAGQIVLRWKKPDIPRPIKVNLIFPVIYLLFWAFLLVFSLWSEPVVCGIGLAIMLTGVPVYFLGVYWQNKPECFNKFVDAMTRAGQKLCVVVYPQMDNKDEDVSEETKEQRAPIYKPGSEEESGAHA

SEQ ID NO: 36884 - DNA, 1590 bp, Xenopus laevis
  CDS (1)..(1590)
atggcggaaggcgcaagattgcggaatagtgctgagaagatcccagaggaaaagggacaggactctggatcaggatcgggttctggggaagatggcggtgtggctctaaagaaagagattgggttggtgagcgcctgtggcattatagtgggtaatattattggctctggtatattcgtatctccaaagggagtgatggagaatgcaggttctgtaggaatggcattgattgtatggattgtaacaggagtaatcacagcagtaggagccctttgctatgcagagctaggggtcaccatcccaaaatctggaggagactactcatatgttaaagatatatttggtggactagcagggttcctccgactgtggatagcagttctggtaatatatcctacaaatcaagcagttattgccctgacattctccaattacgtcctgcagccccttttccctacatgctttgcaccagagtctggacttcgattgctggctgcagtctgtctgttgttgttgacatgggtgaactgtgccagtgtgcgctgggcaacacgcgtgcaggacatatttacagctggaaaacttttggcactgggactaatcattatcatgggaattgtacagatttgcaaaggagagtatttctggctggaaccaaagaacgcctttgagaatttccaggagccagacattggccttattgcactagcctttttacagggatctttcgcttatggtggttggaacttccttaactatgtcacagaagaactggtgaacccttacaaaaacttgccccgtgccatctttatctctattccacttgtcacctttgtgtatgtttttgccaatattgcctatgtgactgccatgtccccccaggaactactagcatccaatgctgttgctgtgacatttggtgagaagttgctaggtgttatggcctggatcatgccaatttctgtggctctctccacttttgggggagtcaatggttctctctttacttcatccagattgttctttgcgggagccagagagggccatcttccaagtttaatggcaatgatccacataaagcgttgcactcctattccagcactgctcttcacttgcatctccactctgctgatgttagtgaccagtgatatgtacacgcttatcaattatgtcggcttcatcaattatctgttttatggagtaacagtggcaggacagatcgtcctacgatggaagaagccagacattcttcggcctatcaaggtgaatctgattttcccagtgatctacctcctattttgggccttcttgcttgttttcagcttgtggtcagagcctgtggtctgtggaattggccttgcgatcatgctgacaggggtgcctgtctattttctgggagtgcactggcagaacaaaccagagtgttttaataattttgtggatgccgtgacacgagctggtcagaagctatgtgtggttgtctaccctcaaatggacaataaagatgaagatgtgagtgaagagaccaaagagcagagggcgccaatctataaaccaagctctgaggaagaaagtggagcacaggcctga

SEQ ID NO: 36885 - protein, 529 aa, Xenopus laevis
MAEGARLRNSAEKIPEEKGQDSGSGSGSGEDGGVALKKEIGLVSACGIIVGNIIGSGIFVSPKGVMENAGSVGMALIVWIVTGVITAVGALCYAELGVTIPKSGGDYSYVKDIFGGLAGFLRLWIAVLVIYPTNQAVIALTFSNYVLQPLFPTCFAPESGLRLLAAVCLLLLTWVNCASVRWATRVQDIFTAGKLLALGLIIIMGIVQICKGEYFWLEPKNAFENFQEPDIGLIALAFLQGSFAYGGWNFLNYVTEELVNPYKNLPRAIFISIPLVTFVYVFANIAYVTAMSPQELLASNAVAVTFGEKLLGVMAWIMPISVALSTFGGVNGSLFTSSRLFFAGAREGHLPSLMAMIHIKRCTPIPALLFTCISTLLMLVTSDMYTLINYVGFINYLFYGVTVAGQIVLRWKKPDILRPIKVNLIFPVIYLLFWAFLLVFSLWSEPVVCGIGLAIMLTGVPVYFLGVHWQNKPECFNNFVDAVTRAGQKLCVVVYPQMDNKDEDVSEETKEQRAPIYKPSSEEESGAQA

SEQ ID NO: 36886 - DNA, 1317 bp, Shigella flexneri
  CDS (1)..(1317)
atgctaccatcgaaaatctacgcagttgcccaaaatttgggcgcaatcggatatcaacccatgagtggactcaaacaagaactggggctggcccagggcattggcctgctatcgacgtcattattaggcactggcgtgtttgccgttcctgcgttagctgcactggtagcaggcaataacagcctgtgggcgtggcccgttttgattatcttagtgttcccgattgcgattgtgtttgcgattctgggtcgccactatcccagcgcatgcggcgtcgcgcacttcgtcggtatggcgtttggttcgcggcttgagcgagtcaccggctggctgtttttatcggtcattcccgtgggtttgcctgccgcactacaaattgccgccggattcggccaagcaatgtttggctggcatagctggcaactgttgttggcagaactcggtacgctggcgttggtgtggtatatcggtactctcggtgccagttccagtgctaatctacaaaccgttattgccggacttatcgtcgcactgattgtcgctatctggtgggcgggcgatatcaaacctgcgagtatccccttccccgcgccaggaaatatcgaacttaccgggttatttgctgcgttatcagtgatgttctggtgttttgtcggtctggaagcatttgcccatcttgcctcggaatttaaaaatccagagcgtgattttcctcgtgctttgatgattggtctgctgctggcaggattagtctactggggctgtacggtagtcgtcttacacttcgacgcctatggtgaacaaatggcggcggcagcatcgcttccaaaaattgtagtacagttgttcggtgtaggagcgttatggattgcctgcgtaattggctatctggcctgctttgccagtcttaacatttatatacagagcttcgcccgcctggtctggtcgcaggcgcaacataatcctgaccactacctggcacgcctctcttctcgccatatcccgaataatgccctcaatgcggtgcttggctgctgcgtggtgagcacgttggtaattcatgccttagagatcaatctggacgctcttattatttatgccaatggcatctttattatgatttatctgttatgcatgctggcaggctgtaaattattgcaaggtcgttatcgactactggcggtggttggcgggctgttatgcgttctgttactggcaatggtcggctggaaaagtctctatgcgctgatcatgctggtggggttatggctgtttctgccaaaacgaaaaacgccggaaaatggcataaccacataa

SEQ ID NO: 36887 - protein, 438 aa, Shigella flexneri
MLPSKIYAVAQNLGAIGYQPMSGLKQELGLAQGIGLLSTSLLGTGVFAVPALAALVAGNNSLWAWPVLIILVFPIAIVFAILGRHYPSACGVAHFVGMAFGSRLERVTGWLFLSVIPVGLPAALQIAAGFGQAMFGWHSWQLLLAELGTLALVWYIGTLGASSSANLQTVIAGLIVALIVAIWWAGDIKPASIPFPAPGNIELTGLFAALSVMFWCFVGLEAFAHLASEFKNPERDFPRALMIGLLLAGLVYWGCTVVVLHFDAYGEQMAAAASLPKIVVQLFGVGALWIACVIGYLACFASLNIYIQSFARLVWSQAQHNPDHYLARLSSRHIPNNALNAVLGCCVVSTLVIHALEINLDALIIYANGIFIMIYLLCMLAGCKLLQGRYRLLAVVGGLLCVLLLAMVGWKSLYALIMLVGLWLFLPKRKTPENGITT

SEQ ID NO: 36888 - DNA, 1377 bp, Shigella flexneri
  CDS (1)..(1377)
atgatggaaagtaagaataagctaaagcgtgggctaagtacccgccacatacgctttatggcactgggttcagcaattggcaccgggctgttttacggttcggcagacgccatcaaaatggccggtccgagcgtgttgttggcctatattatcggtggtatcgcggcgtatatcattatgcgtgcgctgggggaaatgtcggtacataacccggccgccagctctttctcgcgttatgcgcaggaaaaccttggcccgctggcaggttacattaccggatggacctactgttttgaaatccttattgtcgccatcgccgatgtgaccgcttttggtatctatatgggtgtcttgttcccgacggtgccgcactggatttgggtactgagcgtggtgctgatcatttgcgccgtaaacctgatgagcgtgaaggtcttcggtgagctggaattctggttctcgttctttaaagtcgccaccatcatcatcatgattgtcgccggtttcggcatcatcatctgggggattggcaacggcgggcaaccgaccggtattcataacctgtggagcaacggcggcttcttcagtaacggctggcttggcatggtaatgtcgttgcaaatggtgatgtttgcttacggtgggatcgaaattatcgggattaccgccggtgaagcgaaagatcctgagaaatcgattccgcgtgcgattaactccgtgccgatgcgtattctggtgttctacgtcggtacgctgttcgtcattatgtctatctacccgtggaatcaggttggcactgccggtagcccgttcgtactgacgttccagcatatgggcattacctttgccgccagcattcttaactttgttgtgctgaccgcttcgctgtcggcaattaacagtgacgtatttggcgtaggccgtatgctccacggtatggcagagcagggcagcgcaccgaaaattttcagcaaaacgtcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtatgggtgtggattatgatcctgctgtcgcaaatcgccttccgtcgccgtttgccgccagaagaagttaaggcgctgaaatttaaagtgccgggtggggtagcaacgaccatcggcgggctgattttcctgctctttattatcgggttgattggttatcacccggatacgcgtatctcgctgtatgtcggtttcgcgtggattgttgtgctgttgattggctggatgtttaaacgccgccacgatcgtcagctggctgaaaaccaataa

SEQ ID NO: 36889 - protein, 458 aa, Shigella flexneri
MMESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVLFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 36890 - DNA, 1908 bp, Arabidopsis thaliana
  CDS (1)..(1908)
atggggtttttggtggatacgcaaaaggaaggaggtggacattcatggggttacgttagaagtttggttagaaggaaacaagtcgactctgctaatggccaatctcatggtcaccaacttgctagagccctcactgttcctcatctcgttgcaattggtgttggagcaacaataggagctggagtttatattcttgtaggaacagttgcgagagagcattcaggaccttctcttgctttgtcttttcttattgctggaattgctgctggtctttctgcgttttgttatgctgaactctctagtcgttgcccttcagctgggagtgcgtatcactattcttacatttgtgttggtgaaggtgttgcgtggataatcggttgggcgttgattctggagtataccattggtggctcagctgttgcccgtggcatatcccctaatctggcactgatttttggtggtgaagatggtttgcctgcaattttagcgcgccaccagatcccaggccttgatattgttgttgatccatgtgctgctattcttgtgtttgttgtaactggccttttgtgcatgggaataaaggagagcacatttgctcagggaattgtaactgcagtcaatgtgtgtgtcctgttatttgtcatagtagctggcagttatctcggcttcaagacaggttggcctggttatgaacttccaacagggttctttccattcggagtagatggaatgtttgctggttctgctacagtcttttttgcattcattgggtttgattcggttgcaagtaccgcagaggaggtgagaaatccccaacgggatttaccgattggtattggtcttgctctcttgttatgttgttctctctacatgatggtctccatagttattgttggtttaattccttactatgcaatggatcccgacaccccgatatcctctgcattcgctagtcatgacatgcaatgggctgtatacttaataactttaggagctgtcatggcactctgctcagctctaatgggtgcccttctccctcagccacgaattctgatggcaatggctagggatggtctgctcccttctattttttcagacattaataaacgcacacaggttccggttaaagcaacagtggcaactgggttgtgtgctgcaaccttagcgttcattatggatgtttcacagcttgcagggatggtgagtgttgggacacttctggcatttacaatggtggcaatatcagtgttgatactaagatatgttcctccagatgagcaacctcttccgtcatctcttcaagagagaattgattctgtttcctttatatgtggtgaaacaacgtcatccggtcatgttggtacttccgatagcagtcaccagcctttaatagttaataatgatgctttggtcgatgtcccacttatcaagaatcaagaagctctagggtgtttggttctcagcgaggaaaccagaaggattgtcgctggatggagcattatgttcacatgtgttggggccttccttttaagttatgcggcatcaagcctgagcttcccagggcttattagatatccgttgtgtggtgttggtggatgtctcctccttgctggtttgattgctctgagttccatagatcaggatgatgcgagacacacttttggacattctggaggttacatgtgcccgtttgttcccctcctacctatcatctgcattctcatcaacatgtaccttttggttaaccttggatctgcgacatgggctcgtgtatcggtgtggctgcttataggagtgattgtgtatgttttctatggtcggaaaaacagttcgcttgccaatgcagtttacgtaactacagctcatgcggaggagatatatcgcgaacatgaaggttctttggcatag

SEQ ID NO: 36891 - protein, 635 aa, Arabidopsis thaliana
MGFLVDTQKEGGGHSWGYVRSLVRRKQVDSANGQSHGHQLARALTVPHLVAIGVGATIGAGVYILVGTVAREHSGPSLALSFLIAGIAAGLSAFCYAELSSRCPSAGSAYHYSYICVGEGVAWIIGWALILEYTIGGSAVARGISPNLALIFGGEDGLPAILARHQIPGLDIVVDPCAAILVFVVTGLLCMGIKESTFAQGIVTAVNVCVLLFVIVAGSYLGFKTGWPGYELPTGFFPFGVDGMFAGSATVFFAFIGFDSVASTAEEVRNPQRDLPIGIGLALLLCCSLYMMVSIVIVGLIPYYAMDPDTPISSAFASHDMQWAVYLITLGAVMALCSALMGALLPQPRILMAMARDGLLPSIFSDINKRTQVPVKATVATGLCAATLAFIMDVSQLAGMVSVGTLLAFTMVAISVLILRYVPPDEQPLPSSLQERIDSVSFICGETTSSGHVGTSDSSHQPLIVNNDALVDVPLIKNQEALGCLVLSEETRRIVAGWSIMFTCVGAFLLSYAASSLSFPGLIRYPLCGVGGCLLLAGLIALSSIDQDDARHTFGHSGGYMCPFVPLLPIICILINMYLLVNLGSATWARVSVWLLIGVIVYVFYGRKNSSLANAVYVTTAHAEEIYREHEGSLA

SEQ ID NO: 36892 - DNA, 1497 bp, Rhodococcus sp
  CDS (1)..(1497)
atggctgtcaaggacgagcaggccggatctggacggtcgaagctgtttcgaaccaaatcgatcgagcagtccatcaaggacaccgacgagccggaaaccaaactccggaaagaactgaactcgtgggatctcacggtgttcggtgtcgcagtcgtcatcggtgcgggcatcttcacactcacggctcggacggcgggaaatgtcgccgggccgtcggtctcgctcgcgttcgtcattgccgccatcgcctgcggactggcagcgctgtgttacgccgaattcgcgtcgacggtcccggttgccggtagcgcgtacacgttctcgtacgcgacattcggcgaattcgtcgcctggatcatcggctgggatctcatcctcgaattcgccttggcgtcttcggtggtcgccaagggctggtcgctgtacctcggcgaagtgatgggctcacgcagcccgatcgtcgaattggggccgatctcattcgactggggtgcggtgctggtgatcgctgtcatcacgatcctgctcgcgaccggcacaaaactctcgtcgagggtgtcgctggtgatcacggcgatcaaggtcgcggtggtgttgctggtgatcgtcgtcggcctcttctacatcgacaccgacaactactcgccgtacattccgccgtcggagccgggctcgacgggagagggcatccaccagtcgttgttctcgtacgtgaccggggccggtggcagcacgttcgggtggtacggattgctcgcggcagccagtctggtgttcttcgcgttcatcggcttcgacgtcgtcgccacgacggcggaggaggcgaaggagccgcagaaggcgctgccacgcggcatcctgggttctctcctgatcgtcacggttctgtacgtggcggtgacactggtgctgacggggatggtgaaatacaccgagctcgagggcgatacctccaacctggcaacggcattcgctttccacgacatcacgtgggcgaaaaacgtcatctcgttcggcgctttggccggtctcacgacagtggtgatggtgctgatgctcgggcagaccagggtgctcttcgcgatggcacgcgacggtctgatgccacgacgcctggcaccgaccggcaagcacggaacccctgtgcggatcacgatcttggtcggcgtcgtggtcgcggtgctcgccggcgtttttccgatcggcaccctcgaggaaatggtcaacatcggcacactgttcgcttttgttctcgtctcgatcggggttctcgtgctccgtcggacgcgtcccgacctacctcgcggattcagggtgccgctggtcccgctggtcccgattctggccgtcctcgcgtgtctgtggctgatgttcaacctgtcggtggagacctggatgaggttcgtggtctggatggccctcggcgttgtcatctattttgcctacagcagacagcattcgatgatcgggaagcgtgaacgcggcgaaatcgagtag

SEQ ID NO: 36893 - protein, 498 aa, Rhodococcus sp
MAVKDEQAGSGRSKLFRTKSIEQSIKDTDEPETKLRKELNSWDLTVFGVAVVIGAGIFTLTARTAGNVAGPSVSLAFVIAAIACGLAALCYAEFASTVPVAGSAYTFSYATFGEFVAWIIGWDLILEFALASSVVAKGWSLYLGEVMGSRSPIVELGPISFDWGAVLVIAVITILLATGTKLSSRVSLVITAIKVAVVLLVIVVGLFYIDTDNYSPYIPPSEPGSTGEGIHQSLFSYVTGAGGSTFGWYGLLAAASLVFFAFIGFDVVATTAEEAKEPQKALPRGILGSLLIVTVLYVAVTLVLTGMVKYTELEGDTSNLATAFAFHDITWAKNVISFGALAGLTTVVMVLMLGQTRVLFAMARDGLMPRRLAPTGKHGTPVRITILVGVVVAVLAGVFPIGTLEEMVNIGTLFAFVLVSIGVLVLRRTRPDLPRGFRVPLVPLVPILAVLACLWLMFNLSVETWMRFVVWMALGVVIYFAYSRQHSMIGKRERGEIE

SEQ ID NO: 36894 - DNA, 1857 bp, Oryza sativa
  CDS (1)..(1857)
atggaggaagaaggcgcagaccaccggcccccctcctcctcctccggcgggcgcggcttcctctccggcctctgcgccgccgcgctacgccgcaagcccatctccgcccacgcggcccacgccgcctccggcgagggcctcgtgcggcagctcggcgtcttcgagctcgtgctcctcgggatcggcgcgtccatcggcgccgggatcttcgtcgtcaccggaacggttgcccgcgacgccggcccaggtgttacaatcagttttgttcttgctggagccgcatgtgtgctcaatgccttgtgctatgccgaactcgcatctcgatttcctgctgtggttgggggagcatacttgtacacgtatgcggcgtttaacgagctcaccgcgttcctggttttcactcagttgatgcttgattatcatattggggcggcaagcatagctcgtagcttggcaagctattttgtccaattccttgagctaattccattcttgaagggccatattccaacttggataggtcatggagaagagttctttggtggtgttgtatcagttaatatattagctccaattcttctcatcatcttaactacaattctctgctatggggtcaaagaatcatcagcagtaaatacctttatgactacattgaagatagtgattgttatagttgttgtatttgctggtgtctttgaggtggatgtatcaaattggtcaccgtttatgccaaatggtttcaaatctgttgtaaccggagctacagtggtctttttcgcatatgttggatttgatgcagttgctaattctgctgaagaggccaaaaaaccacaggtgatttcagtaactacccatatttgttactatgatagtatgatttttgctttaacttctctttctgctcatgcattcaaaattcttcagagggacttgccgataggtatcctagggagccttctagcatgcgtcttattatatgttgctgtatgcttggtgattactggaatggtgccatatactttacttggtgaagatgctcctttggctgaggcttttgctgctaaggggctgaaatttgttactgtattgatcagcatcggagctgttgctggtcttactacaacacttcttgttggtttgtatgttcagtcacgtttgtatcttggacttggaagggatggattgctaccttcaatatttgccaaagtacacccaacgcgtcatactcctctgcattctcagatctgggttggttgtgttgcagcagttttggctggtctctttaatgtgcatgaactctctcatattctctcagttggcacgctggtatgtaaacttcagttaatattcgctattacaagtttacaacacataactaccggttattcagttgtatcagcttgtgtaatcacacttcgatggaatgacaagaccaccagttgtcgctcccttggaaatatgtcaatctggcaggagggtgttctatgtcttgtcataattgctctttgtggttttgtagcaggaatgtgctatcggtttagctatgccattgccttcatgataatagctcttctcatagctgttgctgctggttttgctctccagtttcgacaggtatatgtggatccacctggcttttcttgtcctggagttcctattgttccaatggtctctgttttcttcaatatgcttctctttgctcagctgcatgaagaagcttggtatagatttgtcatccttagtctccttgctgtgggtgtctatgctggctatggtcagtaccacgcagttccttcaagttcagaccacccacacccggccgttgcttatcatggaattccttctgaagctccatga

SEQ ID NO: 36895 - protein, 618 aa, Oryza sativa
MEEEGADHRPPSSSSGGRGFLSGLCAAALRRKPISAHAAHAASGEGLVRQLGVFELVLLGIGASIGAGIFVVTGTVARDAGPGVTISFVLAGAACVLNALCYAELASRFPAVVGGAYLYTYAAFNELTAFLVFTQLMLDYHIGAASIARSLASYFVQFLELIPFLKGHIPTWIGHGEEFFGGVVSVNILAPILLIILTTILCYGVKESSAVNTFMTTLKIVIVIVVVFAGVFEVDVSNWSPFMPNGFKSVVTGATVVFFAYVGFDAVANSAEEAKKPQVISVTTHICYYDSMIFALTSLSAHAFKILQRDLPIGILGSLLACVLLYVAVCLVITGMVPYTLLGEDAPLAEAFAAKGLKFVTVLISIGAVAGLTTTLLVGLYVQSRLYLGLGRDGLLPSIFAKVHPTRHTPLHSQIWVGCVAAVLAGLFNVHELSHILSVGTLVCKLQLIFAITSLQHITTGYSVVSACVITLRWNDKTTSCRSLGNMSIWQEGVLCLVIIALCGFVAGMCYRFSYAIAFMIIALLIAVAAGFALQFRQVYVDPPGFSCPGVPIVPMVSVFFNMLLFAQLHEEAWYRFVILSLLAVGVYAGYGQYHAVPSSSDHPHPAVAYHGIPSEAP

SEQ ID NO: 36896 - DNA, 1602 bp, Arabidopsis thaliana
  CDS (1)..(1602)
atgaaggctcgtagtggtcacgagatgaagaagacgttgacgtggtgggatctcatgtggtttggtatcggtgcagtcatcggctctgggatattcgttctcactggactcgaagcacgtaatcattccggtccagccgtcgtgttgtcttacgttgtctctggtgtctccgccatgctctccgtcttttgttacaccgagttcgccgttgagattcccgtcgcaggcggttcttttgcctacttaagagtggagctcggcgacttcatggccttcatcgccgcgggaaacataatcctcgaatacgttgtcggtggagctgccgtggctcgatcgtggacctcttacttcgccactctcttaaaccataaacctgaagacttccgcatcatagttcacaaactcggcgaagactatagccacttagatccaatagccgtcggcgtttgcgccatcatttgtgttttagctgtcgttggcacaaaaggctcctcaagattcaattacattgcttctataatccacatggtcgtgattctctttgttatcatcgccggatttactaaagccgatgtgaaaaactacagcgatttcactccttacggcgttagaggagtgtttaaatccgccgcggttcttttctttgcctatattggatttgatgcggtttcaacgatggctgaggagacaaagaatccagggagagatattcctattggtcttgttggatcgatggtggttactacggtttgttattgtctcatggcggttacgttgtgtcttatgcagccgtatcaacagattgatccggacgcgccattctcggttgcgttttctgccgttggatgggattgggctaagtacattgtcgcctttggggctcttaaaggtatgacgacggttttgttagttggggccattggtcaagctaggtacatgacacacatagcccgagcccatatgatgcctccatggctagctcaagtcaacgcaaagaccggaacaccaattaacgcgaccgtggtaatgcttgccgcgacagctctcatagcattcttcacaaaactgaaaattttagccgatctcttgtctgtttccacacttttcatcttcatgttcgttgctgtggctcttctcgttagaagatattacgtcaccggagaaacatcgacccgtgaccgtaacaagtttttagtgttcttaggtttgattcttgcgtcctctaccgcgactgctgtttattgggctttggaagaagaaggttggattgggtattgcattacggttcctatatggtttctgtctacggttgccatgaagtttcttgtaccgcaagctagggctccgaaaatttggggtgttcctttggttccgtggttgccttctgcttccatcgctattaatatcttccttcttggttccatcgatacaaaatcgttcgttaggtttgcaatctggacaggtattctgctcatatattacgtcttgtttgggttgcacgcaacgtatgatacagctaaggcgacgttgaaggagaagcaggcattgcagaaagctgaggaaggtggtgttgttgctgataattcttgttctgcaacttaa

SEQ ID NO: 36897 - protein, 533 aa, Arabidopsis thaliana
MKARSGHEMKKTLTWWDLMWFGIGAVIGSGIFVLTGLEARNHSGPAVVLSYVVSGVSAMLSVFCYTEFAVEIPVAGGSFAYLRVELGDFMAFIAAGNIILEYVVGGAAVARSWTSYFATLLNHKPEDFRIIVHKLGEDYSHLDPIAVGVCAIICVLAVVGTKGSSRFNYIASIIHMVVILFVIIAGFTKADVKNYSDFTPYGVRGVFKSAAVLFFAYIGFDAVSTMAEETKNPGRDIPIGLVGSMVVTTVCYCLMAVTLCLMQPYQQIDPDAPFSVAFSAVGWDWAKYIVAFGALKGMTTVLLVGAIGQARYMTHIARAHMMPPWLAQVNAKTGTPINATVVMLAATALIAFFTKLKILADLLSVSTLFIFMFVAVALLVRRYYVTGETSTRDRNKFLVFLGLILASSTATAVYWALEEEGWIGYCITVPIWFLSTVAMKFLVPQARAPKIWGVPLVPWLPSASIAINIFLLGSIDTKSFVRFAIWTGILLIYYVLFGLHATYDTAKATLKEKQALQKAEEGGVVADNSCSAT

SEQ ID NO: 36898 - DNA, 1524 bp, Homo sapiens
  CDS (1)..(1524)
atggcgggtgcgggcccgaagcggcgggcgctagcggccccggtggccgaggagaaggaagaggcgcgggagaagatgctggcctccaagcgcgcggacggcgcggcgccggcaggcgagggcgagggcgtgaccctgcagcggaacatcacgctactcaacggcgtggccatcatcgtgggcgccatcatcggctcgggcatcttcgtgacgcccacgggcgtgcttaaggaggcaggctcgccggggctggcgctggtgatgtgggccgcgtgcggcgtcttctccatcgttggcgcgctctgctacgcggagctgggcaccaccatctccaaatcgggcggcgactacgcctacatgctggacgtctacggctcgctgcccgccttcctcaagctctggatcgagctgctcgtcatccggccttcatcgcagtacatcgtggccctggtcttcgccacctacctgctcaagccgctcttccccagctgcccggtgcccgaggaggcagccaagctcatggcctgccactgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatag

SEQ ID NO: 36899 - protein, 507 aa, Homo sapiens
MAGAGPKRRALAAPVAEEKEEAREKMLASKRADGAAPAGEGEGVTLQRNITLLNGVAIIVGAIIGSGIFVTPTGVLKEAGSPGLALVMWAACGVFSIVGALCYAELGTTISKSGGDYAYMLDVYGSLPAFLKLWIELLVIRPSSQYIVALVFATYLLKPLFPSCPVPEEAAKLMACHCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 36900 - DNA, 1485 bp, Homo sapiens
  CDS (1)..(1485)
atggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagggttcctagcactgatgcctgcacaagcatgtgatatgtga

SEQ ID NO: 36901 - protein, 494 aa, Homo sapiens
MVRKPVVSTISKGGYLQGNVNGRLPSLGNKEPPGQEKVQLKRKVTLLRGVSIIIGTIIGAGIFISPKGVLQNTGSVGMSLTIWTVCGVLSLFGALSYAELGTTIKKSGGHYTYILEVFGPLPAFVRVWVELLIIRPAATAVISLAFGRYILEPFFIQCEIPELAIKLITAVGITVVMVLNSMSVSWSARIQIFLTFCKLTAILIIIVPGVMQLIKGQTQNFKDAFSGRDSSITRLPLAFYYGMYAYAGWFYLNFVTEEVENPEKTIPLAICISMAIVTIGYVLTNVAYFTTINAEELLLSNAVAVTFSERLLGNFSLAVPIFVALSCFGSMNGGVFAVSRLFYVASREGHLPEILSMIHVRKHTPLPAVIVLHPLTMIMLFSGDLDSLLNFLSFARWLFIGLAVAGLIYLRYKCPDMHRPFKVPLFIPALFSFTCLFMVALSLYSDPFSTGIGFVITLTGVPAYYLFIIWDKKPRWFRIMSGFLALMPAQACDM

SEQ ID NO: 36902 - DNA, 1851 bp, Arabidopsis thaliana
  CDS (1)..(1851)
atgggttgtttaagaagcttagtaagaaggaaacaattcgactcttcaaatggcaaagcagagactcatcatcatcaccaacagcttgcaaaagcgttgacctttcctcacttgattgccattggtgttggatcaacaattggagcaggggtttatattcttgtgggaacagtagctagagagcattcaggacctgctcttgctttatccttccttatagctggaatttctgctgccctttctgcgttttgttatgcggaactatctagtcgttttccctctgctgggagtgcctatcattattcttacatttgcattggtgaaggtgttgcgtggttgattggctgggcgctgattttggaatacacaattggtggttcaacagttgcccgcggcatatctccaaatctggcaatgattttcggtggtgaagattgtctgcctacaatattagctcgtcatcaaatcccaggccttgatattgttgttgacccgtgtgctgctgtgctagtgttcattgtaacaggactttgttgccttggagtaaaggagagcacatttgctcagggaattgtaacaacagcaaatgtctttgtcatgatatttgtcatagtagctggaagctatttgtgtttcaagacaggttgggttggttatgaacttccaacggggtattttccttacggggttgatggaatgcttactggatctgctactgtcttctttgcctacatcgggtttgatacagttgcaagtatggcagaggaggtgaaaaatccccggcgggatttaccgctcggtattgggatttcgctcctgctttgttgtttgctgtacatgatggtgtctgttgttattgttggtttagtgccgtattatgctatggaccctgacactccaatatcatccgcattttctagtcatggaattcaatgggctgcatatttgataaatttaggtgctgtcatggctctctgttctgcattaatgggctccattctccctcagccgcggattctgatggcaatggctagggatggtctcttgccttcatatttctcatatgtgaatcaacgcacgcaggttccaattaatggcaccataaccactggtgtttgtgcagcaatcttagctttctttatggatgtttcgcaactggcgggaatggtgagtgtcgggacacttgttgcatttacaatggttgcaatatcattgttgatagtcagatatgttgttcctccagatgaggtactgataagattggaactggtacctcttccctcatcacttcaagaaaactcatccagtcacgtcggaacttccatccgtagtaaacaacctttacttggcaaagtggatgattcagttgtcgataaggaaaatgctccaggaagttgggttctcaacaaaaaaaacagacggaaatttgctggttggagcattatgttcacttgtattggaaacttccttttaagctatgcagcgtcaagcttcctcttgccaggactcctccgatattctctatgtggtgttggtggattgttccttcttgtcggtttgattgttctgatttgcatagatcaggatgatgctagacacagttttgggcattctggaggcttcatttgcccgtttgttccgcttttgcctatagtttgcattcttatcaacatgtatctcttggtaaaccttggagctgcgacgtgggttcgtgtatcggtttggctgttcctcggagtggttgtttacattttctatgggagaagaaacagctctcttgtgaatgctgtttatgtctccactgctcatctccaggagattcgtcgcacttctggacattctttggcttaa

SEQ ID NO: 36903 - protein, 616 aa, Arabidopsis thaliana
MGCLRSLVRRKQFDSSNGKAETHHHHQQLAKALTFPHLIAIGVGSTIGAGVYILVGTVAREHSGPALALSFLIAGISAALSAFCYAELSSRFPSAGSAYHYSYICIGEGVAWLIGWALILEYTIGGSTVARGISPNLAMIFGGEDCLPTILARHQIPGLDIVVDPCAAVLVFIVTGLCCLGVKESTFAQGIVTTANVFVMIFVIVAGSYLCFKTGWVGYELPTGYFPYGVDGMLTGSATVFFAYIGFDTVASMAEEVKNPRRDLPLGIGISLLLCCLLYMMVSVVIVGLVPYYAMDPDTPISSAFSSHGIQWAAYLINLGAVMALCSALMGSILPQPRILMAMARDGLLPSYFSYVNQRTQVPINGTITTGVCAAILAFFMDVSQLAGMVSVGTLVAFTMVAISLLIVRYVVPPDEVLIRLELVPLPSSLQENSSSHVGTSIRSKQPLLGKVDDSVVDKENAPGSWVLNKKNRRKFAGWSIMFTCIGNFLLSYAASSFLLPGLLRYSLCGVGGLFLLVGLIVLICIDQDDARHSFGHSGGFICPFVPLLPIVCILINMYLLVNLGAATWVRVSVWLFLGVVVYIFYGRRNSSLVNAVYVSTAHLQEIRRTSGHSLA

SEQ ID NO: 36904 - DNA, 1845 bp, Arabidopsis thaliana
  CDS (1)..(1845)
atggttggcccaatatttattgatttggattctgattatcccgggggtgatttcagtcatcgtctcgatcaatcttcaactctcaaattgaagtttccatgggaggccacgaaggtttcagcaaccaacgcctctcctccgccacatggttctctcatttccgtgcttcagctctccgatctaaatcactgccccctccgtcctcgcagactgccgttcgctccacctctggcgactctctggttcgtcgcctcggccttttcgacctcatactgttgggcgtcggcgcttccatcggcgccggtgtcttcgtcgtcaccggaaccgtcgctcgcgatgctggacctgaatcgcttagtgattattgctgccgttgcgtgcctaggagtcacaatcagcttcttgctagctggagcatcgtgtgtgttgaacgctctctgttatgctgaactttcatctcgtttccctgctgttgttggtggagcttacatgtactcttactcagctttcaatgagatcacagcttttcttgttttcgttcaactcatgcttgactatcatattggcgccgctagtatctcccgtagcttggccagctatgctgttgctcttcttgagctttttccagccctcaagggctctattcctctctggatgggaagcggcaaagagctcttgggagggcttctctctttgaatattttggctcccattttacttgctctcttgacccttgttctatgccaaggtgtgcgagaatcttccgctgtcaactccgttatgactgctactaaggtcgtgatcgttctcgttgtgatttgtgccggtgcttttgaaattgatgtagcaaattggtctccttttgcgcctaatggttttaaagcagttctcactggagctactgttgtcttcttttcatatgttggatttgatgcagttgctaattctgctgaagaatcgaagaaccctcagcgcgatttgccaatcggaattatggggagccttctggtttgtatctcgctgtatattggcgtatgtttggtgctcaccgggatggtcccttttagcctcctcagcgaagatgctcctttagctgaagccttttcatcaaagggtatgaagttcgtctcaatcttaatcagtattggtgctgttgctggactcacaactactctgcttgttggtctttatgttcagtccaggttatatctgggacttggaagggatggtctattgccttcaatcttttccagaatacacccaactcttcatacacctcttcattctcaaatctggtgcggcattgtagctggcgttttagctggcatatttaatgtacatagtctttcccatattctgtctgttggtacattgactgggtattcagttgttgcggcttgtgttgtggcattgagactgaatgataaaaaagatagagagtcgtccaatagatggacatcaagttggcaggaaggcgtcatttgccttgttataattgcatgcagtggttttggtgctggcgtattttaccgtttcagtgcttcagttatatttattctcctctcagttggtgtggcagttgttgcttcagcagttcttcattatcgccaagcttatgctctgcctctaggttctgggtttagctgtcctggtgtacccattgtgccatccgtttgcattttcttcaacatcttcttatttgctcagttgcattatgaagcatggataagatttgttgttgtcagtgtgcttgcaactgccgtttatgccttgtatgggcagtaccacgcagatccgagcatgttggattatcagagggcacctgaaactgaaagcgacgcttag

SEQ ID NO: 36905 - protein, 614 aa, Arabidopsis thaliana
MVGPIFIDLDSDYPGGDFSHRLDQSSTLKLKFPWEATKVSATNASPPPHGSLISVLQLSDLNHCPLRPRRLPFAPPLATLWFVASAFSTSYCWASALPSAPVSSSSPEPSLAMLDLNRLVIIAAVACLGVTISFLLAGASCVLNALCYAELSSRFPAVVGGAYMYSYSAFNEITAFLVFVQLMLDYHIGAASISRSLASYAVALLELFPALKGSIPLWMGSGKELLGGLLSLNILAPILLALLTLVLCQGVRESSAVNSVMTATKVVIVLVVICAGAFEIDVANWSPFAPNGFKAVLTGATVVFFSYVGFDAVANSAEESKNPQRDLPIGIMGSLLVCISLYIGVCLVLTGMVPFSLLSEDAPLAEAFSSKGMKFVSILISIGAVAGLTTTLLVGLYVQSRLYLGLGRDGLLPSIFSRIHPTLHTPLHSQIWCGIVAGVLAGIFNVHSLSHILSVGTLTGYSVVAACVVALRLNDKKDRESSNRWTSSWQEGVICLVIIACSGFGAGVFYRFSASVIFILLSVGVAVVASAVLHYRQAYALPLGSGFSCPGVPIVPSVCIFFNIFLFAQLHYEAWIRFVVVSVLATAVYALYGQYHADPSMLDYQRAPETESDA

SEQ ID NO: 36906 - DNA, 1608 bp, Oryctolagus cuniculus
  CDS (1)..(1608)
atggaaaagggggccaggcaccgacacaacaccgacaagaaccacgcaggtgggagcgaatccgaagatttccccgaggccagctccggagggggcggagtagccctgaagaaagagatcggattggtcagtgcttgtggcatcatcgtagggaacatcatcggctcgggaatctttgtctcaccgaagggcgtgctggagaacgctggctctgtgggccttgctgtcatcgtctggatcgtgacaggtctcatcacagccgtgggagccctctgctatgccgagctcggggtcaccatccccaagtcgggaggtgactactcctacgtcaaggatatctttggaggactggctgggttcctgaggctgtggatcgctgtgctggtgatctaccccaccaaccaagctgtcatcgccctcaccttctccaactacgtgctgcagccactcttccccacctgcttccccccggactccggccttcgactgctggctgccatctgcctgttgctgctgacgtgggtcaactgctccagtgtgcggtgggccacccgcgtccaggacatcttcacggccgggaagctcctggccctggccctcatcatcatcatgggggttgtgcagatatgcaaaggagagtacttctggctggagccgaagaacgcgtttgacaatttccaagaaccggacatcggcctcatcgcgctggcctttcttcagggctcctttgcctacggaggctggaacttccttaattatgtgactgaggaacttgtggatccctataagaaccttcccagagccatcttcatctccatcccactggtcacatttgtgtatgtctttgccaatgtcgcgtatatcactgcaatgtccccccaggagctgctggcgtcaaacgcagtcgctgtgacatttggagagaagctcctgggtgtcatggcctggatcatgcccatctccgtggcgctgtccacatttggaggagtcaatggctctctcttcacctcctcccggctgttctttgctggagccagagaaggccaccttcccagcgtgttggcgatgatccacgtgaaacgctgcacccccatcccagccctgctcttcacttgcctgtccaccctgctgatgctggtcaccagcgacatgtacacgctcatcaactacgtgggcttcatcaactacctcttctacggggtcacggttgctggacagatagttcttcgctggaagaagcctgacatcccccgtcccatcaagatcaacctgctgttccccatcatctacctgctcttctgggccttcctgctgatcttcagcctgtggtcagagcccgtggtctgcggcatcggcctggccatcatgctcacgggggtgcccgtctatttcctgggtgtttactggcaacacaagcccaagtgtttcaacgacttcattgagctgctaaccctggtgagccagaagatgtgcgtggttgtgtatcctgaggtggatgggggctcggggacagaggggacgcgcgaggacatggaggagcagcagcagcccatctgccagccctctcctggcaaggacaaggactcgctggagcagtcccagccctga

SEQ ID NO: 36907 - protein, 535 aa, Oryctolagus cuniculus
MEKGARHRHNTDKNHAGGSESEDFPEASSGGGGVALKKEIGLVSACGIIVGNIIGSGIFVSPKGVLENAGSVGLAVIVWIVTGLITAVGALCYAELGVTIPKSGGDYSYVKDIFGGLAGFLRLWIAVLVIYPTNQAVIALTFSNYVLQPLFPTCFPPDSGLRLLAAICLLLLTWVNCSSVRWATRVQDIFTAGKLLALALIIIMGVVQICKGEYFWLEPKNAFDNFQEPDIGLIALAFLQGSFAYGGWNFLNYVTEELVDPYKNLPRAIFISIPLVTFVYVFANVAYITAMSPQELLASNAVAVTFGEKLLGVMAWIMPISVALSTFGGVNGSLFTSSRLFFAGAREGHLPSVLAMIHVKRCTPIPALLFTCLSTLLMLVTSDMYTLINYVGFINYLFYGVTVAGQIVLRWKKPDIPRPIKINLLFPIIYLLFWAFLLIFSLWSEPVVCGIGLAIMLTGVPVYFLGVYWQHKPKCFNDFIELLTLVSQKMCVVVYPEVDGGSGTEGTREDMEEQQQPICQPSPGKDKDSLEQSQP

SEQ ID NO: 36908 - DNA, 1845 bp, Arabidopsis thaliana
  CDS (1)..(1845)
atgaacagtcttgtgagaagaaaacaagttgattctgttcatcttatcaaaaacgatggacctcatcagcttgccaagaaactatccgccgttgatcttgttgctattggagttgggacaacaattggagcaggagtgtatattcttgtgggaacggtagctagagagcacacaggacctgctcttgctgtatcattcttcattgctggagtagctgctgctctctctgcctgttgttatgctgagcttgcttctcgttgtccatctgctgggagtgcttatcattatgcgtacatttgtcttggagaagggattgcttggttggttggttgggcactggtgttggattatacaattggtggatcagccattgcccgtggcataactccaaatctggtatttgcctttgagttatatgtgtttggtttcagtcaagaagcatctttttttggtggtttggacaatcttcctgtgttcttagctcgacaaactatacccggggttggtattgtggttgatccatgtgctgcacttttgattatgattgtcacgatactactatgttttgggataaaggagagttcaacagtacaagcaattgtaacatcagtgaatgtttgcaccttggttttcatcatagtagttggtggatatttagcttgcaagactggatgggttggatatgatctccccagtgggtactttccttttggactaaatgggatacttgccggatctgctgtagtattcttctcatacattggatttgatactgtaactagtacggctgaggaggtgaaaaatcctcaaagggatcttccattgggaatcgggattgcattactgatatgctgcattttgtatatgcttttatcagtagttattgttggattggtcccatactattcattgaatcctgatactcctatctcctctgcatttggagacagtgggatgcaatgggcagcgtacatcttaaccactggggcaataactgctctatgtgcgagtttgttgggttcccttctggctcagccacgaatattcatggcaatggctagggatggattgttgccagctttcttttcagaaattagcccacgaactcaagtaccagtgaaaagcacaatagctattggtgttcttgccgctgcactcgcatttttcatggatgttgcacagttgtccgagatggttagtgtaggcactctaatggcattcactgccgttgcagtctgtgtgctagttcttagatatgtaccaccagatggagttcccctatcatcttcctcccaaactttgagtgataccgatgaaagtagagctgaaactgaaaattttcttgtggatgctatagaatcttctgattcccctctacttggaaatgaaactgctcgagatgaaaagtattttggaaagaggagaaaaattgctgcctggagtatagctcttgtgtgcataggtgtcctaggtcttgcttcagcagcttcagctgagcgtcttccaagttttcctcgtttcactatatgtggtgtcagtgcagtcatcttgcttggcagtttgattactcttggctacattgacgaggatgaagaaaggcacaactttggacacaaaggagggtttctctgcccattcgtcccataccttccagttctttgcattttgatcaacacctacttgatcatcaacattggagctgggacatggatcagggtcttgatatggctacttattggaagcatgatctatatcttctatggccgatctcacagcttactgaacaatgcggtttacgttcccacaatgacttgtacgagaaaaacaacagatcatcttgcttaa

SEQ ID NO: 36909 - protein, 614 aa, Arabidopsis thaliana
MNSLVRRKQVDSVHLIKNDGPHQLAKKLSAVDLVAIGVGTTIGAGVYILVGTVAREHTGPALAVSFFIAGVAAALSACCYAELASRCPSAGSAYHYAYICLGEGIAWLVGWALVLDYTIGGSAIARGITPNLVFAFELYVFGFSQEASFFGGLDNLPVFLARQTIPGVGIVVDPCAALLIMIVTILLCFGIKESSTVQAIVTSVNVCTLVFIIVVGGYLACKTGWVGYDLPSGYFPFGLNGILAGSAVVFFSYIGFDTVTSTAEEVKNPQRDLPLGIGIALLICCILYMLLSVVIVGLVPYYSLNPDTPISSAFGDSGMQWAAYILTTGAITALCASLLGSLLAQPRIFMAMARDGLLPAFFSEISPRTQVPVKSTIAIGVLAAALAFFMDVAQLSEMVSVGTLMAFTAVAVCVLVLRYVPPDGVPLSSSSQTLSDTDESRAETENFLVDAIESSDSPLLGNETARDEKYFGKRRKIAAWSIALVCIGVLGLASAASAERLPSFPRFTICGVSAVILLGSLITLGYIDEDEERHNFGHKGGFLCPFVPYLPVLCILINTYLIINIGAGTWIRVLIWLLIGSMIYIFYGRSHSLLNNAVYVPTMTCTRKTTDHLA

SEQ ID NO: 36910 - DNA, 1593 bp, Mus musculus
  CDS (1)..(1593)
atgaggcgggacagcgacatggcaagccacatacaacagccaggcgggcacgggaaccccggccctgcgccctcgccttccccgggccctggtcccggcccgggcgcctcggagcgggtggcactcaagaaagagatcgggctggtgagcgcttgcaccatcatcatcgggaacatcattggctcaggcatcttcatctcacccaagggtgtcctggaacactcgggctccgtgggtttggccctcttcgtctgggtcctgggtgggggcgtgacagctctgggctctctctgctatgcagagctgggtgtcgccatccccaagtctggtggggactacgcctatgtcactgagatcttcgggggcctggctggattcctactgctctggagtgctgtcctcatcatgtaccccaccagcctggctgtcatctccatgaccttctccaactatgtgcttcagcctgtctttcccaactgtatccccccagccacagcctctcgagtactctccatggcctgcctgatgctcctgacgtgggtgaacagctccagcgtacgctgggccacgcgcatccaggttatcttcactggtgggaagctgctggcgctgtctctcatcatcactgttggctttgtccagatcttccaaggacactttgaagagctgagacccaccaatgccttcgccttctggatgacaccgtctgtgggtcacctggccctggctttcctccaaggttcttttgccttcagtggctggaacttcctcaactatgtcacggaggagctggttgacccacgcaagaacctacctcgtgccatcttcatttccatcccactggtcacctttgtgtacacattcaccaatgtcgcctacttcactgccatgtccccccaggagttgctgtcctccaacgccgtggcggtgaccttcggcgagaagctgctgggctacttttcgtgggtcatgcccgtctctgtggccctctctacttttggagggatcaatggctacctgttcacctcatccaggctatgcttctctggagcccgagagggacacttacccagcttcctggccatgattcatgtcagacgctgcaccccaatccctgccctccttgtctgttgcggggccacagcggtcatcatgctcgtgggtgacacatacacactcatcaactatgtgtccttcatcaactacctctgctacggagtcactatcctgggcctgcttgtgctgcgctggagacggccggcactccacaggcccattaaggtgaacctcctcgttcctgttgtgtacttggtgttctgggcattcctactggtcttcagcttcatctcggagcccatggtctgtggggtcggcatcatcattatcctcactggggttcccatcttcttcctgggagtgttctggagaagcaaaccaaagtgtgtacacagattcacagagtccatgacacgctggggccaggagctgtgtttcgtggtttacccccagggctccctagaggaggaggaaaatggccccatgggccagccctccccattgcccatcacggacaagcccttgaagacacaatga

SEQ ID NO: 36911 - protein, 530 aa, Mus musculus
MRRDSDMASHIQQPGGHGNPGPAPSPSPGPGPGPGASERVALKKEIGLVSACTIIIGNIIGSGIFISPKGVLEHSGSVGLALFVWVLGGGVTALGSLCYAELGVAIPKSGGDYAYVTEIFGGLAGFLLLWSAVLIMYPTSLAVISMTFSNYVLQPVFPNCIPPATASRVLSMACLMLLTWVNSSSVRWATRIQVIFTGGKLLALSLIITVGFVQIFQGHFEELRPTNAFAFWMTPSVGHLALAFLQGSFAFSGWNFLNYVTEELVDPRKNLPRAIFISIPLVTFVYTFTNVAYFTAMSPQELLSSNAVAVTFGEKLLGYFSWVMPVSVALSTFGGINGYLFTSSRLCFSGAREGHLPSFLAMIHVRRCTPIPALLVCCGATAVIMLVGDTYTLINYVSFINYLCYGVTILGLLVLRWRRPALHRPIKVNLLVPVVYLVFWAFLLVFSFISEPMVCGVGIIIILTGVPIFFLGVFWRSKPKCVHRFTESMTRWGQELCFVVYPQGSLEEEENGPMGQPSPLPITDKPLKTQ

SEQ ID NO: 36912 - DNA, 1500 bp, Escherichia coli
  CDS (1)..(1500)
atgagtaaacacgacaccgacacttcagatcaacacgccgcgaaacgccgctggcttaatgcccacgaagaggggtatcacaaagcgatgggcaatcgccaggtacagatgatcgccattggcggcgcgattggcaccggcttgtttttaggtgcaggagcccgactgcaaatggcgggtccagcactggcactggtttatttaatttgtggcttgttttcgttttttattctgcgtgcattgggtgagctggtgctacaccgcccttccagtggcagttttgtctcttatgcccgtgagtttttgggtgagaaagccgcttatgttgctggctggatgtacttcatcaactgggcgatgacggggattgttgatattaccgccgtcgctctgtatatgcattactggggtgcgtttggcggcgtgccgcagtgggtctttgcgctcgctgcacttaccatcgttggcaccatgaatatgatcggtgtgaaatggtttgcggagatggagttctggtttgcgcttattaaagtgctcgccattgtgacctttttggtcgtgggtacggtgttcctcggtagtggtcagccgctggatggcaacaccactggctttcatttaatcaccgataatggcggcttcttcccccacggtttgctgcctgcgctggtgttgattcagggcgtagtgtttgcttttgcctccattgaaatggtgggtacagctgccggagaatgtaaagatccgcagaccatggtgcctaaagcgattaacagtgtgatttggcgtattggcctgttttacgtcggctccgtggtgttgctggttatgttattgccgtggagcgcgtatcaggcggggcaaagtccgttcgtgacgtttttctctaaactgggtgtgccatatatcggcagcattatgaacattgtggtgctgaccgctgccctctccagcctgaattcaggtctgtactgcaccggacgtattctgcgctcaatggcgatgggcggttccgcaccgagttttatggcgaaaatgagtcgtcagcatgtgccgtatgccgggattctggcgacactggttgtgtatgtcgtcggcgtattcctcaactatctggtgccgtcgcgcgtatttgagattgtgttgaacttcgcgtcgctgggaatcatcgcttcatgggcgtttatcatcgtgtgccagatgcgcctgcgtaaagcgattaaagaaggcaaagcagcggatgtcagttttaaactgcctggcgcgcccttcacttcctggctgacattactgtttttactgagtgtccttgtgctgatggcgttcgattacccgaacgggacttatactatcgcggcgctgccgattatcggtattctgctggttataggctggtttggtgtgcgcaaacgcgttgctgaaattcacagcactgcgccagtcgtcgaggaagatgaagaaaaacaggaaattgtgtttaagcctgaaacggcgagctaa

SEQ ID NO: 36913 - protein, 499 aa, Escherichia coli; identical to SEQ ID NO: 9412

SEQ ID NO: 36914 - DNA, 1494 bp, Salmonella typhimurium
  CDS (1)..(1494)
atgaaaacacagactacgcacgccgcagaacaacatgcggcgaaacgacgctggctgaacgcccatgaagaggggtatcacaaagcgatggggaatcgtcaggttcagatgattgctatcggcggcgcgattggcaccggtttatttttaggtgcaggcgcccgattgcaaatggccggaccggcactggcgctggtctatctgatatgcggcattttttcttttttcattttacgcgcgctgggcgaactggtattgcatcgcccttccagcgggagcttcgtctcctacgcccgtgaatttttgggtgaaaaagcggcctacgtcgcaggctggatgtactttattaactgggcgatgaccgggatcgtcgatatcaccgcagtggcgttatacatgcactactggggcgcatttggcgacgttccgcaatgggtgttcgcgctcggcgcgttaaccattgtcggtaccatgaacatgatcggcgtaaaatggtttgccgaaatggagttctggttcgcgctgataaaagtactcgccattgttatcttcctggtggtaggcacgatttttctcggtaccggtcaaccgcttgagggtaatgccaccggttttcacctgattacagataatggcggctttttcccgcacggcctgttgcccgcgctggtactgattcagggcgtggtgttcgcttttgcttcgattgaactggtcggtaccgccgctggggagtgcaaagatccacagaagatggtgccaaaagccatcaatagcgtgatctggcgtattggtcttttctatgtaggatcggtcgtattgctggttttgctgctgccgtggaacgcctaccaggcggggcaaagtccgtttgtcaccttcttttctaaacttggcgtgccttatatcggcagtattatgaatatcgtggtgttaaccgccgcgctttccagcctgaactccgggctttactgtacggggagaattttacgttcaatgtcgatggggggttccgcgccgaaattcatggcgaaaatgagccgtcagcatgtgccctatgcgggtattctggcgactctggtggtttacgtggtcggcgtgttcctgaattacctggtcccctcccgcgtgttcgagatcgttcttaattttgcctcgctcggcattatcgcgtcgtgggcgtttatcatggtgtgccagatgcgtttacgccaggcgataaaagaaggcaaagccgcagacgtcagttttaaactgcccggcgcgccttttacctcctggctaacactgctgtttttactaagcgtgctggtactcatggcgtttgactacccgaatggaacttatactatcgcctcgttgccgctgatcgctattctgctggtcgccggctggtttggcgtgcgacgtcgcgtggcggagatccatcgcactgcgccagtgacggcggattcgacagagagtgtcgtattgaaagaagaagcagcgacataa

SEQ ID NO: 36915 - protein, 497 aa, Salmonella typhimurium
MKTQTTHAAEQHAAKRRWLNAHEEGYHKAMGNRQVQMIAIGGAIGTGLFLGAGARLQMAGPALALVYLICGIFSFFILRALGELVLHRPSSGSFVSYAREFLGEKAAYVAGWMYFINWAMTGIVDITAVALYMHYWGAFGDVPQWVFALGALTIVGTMNMIGVKWFAEMEFWFALIKVLAIVIFLVVGTIFLGTGQPLEGNATGFHLITDNGGFFPHGLLPALVLIQGVVFAFASIELVGTAAGECKDPQKMVPKAINSVIWRIGLFYVGSVVLLVLLLPWNAYQAGQSPFVTFFSKLGVPYIGSIMNIVVLTAALSSLNSGLYCTGRILRSMSMGGSAPKFMAKMSRQHVPYAGILATLVVYVVGVFLNYLVPSRVFEIVLNFASLGIIASWAFIMVCQMRLRQAIKEGKAADVSFKLPGAPFTSWLTLLFLLSVLVLMAFDYPNGTYTIASLPLIAILLVAGWFGVRRRVAEIHRTAPVTADSTESVVLKEEAAT

SEQ ID NO: 36916 - DNA, 1470 bp, Streptomyces coelicolor
  CDS (1)..(1470)
gtgagcaaggacgccgtcgacacggcacaggtcgccgcccatccccaggcgaccgggaccatccccgcggacgcgggcgacgccggttacagcaaggacctcaaggcccgtcacgtcaacatgatcgccatcggcggcgcgatcggcaccggcctcttcctcggcgccggcgggcggctgcgcgacgccggaccggcgctcgccatcgcctacctcgtcgccggcgtcttcgccttcttcgtcgtcaaggcactgggcgagctggtgctgtaccggccctcctccggatccttcgtgtcgtacgcgcgcgagttcctcggtgagaagggcgcctacgtcgccggctggatgtacttcctgaactggtccacgaccggtatcgccgacatcaccgcgatcgcgctgtacacgcactactggagcatgttcacgagcatcccccaatgggtgctcgccctcgtcgccctcgcggtggtcctggccgtgaacctgatctcggtgaagatcttcggcgagatggagttctggttcgcgatcgtcaaggtcgccaccctcgtcggcttcatgctgatcggaatcttcctgctcgccacccagcacgaggtgagcgggcagaccccgggcatgggcatgatcaccgaccacggcggcatcctcccgcacggtgtgatgcccgtggtcctcgtcatgcagggcgtgatcttctcctacgcggccctcgaactggtcggcgtcgccgccggcgagaccgccgagccgcacaagatcgttcctcgtgcggtgaactcgatcatgtggcgggtggccctgttctacgtcggctcggtcgtgctcctggccctgctgctgccgagttcgctctactcgggcgacgagagccccttcgtcacggtgctgtcggggatcggtgtgccggccgccggtgacgtgatgaacctcgtcgtcctcaccgccgcgatgtcgtcgctgaactccggcctgtactccaccggccgcatcctgcgttccatggcgatggccggctccgcgcccaggttcaccggcgtgatgagccgcagtcaggtcccctacggcggcatcctgctgacctgcgcggtctgcgtcctcggtgtcggactgaactacctggtgccgagcaaggccttcgagatcgtgctgaacgtcgcctcgctgggcatcatcagcacgtgggtgatcatcatgatctgccacctggtgttcgtccgccgggcgcgtgcgggcctggtcgaacggccgggcttccggctgcccggcagccccgtcacggagatcgtcaccatcgccttcctgctggcggtcgtcggcctgatgtggaacgacgaggaggtcggccgcaagaccgtgctgctggtgcccgtgatcgcggtgatgctggtggccggctggttcggcgtccggcgccgggtcgcgcaccaggccgggcaggaacggccggcgccgagggagtag

SEQ ID NO: 36917 - protein, 489 aa, Streptomyces coelicolor; identical to SEQ ID NO: 9150

SEQ ID NO: 36918 - DNA, 1563 bp, Bacillus subtilis
  CDS (1)..(1563)
atgtctaaacaaggaaattttcaaaaatcaatgtcgctgtttgatctgattttgattgggatgggagccatctttggatcagcgtggctgttcgctgtcagtaatgtcgcttcaaaagcagggccctccggcgctttttcctggatcctcggaggagccattattttgttaatcgggcttgtatatgcggagctcggagccgctctgccccgtaccggaggcatcattcgataccccgtttattcacatggccaccttgtcggctacttaatttcgtttgtcacgattgtcgcttatacaagcttgatttcaattgaagtgacagctgtgcgccagtatgtggcctattggtttcccggcctgaccattaaagggtctgattcgcctaccatttccggctggatcttgcagtttgccctattatgcttgtttttcctgctgaattattggagcgtcaaaaccttcgctaaggcgaatttcatcatatcgatttttaaatatattgtgccgattaccatcattattgtgctgatctttcattttcagccggagaatttatccgttcaaggatttgcaccgtttggatttacaggtattcaggctgccatctcgacaggcggcgtcatgtttgcgtatctcggcctgcatccgattgtatctgtagcaggtgaagtccaaaatccaaaacgcaatatcccgatcgctttaatcatttgcatcatcgtttcaaccatcatttatactgttttgcaggtcacctttattggtgcaatcccgacagaaacactgaaacatggctggccggcaattggccgggagttctcattgccgtttaaggatattgcggtcatgctcgggttaggctggcttgcaacgcttgtcattttagacgccattctgtctcccggaggaaacgggaatatctttatgaatacgacatcccgccttgtttacgcctgggcgcgtaacggcacattatttggcatattctcaaaggtcaataaagatacggggacaccccgcgcttcgctttggctttcgtttgccctgtccattttctggacacttccctttccttcgtggaacgcgctcgtcaatgtctgttcagtcgcgctcattctttcatatgcgattgcacccatttcttcagctgcgctgagggtcaacgcgaaggacttaaacaggccgttttatttaaagggaatgagcattatcgggccgctttcctttatatttacagcgtttatcgtgtactggtcaggatggaaaacagtctcctggctgctcggttcacaactcgtgatgtttttgatctatctctgtttcagcaaatatacgcctaaagaagatgtcagccttgctcagcagctgaaatcagcctggtggcttatcgggttttatattatgatgctgatcttttcctacatcggttctttcggacatggtttagggattatcagcaatcccgtcgacctcattttagtcgcgatcggctcacttgcgatttattactgggcaaagtataccgggctcccaaaagccgccattgattatgataaataa

SEQ ID NO: 36919 - protein, 520 aa, Bacillus subtilis
MSKQGNFQKSMSLFDLILIGMGAIFGSAWLFAVSNVASKAGPSGAFSWILGGAIILLIGLVYAELGAALPRTGGIIRYPVYSHGHLVGYLISFVTIVAYTSLISIEVTAVRQYVAYWFPGLTIKGSDSPTISGWILQFALLCLFFLLNYWSVKTFAKANFIISIFKYIVPITIIIVLIFHFQPENLSVQGFAPFGFTGIQAAISTGGVMFAYLGLHPIVSVAGEVQNPKRNIPIALIICIIVSTIIYTVLQVTFIGAIPTETLKHGWPAIGREFSLPFKDIAVMLGLGWLATLVILDAILSPGGNGNIFMNTTSRLVYAWARNGTLFGIFSKVNKDTGTPRASLWLSFALSIFWTLPFPSWNALVNVCSVALILSYAIAPISSAALRVNAKDLNRPFYLKGMSIIGPLSFIFTAFIVYWSGWKTVSWLLGSQLVMFLIYLCFSKYTPKEDVSLAQQLKSAWWLIGFYIMMLIFSYIGSFGHGLGIISNPVDLILVAIGSLAIYYWAKYTGLPKAAIDYDK

SEQ ID NO: 36920 - DNA, 1602 bp, Rattus norvegicus
  CDS (1)..(1602)
atggaaaagggaacccgacagcgaaacaacaccgcgaagaaccacccggaccgcggatctgacaccagccctgaggccgaggctagctcgggagggggcggagtagccctgaagaaagagatcggattggtcagcgcctgtggtatcattgtagggaacatcattggctccggaatcttcgtctcaccaaagggtgtgctggagaacgctggctcggtgggccttgctctcattgtctggatcgtgacgggtgtcatcacggctgtgggagctctctgctatgctgaactaggtgtcaccatccctaaatctggaggtgattactcctatgtcaaggacatcttcggaggactggctgggttcctgcggctatggattgctgtgctggtgatctaccccaccaaccaagctgtcatcgccctcaccttctccaactatgtgctgcagccactcttccctacctgcttcccccctgagtccggcctgcgactcctggctgccatctgcctgttgctgctcacatgggtcaactgctccagtgtccgatgggccacccgggttcaagatatcttcacggctgggaagctcctggccctggctctgatcatcatcatgggtgttgtgcagatatgcaaaggagaattcttttggctggagccaaagaatgcatttgagaatttccaagaaccagacatcggcctcgtcgctctggctttcctccagggctcctttgcctacggaggctggaacttccttaattacgtgacggaggaacttgtggatccttacaagaaccttcctagagccatcttcatttccatcccactggtcacatttgtgtacgtctttgctaatatcgcctatgtcactgcaatgtccccccaggagctgctggcctcaaatgcagtcgctgtgacttttggagagaagctcctaggggtcatggcctggatcatgcccatttccgtcgccctgtccacatttggtggagtcaacggttccctcttcacctcctcccggctgttctttgctggagccagagaaggccaccttcccagcgtgttagccatgatccacgtgaagcgctgcaccccaatcccagcactgctcttcacatgcctctccaccctgctgatgctggtcaccagtgacatgtatacactcatcaactacgtgggcttcatcaactacctcttctacggggttacagttgcaggacagatagtccttcgctggaagaagcctgacatcccccgccccatcaagatcagcctgctgtttcccatcatctacttgctgttctgggccttcctgctgattttcagcctgtggtcagagccagtagtatgcggcattggccttgccatcatgctgacgggtgttcctgtatacttcctgggtgtctactggcaacacaaacccaagtgtttcaatgacttcattgagtccctaactctagtgagtcagaagatgtgtgtggtcgtgtatccccaggagggggactcggggaccgaggaaacaattgatgacgtagaggaacaacacaagcctatcttccagcctactcctgtcaaggacccagactcggaggagcagccctga

SEQ ID NO: 36921 - protein, 533 aa, Rattus norvegicus
MEKGTRQRNNTAKNHPDRGSDTSPEAEASSGGGGVALKKEIGLVSACGIIVGNIIGSGIFVSPKGVLENAGSVGLALIVWIVTGVITAVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGVVQICKGEFFWLEPKNAFENFQEPDIGLVALAFLQGSFAYGGWNFLNYVTEELVDPYKNLPRAIFISIPLVTFVYVFANIAYVTAMSPQELLASNAVAVTFGEKLLGVMAWIMPISVALSTFGGVNGSLFTSSRLFFAGAREGHLPSVLAMIHVKRCTPIPALLFTCLSTLLMLVTSDMYTLINYVGFINYLFYGVTVAGQIVLRWKKPDIPRPIKISLLFPIIYLLFWAFLLIFSLWSEPVVCGIGLAIMLTGVPVYFLGVYWQHKPKCFNDFIESLTLVSQKMCVVVYPQEGDSGTEETIDDVEEQHKPIFQPTPVKDPDSEEQP

SEQ ID NO: 36922 - DNA, 1374 bp, Escherichia coli
  CDS (1)..(1374)
atggaaagtaagaacaagctaaagcgtgggctaagtacccgccacatacgctttatggcactgggttcagcaattggcaccgggctgttttacggttcggcagacgccatcaaaatggccggtccgagcgtgttgttggcctatattatcggtggtatcgcggcgtatatcattatgcgtgcgctgggggaaatgtcggtacataacccggccgccagctctttctcgcgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtactgagcgtggtgctgatcatttgcgccgtaaacctgatgagcgtgaaggtattcggtgagctggaattctggttctcgttctttaaagtcgccaccatcatcatcatgattgtcgccggtttcggcatcatcatctgggggattggcaacggcgggcaaccgaccggtattcataacctgtggagcaacggcggcttcttcagtaacggctggcttggcatggtaatgtcgttgcaaatggtgatgtttgcttacggtgggatcgaaattatcgggattaccgccggtgaagcgaaagatcctgagaaatcgataccgcgtgcgattaactccgtgccgatgcgtattctggtgttctacgtcggtacgctgttcgtcattatgtctatctacccgtggaatcaggttggcactgccggtagcccgttcgtgctgacgttccagcatatgggcattacctttgccgccagcattcttaactttgttgtgctgactgcttcgctgtcggcaattaacagtgatgtatttggcgtaggccgtatgctccacggtatggcagagcagggcagcgcgccgaaaattttcagcaaaacgtcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaattgccttccgtcgccgtttgccgccagaagaagttaaggcgctgaaatttaaagtgccgggtggggtagcaacgaccatcggcgggctgattttcctgctctttattatcgggttgattggttatcacccggatacgcgtatctcgctgtatgtcggtttcgcgtggattgttgtgctgttgattggctggatgtttaaacgccgccacgatcgtcagctggctgaaaaccagtaa

SEQ ID NO: 36923 - protein, 457 aa, Escherichia coli; identical to SEQ ID NO: 9056

SEQ ID NO: 36924 - DNA, 1371 bp, Salmonella typhimurium
  CDS (1)..(1371)
atggaaagcaataataagctaaagcgtgggctgagcacccggcacattcgctttatggcattaggttcggcaatcggcaccggcctgttttacggctcggcggacgccatcaaaatggcggggccgagcgtgctgttggcctatattattggcggggtcgcggcatatatcattatgcgcgcattgggggaaatgtccgttcacaaccctgccgccagctcattttcgcgctatgcgcaggaaaacctcggcccgcttgcgggctacattaccggctggacctactgttttgagatcctgatcgtcgccattgccgacgtgaccgcgttcggcatttacatgggagtctggttccccgccgtgccgcactggatttgggtacttagcgtggtgctgatcatttgcgccatcaacctgatgagcgtcaaggtgttcggcgagctggagttttggttctccttcttcaaagtcgccaccattattatcatgattgtcgcgggtatcggcatcattgtgtggggaattggcaacggcgggcagccgaccggcattcataacctgtggagcaacggcggcttcttcagcaatggctggttgggaatgatcatgtcgctgcaaatggtgatgttcgcttacggcgggattgagattatcggtatcaccgccggggaagcgaaagacccggagaaatccattccgcgcgccattaactcagtaccgatgcgtatcctggtattttatgtcggcacgctgttcgtcattatgtctatctatccgtggaatcaggtcggcacaaacggcagtccatttgtgctgacgttccagcatatggggattacctttgccgccagcattctgaactttgtggtattgaccgcctcgctttccgctatcaactccgatgtgtttggcgtaggccgtatgctgcatggtatggcggagcaggggagcgcgccgaaagtctttgctaaaacgtcacgccgtggtattccgtgggtcactgtgctggtgatgacgattgcgctgctgtttgcggtttacctgaactacatcatgccggaaaacgtcttcctggtgattgcttcgctggcgacgtttgcgacggtatgggtatggattatgatcctgctgtcgcaaatcgccttccgtcgtcgtttaccgccggaagaggtaaaagcgctgaaatttaaggtgccgggcggtgtcgtaacgacgatagcgggtctgattttcctggtcttcattattgcgcttatcggctaccatccggatacccgcatctcactgtatgtgggcttcgcctggatagttctgctgttgattggctggatatttaaacgccgtcgcgaccgtcaattggcgcaggcgtag

SEQ ID NO: 36925 - protein, 456 aa, Salmonella typhimurium; identical to SEQ ID NO: 9418

SEQ ID NO: 36926 - DNA, 1509 bp, Mus musculus
  CDS (1)..(1509)
atggtcagaaagccagttgtggccaccatctccaaaggaggttacctgcagggcaatatgagcgggaggctgccctccatgggggaccaagagccacctgggcaggagaaggtagttctgaaaaagaagatcactttgctgaggggggtctccatcatcatcggcaccgtcatcggatcaggcatcttcatctcccccaagggcatactccagaacacgggcagcgtgggcatgtccctggttttctggtctgcctgtggagtactgtcactttttggagccctgtcctatgcagaattaggtacaagcataaagaaatctggtggtcattacacatacattctggaggtctttggtcctttgctggcttttgttcgagtctgggtggaactgctcgtaatacgccctggagctactgctgtgatatccctggcatttggacgctacatcctggaaccattttttattcaatgtgaaattcctgaacttgcaatcaagctcgtgacagctgtgggcatcactgtggtgatggtcctaaatagcacgagtgtcagctggagtgcccggatccagattttcctaaccttttgcaagctcacagcaattctgataattatagtccctggagttatacagctaattaaagggcaaacacatcactttaaagatgcattttcaggaagagacacaagtctaatggggttgcccttggctttttattatgggatgtatgcatatgctggctggttttacctcaactttattactgaagaagtagacaaccctgaaaaaaccatcccccttgcaatctgcatctccatggctatcatcacagtgggctacgtactgacaaacgtggcctattttaccaccatcagtgcggaggagctgctgcagtccagcgccgtggcggtgaccttctctgagcggctgctgggaaaattctcattagcagtcccgatctttgttgccctctcctgcttcggctccatgaacggtggtgtgttcgctgtctccaggttattctacgtcgcatctcgagaagggcaccttccggaaatcctctctatgattcatgtccacaagcacactcctctgccagctgttattgttttgcatcctctgacgatggtgatgctcttctccggagacctctatagtcttctaaatttcctcagttttgccaggtggctttttatggggctggcagtcgcaggactgatttatcttcgatacaaacgcccagatatgcatcgtcctttcaaggtgcctctcttcatcccggcactattttccttcacctgcctcttcatggttgtcctctctctttactcggacccattcagcaccggggtcggttttcttatcaccttgactggggtccctgcatattatctcttcattgtatgggacaagaaacccaagtggttcagacgattatcagacagaataaccagaacattacagattatactagaagttgtaccagaagactctaaagaattatga

SEQ ID NO: 36927 - protein, 502 aa, Mus musculus
MVRKPVVATISKGGYLQGNMSGRLPSMGDQEPPGQEKVVLKKKITLLRGVSIIIGTVIGSGIFISPKGILQNTGSVGMSLVFWSACGVLSLFGALSYAELGTSIKKSGGHYTYILEVFGPLLAFVRVWVELLVIRPGATAVISLAFGRYILEPFFIQCEIPELAIKLVTAVGITVVMVLNSTSVSWSARIQIFLTFCKLTAILIIIVPGVIQLIKGQTHHFKDAFSGRDTSLMGLPLAFYYGMYAYAGWFYLNFITEEVDNPEKTIPLAICISMAIITVGYVLTNVAYFTTISAEELLQSSAVAVTFSERLLGKFSLAVPIFVALSCFGSMNGGVFAVSRLFYVASREGHLPEILSMIHVHKHTPLPAVIVLHPLTMVMLFSGDLYSLLNFLSFARWLFMGLAVAGLIYLRYKRPDMHRPFKVPLFIPALFSFTCLFMVVLSLYSDPFSTGVGFLITLTGVPAYYLFIVWDKKPKWFRRLSDRITRTLQIILEVVPEDSKEL

SEQ ID NO: 36928 - DNA, 1308 bp, Methanococcus jannaschii
  CDS (1)..(1308)
atggagttaaaaaataaaaagcttagtttgtgggaagctgtttctatggctgttggtgtaatgattggggcaagtatattttctatatttggagttggagctaaaatagctggaagaaaccttccagaaacatttatattgtctggaatttatgcacttttagttgcttattcctatacaaaacttggagcaaagatagtttcaaatgcgggacctattgcattcatccataaagccattggagataatataataactggagctttgagcattttattatggatgagttacgttatatccattgctctatttgcaaaagggtttgctggctatttcttacctttaataaatgctccaataaatacattcaatattgccataactgaaataggcatagttgcgtttttcactgctctgaatttctttggttctaaggctgtagggagggctgaattttttattgttttggttaagctcttaatattagggttgtttatatttgctgggttgataacaattcatccatcttatgtaattccagatttagccccatctgcagtaagtgggatgatttttgcatcagctatattcttcctatcatatatgggttttggagttataactaatgcctcagaacatattgaaaaccctaaaaagaacgttccaagggctatatttataagcatattgattgtgatgtttgtgtatgttggagtagccatttcagcaataggaaatttaccaatagatgaactaattaaagccagtgaaaatgccttagcagtggcggcaaaaccattcttaggaaacttagggtttttattaatatctataggagctttattttcaatttcatcagcaatgaacgccacaatatacggaggggctaatgttgcctattcattagcaaaagacggagaacttccagaattctttgagagaaaggtatggtttaaatccacagagggactttatataacctcagcccttggagtgttgtttgcattactgtttaatatggagggggtggcatcaataacaagtgccgtatttatggttatatatctctttgttattctctcccactatatccttatcgatgaagttggagggagaaaagagattgtaatctttagctttattgttgtattaggagtttttctacttttattgtattatcagtggataaccaatagatttgtgttttatgggataatagcaacatttattggagtgctgatatttgagattatctatagaaaagtaacaaaaagaacattctccaacaatatgtatgttaaaagctaa

SEQ ID NO: 36929 - protein, 435 aa, Methanococcus jannaschii
MELKNKKLSLWEAVSMAVGVMIGASIFSIFGVGAKIAGRNLPETFILSGIYALLVAYSYTKLGAKIVSNAGPIAFIHKAIGDNIITGALSILLWMSYVISIALFAKGFAGYFLPLINAPINTFNIAITEIGIVAFFTALNFFGSKAVGRAEFFIVLVKLLILGLFIFAGLITIHPSYVIPDLAPSAVSGMIFASAIFFLSYMGFGVITNASEHIENPKKNVPRAIFISILIVMFVYVGVAISAIGNLPIDELIKASENALAVAAKPFLGNLGFLLISIGALFSISSAMNATIYGGANVAYSLAKDGELPEFFERKVWFKSTEGLYITSALGVLFALLFNMEGVASITSAVFMVIYLFVILSHYILIDEVGGRKEIVIFSFIVVLGVFLLLLYYQWITNRFVFYGIIATFIGVLIFEIIYRKVTKRTFSNNMYVKS

SEQ ID NO: 36930 - DNA, 1323 bp, Mycobacterium tuberculosis
  CDS (1)..(1323)
atgagacgcccgctagacccacgcgatattccagatgagctgcggcgacggctggggctcttggatgcggtggtgatcgggcttgggtccatgatcggtgccggaatctttgccgccctggccccggccgcgtacgcggccggttctgggttgttgctcgggttggcagtggccgcggtggtggcctactgcaatgcgatctcgtcggcgcggctggccgcgcgctacccggcctcggggggcacctatgtgtatggccggatgcggctgggcgacttctggggatacctggcgggctggggctttgtggtcggcaagacggcatcgtgtgcggcgatggcgttgacggtcggcttctatgtgtggcccgcgcaagcgcacgcggtggccgtcgccgtggtggtggcactgaccgcggtgaactacgccgggatacagaagtccgcctggctcacccggtcgatcgtcgccgtggtgttggtggtcttgaccgcagtcgtggtcgccgcctatggctccggcgctgcggacccggcgcgactcgatatcggtgtagatgcacacgtctgggggatgctgcaggcggccggcctgctgtttttcgcgttcgccggctatgcccgcatcgccacgctgggggaggaggtccgcgacccggcccgcacgatcccacgcgccatcccgctggcgctgggcatcaccctggcggtgtatgccctggtcgccgtggccgtgatcgctgtgttgggtccgcagcggctcgcgcgggccgccgccccgttgtcggaggccatgcgggtcgcgggggtgaactggctgattcccgtcgtgcagataggggccgcggtggccgcattgggctcgctactggccttgattctcggggtctcccgcaccaccttggcgatggcacgcgaccggcacctaccgcgctggctggccgccgtgcaccctaggttcaaggtgccctttcgtgccgaactggtggttggcgcggtggtggcggcgctggcggcgacagcggatatccgtggtgcgatcggcttttcgtccttcggtgtgctggtctactacgcgatcgccaacgcctccgccttgactctggggctcgacgagggccggccccgccgcctgattccgctggtgggactgatcggctgcgtagtcctggcgttcgcgctgccactctcctcggtggccgccggggccgcggtgctcggtgtcggtgtggcggcatacggtgtgcgccgcatcatcactcgtcgagcacgacagactgattctggtgatacccaacgaagtggtcatccgtccgcaacctag

SEQ ID NO: 36931 - protein, 440 aa, Mycobacterium tuberculosis
MRRPLDPRDIPDELRRRLGLLDAVVIGLGSMIGAGIFAALAPAAYAAGSGLLLGLAVAAVVAYCNAISSARLAARYPASGGTYVYGRMRLGDFWGYLAGWGFVVGKTASCAAMALTVGFYVWPAQAHAVAVAVVVALTAVNYAGIQKSAWLTRSIVAVVLVVLTAVVVAAYGSGAADPARLDIGVDAHVWGMLQAAGLLFFAFAGYARIATLGEEVRDPARTIPRAIPLALGITLAVYALVAVAVIAVLGPQRLARAAAPLSEAMRVAGVNWLIPVVQIGAAVAALGSLLALILGVSRTTLAMARDRHLPRWLAAVHPRFKVPFRAELVVGAVVAALAATADIRGAIGFSSFGVLVYYAIANASALTLGLDEGRPRRLIPLVGLIGCVVLAFALPLSSVAAGAAVLGVGVAAYGVRRIITRRARQTDSGDTQRSGHPSAT

SEQ ID NO: 36932 - DNA, 1257 bp, Escherichia coli
  CDS (1)..(1257)
atgagtggactcaaacaagaactggggctggcccagggcattggcctgctatcgacgtcattattaggcactggcgtgtttgccgttcctgcgttagctgcgctggtagcgggcaataacagcctgtgggcgtggcccgttttgattatcttagtgttcccgattgcgattgtgtttgcgattctgggtcgccactatcccagcgcaggcggcgtcgcgcacttcgtcggtatggcgtttggttcgcggcttgagcgagtcaccggctggctgtttttatcggtcattcccgtgggtttgcctgccgcactacaaattgccgccgggttcggccaggcgatgtttggctggcatagctggcaactgttgttggcagaactcggtacgctggcgctggtgtggtatatcggtactcgcggtgccagttccagtgctaatctacaaaccgttattgccggacttatcgtcgcgctgattgtcgctatctggtgggcgggcgatatcaaacctgcgaatatcccctttccggcacctggtaatatcgaacttaccgggttatttgctgcgttatcagtgatgttctggtgttttgtcggtctggaggcatttgcccatctcgcctcggaatttaaaaatccagagcgtgattttcctcgtgctttgatgattggtctgctgctggcaggattagtctactggggctgtacggtagtcgtcttacacttcgacgcctatggtgaaaaaatggcggcggcagcatcgcttccaaaaattgtagtgcagttgttcggtgtaggagcgttatggattgcctgcgtgattggctatctggcctgctttgccagtctcaacatttatatacagagcttcgcccgcctggtctggtcgcaggcgcaacataatcctgaccactacctggcacgcctctcttctcgccatatcccgaataatgccctcaatgcggtgctcggctgctgtgtggtgagcactttggtgattcatgctttagagatcaatctggacgctcttattatttatgccaatggcatctttattatgatttatctgttatgcatgctggcaggctgtaaattattgcaaggacgttatcgactactggcggtggttggcgggctgttatgcgttctgttactggcaatggtcggctggaaaagtctctatgcgctgatcatgctggcggggttatggctgttgctgccaaaacgaaaaacgccggaaaatggcataaccacataa

SEQ ID NO: 36933 - protein, 418 aa, Escherichia coli
MSGLKQELGLAQGIGLLSTSLLGTGVFAVPALAALVAGNNSLWAWPVLIILVFPIAIVFAILGRHYPSAGGVAHFVGMAFGSRLERVTGWLFLSVIPVGLPAALQIAAGFGQAMFGWHSWQLLLAELGTLALVWYIGTRGASSSANLQTVIAGLIVALIVAIWWAGDIKPANIPFPAPGNIELTGLFAALSVMFWCFVGLEAFAHLASEFKNPERDFPRALMIGLLLAGLVYWGCTVVVLHFDAYGEKMAAAASLPKIVVQLFGVGALWIACVIGYLACFASLNIYIQSFARLVWSQAQHNPDHYLARLSSRHIPNNALNAVLGCCVVSTLVIHALEINLDALIIYANGIFIMIYLLCMLAGCKLLQGRYRLLAVVGGLLCVLLLAMVGWKSLYALIMLAGLWLLLPKRKTPENGITT

SEQ ID NO: 36934 - DNA, 24 bp, Primer
atgatgaacacggaaggtaataac

SEQ ID NO: 36935 - DNA, 24 bp, Primer
ttatacggttttattgcgcttcat

SEQ ID NO: 36936 - protein, 78 aa, consensus
  MISC_FEATURE (1)..(78): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXXXXXXX

SEQ ID NO: 36937 - protein, 38 aa, consensus
  MISC_FEATURE (1)..(38): consensus for the disclosure of xaa see table XV
XXXXXXXXXXXXXXXXXXXXXXXXXXXXXXXXXXXXXX

SEQ ID NO: 36938 - DNA, 969 bp, Escherichia coli K12
  CDS (1)..(969)
atggctcagctttcgttacaacatattcaaaaaatctacgataaccaggtgcatgtggtgaaggacttcaacctggaaattgccgataaagagttcatcgtgtttgtcggcccgtcgggctgcggtaagtcgaccaccctgcgcatgattgccgggcttgaggagatcagcggcggcgatctgttgatcgacggcaaacgaatgaatgacgttccagccaaagcacgcaatatagcgatggtgttccagaactacgcgttgtatccgcatatgacggtttacgacaacatggcgtttggtctgaagatgcaaaaaatcgccaaagaggtgattgatgagcgggtgaactgggcggcgcaaattctcggcctgcgtgagtacctgaaacgtaagccgggggcgctttccggcgggcaacgtcagcgagtggcgcttgggcgggcgattgtacgcgaagcgggcgtgtttttaatggatgaaccgctctctaaccttgatgccaagctgcgcgtgcaaatgcgcgcagagatcagcaagctgcatcagaaactgaacaccaccatgatctacgtgacccacgatcagaccgaagcgatgaccatggcgacgcggattgtgattatgaaagacgggattgttcagcaagtaggtgcgccgaaaaccgtttataaccaacccgcgaatatgtttgtttccggatttattggatcaccagcgatgaattttattcgcggcacgatcgatggcgataaattcgttacggaaacgcttaaattaaccattcccgaagagaaattagcggttctgaaaacacaggaaagtttgcataagcccatcgtgatgggaatacgaccggaagatattcatccggacgcgcaagaggaaaataacatttccgccaaaattagcgtggcagaattaaccggtgcggaatttatgctctacaccacggttgggggcacgagttag

SEQ ID NO: 36939 - protein, 322 aa, Escherichia coli K12
MAQLSLQHIQKIYDNQVHVVKDFNLEIADKEFIVFVGPSGCGKSTTLRMIAGLEEISGGDLLIDGKRMNDVPAKARNIAMVFQNYALYPHMTVYDNMAFGLKMQKIAKEVIDERVNWAAQILGLREYLKRKPGALSGGQRQRVALGRAIVREAGVFLMDEPLSNLDAKLRVQMRAEISKLHQKLNTTMIYVTHDQTEAMTMATRIVIMKDGIVQQVGAPKTVYNQPANMFVSGFIGSPAMNFIRGTIDGDKFVTETLKLTIPEEKLAVLKTQESLHKPIVMGIRPEDIHPDAQEENNISAKISVAELTGAEFMLYTTVGGTS

SEQ ID NO: 36940 - DNA, 1119 bp, Thermococcus kodakaraensis
  CDS (1)..(1119)
atggcggaagtaaagctcatcaacgtctggaagcagtttggcgacttcacggccgttaaggatatgaacctccacataaaggacggcgagttcatgatactcctcggtccgagcggctgtggaaaaaccactactctgagaatgatagctggcttggaagagccgacgaagggccagatatacataggagacaagctcgtcgccgaccccgagaaaggtatctttgtcccgcccaaggacagggacattgccatggtcttccagagctacgctctctatccgcacatgaccgtctacgacaacatagcattcccactcaagctgaggaaggttccaaaggacgagatcgacagacgcgtcagggaagtcgctgagatgctcggcctcacggagctcctcaacagaaagccaagggagctttcaggtggacagagacagcgtgtcgcccttggaagggccatcgtgagaaagccgcaggtcttcctcatggacgagccgctctcgaacctcgacgccaagctgagggtgaagatgcgtgccgaactcaagaggctccagaggcaactcggcgtcaccaccatctacgtcacacacgaccaggtcgaggcaatgacgatgggagacagggtcgccgtcatcaaccagggccagctccagcaggtaggaacgcctgaggaggtctacgacaggcctgcgaacacattcgttgcaggcttcattggaagcccgccgatgaacttcatggacgccaccgttacagaggacggctttgcagacttcggcgagttcaggctgaaattcctcccagatcagttcgaagtgctccgggagaagaacctcgtcggcagggaggtcatcttcggcataaggcccgaggacatctacgacgccctcttcgcccaggtcaagatcccaggggaaaacatggccagagcactcgtggagatcattgagaacctcggtggagagaagatagtacacctgagcattggtgacgttaccttcctcggcaagttccctgccgagtcaagggttcaggaaggccaggaagttgacgtcgtcttcgacatgaggaaggcccacgtcttcgagaagggaagcgggaaggccgtcttctga

SEQ ID NO: 36941 - protein, 372 aa, Thermococcus kodakaraensis
MAEVKLINVWKQFGDFTAVKDMNLHIKDGEFMILLGPSGCGKTTTLRMIAGLEEPTKGQIYIGDKLVADPEKGIFVPPKDRDIAMVFQSYALYPHMTVYDNIAFPLKLRKVPKDEIDRRVREVAEMLGLTELLNRKPRELSGGQRQRVALGRAIVRKPQVFLMDEPLSNLDAKLRVKMRAELKRLQRQLGVTTIYVTHDQVEAMTMGDRVAVINQGQLQQVGTPEEVYDRPANTFVAGFIGSPPMNFMDATVTEDGFADFGEFRLKFLPDQFEVLREKNLVGREVIFGIRPEDIYDALFAQVKIPGENMARALVEIIENLGGEKIVHLSIGDVTFLGKFPAESRVQEGQEVDVVFDMRKAHVFEKGSGKAVF

SEQ ID NO: 36942 - DNA, 1101 bp, Mesorhizobium loti MAFF303099
  CDS (1)..(1101)
atggcctccatcacaatacgcggcgtcaagaagaactacgccaagacgcaggtcgtgcacggcgtcgacctcgacttcgcctcgggcgaattcgtcgtcatcctgggaccgtccggctgcggcaagtccacgctgcttaggatgattgccgggctggaagagatttccgatggcgagatctcgatcgacggcacggtggtcaacaaactcgaaccgcgcgagcgcggctgcgccatggtgttccagaactatgcgctctatccgcatatgagtgtggcgcagaacatcggctattcgctcaaggtcgccggcgttccctcggccgagcgtactcagcgcattcaggcggtcgcccgcacgctggagctcgaacatctgctcgaccgcaagccgatggcgctttccggcggccagaggcagcgcgtcgccatgggccgcgccatgatccgcgagccaaaggtgttcctgttcgacgagccgctgtccaatctcgacgccaagctgcgcgtgcagatgcgttcggaaatccgcaagctgcatcgccggctgaacgccacctccgtcttcgtcacccacgaccaggtcgaggcgatgacgctggccgatcggctggtggtgatgaatggcggacgcgttgagcaggtcggcacgccgggtgagatctacacccgcccggccagccgcttcgtcgccaccttcgtcggcgcgccggccatgaacattctcgaaggcacggtcgaactcgacgggctctcgctgctcggcggcagccggcgcctggccatggcacgcaccggcctgccggtcggcaccaaggtcgccatgggcatccggcccgaggccgtccggctggtggcgcccggcatcgccggcgcgttgaatgctacggtcgacctggtcgaggaactaggggcggggcgcgtgatctatgtcgatctcgacggcgcgccgttttcggtgatgacgtcggaggctgtccatcccgagcccggcagccaggtcggcctgaagatttcgccggacgacatgcatttcttctcgtcggaggcgggcagccgccttgatgtcttcaaggcgtcggtgcccgagccggcgctctga

SEQ ID NO: 36943 - protein, 366 aa, Mesorhizobium loti MAFF303099
MASITIRGVKKNYAKTQVVHGVDLDFASGEFVVILGPSGCGKSTLLRMIAGLEEISDGEISIDGTVVNKLEPRERGCAMVFQNYALYPHMSVAQNIGYSLKVAGVPSAERTQRIQAVARTLELEHLLDRKPMALSGGQRQRVAMGRAMIREPKVFLFDEPLSNLDAKLRVQMRSEIRKLHRRLNATSVFVTHDQVEAMTLADRLVVMNGGRVEQVGTPGEIYTRPASRFVATFVGAPAMNILEGTVELDGLSLLGGSRRLAMARTGLPVGTKVAMGIRPEAVRLVAPGIAGALNATVDLVEELGAGRVIYVDLDGAPFSVMTSEAVHPEPGSQVGLKISPDDMHFFSSEAGSRLDVFKASVPEPAL

SEQ ID NO: 36944 - DNA, 1074 bp, Mesorhizobium loti MAFF303099
  CDS (1)..(1074)
atgagcgcgcttgaaatccgcaacgtccgcaagaattacggcagcgtcgaaacgctgaaaggcatcgacatcgcgctgcagagcggcgaattccttgtgctgctcggctcgtcgggctgcggaaagtcgacgcttctcaacatcatcgccggcctcgccgaagcgacgagcggcgacgtgttgatcggcggccgctcgatccttggcgttcatcccaagaatcgtgacatcgccatggtcttccagtcctatgcgctctatccgaacctgaccgtgcgccgcaacatcggcttcgggctggagatgcgcggcgtcgccgccgatgagcgcgaaaaggcggtggccgaggcggcaagattgctgcagatcgaagccctgctcgatcgcaagccgagccagctttccggcggccagcgccagcgcgtcgccatcggcagggcgctggtgcgcaagccgcaggtgttcctgttcgacgaaccgctgtccaatctcgacgccaagctgcgcctggaaatgcgcaccgaactgaagcgcctgcaccagatgctgcagaccaccgtcgtctacgtcacccacgaccagatcgaggcgatgacgctggcgagccgcatcgcggtcatgcgcgacggcaggatcgagcaactcggaacgccggaggaaatctacaatgaaccggcaacgctctatgtcgccggctttgtcggcgcaccgtcgatgaacatgctcgaggccaccctcacggacggcaagctggcaatcgatggttcggacgcgcggctgcccttgcctgcccgtttcagccatgcggttgcggacggcgcgcgcgtcatagtcggcataagacccgaagcactgcgggtcgcggcggatgcatcagcgccgtcactgccggtggaaatagaagtcgtcgagttgaccggtcccgaactggtcaccaccgcgcggatcggcacacagcggctgacggcctgcctgccgccggcgtcccgcgtcgcgaaaggtcaggcaggcagcttcgccttcagcgagcacgcgctgcggctcttcgaccctgacacgggcaaggctttttga

SEQ ID NO: 36945 - protein, 357 aa, Mesorhizobium loti MAFF303099
MSALEIRNVRKNYGSVETLKGIDIALQSGEFLVLLGSSGCGKSTLLNIIAGLAEATSGDVLIGGRSILGVHPKNRDIAMVFQSYALYPNLTVRRNIGFGLEMRGVAADEREKAVAEAARLLQIEALLDRKPSQLSGGQRQRVAIGRALVRKPQVFLFDEPLSNLDAKLRLEMRTELKRLHQMLQTTVVYVTHDQIEAMTLASRIAVMRDGRIEQLGTPEEIYNEPATLYVAGFVGAPSMNMLEATLTDGKLAIDGSDARLPLPARFSHAVADGARVIVGIRPEALRVAADASAPSLPVEIEVVELTGPELVTTARIGTQRLTACLPPASRVAKGQAGSFAFSEHALRLFDPDTGKAF

SEQ ID NO: 36946 - DNA, 1113 bp, Mesorhizobium loti MAFF303099
  CDS (1)..(1113)
atggccgatgtcaatttgaggcaagtgaagaagtcctacggcaatctcaacattctccacggcatcgacctcgatatcaaatcgggcgagttcatcgtcttcgttggtccatcgggctgcggcaagtcgaccttgctgcgctcgatcgccgggctcgaggaaatcacgtcgggcgaactcaagatcgatggcgaagtggtcaacgatgtgccgccgtccaagcgcggcatcgccatggtgttccagtcctacgcgctctatccgcatatgacggtctacgacaacatggcgttctcgatgaagatcggcaaggaaaacaaggccgagatcgaccgccgcgtgcgccaggcggcggaaatcctgcaattgaccaaatatctcgaccggctgcccaaggcgatgtcgggcggccagcgccagcgtgtcgccatcggccgcgccatcgtgcgcaatccgaaagtgttcctgttcgatgagccgctgtcgaaccttgacgccgcactgcgtgtcgcgacccgcatcgagatcgccaagctcaaggaatcgatgcccaacacgacgatgatctatgtcacccacgaccaggtcgaggcgatgacgcttgccgaccgcatcgtggtgctgaaggacggccatgtcgaacaggtcggcacgccaatggacctttacaagaagcccggcaatctgttcgtcgcccagttcatcggctcgccggccatgaacatcctgccggcaaccatcgacaagaccggcaacccgaccgtcgtcaaccatgtcggcggccgcaaggcgacggtgccgatcacgacgcccgcctcggccaagggcgcggcggtcagtttcggcgtgcggccggaagatctgatgatcgccagcggcgcggactatctgttcgagggagcggtcgactatatcgagcagctcggcgaggttcagctggtctatgtcgacatcggccgcgccgacctgccgctggtgaccaaactgccgggcaatgtcgaggtcaagcgcggttcgacattgcggctgagcgccaatgccgaagacctgcatatcttcgatgcagacggacattccttcgcgctgcaaagaccggaagcaaaagcggcctga

SEQ ID NO: 36947 - protein, 370 aa, Mesorhizobium loti MAFF303099
MADVNLRQVKKSYGNLNILHGIDLDIKSGEFIVFVGPSGCGKSTLLRSIAGLEEITSGELKIDGEVVNDVPPSKRGIAMVFQSYALYPHMTVYDNMAFSMKIGKENKAEIDRRVRQAAEILQLTKYLDRLPKAMSGGQRQRVAIGRAIVRNPKVFLFDEPLSNLDAALRVATRIEIAKLKESMPNTTMIYVTHDQVEAMTLADRIVVLKDGHVEQVGTPMDLYKKPGNLFVAQFIGSPAMNILPATIDKTGNPTVVNHVGGRKATVPITTPASAKGAAVSFGVRPEDLMIASGADYLFEGAVDYIEQLGEVQLVYVDIGRADLPLVTKLPGNVEVKRGSTLRLSANAEDLHIFDADGHSFALQRPEAKAA

SEQ ID NO: 36948 - DNA, 1182 bp, Mesorhizobium loti MAFF303099
  CDS (1)..(1182)
atggctcggtcgtgcgcgggggcaaggcggacgctgctttcggggtcgagttacccggcaagccctaccaagccatccgcgtcaggccacggcgctagtaaacggggttacaagatgtcttctgtccagattgtcgacgtgaagaagtcctatggtgcgacccccgtgatccatggggtcagcgtcgacatcgaggacggtgaatttgtcattctggtcggcccttcgggctgtggaaaatcgacgctgctgcgcatgatcgccgggctcgaaaccatctcgggcggagagatctcgatcggcgagcgggtggtcaaccatctccagccaaaggaacgggacatcgccatggtgttccagaactatgcgctctatccgcagatgaccgtcgcgcagaatatgggtttcgccctcgagctcgccggcgccaagaaggccgagatcaaggaaaaggtagatacggcggcatcgatcctggggctgcagccgctgctcgcgcgttatccgcgccagttgtccggcggccagcgccaacgggtcgccatgggccgcgccatcgtgcgcgatcccaaggtgttcctgttcgacgaaccgctgtccaacctcgacgccaagctgcgcgtgcagatgcgcaccgagatcaaggcgctgcaccagcggctcaaatctaccatcgtgtatgtcacccacgaccagatcgaggcgatgacgatggccgacaagatcgtggtgctcaacggcggcaggatcgagcaggttggaagcccgctccaactctatgaccggccggtcaacatgttcgtcgccggcttccttggatcgccggcgatgaatttcatcgaaggaacagtgcgcgacgatccgcatcccggcctcgaactggacaacggatcaatcatcccgctgtcagccattcccgccggcgccgcagggcggcgcctcgtgctgggcgtgcgtccggaggacattcatatcgacagcgaaaccggcgccgcggcgaaggtgatcgtcgtcgagccgacgggcgccgagacgcatctttcggtcgaaatggcgggccatgaactcgtctgcgtgctgcgcgaacgcgtcactttgaagccggatgagactgtcatgctttccgtacgaaagtcggcagtgcatttcttcgatccggcgtcgggaagccgtatcggatga

SEQ ID NO: 36949 - protein, 393 aa, Mesorhizobium loti MAFF303099
MARSCAGARRTLLSGSSYPASPTKPSASGHGASKRGYKMSSVQIVDVKKSYGATPVIHGVSVDIEDGEFVILVGPSGCGKSTLLRMIAGLETISGGEISIGERVVNHLQPKERDIAMVFQNYALYPQMTVAQNMGFALELAGAKKAEIKEKVDTAASILGLQPLLARYPRQLSGGQRQRVAMGRAIVRDPKVFLFDEPLSNLDAKLRVQMRTEIKALHQRLKSTIVYVTHDQIEAMTMADKIVVLNGGRIEQVGSPLQLYDRPVNMFVAGFLGSPAMNFIEGTVRDDPHPGLELDNGSIIPLSAIPAGAAGRRLVLGVRPEDIHIDSETGAAAKVIVVEPTGAETHLSVEMAGHELVCVLRERVTLKPDETVMLSVRKSAVHFFDPASGSRIG

SEQ ID NO: 36950 - DNA, 1080 bp, Mesorhizobium loti MAFF303099
  CDS (1)..(1080)
atggcgacactttccatcaaggatgtgcgcaagtcctatggctccgtgcaggtccttcacggggtcgatatcgagctcgaggacggaggctttctggttctgctcgggccgtcgggatgcggcaagtcgaccctgctcaacataattgcgggcctcgacgacacgtcgggcggcgacatcctgatcggcggacgctcggtcgtggatctcgcgcccaaggaccgcaatatcgcgatggtgttccagtcctacgcactttaccccaccatgtccgtggagcgaaatatcggcttcggattggaaatgcgtggcgtggacgccgaccagcgtaagcgtgccgtcgacgatgccgcgcggctgctgcagatttcgcatctgcttgaccgacgccccgccaatctttcgggaggacagcggcagcgcgtcgcgatggggcgcgcgatcgtgcgcgacccggagctgttcctctttgacgagccgctttccaatctcgatgcaaagcttcgtgtggaaatgcgcacggagatcaagcgcctgcacgagcgtctcggcaccagcatcgtctatgtgacgcacgatcagatcgaggcgatgacgctggccaccaaggtggcggtgatgaagggcggccacatccaacagtttgccgatcctcgcaccatctatgaacggcccgccaacgtgttcgtcgcaagtttcatcggatcgcccgcaatgaacttcctgcccgggcgcctggtctcggacgcaactggcgtgcgtttcgcagcgagcggcgtgtcggtcgcattgcaggccggcaagcggacggttgattccgagcgcccggtgatcctgggtataaggcctgaagaactgaaggtggccgggcgcgatgaagcgtcggtcaccggggtgatcgacgtcgtggagcctacagggcctgaaaccatggtgacggtacaggttggcgaccagtcgatcatcgcccgcctgccgccgaggtttgcaggccggcgaaacgagccgatattcctcgccgtcgatccggccagcgtcaacctgttcgaccccggcagcgagcaccgcatcgatatctag

SEQ ID NO: 36951 - protein, 359 aa, Mesorhizobium loti MAFF303099
MATLSIKDVRKSYGSVQVLHGVDIELEDGGFLVLLGPSGCGKSTLLNIIAGLDDTSGGDILIGGRSVVDLAPKDRNIAMVFQSYALYPTMSVERNIGFGLEMRGVDADQRKRAVDDAARLLQISHLLDRRPANLSGGQRQRVAMGRAIVRDPELFLFDEPLSNLDAKLRVEMRTEIKRLHERLGTSIVYVTHDQIEAMTLATKVAVMKGGHIQQFADPRTIYERPANVFVASFIGSPAMNFLPGRLVSDATGVRFAASGVSVALQAGKRTVDSERPVILGIRPEELKVAGRDEASVTGVIDVVEPTGPETMVTVQVGDQSIIARLPPRFAGRRNEPIFLAVDPASVNLFDPGSEHRIDI

SEQ ID NO: 36952 - DNA, 1098 bp, Mesorhizobium loti MAFF303099
  CDS (1)..(1098)
atggcaacggtttccctcaaaaaactgaccaagcgctacggcaatatcgggatcgtgcatggcatcgatctcgatattgccgaccgcgaattcatcgcgctggtcggcccgtcaggctgcggcaagtcaacgactttacgtatgattgccgggctcgaagaaatcagcgccggtacgatcgagatcggcgggcgtatcgtcaacgatctgccgccgcgctcgcgcaacatctcgatggtgttccagtcctacgcgctctacccgcacatgacggtgcgcgagaatctcggcttctccctgaagatcgccggtgcggccaaagaggacatggatcgccgcgtcgccgaggcctcggccatcctcggcctcgatacgctgctcgaccgccgcccgtcgcagctctccggcggccagcgccagcgcgtcgccatgggccgcgccatcgtgcgcgaccccgacgtgttcctgttcgacgagccgctttccaatctcgacgccaagctgcgcacgcagatgcgcaccgagatcaagaagctgcatgccaaggtgcagtcgacagtgatctacgtcacccacgaccaggtcgaggcgatgacgctggccgatcgcatcgtcatcatgcgcgacggccatatcgaacaggtcggcacgccagacgaggtgttccgccgcccggcgacacgcttcgtcgccggcttcatcggttcgccgccgatgaatttgcacgaggcgacggtcgatgacggccagctggttttcgccagcggcgaaaagctgccgctgcccgcccagttcaaggccaatgtcgcgaccggcgacaaggttgtgttcgggttgcggccggatgacatctatccgaccggccatggcatcagctccggcggggcggccgatgtccatcagatcgacctgccgatcaccgtcaccgagccgctcggcaacgagacgcttgtgttcgtcgagttcaacggcacggactgggtttcgcgcatgctgaacccgcgcccgttgcgctccggcgagcgggtggcgatgagcctcgacctgtcgcaggcgcatctgtttgccgccgagaccggaaagacattgcggagctga

SEQ ID NO: 36953 - protein, 365 aa, Mesorhizobium loti MAFF303099
MATVSLKKLTKRYGNIGIVHGIDLDIADREFIALVGPSGCGKSTTLRMIAGLEEISAGTIEIGGRIVNDLPPRSRNISMVFQSYALYPHMTVRENLGFSLKIAGAAKEDMDRRVAEASAILGLDTLLDRRPSQLSGGQRQRVAMGRAIVRDPDVFLFDEPLSNLDAKLRTQMRTEIKKLHAKVQSTVIYVTHDQVEAMTLADRIVIMRDGHIEQVGTPDEVFRRPATRFVAGFIGSPPMNLHEATVDDGQLVFASGEKLPLPAQFKANVATGDKVVFGLRPDDIYPTGHGISSGGAADVHQIDLPITVTEPLGNETLVFVEFNGTDWVSRMLNPRPLRSGERVAMSLDLSQAHLFAAETGKTLRS

SEQ ID NO: 36954 - DNA, 1056 bp, Mesorhizobium loti MAFF303099
  CDS (1)..(1056)
atggctcaagtcgcaatcagcaaggtggccaaggcgtttggaaccgtcaaggttctgcacgaagtcagcgtcgacatcgctgacggacagttcgtggtgctggtcggcccctcgggttgcggcaagtccacgctgctcaggatggtggccgggttggagaccgtttccggtggcacgatcgccatcggcgaccgcgtcgtcaaccatttgccgccggcaaaacgcgacatcgccatggtgttccagaactacgcgctctacccacacaagacggtcgagcagaacatggcctttgccctcaaactgcggaaaaccgatccggccgtggtcgccgagcgggtcaagcgcgccgccgacatcctcgacctcaacccctatctgaagcgctatccccggcagctctccggcggccagcgccaacgtgtggcgatgggccgcgccatcgtgcgcaatccacaggtgttcctgttcgacgagccgctctcgaacctcgacgccaagctgcgcgtgcagatgcgcaccgagatcaaggaactgcaccagcggctgaagaccaccacgatctacgtcacccacgaccagatcgaggccatgaccatggccgacaagatcgtcgtcatgcgcgatggccgcatcgagcaggtcggcgcgccgctggaattgttcgaccggccggccaatttgttcgtcgccggtttcatcggctcgccgtcgatgaacctgctcaagggtgttgttcgcaagggagacaagcccggcgtcgacatatcaggcacattgtttccgattgccgacaatgccgcgcaggacgggcaagccgtcgtctatggcgtgcgcccggagcatctggaaatccatcccgacggcgtgccggcgaagatttcggtggtcgaaccgaccggctcggaaacgctggtgttcctgcgctttggcgaccgcgagatggtggcgctgtttcgcgagcgccacgacttcaagcccggcgacacgctgaccctgaagcccaggctcgaccagattcatcttttcgatgccgagaccggcaagcgtctctga

SEQ ID NO: 36955 - protein, 351 aa, Mesorhizobium loti MAFF303099
MAQVAISKVAKAFGTVKVLHEVSVDIADGQFVVLVGPSGCGKSTLLRMVAGLETVSGGTIAIGDRVVNHLPPAKRDIAMVFQNYALYPHKTVEQNMAFALKLRKTDPAVVAERVKRAADILDLNPYLKRYPRQLSGGQRQRVAMGRAIVRNPQVFLFDEPLSNLDAKLRVQMRTEIKELHQRLKTTTIYVTHDQIEAMTMADKIVVMRDGRIEQVGAPLELFDRPANLFVAGFIGSPSMNLLKGVVRKGDKPGVDISGTLFPIADNAAQDGQAVVYGVRPEHLEIHPDGVPAKISVVEPTGSETLVFLRFGDREMVALFRERHDFKPGDTLTLKPRLDQIHLFDAETGKRL

SEQ ID NO: 36956 - DNA, 1053 bp, Thermoplasma volcanium GSS1
  CDS (1)..(1053)
atggtgaacgtaagagtagtggatgtatacaaatcatacggtaaagtacaagtattgaaaggtataaatttcaatatagaagacggggaattttttgtattgctagggtcttccggcgctggaaaatcaactttattaaatattctcgccggtttggaagctgtagacagtggaagtatcttctttgatgataagattgttaatgacttgccacctgtagagaggggggtagctatggtttttcaaaattatgcattatatccccacatgacagtatataaaaatatggcgtttccattgaaaatgctaaattataaaaaagatagtatagatcgaatcgtcaaaaaagtagctgaaactttagatataacatggttacttaatagatacccgcgtgaattatctggagggcaagcacaacgagttgcacttggaagagcattagtacgtgatccaaagatatttttattggatgaaccactaagtaatctagatgcgaatataagatcaaagataagaaacgaattaaaattaatgcaaaaacaattaaataaaacatttatttatgtaacacatgatcaaatggaggcaatgtcacttggagaccacataggaattttacacaatggcgtattggaacaatatggaaggccaatagatatatataataacccgataaatgaatatattgcaacctttcttggagatccagaaataaatatgctatcatgcataaaatatcgggatgtatatgaatgcgatggctccataaaatttaaattggatttagatgataaaaagattacattaggaataagaccagaaaatatatatcttcatagacaaaatgataatgacatagaaggaaaaataatacctaaagtctcagaattgttaggttcgcatacattgataattggatctgtagaaaataaagaaataagaatcgttactgaagaaacaaatataagcatagggaaggaaattccaatatacattaatttgaataaatgtcttatatttaatgaaaaaggagaaaatattaataaataa

SEQ ID NO: 36957 - protein, 350 aa, Thermoplasma volcanium GSS1
MVNVRVVDVYKSYGKVQVLKGINFNIEDGEFFVLLGSSGAGKSTLLNILAGLEAVDSGSIFFDDKIVNDLPPVERGVAMVFQNYALYPHMTVYKNMAFPLKMLNYKKDSIDRIVKKVAETLDITWLLNRYPRELSGGQAQRVALGRALVRDPKIFLLDEPLSNLDANIRSKIRNELKLMQKQLNKTFIYVTHDQMEAMSLGDHIGILHNGVLEQYGRPIDIYNNPINEYIATFLGDPEINMLSCIKYRDVYECDGSIKFKLDLDDKKITLGIRPENIYLHRQNDNDIEGKIIPKVSELLGSHTLIIGSVENKEIRIVTEETNISIGKEIPIYINLNKCLIFNEKGENINK

SEQ ID NO: 36958 - DNA, 1095 bp, Pyrococcus abyssi GE5
  CDS (1)..(1095)
atggtggaagttaggctcgaaaacttaactaagaaattcggaaactttacagcggtgaataagctaaacctaacgatcaaagatggtgagttcttagttctcctggggccgagtggctgtgggaagactacgacgctaaggatgattgcaggcttagaggaacctaccgagggcaagatatacttcggggatagggaagtgacgtatctgcctccaagggagaggaacataagcatggtctttcaaagctatgccgtttggcctcacatgacggtttacgataacatagcattcccactaaagataaagaagttccccagggatgagatagataagagggtaagatgggccgcggagcttttacaaatagaggaacttttagataggtatcctgcccagctctccggaggtcaaaggcaaagggttgccgtggccagggcaatagtcgttgagcccgatgttctcttaatggatgagccattaagcaatttggatgcgaagcttagggttgcgatgagagctgaaataaaaaagttgcaacagaagcttaaggtcaccacaatctacgttacccacgatcaagttgaggccatgacgatgggggataggattgcagttatgaacaggggacagttacttcaagttggacctcccacggaagtttaccttaagccaaactccgtcttcgtggccacattcatcggagctcccgagatgaacatagttgaagtctctgtaggagatggttacttagaggggaaagggttcaaaatagagttgccccaggatatcatggaactccttagggattacattggaaaaactgttctatttggaattagaccagagcacatgaccgttgaaggggttagcgagctagctcatatgaaaaagactgcaaagctcaatgctaaggttgatttcgttgaggccttgggaactgacaccatactccacgttaaatttggggatgagctagtcaaggttaagctccctgggcacattccaattgaagtcgggaaggaagtaaccatcgttatagaccttgacatgatgcacgtatttgacaaagatacagaaaaggcgataatatga

SEQ ID NO: 36959 - protein, 364 aa, Pyrococcus abyssi GE5
MVEVRLENLTKKFGNFTAVNKLNLTIKDGEFLVLLGPSGCGKTTTLRMIAGLEEPTEGKIYFGDREVTYLPPRERNISMVFQSYAVWPHMTVYDNIAFPLKIKKFPRDEIDKRVRWAAELLQIEELLDRYPAQLSGGQRQRVAVARAIVVEPDVLLMDEPLSNLDAKLRVAMRAEIKKLQQKLKVTTIYVTHDQVEAMTMGDRIAVMNRGQLLQVGPPTEVYLKPNSVFVATFIGAPEMNIVEVSVGDGYLEGKGFKIELPQDIMELLRDYIGKTVLFGIRPEHMTVEGVSELAHMKKTAKLNAKVDFVEALGTDTILHVKFGDELVKVKLPGHIPIEVGKEVTIVIDLDMMHVFDKDTEKAII

SEQ ID NO: 36960 - DNA, 1122 bp, Pyrococcus horikoshii OT3
  CDS (1)..(1122)
gtggggaataacattgaggtgatcaagatggttgaagttaaactcgaaaatttaacgaaaaggttcgggaactttacggccgttaataagcttaacctaacaattaaggatggggaatttctggttttattagggcccagcggttgcggtaaaacaactacgttgagaatgatagctgggttggaagaaccgacggaggggaggatatacttcggtgatagagatgtcacgtatcttccacctaaggataggaatataagcatggtgttccagagctatgcagtatggccccacatgaccgtttatgagaatatagcttttcctctcaagataaagaagtttccaaaggatgaaattgacaagagggttagatgggccgcggagcttttacagatagaggaattgttgaataggtatccagcccagctctctggaggtcagaggcagagggttgctgtagctagagctattgtagttgagcctgatgttttgctaatggatgagccattgagcaacttagacgctaagctaagggttgctatgagggccgagataaagaagttgcagcagaagcttaaggtcacaaccatttacgttacccatgatcaggttgaggccatgacgatgggtgatagaatagccgtcatgaacaggggccaactacttcagataggatcgccgactgaagtttacttaaggcctaactcagtatttgtggcaaccttcataggggcccctgagatgaacatacttgaggtttcagtaggggatggctacttggagggtagaggattcagaatagagcttccacaagacttaatggatctcctgaaggattacgtagggaaaacggtattgttcgggattaggcctgagcacatgacagttgaaggcgtaagtgagctagctcacatgaagagaacggccagacttattggaaaggttgacttcgttgaagcgttgggaactgatacaatacttcacgtgaagtttggggatgaactcgtgaaggttaaacttcctggacacattcccatagagcctggtagagaggtcaaggtgatcatggacttagatatgatccacgtgtttgacaaagatactgagaaggcgatagtctag

SEQ ID NO: 36961 - protein, 373 aa, Pyrococcus horikoshii OT3
MGNNIEVIKMVEVKLENLTKRFGNFTAVNKLNLTIKDGEFLVLLGPSGCGKTTTLRMIAGLEEPTEGRIYFGDRDVTYLPPKDRNISMVFQSYAVWPHMTVYENIAFPLKIKKFPKDEIDKRVRWAAELLQIEELLNRYPAQLSGGQRQRVAVARAIVVEPDVLLMDEPLSNLDAKLRVAMRAEIKKLQQKLKVTTIYVTHDQVEAMTMGDRIAVMNRGQLLQIGSPTEVYLRPNSVFVATFIGAPEMNILEVSVGDGYLEGRGFRIELPQDLMDLLKDYVGKTVLFGIRPEHMTVEGVSELAHMKRTARLIGKVDFVEALGTDTILHVKFGDELVKVKLPGHIPIEPGREVKVIMDLDMIHVFDKDTEKAIV

SEQ ID NO: 36962 - DNA, 1128 bp, Pyrococcus horikoshii OT3
  CDS (1)..(1128)
gtgattgggatggccgaagttaagctcataaacatatggaagagatttggggatgttaccgcggttaaggatctaagcctagaaataaaagatggggaatttttggttctcctaggccctagtggttgcggtaaaacaacgacgcttagaatgatagcgggactggaggagcctactaggggccaaatatatatagaggataacctcgtggccgatcccgaaaagggggttttcgtacctcctaaggagagagatgttgcaatggtattccagagttatgccctttatcctcacatgacagtttacgacaacattgcatttccattaaagttgaggaaagtgccgaagcaggagatagataagagggttagggaagttgcggagatgctgggcttaactgaattactcaataggaagcccagagaactctccggaggtcagaggcagagggttgcgttgggaagggcaataataaggaggccaaaggttttccttatggatgaacctttgagtaatttggatgccaagctaagggttaagatgcgtgctgaattgaagaagctgcagagacagctcggcgttaccaccatctacgttacccatgatcaggttgaggccatgacgatgggtgatagaatagccgtcatgaataagggagagcttcaacaagttgggaccccagatgaagtttactataagccagttaatacctttgttgcgggcttcataggaagcccaccaatgaacttccttgatgcgacaattaccgacgatggatttttagacttcggagaattcaagctaaagctccttcaggatcagtttgaagttcttgaagaggaaaatatggtgggtaaggaagtgatatttggcataaggcccgaggatgtacacgatgcatcctttacacatattgacgttcctgaggagaacacggtaaaagctaccgtggacataatagagaaccttggaggggagaagatagttcacctaaggagaggaaatatatcctttacagcgaaatttcccaaggagtcaaaagttagggagggagatgaagttagtgtcgtgtttgacatgaagaagatacacatctttaggaaagacactgaaaaggccatcttttaa

SEQ ID NO: 36963 - protein, 375 aa, Pyrococcus horikoshii OT3
MIGMAEVKLINIWKRFGDVTAVKDLSLEIKDGEFLVLLGPSGCGKTTTLRMIAGLEEPTRGQIYIEDNLVADPEKGVFVPPKERDVAMVFQSYALYPHMTVYDNIAFPLKLRKVPKQEIDKRVREVAEMLGLTELLNRKPRELSGGQRQRVALGRAIIRRPKVFLMDEPLSNLDAKLRVKMRAELKKLQRQLGVTTIYVTHDQVEAMTMGDRIAVMNKGELQQVGTPDEVYYKPVNTFVAGFIGSPPMNFLDATITDDGFLDFGEFKLKLLQDQFEVLEEENMVGKEVIFGIRPEDVHDASFTHIDVPEENTVKATVDIIENLGGEKIVHLRRGNISFTAKFPKESKVREGDEVSVVFDMKKIHIFRKDTEKAIF

SEQ ID NO: 36964 - DNA, 1089 bp, Pyrococcus horikoshii OT3
  CDS (1)..(1089)
atggtagagatcaagctcgaaaatatagttaagaagtttggaaatttcacagcgctgaacaatataaatctaaagataaaagatggggagttcatggccttattgggaccatctggaagcggaaaatcaacactattatacacgatagctggaatttacaagccaacgtcgggtaagatatactttgacgagaaggatgtaacggaactaccacctaaggatagaaacgttggacttgttttccagaactgggctctttatcctcacatgactgtttacaagaacatagcctttccactagagcttagaaaagctccaagagaggaaatagacaaaaaagttagggaagttgcgaagatgctccacatagataaattactcaacagatatccatggcaactcagcggaggtcagcagcagagagttgcaatagcaagagcattagttaaagaaccggaggttcttctgctggatgagcctctcagcaacttagatgccctgttaagattggaagttagagcagaattgaagaggcttcaaaaagaactcggcataactaccgtgtacgtaacccacgatcaagcagaagctttagctatggccgataggatagccgtgataagggaaggtgagatactccaagttggaactcccgatgaagtctactataagccaaagtataaattcgttgggggcttccttggaaatccaccaatgaattttgtggaggccaaagtagaagatggaaaattggtaataacggaaaagagcaaattaccaatacccaagcaatacgttgagatagtcaaggaaactggaatcaccgaagtcataatagggttcagaccccacgatgctgagatagtgaagggtgagggagaagggatcgtcggagaggtttattcctttgagcccctaggaagggagcagatcgttacagtgtcagtaaatgattcgatcgttaaggtatttgcaccagagggggaacacttcagctttggagagaaggtaacgatcaaagttaaagaagaactactcgttctttttgataagaaaaccgagaaagcccttgaattctcaaagctttaa

SEQ ID NO: 36965 - protein, 362 aa, Pyrococcus horikoshii OT3
MVEIKLENIVKKFGNFTALNNINLKIKDGEFMALLGPSGSGKSTLLYTIAGIYKPTSGKIYFDEKDVTELPPKDRNVGLVFQNWALYPHMTVYKNIAFPLELRKAPREEIDKKVREVAKMLHIDKLLNRYPWQLSGGQQQRVAIARALVKEPEVLLLDEPLSNLDALLRLEVRAELKRLQKELGITTVYVTHDQAEALAMADRIAVIREGEILQVGTPDEVYYKPKYKFVGGFLGNPPMNFVEAKVEDGKLVITEKSKLPIPKQYVEIVKETGITEVIIGFRPHDAEIVKGEGEGIVGEVYSFEPLGREQIVTVSVNDSIVKVFAPEGEHFSFGEKVTIKVKEELLVLFDKKTEKALEFSKL

SEQ ID NO: 36966 - DNA, 1146 bp, Aeropyrum pernix K1
  CDS (1)..(1146)
gtgggtttgtcggctgggctgcgaaggggtgatgcctggatggctgagattaggctggagggcgttgttaaaaggtttggcaaggtagtcgccgtggaccatgtagaccttagcattaaggacggagagttcttcgtcctcctaggcccaagcggctgcgggaagacaacgacgctccgactcatagccggtcttgaatacccagacgagggaaggatactgatagacggggaggacgtcacgttcaaggaccccaaggacaggaatgtggctatggttttccagaactatgccctctaccctcacatgagtgtgttcgacaacatagcattcaccctccaccttaggaggaaggagatggggctaactaaggacgacatcagaaggcgggtcatagaggttgcgaagctccttagaatagaggacctgcttgaccgcaagcccggccagctgagcggggggcagcagcagagggttgcactggcgagggccctcgtgagaaggccgaaagtttggcttatggatgagccgctcagcaacctagacgcactcctcagactggctatgagggcagagctgaagaagcttcagaaggaccttaagattacaacggtttatgtcacccacgatcaggcagaggctatgagcatggcagacaggattgccgttatgaataaggggagagtagttcaggttggcacgcctgaggaggtttacatgaggccgaaacacacgttcgtcgcaaccttcataggggcaccgccgatgaacctcgtggaatgtgacgttgagtctgtgggcgaggacctctggatatcttgcccaggcttttccaggagggtgcctgaggaggcgaggagtgttattgaatccaagggtgtcaggaagatatatctgggcataaggcccgagttcatatcagtatccagacgtgaaacagagggctccatagctggtaaggtgtacgttgtggagcccctcggctctgagtatgtggtcaacgttgacataggggacggcataataatcaaggctaaggtactgggcctaagggagaagatgactcctggggataaagtctacctgaagcttgattggagcaaagtcaagatatttgactaccgaacaggcgaggctctggcgtaa

SEQ ID NO: 36967 - protein, 381 aa, Aeropyrum pernix K1
MGLSAGLRRGDAWMAEIRLEGVVKRFGKVVAVDHVDLSIKDGEFFVLLGPSGCGKTTTLRLIAGLEYPDEGRILIDGEDVTFKDPKDRNVAMVFQNYALYPHMSVFDNIAFTLHLRRKEMGLTKDDIRRRVIEVAKLLRIEDLLDRKPGQLSGGQQQRVALARALVRRPKVWLMDEPLSNLDALLRLAMRAELKKLQKDLKITTVYVTHDQAEAMSMADRIAVMNKGRVVQVGTPEEVYMRPKHTFVATFIGAPPMNLVECDVESVGEDLWISCPGFSRRVPEEARSVIESKGVRKIYLGIRPEFISVSRRETEGSIAGKVYVVEPLGSEYVVNVDIGDGIIIKAKVLGLREKMTPGDKVYLKLDWSKVKIFDYRTGEALA

SEQ ID NO: 36968 - DNA, 1164 bp, Treponema pallidum subsp. pallidum str. Nichols
  CDS (1)..(1164)
atggcaaaggttgaactcaagcatatctgtaagacgtatcacggatgcgtccatgcagtaaaagacgtaactattaccgcagaaagtggagagttcgtggtgttcatcggaccatctggatgcggcaagtcaactgcactacgtatcattgcagggcttgaagatatctgctcaggtgacctctacattgacggtgagcacatgaatcacgttacaccaaaagatcgcaatatcgcgatggtctttcaaaactacgcgctctacccacacatgaacgtttttgacaacatggcgttcggccttagaatccgtaaaatccctcagcaagaaatcatccgccgtgtccacgaagcagcgcgtgttcttgatatcgaaccactgcttgcccgaaaacccaaagcactttcggggggacagcgacaacgcgttgcagttggacgtgccattgtcagaaatcctaaggtttttctctttgatgagccattgtcaaatttagatgcaaagttgcgcgtgcaaatgcgatccgaaatctctcttcttcacaagcgcctaaaggccacgatgatttacgtcacccatgatcaaatggaagcgatgacaatggcagataagattgtcatcatgaaagacgggtgcgtacaacagattggttctcctctccatatctaccagcatcctgcgaacacgttcgttgcacaattcattggttctcctcctatgaattgtttccctgttacgattgttaaagatgagcatgggataaaaattgatgcaggtctttttgttcttcgaccggatatccccgcgtcctttttgttaaaaaactatattggcacacaggtagtctttggcctcagaccggaagctatcacgccgcgcacggaagaaacactcgcgcgagaatgcgccaacgtcattcagctaaaagtacttgcagttgaagctttaggggcagaaacgtttgtgtatctcgatgcaggtgtacaaccgatagttgcccgctgcaatcataccctaaccgcacacgagggaactttgctwacccttgcactcgatttgtccaaagcactgtactttgacgcagaaaccgggcacgccctgcagggaggaaccagccaagtggctacygtacacgcaccgcctgaaatatccacaggggaataa

SEQ ID NO: 36969 - protein, 387 aa, Treponema pallidum subsp. pallidum str. Nichols
MAKVELKHICKTYHGCVHAVKDVTITAESGEFVVFIGPSGCGKSTALRIIAGLEDICSGDLYIDGEHMNHVTPKDRNIAMVFQNYALYPHMNVFDNMAFGLRIRKIPQQEIIRRVHEAARVLDIEPLLARKPKALSGGQRQRVAVGRAIVRNPKVFLFDEPLSNLDAKLRVQMRSEISLLHKRLKATMIYVTHDQMEAMTMADKIVIMKDGCVQQIGSPLHIYQHPANTFVAQFIGSPPMNCFPVTIVKDEHGIKIDAGLFVLRPDIPASFLLKNYIGTQVVFGLRPEAITPRTEETLARECANVIQLKVLAVEALGAETFVYLDAGVQPIVARCNHTLTAHEGTLLTLALDLSKALYFDAETGHALQGGTSQVATVHAPPEISTGE

SEQ ID NO: 36970 - DNA, 1080 bp, Thermotoga maritima MSB8
  CDS (1)..(1080)
atgcccagtatcagggttgtgaatctgaaaaagtacttcggaaaagtaaaagcggtggatggtgtgagttttgaagtgaaagatggagagttcgtagcgctgcttggtccatctggctgtggaaagaccacgactcttttgatgcttgccggtatatacaagcccacctctggtgagatctacttcgacgacgtgctggtcaacgacattcctccaaagtacagagaagtgggtatggtgttccaaaactacgcgctttatcctcatatgactgtttttgaaaacatagcctttccactcagggcaagaagaatctcaaaggacgaagtcgaaaaaagggtcgttgagatagcccggaaacttctcatagataatcttctcgacagaaagccaacccaactttccggaggacaacagcaaagagtggcgctcgcaagggctctggtgaagcaaccaaaggtgctccttttcgatgaaccactgtcaaacctggacgcaaacctcaggatgatcatgcgggcggaaataaaacaccttcagcaggaacttggaatcacctctgtttacgtcactcacgatcaggctgaggcgatgacgatggcttcaagaatcgctgttttcaatcaggggaaactcgttcagtatggaacacccgatgaggtttatgactctccaaagaacatgtttgtcgcctcgttcataggtaatcctccaacgaacttcctgagggatttctctgtctccgtggaaaacaaacaaacgattttgaaaagagacgatgtcatcattaaactgccagaaccagttgatgtaaaattgaaggaagtcgttgtcggcattagacctgagcactgcaggatttcccgcgagcgtgtggaaaactcaattcccggtgttgtctatgttgtagaaccattgggaagggatataatagtgaacgtgaaaacggagaaaggagagataataaaggtcttcggcgacactggaaaagccccacaaccgggtgagaatgtatttctggttcctgatctaaggaagattcatctgtttaatccagaaacggaggaaacgattctgtaa

SEQ ID NO: 36971 - protein, 359 aa, Thermotoga maritima MSB8
MPSIRVVNLKKYFGKVKAVDGVSFEVKDGEFVALLGPSGCGKTTTLLMLAGIYKPTSGEIYFDDVLVNDIPPKYREVGMVFQNYALYPHMTVFENIAFPLRARRISKDEVEKRVVEIARKLLIDNLLDRKPTQLSGGQQQRVALARALVKQPKVLLFDEPLSNLDANLRMIMRAEIKHLQQELGITSVYVTHDQAEAMTMASRIAVFNQGKLVQYGTPDEVYDSPKNMFVASFIGNPPTNFLRDFSVSVENKQTILKRDDVIIKLPEPVDVKLKEVVVGIRPEHCRISRERVENSIPGVVYVVEPLGRDIIVNVKTEKGEIIKVFGDTGKAPQPGENVFLVPDLRKIHLFNPETEETIL

SEQ ID NO: 36972 - DNA, 1068 bp, Thermotoga maritima MSB8
  CDS (1)..(1068)
ttggcgcaggtgaaaatagacggagtgaagaaatatttcgggaatgtgagggctctcgatggaatcgaccttgtcgtgaacgaaggggagttcctcgttcttctcggtccatctggttgtggaaagacgacccttctgaggtgtatagcgggtctcgaacaggtgaccgggggaaagatctttttcaacgatcgcgacgtgacgaaccttcctccaaaggacaggaacatttcgatggtcttccagagctacgcggtgtggccccacatgaaggtgtacgacaacatcgcgtatcctctgaaactgaaaaaagtcccgaaagaggagatagaaaagagggtaaagtgggcagcggatctccttcacatctccgaactcctcgacaggtaccccgcacagctctccggaggtcagagacagagggttgccgttgcccgagcgatcgttcacgaacccgaagtactcctgatggacgagcctctttccaatctggacgcacttttgagggtgaagatgagaagcgagctgaaaaagcttcaggaaagaattggagtcaccaccatctatgtgactcatgaccagacagaggccatgacgatgggagacagaatcgcggtgatgaaccagggaaagcttcagcaggttggaacgccctctgagatctatcaccatccggtgaacatcttcgtcgctggttttgtgggatcaccgcagatgaacttcttagagatggaagtgagatcggaaggaaatagcgttgtcctccaaaacggtgagataaagattcccgcgaagaccgatccaggtgcaaaaaaggtgatccttggtattcgaccggagaacgtctatctggaggaaaagccgaacactttgaagctggaaggagaggtttatttcgccgagaaactcatgtcggatacgattctccatctcaacgttggaagtgagaagatcgtcgcaaaaattccaggggatgtggatttcagaagcggtgagaagatcacgtttttcctggacgttgaaaagatccatctctttcaccctgagacgggagagagaatctcatga

SEQ ID NO: 36973 - protein, 355 aa, Thermotoga maritima MSB8
MAQVKIDGVKKYFGNVRALDGIDLVVNEGEFLVLLGPSGCGKTTLLRCIAGLEQVTGGKIFFNDRDVTNLPPKDRNISMVFQSYAVWPHMKVYDNIAYPLKLKKVPKEEIEKRVKWAADLLHISELLDRYPAQLSGGQRQRVAVARAIVHEPEVLLMDEPLSNLDALLRVKMRSELKKLQERIGVTTIYVTHDQTEAMTMGDRIAVMNQGKLQQVGTPSEIYHHPVNIFVAGFVGSPQMNFLEMEVRSEGNSVVLQNGEIKIPAKTDPGAKKVILGIRPENVYLEEKPNTLKLEGEVYFAEKLMSDTILHLNVGSEKIVAKIPGDVDFRSGEKITFFLDVEKIHLFHPETGERIS

SEQ ID NO: 36974 - DNA, 1110 bp, Thermotoga maritima MSB8
  CDS (1)..(1110)
gtgagaatggctcaggttgtccttgaaaacgtcaccaaggtctacgaaaacaaagtcgtcgctgtgaaaaacgcgaatctcgtcgtcgaagacaaggagttcgtggttctccttggaccatccggctgtggaaagacgaccactctgaggatgatcgcaggactggaggagatcacagatggaaagatctacatcgacggcaaggttgtgaacgacgtcgaaccaaaagacagagacatcgccatggtgttccagaactacgctctgtatccacacatgaccgtctacgaaaacatggccttcggtttgaaactgagaaaatatccaaaggacgaaatcgacagaagagtacgtgaagctgcgaaaatcctcggaatagaaaacctgctcgacagaaaaccgagacagctttcaggtggtcagaggcagagggtcgccgttggaagagccatcgtgagaaatccgaaggtcttcctcttcgacgaaccactctccaacctcgacgcgaaactcagagtgcagatgagaagcgagctcaagaagctccaccacagactccaggcaacgatcatctacgtgacacacgaccaggtggaagcgatgacaatggctgacaagatcgttgtcatgaaggacggagaaatccagcagataggaactccacacgaaatatacaactctccagcgaacgtcttcgtcgccggattcatcggtagccctccaatgaatttcgtcaacgcgagagtcgtgagaggagaaggtggcctctggatccaggcatctggcttcaaagtgaaggtgcctaaggaatttgaagacaagctcgcaaactacatcgacaaggagatcatcttcggtatcagacctgaagatatatacgacaagctcttcgcactggcaccttcaccagagaacacgatcacaggtgttgtggatgtggtcgaacccctcggaagtgaaacgattctccacgtgaaagtcggagacgacttgattgtggcatccgtcaacccgaggactcaggcaaaagaagaacagaaaatcgatctggtactcgacatgacgagaatgcacgccttcgataaagaaacggagaaggctattatctga

SEQ ID NO: 36975 - protein, 369 aa, Thermotoga maritima MSB8
MRMAQVVLENVTKVYENKVVAVKNANLVVEDKEFVVLLGPSGCGKTTTLRMIAGLEEITDGKIYIDGKVVNDVEPKDRDIAMVFQNYALYPHMTVYENMAFGLKLRKYPKDEIDRRVREAAKILGIENLLDRKPRQLSGGQRQRVAVGRAIVRNPKVFLFDEPLSNLDAKLRVQMRSELKKLHHRLQATIIYVTHDQVEAMTMADKIVVMKDGEIQQIGTPHEIYNSPANVFVAGFIGSPPMNFVNARVVRGEGGLWIQASGFKVKVPKEFEDKLANYIDKEIIFGIRPEDIYDKLFALAPSPENTITGVVDVVEPLGSETILHVKVGDDLIVASVNPRTQAKEEQKIDLVLDMTRMHAFDKETEKAII

SEQ ID NO: 36976 - DNA, 1137 bp, Bacillus halodurans C-125
  CDS (1)..(1137)
atgagtcatgtcgagttattgaacctatgcaaaagctatgatcaaacgacgtttgctgttgaggatattaacgtatcgatcaaggaaggggaattttttatccttgttggaccttctggttgtggtaagagcacgatgctacggatgattgctgggttagaagatatcagtgctggtgaattaaaaattcacggagcgacagccaaccatttaccaccaagcaaacggaacttatcgatggtgtttcaaaactatgccctttatccccatttaacggtggaagaaaacattttattcggccttaaagtccgaaaagtaaaaaaagcagagcggtcagagcgctgccaacgagcggctgccatgcttggcttaaccgactatttaaagcgaaagccgcgggagttatctggtggacagcggcaacgggtggcacttgcgcgggcggtcgttagtgaggcccctctctgtctaatggatgagcctctatccaacctagatgcgaagctgagggggcatatgcgcacagagattcgtcaattgcaacgacagttaggaatgaccatgatctatgtaacccacgatcaagtggaggcgatgacgatgggggaccggatcatggtactaaaagacggtcaagttcagcaagtcgggtcaccgctcgacatttataatgcacctgcgaatttgtttgtggccacctttattggagcaccaccgatgaatattgccaaggcgacggtggatcgaatgaatcgagagcttgccataggctccttgcgtttaccaatcgaagaacagctgctaatgcgcatcagtagcgataccgtacagcttggcattcgtcctgagcaaatagcgagggcagatgcaccaacccctgagcacgtccaatggcacgtgacacttacaaatgttgaagtattagggaatgaaacgttgctcgcgtttaaggttggtgagcatgaatggaaagcgaaatggctcggacagtggccttatcaactccatgaaaccattgcgatttcttttgcaaaggagcatctttacctttttgatggagaaacgggaaaaacgctcgtatcacctgatcagaatcaaccatacctaaggggggcggtatcccttgaatccagctga

SEQ ID NO: 36977 - protein, 378 aa, Bacillus halodurans C-125
MSHVELLNLCKSYDQTTFAVEDINVSIKEGEFFILVGPSGCGKSTMLRMIAGLEDISAGELKIHGATANHLPPSKRNLSMVFQNYALYPHLTVEENILFGLKVRKVKKAERSERCQRAAAMLGLTDYLKRKPRELSGGQRQRVALARAVVSEAPLCLMDEPLSNLDAKLRGHMRTEIRQLQRQLGMTMIYVTHDQVEAMTMGDRIMVLKDGQVQQVGSPLDIYNAPANLFVATFIGAPPMNIAKATVDRMNRELAIGSLRLPIEEQLLMRISSDTVQLGIRPEQIARADAPTPEHVQWHVTLTNVEVLGNETLLAFKVGEHEWKAKWLGQWPYQLHETIAISFAKEHLYLFDGETGKTLVSPDQNQPYLRGAVSLESS

SEQ ID NO: 36978 - DNA, 1107 bp, Pasteurella multocida subsp. multocida str. Pm70
  CDS (1)..(1107)
atggcaacgttattacttaataatatcaataaacgttatgataatggctttcatgccgtacaagactttaatttaaacgttgaagatcaagaattcattgccttagtgggtccttctggatgtggaaaatcaactttactacgaatgattgcaggcctagaagatatctcaagtggtgagttttatatcgatgaacgcttagtaaatgatgtggaagccaaagatcgggacattgcaatggtgtttcaatcttatgccttatacccacacatgagcgtatatgacaatatggcatttgctttgaaattacgtaaattccctaaagaagaaattgatcgaaaagttaaagaagccgcaaaaatcctcggtttagatggtttactcagccgtaaacccaaagccctttccggtggtcaacgccaacgagttgcactcggcagaaccattgttcgttcaccaaaagttttccttatggatgaacccctttccaatttagatgccaaactacgcggcaatatgcgtgctgaaatcattcgaattcacaaaagccttcatgccacaactatttatgtgactcatgatcaaactgaggccatgactatggccgatcgcatcgtggtgatgaaagcgggtgtcgtacagcaaattggcacaccaaagcaaatttataatgcaccaaataatctctttgttgccggttttattggcgcaccaactatgaattttattcacggaaaaattgaaaacggtcaatttattgcacctaaaggtacttctttacttatcccagaaaatcattatgagctcattaaagaaaaagggtttgaaaataaagaaattattttaggtattcgcccagaaaatatttctaatgatccgatgttattaggcgtttatcaacattcaattatccatgcttatatcaatgtcgcagaattacttggtgcagaatatattttgcatacggatattgatggacaagaaattaaagcgattgtgcattctcgtcaaaacataaaaatggaacaagtggtgaatctcgcatttgatatgaaatatgctcactttttcgatcctcaaacagaaaaatcattattgcaactttaa

SEQ ID NO: 36979 - protein, 368 aa, Pasteurella multocida subsp. multocida str. Pm70
MATLLLNNINKRYDNGFHAVQDFNLNVEDQEFIALVGPSGCGKSTLLRMIAGLEDISSGEFYIDERLVNDVEAKDRDIAMVFQSYALYPHMSVYDNMAFALKLRKFPKEEIDRKVKEAAKILGLDGLLSRKPKALSGGQRQRVALGRTIVRSPKVFLMDEPLSNLDAKLRGNMRAEIIRIHKSLHATTIYVTHDQTEAMTMADRIVVMKAGVVQQIGTPKQIYNAPNNLFVAGFIGAPTMNFIHGKIENGQFIAPKGTSLLIPENHYELIKEKGFENKEIILGIRPENISNDPMLLGVYQHSIIHAYINVAELLGAEYILHTDIDGQEIKAIVHSRQNIKMEQVVNLAFDMKYAHFFDPQTEKSLLQL

SEQ ID NO: 36980 - DNA, 1113 bp, Pseudomonas aeruginosa PAO1
  CDS (1)..(1113)
atggctgatctcaagatccgcaacctgcagaaaggcttcgacggccaggccatcatcaagggcatcgacctcgacgtccgcgaccgcgagttcgtagtcttcgtcggcccctccggctgcggcaagtcgaccctgctgcgcctgatcgccggcctcgaagaggccagcggcggcagcatcgccctcgacggcacggacatcaccgacaccccgccggcgaaacgcgacctggcgatggtcttccagacctacgcgctgtacccgcacatgacggtgcgcaggaacctctccttcgccctcgacctggccggcgtcgacaagcgcgaggtcgccgccaaggtcgacgccgccgcacgcatcctcgaactgcaagcgctgctggagcgcaagccgcgccagctctccggcggccaacggcagcgggtggcgatcggccgggcgatcgtgcgcaacccgaagatattcctcttcgacgaaccgctgtccaacctcgacgccgccctgcgcgtgcagatgcgcctggaactggcgcggctgcaccaggaactggcggcgaccatgatctacgtgacccacgaccaggtcgaggcgatgaccctggcggacaaggtcgtggtgctcaacggcgggcgcgtcgagcaggtcggctcgccgctggagctttaccaccatccggccaacctgttcgtcgccggcttcctcggcacgccgaagatgggcttcctgcgcggccatctcagccgcaaccagggcgagcgctgcgaggtcgccctcgaatgcggcgcgcgcgtcggcctgccgctatgcgccggcgagctggccaccggcagcccggtgaccctcggcatccgcccggaacacctgaacatcgcccgcccgggccatgccttccagggcctgctgcgggtcgccgccgacgtcagcgagcgcctgggcagcgacagcttctgccatgtccgcgccgactcgggggaaatgctcaccctgcgcgtgcgcggcgatttcgcaccggactacggcgcccccctggagctgggcttcgatccggagcactgccacctgttcgacagcaacggccaggccctcgacaaacgactgcaacaggcggcctga

SEQ ID NO: 36981 - protein, 370 aa, Pseudomonas aeruginosa PAO1
MADLKIRNLQKGFDGQAIIKGIDLDVRDREFVVFVGPSGCGKSTLLRLIAGLEEASGGSIALDGTDITDTPPAKRDLAMVFQTYALYPHMTVRRNLSFALDLAGVDKREVAAKVDAAARILELQALLERKPRQLSGGQRQRVAIGRAIVRNPKIFLFDEPLSNLDAALRVQMRLELARLHQELAATMIYVTHDQVEAMTLADKVVVLNGGRVEQVGSPLELYHHPANLFVAGFLGTPKMGFLRGHLSRNQGERCEVALECGARVGLPLCAGELATGSPVTLGIRPEHLNIARPGHAFQGLLRVAADVSERLGSDSFCHVRADSGEMLTLRVRGDFAPDYGAPLELGFDPEHCHLFDSNGQALDKRLQQAA

SEQ ID NO: 36982 - DNA, 1161 bp, Pseudomonas aeruginosa PAO1
  CDS (1)..(1161)
atggcaaccctcgaactgcgcaacctgcacaagagctacggcagcggcctggcggataccctcagggacatccggctgaagatcgactccggcgaattcctgatcctcgtcgggccctcgggttgcggcaagtcgaccctgatgaactgcatcgccgggctggagagcatcaccggcggtgcgatcctggtggacggccaggacatcagcggcatgagccccaaggaccgcgacatcgccatggtcttccagtcctacgccctgtacccgaccatgagcgtgcgcgagaacatcgccttcggcctgaagatccgcaagatgccccaggccgccatcgacgaggaggtggcgcgggtggccaggctgttgcagatcgagcacctgctcgaacgcaagccctcgcagctctccggcggccagcagcagcgggtggccatgggccgggcgctggcgcggcggcccaaggtctacctgttcgacgagccgctgtccaacctcgatgccaagctgcgggtggaaatgcgcaccgagctgaagctgatgcaccagcggctgaagaccacgaccgtgtatgtcacccacgaccagatcgaggccatgaccctcggcgacaaggtggcggtgatgaaggacggcgtcatccagcagttcggcacgccgcagcagatctacaacgacccggccaacctgttcgtcgccagcttcatcggttcgccgccgatgaatttcattccgttgcgcctgcagcgccgggacggacgctggaccggcctgctcgatagcggccaggaccgtatcgaactgccgttgagcctggagcccggcctggaggaggggcgcgagctgatcctcggcgtacgaccggagcagatcgccctgggcgatggcagcgctgcccatgacctgcgtaccgaggtcgaggtgctcgaaccgaccgggccggacaccctggtcttcgtcaccgtcaaccaggtcaaggtctgttgccgcctggcgccggacgtcgcgccggccgcgggcagcggcatgagcctgcgcttcgatcccgcgcgggtcctgctgttcgacgcgcagagcggcgagcgcgtggccgtgcgcacggcgggcgtggcggcggagaaggtcaccgccttgaacggcaatcgccagaagaactcctga

SEQ ID NO: 36983 - protein, 386 aa, Pseudomonas aeruginosa PAO1
MATLELRNLHKSYGSGLADTLRDIRLKIDSGEFLILVGPSGCGKSTLMNCIAGLESITGGAILVDGQDISGMSPKDRDIAMVFQSYALYPTMSVRENIAFGLKIRKMPQAAIDEEVARVARLLQIEHLLERKPSQLSGGQQQRVAMGRALARRPKVYLFDEPLSNLDAKLRVEMRTELKLMHQRLKTTTVYVTHDQIEAMTLGDKVAVMKDGVIQQFGTPQQIYNDPANLFVASFIGSPPMNFIPLRLQRRDGRWTGLLDSGQDRIELPLSLEPGLEEGRELILGVRPEQIALGDGSAAHDLRTEVEVLEPTGPDTLVFVTVNQVKVCCRLAPDVAPAAGSGMSLRFDPARVLLFDAQSGERVAVRTAGVAAEKVTALNGNRQKNS

SEQ ID NO: 36984 - DNA, 1137 bp, Lactococcus lactis subsp. lactis Il1403
  CDS (1)..(1137)
atgacaacactcagtttagacaaaatctacaaaaaatatcccaatgcgacgcaatacgcagttgaagatttcaacattgatatcaaagataaagaattcattgtattcgttggtccttcaggttgtggtaaatcaacaacattgcgaatggtcgctggtcttgaagatattaccgaaggtgaatttaaaattgacggtaaaatcatgaatgatgtcgcaccaaaagatcgtgatattgccatggttttccaaaactatgcgctttatccacatatgaccgtttttgataacatggcctttggtttgaaacttcgtaagttcaaaaaagatgaaattaaacgtcgtgttgaagaagctggaacaattcttggtctttctgatttgcttgaccgtaaacctgctgacttatcaggtggtcaacgtcaacgggtagcaatgggacgtgcgattgtccgtgatgccaaagttttcctcatggatgaacctttgtcaaacttagatgctaaacttcgtgtttcaatgcgtacagaaattgcaaaaattcaccgtcgaattggagcgacaacaatctatgtaacccatgaccaaactgaagcgatgactcttgctgaccgtattgttattatgtcatcatcaccaaactctgataaaacagggacagttggtcgtgttgaacaaatcggaacaccacaagagctttataatgaacctgctaataaatttgttgccggttttatcggtagtcctgcgatgaacttctttaatgtcaaagttgcttctggaaaattaacaaataatgaaggtttgaatatggaccttccagaaggaaaagcaaaattgcttaaagaacaagggtatgaaggaaaagaagtgattcttggaattcgtccagaagacattcaagcaagcaatttggcacaacaagcctatccaaatcaaacaattgaagctgaagttgtcgtttctgaacttcttggagcagaaactatgctttatcttagagctggttcaactgaatttgtttctcgtgttgaagcgcgtgatttccgcaatccaggagaaaaaattacagtggctttgaacctaaacaaatcacatttctttgatgctcaaactgaacatcgcatcattgattaa

SEQ ID NO: 36985 - protein, 378 aa, Lactococcus lactis subsp. lactis Il1403
MTTLSLDKIYKKYPNATQYAVEDFNIDIKDKEFIVFVGPSGCGKSTTLRMVAGLEDITEGEFKIDGKIMNDVAPKDRDIAMVFQNYALYPHMTVFDNMAFGLKLRKFKKDEIKRRVEEAGTILGLSDLLDRKPADLSGGQRQRVAMGRAIVRDAKVFLMDEPLSNLDAKLRVSMRTEIAKIHRRIGATTIYVTHDQTEAMTLADRIVIMSSSPNSDKTGTVGRVEQIGTPQELYNEPANKFVAGFIGSPAMNFFNVKVASGKLTNNEGLNMDLPEGKAKLLKEQGYEGKEVILGIRPEDIQASNLAQQAYPNQTIEAEVVVSELLGAETMLYLRAGSTEFVSRVEARDFRNPGEKITVALNLNKSHFFDAQTEHRIID

SEQ ID NO: 36986 - DNA, 1368 bp, Deinococcus radiodurans R1
  CDS (1)..(1368)
ttgtccgcacggcaacagcgtaagcagcaggtttctcacccggaaccccggttccccgacccctcattcacggggaagagcaggggcggcgaaggagtaggcgtcatggccgaagtgattctcgagcacgtcaacaagtactacggcaacaagcagcacgcggtgaaggatttcaacctcgaaatcgccgaccgcgaattcatggtcttcgtggggccgtcgggctgcggcaagtccaccaccctacgaatgatcgcgggcctcgaagacatcagcgacggggtgctgcgaattggcgaccgcgtcgtcaacgacgtgccgcccaaggaccgcgacatcgcgatggtcttccagaactacgcgctctacccgcacatgaacgtctacgagaacatggcgttcggcctcaagctgcgtaagacgccgcgcgaggagatcgacaagcgcgtgcgcgacgccgcccggattttgcagatcgagcacctgctcgggcgcaagcccaaggagctttcgggcgggcagcgccagcgcgtggcgatgggccgcgccatcgtgcgcgagccgtcggtgttcctgatggacgagccgctctcgaacctcgacgccaagctgcgcgtggagatgcgctcgcagatttcgcagctccaccgccgcctcggggcgaccatcatctacgtgacccacgaccaggtggaggcgatgacgctcggcaaccgcatcgtggtgatgcgcgacggcgtgatcatgcaggtggacaccccgatgaacctctacgacttcccgcaaaaccgcttcgtggcgggcttcatcggcagtccgtccatgaacttcctgaccgcccgcgtgcagaacggcgaattcgtgatcgggcaaagtcaggtggccgcgatgggccgcctcgccgaaagcctgagggcgtatgagggccgcgaggtcttcctggggattcgccccgaacacgtggggctcgtcggccacagcgacctgccgcagggccgcaacgtgctgcgcggcgaagttgtggtcgtggagtcgctcggcgcccagaccgacctgatcgtggacgtggcgggccagcaagtgaccgccaaggtggaaggcatggccccggtgcagcccggcgatcaggtggaactgctgatcgaccagacccgcctgcacgccttcgacaccgaaacggaactggcgatcgatcggggcacccccagcggcacgcgcggccagatggacacccagggcctcggctacgagtaccccggccagggccaaccgcaagcggtgagttttggccaaggcgcccccgcgatggccactgccccaaacgctcccgctggcgtcaccgtcatcacgacggacgcgccccgctga

SEQ ID NO: 36987 - protein, 455 aa, Deinococcus radiodurans R1
MSARQQRKQQVSHPEPRFPDPSFTGKSRGGEGVGVMAEVILEHVNKYYGNKQHAVKDFNLEIADREFMVFVGPSGCGKSTTLRMIAGLEDISDGVLRIGDRVVNDVPPKDRDIAMVFQNYALYPHMNVYENMAFGLKLRKTPREEIDKRVRDAARILQIEHLLGRKPKELSGGQRQRVAMGRAIVREPSVFLMDEPLSNLDAKLRVEMRSQISQLHRRLGATIIYVTHDQVEAMTLGNRIVVMRDGVIMQVDTPMNLYDFPQNRFVAGFIGSPSMNFLTARVQNGEFVIGQSQVAAMGRLAESLRAYEGREVFLGIRPEHVGLVGHSDLPQGRNVLRGEVVVVESLGAQTDLIVDVAGQQVTAKVEGMAPVQPGDQVELLIDQTRLHAFDTETELAIDRGTPSGTRGQMDTQGLGYEYPGQGQPQAVSFGQGAPAMATAPNAPAGVTVITTDAPR

SEQ ID NO: 36988 - DNA, 1095 bp, Xylella fastidiosa 9a5c
  CDS (1)..(1095)
atggccaaagtgcagttggaagcgatccgtaaggtgtacgacaacggccaggtggtggtgcctggagtcagtttcgaagttgctgacggtgagctgatggtgttggtgggaccgtcaggatgcggtaaatcgacgttgttgcgcatgatcgctgggctggaagatatcagcagtggcacgttgcgtattggtgagcgtgtggtgaatgacgtgccgccgaaggatcgtaatgttgcaatggtgtttcagagctatgcgttgtatccccatatgacggccgctgagaatttggcgttcgggctgaagctgcgcgggtattctactgaggccattgccgagcgcattaagaatgtggccgagatgcttggtttgacttctctgctggataccttgcctaaagcgatgtctggtgggcagcgccagcgcgttgcgttggggcgggcgatggtacgtgaatcagcagtgtttttattggatgagccgttgtccaatttagacgcaaaactgcgtaacagtgtgcgttccgatatcacgcgtctgcatcgcaaacttggcacgacgatgatttacgtgacccacgatcaggttgaggcgatgactctcggtcaccgtattgtgttgctcaaagatggagtgatccagcagattgataccccgatggtgctttacgaccatccggcgaatctgtttgttgctggttttcttggtaatccagcaatgaacatgttgcctggtcgattggaggcggttgcaggtggaatggagctgcacttggaatccggtgagtgcgtcatgtttgttggtgcgattccgaagtcagtttggttcgggcgtgatgtggtgttgggggtacgtccggagcacatacggccggcgggtcttggtgaaccagtggcattggaggcgactgtcgaagcgttggagccagtcggtaatgaggtttttttacatctgcgctgtggtgccttggcactcactttgcgggtgccgcctcaggagttgccggggatcggcgagtcattgccgttggcggtgcagcctgatcggttacatgtgtttgacgcggtttctggtgaatgtttggccggtcattaa

SEQ ID NO: 36989 - protein, 364 aa, Xylella fastidiosa 9a5c
MAKVQLEAIRKVYDNGQVVVPGVSFEVADGELMVLVGPSGCGKSTLLRMIAGLEDISSGTLRIGERVVNDVPPKDRNVAMVFQSYALYPHMTAAENLAFGLKLRGYSTEAIAERIKNVAEMLGLTSLLDTLPKAMSGGQRQRVALGRAMVRESAVFLLDEPLSNLDAKLRNSVRSDITRLHRKLGTTMIYVTHDQVEAMTLGHRIVLLKDGVIQQIDTPMVLYDHPANLFVAGFLGNPAMNMLPGRLEAVAGGMELHLESGECVMFVGAIPKSVWFGRDVVLGVRPEHIRPAGLGEPVALEATVEALEPVGNEVFLHLRCGALALTLRVPPQELPGIGESLPLAVQPDRLHVFDAVSGECLAGH

SEQ ID NO: 36990 - DNA, 1179 bp, Mycobacterium leprae TN
  CDS (1)..(1179)
atggccgagattgtgctggagcacgtcaacaagaattacccgaacggtgcgacggcggtgcatgacctttccatcaccgtcgccgacggggaattcctcatcctgatagggccttcaggctgcggcaagaccacgactctgaatatgattgctggacttgaggatatttcttcgggtgagctaagaatcgacggcgatcgggtcaacgagaaggcgcccaaggatcgtgatatcgcgatggtgttccagtcttacgcgctttacccgcatatgaccgtgcgacagaatatcgcgttcccgctgatgctggccaaggtgaagaaagcggagatagcgcagaaggtttccgagactgctcaaatccttgatttgaccgatcttttggaccgtaagccctcgcagttgtctggcgggcaacgacaacgggtcgcgatgggccgggcaattgttcgtcaccccaaggcattcttgatggacgagccgttgtccaacctggatgctaaactacgggtgcggacgcgtggtgaaatcgcccggctgcagcgcaggttgggtgccaccaccgtttatgtcacccacgatcaaactgaagccatgacgctaggggatcgcgtggtggtcatgcgctctggtgttgtacagcagatcggtacgcccgatgagctttatgaacgtccggtcaatctcttcgtcgcggggtttatcggttcgccggtgatgaatttcttccctgccaagttgacaccgaacggactgaccctgcccttgggggaactgaacttgtcgcgggacgtccaggcgatgatcggacagcacccggtgccggacagggttattgtcggggtgcgacccgagcatctgaccgatgctaagttgatcgacgcacatcaacacggcacggtgttaacttttaaggtgaaggttgacttggtcgaatcactgggggccgacaaatacatctattttactacgactggttgtgatgtgtattcagcccagttggacgagttagcttccgagttggaagtacgtgaaaatcagtttgtggcaagagtttccgctgaatcaaaaatggccataggagagtcgattgagttggctttcggcacagcaaaaatagctgttttcgacgctgactctggggtgaatctgactgtttctgcaccgactgatgcgtag

SEQ ID NO: 36991 - protein, 392 aa, Mycobacterium leprae TN
MAEIVLEHVNKNYPNGATAVHDLSITVADGEFLILIGPSGCGKTTTLNMIAGLEDISSGELRIDGDRVNEKAPKDRDIAMVFQSYALYPHMTVRQNIAFPLMLAKVKKAEIAQKVSETAQILDLTDLLDRKPSQLSGGQRQRVAMGRAIVRHPKAFLMDEPLSNLDAKLRVRTRGEIARLQRRLGATTVYVTHDQTEAMTLGDRVVVMRSGVVQQIGTPDELYERPVNLFVAGFIGSPVMNFFPAKLTPNGLTLPLGELNLSRDVQAMIGQHPVPDRVIVGVRPEHLTDAKLIDAHQHGTVLTFKVKVDLVESLGADKYIYFTTTGCDVYSAQLDELASELEVRENQFVARVSAESKMAIGESIELAFGTAKIAVFDADSGVNLTVSAPTDA

SEQ ID NO: 36992 - DNA, 1071 bp, Mycobacterium leprae TN
  CDS (1)..(1071)
atggcttcggtgaccttcgaacaagcgacacgccagttccctgacacagatcgaccagccctggatcgcctcgacctcgacgtcgatgatggcgaatttgtggttgtggtagggccatctggatgcggcaagaccacctcgctgcggatggtggccggattagaaacgctggattccggatgtattcggatcggcgaccgcgatgtcactcacgtcgatcccaaggatcgtgacgtcgcgatggtctttcaaaactatgccctttacccgcacatgaccgtagcgcagaatctagggtttgcgttaaagatctctaaaatctctaaggccgagatccacgatcggatactcgtcgttgcgaaactacttgatctgcaaccgtatctggatcgcaaaccaaaagatctttccggaggtcaacgtcagcgggtagcgatggggcgggccatcgtgcgccgtccacaggtgttcttgatggatgagccgctgtccaatctcgatgccaaactgcgagcgcaaactcgtaatcaaatcgcggaattgcagtgtcaactcggcactaccaccgtctatgtcacccacgaccaggtcgaagccatgaccatgggggaccgtgtcgcggtactgtgctacggggtgttacaacagttcgctacgcctcgtgaactttatcacaaacccgagaatgtttttgtcgcaggattcatagggtctcccggaatgaacttggtcaccctctcgatcgtcgattcctctgttttgctgggggattggccgattcgcataccgcgtgaaatcgccagcgccgcaagcgaggtcatcatcggcgtccgtcccgaacatttcgagctgggcagcctcggtgtcgaagtggagatcgacatggtcgaagagctcggggccgatgcttatctatatggccgaatcgcaggtgccagcaaagtaaccgaccaacttgtcgttgcacgcgtcgacggccgaaacccgccggcaaagggcagccgcgttcgtctgtatacagaacccgggaatgtgcatttcttcggcgttgatggccatcgaatttcttga

SEQ ID NO: 36993 - protein, 356 aa, Mycobacterium leprae TN
MASVTFEQATRQFPDTDRPALDRLDLDVDDGEFVVVVGPSGCGKTTSLRMVAGLETLDSGCIRIGDRDVTHVDPKDRDVAMVFQNYALYPHMTVAQNLGFALKISKISKAEIHDRILVVAKLLDLQPYLDRKPKDLSGGQRQRVAMGRAIVRRPQVFLMDEPLSNLDAKLRAQTRNQIAELQCQLGTTTVYVTHDQVEAMTMGDRVAVLCYGVLQQFATPRELYHKPENVFVAGFIGSPGMNLVTLSIVDSSVLLGDWPIRIPREIASAASEVIIGVRPEHFELGSLGVEVEIDMVEELGADAYLYGRIAGASKVTDQLVVARVDGRNPPAKGSRVRLYTEPGNVHFFGVDGHRIS

SEQ ID NO: 36994 - DNA, 1179 bp, Mycoplasma pulmonis UAB CTIP
  CDS (1)..(1179)
atgaaaaaagaaatattagatgatttaaaaaactatgatttagaatttgataaatttctaaatcaaattggacaaaatagcacttcttataatggtggaaaaattgaacttgtaaatttatctaaaaaatatgaaggtaatgataaatgaactcttaaagatatcaacttaacaattgagccaaaaaagttttgtatctttttaggaccttcaggatgtggtaaaactacacttttaagaatgatagctggacttaattcaattactagaggtgatttattatttgaagataaaagaatcaataatctttctccctctgaaagaaacattgccatggtttttcaatcatatgctctttatccacatatgaatgtttataacaacatgagctttggattgaaaatggcaaaagaaagaaaagacgttattgaccgaagggttaaagacgtagctaaaatcttaaaaatagaaaattatttatataataaacctagagatctatcgggggggcaaagacaaagagttgcaataggaagagccattgtaagaaagccttctattttcttaatggacgagcctctttctaacttagatgctaagttaagagagtctatgagaagagaaattgttcaaattcatagaatgctaaatacaacaacaatttatgtaacccacgatcaacttgaagctatgactatgggagatcaaattgtagtaatgaatgatggtaaaatccaacaaaatggaacaagtgaagaactttactttagacctaaaaatatctttgttgccaagtttattggaagtccaacaatgaatttaatttatggaaattatcaaagaccattttttgttgcaaaagattttaattggaagttaaaacttgatactgaaaatgaaacaaaaattcaaaataacagtgaaatagtaataggctatcgtagtgaagatgttattttaaataaaaacccaattgaaggggcaattcagggaaaaatatttaatattgaacacttaggaaaagagctttcaatagtagttaaaattaatgaaaatattgaaatagtttctactgttttaaataatgaaaaatttgttttatatcaaaatatttgaataacttttaatcaaaaaagaattcatatttttgatttaaaaacacaagagagaattaattaa

SEQ ID NO: 36995 - protein, 392 aa, Mycoplasma pulmonis UAB CTIP
MKKEILDDLKNYDLEFDKFLNQIGQNSTSYNGGKIELVNLSKKYEGNDKWTLKDINLTIEPKKFCIFLGPSGCGKTTLLRMIAGLNSITRGDLLFEDKRINNLSPSERNIAMVFQSYALYPHMNVYNNMSFGLKMAKERKDVIDRRVKDVAKILKIENYLYNKPRDLSGGQRQRVAIGRAIVRKPSIFLMDEPLSNLDAKLRESMRREIVQIHRMLNTTTIYVTHDQLEAMTMGDQIVVMNDGKIQQNGTSEELYFRPKNIFVAKFIGSPTMNLIYGNYQRPFFVAKDFNWKLKLDTENETKIQNNSEIVIGYRSEDVILNKNPIEGAIQGKIFNIEHLGKELSIVVKINENIEIVSTVLNNEKFVLYQNIWITFNQKRIHIFDLKTQERIN

SEQ ID NO: 36996 - DNA, 1182 bp, Mycobacterium tuberculosis CDC1551
  CDS (1)..(1182)
atggccgagattgtgttggaccacgtcaacaagagttaccccgacggtcacacagcggtgcgcgacctcaacctcaccatcgccgacggcgaatttctgatcctggtagggccttccggttgtggcaagaccacgacgctgaatatgattgctgggcttgaagatatctcgtcgggagaactgcgcatcgccggtgagcgggtaaacgagaaggcgccaaaggaccgtgacatcgcgatggtgttccagtcgtacgcgctttacccgcatatgacggtgcgccagaacatcgcgttcccgctgaccctggcgaagatgagaaaggccgacatcgcgcagaaggtctccgagactgcaaaaatccttgacctgaccaaccttctggatcgcaagccctcacaattgtcgggtggtcagcgacagcgggtcgcgatgggcagggcaatcgtgcgccatcccaaagcattcctgatggacgagccgctgtcgaacttggacgcgaagttgcgggtccagatgcgcggcgagattgcccagctgcagcggaggctgggtaccaccaccgtctacgtcacccacgaccagaccgaggcaatgacgctgggcgatcgcgtggtagtgatgtacgggggcatcgcacagcagatcggcacccctgaggagctttacgaacggcccgccaatctgtttgtcgcgggctttatcggctcgccggccatgaatttcttccctgccaggctgaccgcgatcggactgaccctgccgttcggtgaggtgacgctggcccccgaagtccagggggtgatcgcagcgcacccgaaaccggaaaacgtcatcgtaggcgtgcggccggagcatatccaggacgcagcattgatcgacgcgtatcaacgcatcagggcgctgaccttccaggtgaaggtcaacttggtcgagtctttaggcgccgacaaatatctgtatttcactaccgagagcccggctgtgcactcggttcagttggacgagttggcggaggtagagggggagtcggcgttacacgaaaatcagttcgtggcaagggttcccgccgagtccaaggtagccatcgggcagtcggtcgagttggctttcgataccgccagacttgccgtcttcgacgccgactccggtgcgaacctgaccattccgcaccgcgcctaa

SEQ ID NO: 36997 - protein, 393 aa, Mycobacterium tuberculosis CDC1551
MAEIVLDHVNKSYPDGHTAVRDLNLTIADGEFLILVGPSGCGKTTTLNMIAGLEDISSGELRIAGERVNEKAPKDRDIAMVFQSYALYPHMTVRQNIAFPLTLAKMRKADIAQKVSETAKILDLTNLLDRKPSQLSGGQRQRVAMGRAIVRHPKAFLMDEPLSNLDAKLRVQMRGEIAQLQRRLGTTTVYVTHDQTEAMTLGDRVVVMYGGIAQQIGTPEELYERPANLFVAGFIGSPAMNFFPARLTAIGLTLPFGEVTLAPEVQGVIAAHPKPENVIVGVRPEHIQDAALIDAYQRIRALTFQVKVNLVESLGADKYLYFTTESPAVHSVQLDELAEVEGESALHENQFVARVPAESKVAIGQSVELAFDTARLAVFDADSGANLTIPHRA

SEQ ID NO: 36998 - DNA, 1074 bp, Mycobacterium tuberculosis CDC1551
  CDS (1)..(1074)
atggcttcggtgagttttgagcaggcaacccggcgctatcccggcacggaccgaccggccctggatcggctcgacctgatcgtcggcgatggcgagttcgttgtcctggtggggccgtccggatgtggcaagacgacgtcgttacggatggtggctggcttggagacgctggactgtgggcgtatccggatcggcgagcgcgacgtcaccgaggtcgatcccaaggatcgtgatgtcgccatggtgttccagaactacgccctctacccgcacatgacggtggcgcagaacatgggcttcgcgttgaaggtcgccaagatcggcaaggccgagatccgcgagcgggtgcttgccgcagcgaaattgcttgatctgcaatcttatctggatcgcaagccgaaagatctctccggcggccaacggcaacgggtggcgatgggtcgtgcgatcgtgcggcgcccacaggtattcctgatggacgaaccgctgtccaatcttgacgccaaacttcgcgggcaaacccgcaatcagatcgccgcgttacaacggcaactgggtacgaccaccgtgtatgtcactcacgaccaggtcgaggccatgacgatgggtgaccgcgtcgcggtgctgtctgacggtgtgctgcaacagtgtgcttcgcctcgagagctctaccgcaacccgggcaacgtgttcgtcgcggggttcatcggttccccggcgatgaacctgttcaggctttccatcgccgattccacggtgtcactgggtgattggcagatcctgctgccgcgtgcggtcgtcggtacggcagccgaggtcattatcggtgttcgccccgaacatttggagctgggcggcgccggcatcgagatggacgtcgacatggtcgaagaacttggagcggacgcctacttgtatggccgaatcgtgtcgggcggctgcgaaatggaccagtcaatcgtcgctcgagtggacggccgcggcccgcccgagcggggtagtcgcgtgcggctatgtcccacaccgggacacctgcacttcttcgccgtcgacgggcgtcggattccgggctaa

SEQ ID NO: 36999 - protein, 357 aa, Mycobacterium tuberculosis CDC1551
MASVSFEQATRRYPGTDRPALDRLDLIVGDGEFVVLVGPSGCGKTTSLRMVAGLETLDCGRIRIGERDVTEVDPKDRDVAMVFQNYALYPHMTVAQNMGFALKVAKIGKAEIRERVLAAAKLLDLQSYLDRKPKDLSGGQRQRVAMGRAIVRRPQVFLMDEPLSNLDAKLRGQTRNQIAALQRQLGTTTVYVTHDQVEAMTMGDRVAVLSDGVLQQCASPRELYRNPGNVFVAGFIGSPAMNLFRLSIADSTVSLGDWQILLPRAVVGTAAEVIIGVRPEHLELGGAGIEMDVDMVEELGADAYLYGRIVSGGCEMDQSIVARVDGRGPPERGSRVRLCPTPGHLHFFAVDGRRIPG

SEQ ID NO: 37000 - DNA, 1083 bp, Mycobacterium tuberculosis CDC1551
  CDS (1)..(1083)
atggctaacgttcagtactctgctgtcacccagcgctatcccggcgccgacgcgccgaccgtcgacaacttggacctcgacatcgccgacggggagtttctggttctggtcggtccgtccggttgcggcaagtccaccacgctgcgcgtgctggccgggctggaacccattgagagcgggcgcatcagcatcggcgacgtggatgtgacgcatctgccgccgcgggcgcgtgacgtggcgatggtgttccagaactacgcgctgtacccgaacatgacggtggccgccaacatggggttcgcgctgcgaaacgccgggatgtcgcgcgcggacacccgccggcgggtgctggaagtcgccgacatgctggagctgacggatctgctggaccgcaagcccgccaagctctccggcgggcagcggcagcgggtggcgatgggccgggcgatcgtgcgccggccccgggtgttctgcatggacgagccgctgtcgaatctggacgccaagctgcgggtgagcacccgctcacagatctccggattgcagcgtcggttgggcaccaccaccgtctacgtcacccacgatcaggtggaggcgatgacgatgggcgaccgggtggcggtgctcaaagacggtgtgctgcaacaggttgacacgccgagggcgctgtatgacgacccggtcaacacgtttgtcgccacgttcatcggcgcgccggcgatgaacctcatcgacgccgccgtcgcccacggtgtggtgcgggcaccggatttggcgataccggttccggacccggcggccgagcgggtgctggtcggcgtgcggccggagtcctgggacgtggcatcgatcggcaccccgggatcgttgaccgtgcacgtcgagttggtggaggagctcggcttcgaatccttcgtctacgcaacgccggtcgaccagcggggctggtcgtcacgcgcaccgcgcatcgtgttccgcaccgaccggcgtaccgcggtgcgggtgggtgagtcgttggcgatcgtgccgcactcgcaggaggtgcgcctcttcaacagccgcaccgagacccggcttcgctga

SEQ ID NO: 37001 - protein, 360 aa, Mycobacterium tuberculosis CDC1551
MANVQYSAVTQRYPGADAPTVDNLDLDIADGEFLVLVGPSGCGKSTTLRVLAGLEPIESGRISIGDVDVTHLPPRARDVAMVFQNYALYPNMTVAANMGFALRNAGMSRADTRRRVLEVADMLELTDLLDRKPAKLSGGQRQRVAMGRAIVRRPRVFCMDEPLSNLDAKLRVSTRSQISGLQRRLGTTTVYVTHDQVEAMTMGDRVAVLKDGVLQQVDTPRALYDDPVNTFVATFIGAPAMNLIDAAVAHGVVRAPDLAIPVPDPAAERVLVGVRPESWDVASIGTPGSLTVHVELVEELGFESFVYATPVDQRGWSSRAPRIVFRTDRRTAVRVGESLAIVPHSQEVRLFNSRTETRLR

SEQ ID NO: 37002 - DNA, 1107 bp, Sulfolobus solfataricus P2
  CDS (1)..(1107)
atgatgagttacgttaaattagagaatatttggaaggagtatgaggagaagaaaaggaaagtgcaagttcttaggggactgaatttagagatagaaaagggagaatttgtagtaatcttagggccatctggagaaggaaaaactacaattttgaagattatagctggattattaagacaagataagggacatgtctatttgagaggtgaagttgtagacgatttacctcctaaagatagaagagtagcaatggtacctcaaaactacgcaatatacccttttatgtcagtttatgataacatagcgttcccgctaaaagtaatgcacttgtcaaaagatgagataaagaaaagggtgttagaggtagctagaatgctaaggatagacaatttgttagagaggaaacctagccagttaagcggagggcaaatgcaaagggttgctattgcaagggcattagtaaaaggagctgatataatcctaatggacgaacctttatctaatttagacgcacaagttagggtagtggctagagaagagctcaagcaactacaacgtgatcttaagcctacaataatatacgttactcacgatcaagttgaagctctaagcttagcaacaaaagttgcaatacttcacgatggtgtagtacaagcttatggcgatccgatggaaatctacaagagaccaaatagtgcttgggtagggagcttcttaggaaatcccccaatgaacattataagaggtgaaatagaaggcgactccataataatagatagctatagaataggattaccagaagagtacaaaaatttagtgaaaaatggtcaaaaagttcttgtaggagttagaccagaagatatggagatacgtaatagtggagaaatagaaggaaaggttgaaatggtagaggatctaggaccatatagtataattcacttaaagatcaatgaagaaactactattagagttatagagaaatcattgtctagacgagaaaggggagaaaaggtacgaatatccattgatactagcaaagtagtcctcttcgatgcttcaagcgaaagaaatctacttgagcaatatgagaaagtgagcaagaagtga

SEQ ID NO: 37003 - protein, 368 aa, Sulfolobus solfataricus P2
MMSYVKLENIWKEYEEKKRKVQVLRGLNLEIEKGEFVVILGPSGEGKTTILKIIAGLLRQDKGHVYLRGEVVDDLPPKDRRVAMVPQNYAIYPFMSVYDNIAFPLKVMHLSKDEIKKRVLEVARMLRIDNLLERKPSQLSGGQMQRVAIARALVKGADIILMDEPLSNLDAQVRVVAREELKQLQRDLKPTIIYVTHDQVEALSLATKVAILHDGVVQAYGDPMEIYKRPNSAWVGSFLGNPPMNIIRGEIEGDSIIIDSYRIGLPEEYKNLVKNGQKVLVGVRPEDMEIRNSGEIEGKVEMVEDLGPYSIIHLKINEETTIRVIEKSLSRRERGEKVRISIDTSKVVLFDASSERNLLEQYEKVSKK

SEQ ID NO: 37004 - DNA, 1110 bp, Clostridium acetobutylicum ATCC 824
  CDS (1)..(1110)
atggcagatttatctttaaagcacatttataaagtttatgatggtaatgttactgcggttaaggatttcaatcttgacgttgcggataaggaatttattgtatttgtaggaccttccggttgtggtaagtcaactacgcttaggatgatagcaggacttgaagagataactaagggagaactaacaataggtggaagagtagttaatgatgtttccccaaaggatagagatattgctatggtgttccaaaactatgctttatatcctcacatgactgtttatgaaaatatggcttttgggctaaaactaagaaaaacacccaaagatgttatagatgagaaagttaaaaaagcagcagagattttagatatagcacaccttctcgatagaaaaccgaaggcactatcaggaggacaaagacagagagttgctatgggaagagcgatagtaagggaacctaaggtatttcttatggatgaacctctatcaaatttggatgcaaaacttagagttcaaatgagaactgaaatagccaagcttcacaaggatctacaaaatacatttatatatgttactcatgatcagacagaggctatgactttaggaactagaatagtagttatgaaggatggagttattcagcaggttgatactccacaaaatatatatgaaaagccaaagaatatgtttgttgcaggttttattggaagtcctcaaatgaattttgttgattctaaggtgactgaagatagcggaaaaattatggtatcagttgaaggacaagaaattcctgtttcaggtgatatcagtaaaatacttaaagaaaatggttatattaataaagaagttattttaggtataaggcctgaaaatatggatgaaagtcctgaatttcttcaaaagcataaggacgcaataatcaatgcaaaagtagaggttactgaacttatgggtgctgaaacatatatacatcttgcaaagggcaaggctaattttatagtgagggttaatggtgcatctacttcaaaagcaggagacgaaattaaaattggaataaatattaacaaacttcatgtgtttgataaagaaacggaagaaactatattataa

SEQ ID NO: 37005 - protein, 369 aa, Clostridium acetobutylicum ATCC 824
MADLSLKHIYKVYDGNVTAVKDFNLDVADKEFIVFVGPSGCGKSTTLRMIAGLEEITKGELTIGGRVVNDVSPKDRDIAMVFQNYALYPHMTVYENMAFGLKLRKTPKDVIDEKVKKAAEILDIAHLLDRKPKALSGGQRQRVAMGRAIVREPKVFLMDEPLSNLDAKLRVQMRTEIAKLHKDLQNTFIYVTHDQTEAMTLGTRIVVMKDGVIQQVDTPQNIYEKPKNMFVAGFIGSPQMNFVDSKVTEDSGKIMVSVEGQEIPVSGDISKILKENGYINKEVILGIRPENMDESPEFLQKHKDAIINAKVEVTELMGAETYIHLAKGKANFIVRVNGASTSKAGDEIKIGININKLHVFDKETEETIL

SEQ ID NO: 37006 - DNA, 1107 bp, Agrobacterium tumefaciens str. C58
  CDS (1)..(1107)
gtgatgggaagtctgaaactcgaaaacctcaacaaggcgttcggcgccgttcatgtgctgcatgatatcgatcttcagatcgaaaacggtgaattcgtcgttttcgtcggcccctccggctgcggaaaatcgacgctgctgcgcatcatcgcagggcttgaggacgtctcctccggcaccatcggcattggcgggcgcgatgtcagcgcgttgtcgccggccgagcgcaagatcgctatggtgttccagtcctatgcgctttatccacatatgagcgtgcgcaagaaccttgccttcggtctggaaaatctgcgcttcaagcgggcggaaatcgaaagccgcatcaacgaggcggcgcgtatgctcgccatcgagccctatctcgaccgcaagccgaaacagctttccggcggccagcgccagcgtgtcgccatcggccgcgcgatcgtgcgcgagcctgacatctttctgttcgacgagccgttgtcgaacctcgatgcggcactgcgcgtgcagacccgcgccgaaatcacgcggctgcaccgcgatatcaagacaacgatgatctatgtcacccacgatcaggtggaagccatgaccatggccgacaagatcgtggtgctgcgtgcaggacgcatcgagcaggtgggcagcccgcttgagcttttcgacaatccgcgcaacctcttcgttgccggtttcctcggttcaccgcgcatgaacatgctgaagggcaccatcaccaagggcgaggacggcaacatcgccatcgacgccggctacggcgtgtcgctcccctgcctcgtcgaccccgcaaccgtcagtcccggacagccggttctggcgggcatccgcccctcgcatttcgccatcgcggatgccggcctgcccttcgaggtgcaatatcacgaaagcctcggcaccgagacctatctctacggcaatcttcagggtgaaaaagagcagatcatcgtgcatcaggcgggccatttcgcgcccgcctccggctccgttctgaagatcatgccggcacgggaaaaggtgcatgtcttcgatcccgccaccgaactggcgctgccgcgcgccgcgagcgaagggagaggttag

SEQ ID NO: 37007 - protein, 368 aa, Agrobacterium tumefaciens str. C58
MMGSLKLENLNKAFGAVHVLHDIDLQIENGEFVVFVGPSGCGKSTLLRIIAGLEDVSSGTIGIGGRDVSALSPAERKIAMVFQSYALYPHMSVRKNLAFGLENLRFKRAEIESRINEAARMLAIEPYLDRKPKQLSGGQRQRVAIGRAIVREPDIFLFDEPLSNLDAALRVQTRAEITRLHRDIKTTMIYVTHDQVEAMTMADKIVVLRAGRIEQVGSPLELFDNPRNLFVAGFLGSPRMNMLKGTITKGEDGNIAIDAGYGVSLPCLVDPATVSPGQPVLAGIRPSHFAIADAGLPFEVQYHESLGTETYLYGNLQGEKEQIIVHQAGHFAPASGSVLKIMPAREKVHVFDPATELALPRAASEGRG

SEQ ID NO: 37008 - DNA, 1242 bp, Agrobacterium tumefaciens str. C58
  CDS (1)..(1242)
atgaaaggtaatatcacgtcctcagggagacaggcgtttcgccatccccgctatcgccagacaatcgggatcgattttcgaagatgcgatacggggaacttgaaggttgataccggctattgcgtccattcaaattctgggcgcgccggtcgtgaggaggaaaatatggcttcggtcagcctgcgcaagctggacaagagttacggtgcgcttcgcatcgtcaagggcatcgaccttgaaatcaacgatggcgaattcgtcgtgttcgtcggcccttccggctgcggcaaatcgacgacgctacgcatggtcgcggggctggagagcattaccggcggcgaggtgaagatcggcgaccgcgtcgtcaaccagctgccgccgcgtgaacgcgacatcgccatggtgtttcaggactatgcgctttatccgcacaagacggtgcgcgaaaacatgggtttcagcctgaaggtgcgcggcgtcagcgcttcccaggccaatgccagcatcgatgaagcggcgaagatgctgggcatcgagcaccttctcgaccggcggcccggccagctttccggcggccagcgtcagcgtgtggccatgggacgcgccatagtacgccgcccgcaggtcttcctgttcgatgagccgctttccaacctagacgccaagctgcgcggacaggtgcgcaccgaaatcaaacgcctgcatcagcagctcggcacgacgatcatttacgttacccatgatcaggtggaggcgatgacgctcgccgaccgcatcgtcatcctgcgcggcggcgatatcgaacaggttggtacgccggatgaggtttataaccgcccggaaagcgtctttgtgggtggtttcgtcggtgcgcccgccatgaatttcgcccgcgccagggtcaatggcgaccggctggcattttccgacggcaactccctgccgatggcggccatccggccatcgcgcgaaacagggctcgaaggccgagacgtcatcgtcggcattcgtccggaacatttcggtcccgccgaaggcttcgacagccagcttgccgtcagcgtgcaggtggtggaaccgttgggttcggacacgctcgtccatttcagccttggcgacgcggcgctgaccgcacggatgccgccgcagcttcggccaacgccgaacgaggaactgcggatcggcgtcgatccatccaaggtccatcttttcgacgcgacgacggaacgctcgattcactga

SEQ ID NO: 37009 - protein, 413 aa, Agrobacterium tumefaciens str. C58
MKGNITSSGRQAFRHPRYRQTIGIDFRRCDTGNLKVDTGYCVHSNSGRAGREEENMASVSLRKLDKSYGALRIVKGIDLEINDGEFVVFVGPSGCGKSTTLRMVAGLESITGGEVKIGDRVVNQLPPRERDIAMVFQDYALYPHKTVRENMGFSLKVRGVSASQANASIDEAAKMLGIEHLLDRRPGQLSGGQRQRVAMGRAIVRRPQVFLFDEPLSNLDAKLRGQVRTEIKRLHQQLGTTIIYVTHDQVEAMTLADRIVILRGGDIEQVGTPDEVYNRPESVFVGGFVGAPAMNFARARVNGDRLAFSDGNSLPMAAIRPSRETGLEGRDVIVGIRPEHFGPAEGFDSQLAVSVQVVEPLGSDTLVHFSLGDAALTARMPPQLRPTPNEELRIGVDPSKVHLFDATTERSIH

SEQ ID NO: 37010 - DNA, 1131 bp, Streptococcus pneumoniae R6
  CDS (1)..(1131)
atggtagaattgaatcttaaaaatatttacaaaaaatatccaaacagcgaacactattcagttgaagatttcaacttgaacatcaaagataaagaatttatcgttttcgtaggaccttcaggatgtggtaaatcaactacactccgtatgattgctggtcttgaagacattacagaaggtactgcatctatcgatggcgtggttgtcaacgacgtagctccaaaagaccgtgatatcgccatggtattccaaaactacgctctttacccacacatgactgtttatgacaacatggctttcggtttgaaattgcgtaaatacagcaaagaagacattaacaaacgtgttcaagaagcagctgaaatacttggattgaaagaattcttggaacgtaaaccagctgacctttcaggtggtcaacgtcaacgtgttgccatggggcgtgcgattgtccgtgatgcgaaagtattcttgatggacgaacctttgtcaaacttggatgccaaacttcgtgtatcaatgcgtgctgaaatcgctaaaattcaccgtcgtatcggagctacaactatctatgtaactcacgaccaaacagaagcgatgacacttgcagaccgtatcgttattatgtcagctactaagaaccctgctggtacaggtactatcggacgtgtagaacaaatcggtactcctcaagaagtttacaaaaatccagttaacaaattcgttgcaggattcatcggaagcccagctatgaacttcatcaacgtgaaattggttggtagcgaaattgtttctgacggtttccgtttgaaagtgccagaaggagcattgaaagttcttcgtgaaaaaggctacgaaggaaaagaattgatctttggtatccgtccagaagacgtgaatgcagaacctgctttccttgaaacattcccagactgtgttgtaaaagcgactatctctgtatcagaactgcttggttcagaatctcacctttactgccaagttggtaaagacgagtttgttgcaaaagttgatgctcgtgactacttgcaaacaggtgcaacagttgagcttggatttgacttgaacaaagcacacttcttcgatgtagaaactgaaaaaacaatctactaa

SEQ ID NO: 37011 - protein, 376 aa, Streptococcus pneumoniae R6
MVELNLKNIYKKYPNSEHYSVEDFNLNIKDKEFIVFVGPSGCGKSTTLRMIAGLEDITEGTASIDGVVVNDVAPKDRDIAMVFQNYALYPHMTVYDNMAFGLKLRKYSKEDINKRVQEAAEILGLKEFLERKPADLSGGQRQRVAMGRAIVRDAKVFLMDEPLSNLDAKLRVSMRAEIAKIHRRIGATTIYVTHDQTEAMTLADRIVIMSATKNPAGTGTIGRVEQIGTPQEVYKNPVNKFVAGFIGSPAMNFINVKLVGSEIVSDGFRLKVPEGALKVLREKGYEGKELIFGIRPEDVNAEPAFLETFPDCVVKATISVSELLGSESHLYCQVGKDEFVAKVDARDYLQTGATVELGFDLNKAHFFDVETEKTIY

SEQ ID NO: 37012 - DNA, 1104 bp, Sulfolobus tokodaii str. 7
  CDS (1)..(1104)
atgagttatgttaaattagaagatatttggaaggagtatgagtcaaaaggaaagaaagtagaagtattaagaggattaaacctagatatagagaaaggagaatttgtagttattctaggaccttctggtgaaggaaagacaacaattttaaaaattatagcaggattattaaggcaagataaaggtcacgtatatttaagaggaaaaatagtagatgatttacctcctaaagacagaaatgttgcaatggtaccacaaaactacgctttatacccctttatgtcagtatacgataatatagcctttcctttaaagatagcacatgtccctaaggatgaaattaagaaaaaagtagaggaagtggctagaatgttaagaatagatgacttattggatagaaagcctagccaattgagcggaggtcagatgcaaagggtggcaatagcaagagcattagttaaaggtgcagatatcatattaatggacgaacctttatcaaaccttgatgctcaagttagagttttagctagagaagagttaaaacaattacagcgtagtcttaaaccaaccataatatatgttactcatgaccagatagaagcgttaagtttagcctcaaaagtagcaatacttcatgagggagttatacaagcttatggagatccaatggaaatatatagagaaccaaataatgcatgggtagcaaaattcttaggtaatcctccaatgaacgtcttgaaaggagaaataaaagatagtagtataatcataggcaacactaaaattgagttacctactaaattcagaagtatagttaaagaagggcaaaaagtcttagtgggtattagaccagaggacctttacttaaatgataacggacctttagaaggtagtgtagaaatggtagaagacctaggaccatatagcattattcatgttaggatagaggatgagattataagagtaatagaaaaatcaataatgaggagagaaagaggtgaaaaggttaatctaagtattgatactagtaaaattgttctttttgaccaagaaagtgagaaaaatcttatgctgttacaatcgaaagtggaaagcaatgaataa

SEQ ID NO: 37013 - protein, 367 aa, Sulfolobus tokodaii str. 7
MSYVKLEDIWKEYESKGKKVEVLRGLNLDIEKGEFVVILGPSGEGKTTILKIIAGLLRQDKGHVYLRGKIVDDLPPKDRNVAMVPQNYALYPFMSVYDNIAFPLKIAHVPKDEIKKKVEEVARMLRIDDLLDRKPSQLSGGQMQRVAIARALVKGADIILMDEPLSNLDAQVRVLAREELKQLQRSLKPTIIYVTHDQIEALSLASKVAILHEGVIQAYGDPMEIYREPNNAWVAKFLGNPPMNVLKGEIKDSSIIIGNTKIELPTKFRSIVKEGQKVLVGIRPEDLYLNDNGPLEGSVEMVEDLGPYSIIHVRIEDEIIRVIEKSIMRRERGEKVNLSIDTSKIVLFDQESEKNLMLLQSKVESNE

SEQ ID NO: 37014 - DNA, 1086 bp, Sinorhizobium meliloti 1021
  CDS (1)..(1086)
atgacaagcgtatctgtcagggacctgtcgttgaacttcggcgccgtcacagtgctcgacaggctcaatctcgacatcgatcacggggagttcctcgtcctgctcggctcttccgggtgcggcaagtccacgctgctcaattgcattgccgggctgctcgacgtttccgacgggcagatcttcatcaaggaccgcaacgtcacctgggaggagccgaaggaccgcggcatcggcatggtgtttcagtcctatgcgctctatccgcagatgaccgttgagaagaatctctccttcggcttgaaagtcgccaagatcccgccggccgaaatcgaaaagcgcgtgaagcgggcctcggagatcctgcagatccagccgctgctcaagcgcaaaccttcggagctctccggcggtcagcggcagcgcgtggcgatcggccgggcgctggtgcgcgatgtcgacgtcttcctgttcgacgagccgctgtcgaacctcgacgccaaactgcgctccgaactgcgcgtggagatcaagcgcctgcaccagtcgctgaagaatacgatgatctacgtcacccatgaccagatcgaagcgctgacgctggccgaccggatcgccgtcatgaaaagcggcgtgatccagcaactcgccgatccgatgacgatctataacgccccggagaacctcttcgtcgccggcttcatcggctcgccgtcgatgaatttcttccgcggcgaggtggagccgaaggatggacgcagtttcgttcgggccggcggcatcgccttcgacgtgaccgcctatccggcgcataccaggctgcagccgggccagaaagtcgttctcggcctgcggccggagcacgtgaaggtcgacgaggcgagggacggcgagccaacgcatcaggcggtcgtcgacatcgaggaaccgatgggggcggacaacctcctatggctgacatttgccggccaatcgatgtcggtgcggattgccggccaaaggcgctacccgccgggaagcacggtgcgcctctccttcgacatgggcgtcgcgtcgattttcgacgccgagagtgaaaaccgcctctga

SEQ ID NO: 37015 - protein, 361 aa, Sinorhizobium meliloti 1021
MTSVSVRDLSLNFGAVTVLDRLNLDIDHGEFLVLLGSSGCGKSTLLNCIAGLLDVSDGQIFIKDRNVTWEEPKDRGIGMVFQSYALYPQMTVEKNLSFGLKVAKIPPAEIEKRVKRASEILQIQPLLKRKPSELSGGQRQRVAIGRALVRDVDVFLFDEPLSNLDAKLRSELRVEIKRLHQSLKNTMIYVTHDQIEALTLADRIAVMKSGVIQQLADPMTIYNAPENLFVAGFIGSPSMNFFRGEVEPKDGRSFVRAGGIAFDVTAYPAHTRLQPGQKVVLGLRPEHVKVDEARDGEPTHQAVVDIEEPMGADNLLWLTFAGQSMSVRIAGQRRYPPGSTVRLSFDMGVASIFDAESENRL

SEQ ID NO: 37016 - DNA, 1002 bp, Sinorhizobium meliloti 1021
  CDS (1)..(1002)
atgggaagcatcactctcaagaacgtatcgaaggtcttcggcgcccacgccgtcatcccctcgatagacctcgatatcaccgacggcgagtttgtcgtcttcgtcggcccctcgggctgcggcaagtccacgcttctgaggctgatcgccggactggaggacgtcagcgatggcgagatcgtcatcgacggccggaacgccaccgagctgccgccggcaaggcgcgggctttcgatggtgttccagtcctacgcgctctatccgcatatgagcgtgcgctccaacatcgcctttccgctgaagatggcgggtgaggacaaggcctcgatcgacaagaaggtcgaggacgcggcgcgcgtcctgaacctcaccgactatctcgaccgcaagccccgccagctttccggcggccagcgccagcgcgtcgcgatcggccgggcgatcgttcgccagccggaagccttccttttcgacgagccgctgtctaacctcgacgccgcgctgcgggtcaacatgcgactggagatcagccagcttcaccagcaactgaagacgacgatggtctacgtgacgcacgaccaggtggaggccatgaccatggccgacaagatcgtcgtgctcaaccgcggccgcatcgagcaggtgggctcgcccctcgacctctaccgcaggccggacaatctcttcgtcgccggtttcatcgggtcgccgaagatgaatttcgtcaccggtgcgccggccgcggcccatcaggcccacacgatcggcatccgcccggagcatattgccctttcgaaggatcagggcacatggcggggcacggtgggagtggccgagcatctcggctcggacaccttcctgcacgtgaacgccgacggcatcggtactttgacggcgcgcgtcggcggcgacttcgcggtgacccatggcgatcaggtctacctgacgcccgatgctgagcgcctccacaggttcgatgaaaagggactggcaattcgatga

SEQ ID NO: 37017 - protein, 333 aa, Sinorhizobium meliloti 1021
MGSITLKNVSKVFGAHAVIPSIDLDITDGEFVVFVGPSGCGKSTLLRLIAGLEDVSDGEIVIDGRNATELPPARRGLSMVFQSYALYPHMSVRSNIAFPLKMAGEDKASIDKKVEDAARVLNLTDYLDRKPRQLSGGQRQRVAIGRAIVRQPEAFLFDEPLSNLDAALRVNMRLEISQLHQQLKTTMVYVTHDQVEAMTMADKIVVLNRGRIEQVGSPLDLYRRPDNLFVAGFIGSPKMNFVTGAPAAAHQAHTIGIRPEHIALSKDQGTWRGTVGVAEHLGSDTFLHVNADGIGTLTARVGGDFAVTHGDQVYLTPDAERLHRFDEKGLAIR

SEQ ID NO: 37018 - DNA, 1068 bp, Sinorhizobium meliloti 1021
  CDS (1)..(1068)
atggcttccatcgacatcgccaacatcaagaagtcctacggtacccacccggtgctgcacgacgtcgacctcaagatcagcgacggcgaattcgtcgtgctcgtcggtccctccggctgcggcaagtcgacccttctgcgcatgatcgccgggcttgagagcgtgaccggcggcgagatccgcatcgccggcaggcgggtcaacgaactcgccccgaaggaccgcgacatcgccatggtgttccagtcctatgcgctctacccgcatatgtcggtcgccaggaacatgagctacagcctgaggctccgcaagacggccaaggacaggataacgacggtcgttgcgggcgccgctgccaagctcggcctcgacccgttgctcgaccgccgccccaaggcgctctccggcggccagcgccagcgcgtcgccatgggccgcgccatcgtgcgccagccgaaggcgtttctcttcgacgaaccgctctccaacctcgatgcgcgcctgcgcgagcagatgcgcgccgagatcaagaaactgcacaaggatctcggcgccacctccatctatgtgacgcacgatcagatcgaggcgatgacgctcgcagaccggatcgtcgccatgaatggcggcgtggtccagcaggtcggaagcccgctcgatctttacgaccgtcctgccaaccttttcgtcgccggcttcatcggctcgccgggcatgaatttcttcgagggtgcctaccacgcgggcgacgcgccgcgcttcgagatgtcggatgagatcggcattccgctcgacgcggccgcgcccgtttcgaataactcaaaggtgacgctcggcatccgtcccgaacatgtcgtgcttgccggccacggcccggagacgctgcttgccggcgtcgacctggtcgagccgaccggcttcggcatcatcctgcatctctcgctcgggcgggcggccttcaaggtcttcaccaacgaccgatccttcctgacggcgtccggcacgatccccgtccacttccccgctcatcacctgcatttcttcgatgcggagggcaaacgcgtctga

SEQ ID NO: 37019 - protein, 355 aa, Sinorhizobium meliloti 1021
MASIDIANIKKSYGTHPVLHDVDLKISDGEFVVLVGPSGCGKSTLLRMIAGLESVTGGEIRIAGRRVNELAPKDRDIAMVFQSYALYPHMSVARNMSYSLRLRKTAKDRITTVVAGAAAKLGLDPLLDRRPKALSGGQRQRVAMGRAIVRQPKAFLFDEPLSNLDARLREQMRAEIKKLHKDLGATSIYVTHDQIEAMTLADRIVAMNGGVVQQVGSPLDLYDRPANLFVAGFIGSPGMNFFEGAYHAGDAPRFEMSDEIGIPLDAAAPVSNNSKVTLGIRPEHVVLAGHGPETLLAGVDLVEPTGFGIILHLSLGRAAFKVFTNDRSFLTASGTIPVHFPAHHLHFFDAEGKRV

SEQ ID NO: 37020 - DNA, 1104 bp, Bacillus subtilis subsp. subtilis str. 168
  CDS (1)..(1104)
atggcttcattaacatttgaacacgtcaaaaaatcatatcactcacaattaaccgtgaaggactttgatttagatgtaaaggataaggagcttttggtgctggtggggccgtcaggatgcggaaaatcaacaacgctgcggatggtggctggattagaaagcatttctgaaggaaatcttcttattgatggggagcgggtcaatgatcttccgccgaaagaacgtgatattgcgatggtattccagaactatgcgctttatccgcatatgacggtttttgataatatggcgtttggattaaagctcagaaagatggcgaaacaggaaattgccgagcgggttcatgcggcagccagaattttagaaattgaacatttgctgaagagaaaaccgaaggcgctctccggcgggcagcggcaaagggtggcgcttggcaggtcgattgtgagggagccgaaggtctttttaatggacgagccgctttctaatctggatgcaaaactaagagtgacgatgcggacagaaatcagcaagctgcaccagcgattagaggcaacgatcatttatgtcacgcatgaccagaccgaagcaatgacaatgggagatcggattgtcgtcatgaatgaaggggaaattcagcaagtggcgaaacctcatgacatttatcattacccggccaatttgtttgtcgcaggcttcattggctctcccggaatgaactttttgaaaggcatcatagaacagcagcatggcgagctgtttttcacaaattcttcgatccggcttcatattcctgaagaaaaagcaaagcggctgaaggaaaagggatatgccggagaacagatgattgccggtgtacggccggagcacatcacacaaatgacaggaaatgaccagttgtttgattcagtgtttcaagcgaacgtggaagtgaatgaaaatctgggctcggagctcatagtgcatgtcatggctggggacgagcggctcaaggtccgcctggacggaaacacgcgaatcgatgcaggcgattcaatccagctctcagtgaaaatggaccacgtcgtctttttcgatgcggaaacggaagaggctgtgtattag

SEQ ID NO: 37021 - protein, 367 aa, Bacillus subtilis subsp. subtilis str. 168
MASLTFEHVKKSYHSQLTVKDFDLDVKDKELLVLVGPSGCGKSTTLRMVAGLESISEGNLLIDGERVNDLPPKERDIAMVFQNYALYPHMTVFDNMAFGLKLRKMAKQEIAERVHAAARILEIEHLLKRKPKALSGGQRQRVALGRSIVREPKVFLMDEPLSNLDAKLRVTMRTEISKLHQRLEATIIYVTHDQTEAMTMGDRIVVMNEGEIQQVAKPHDIYHYPANLFVAGFIGSPGMNFLKGIIEQQHGELFFTNSSIRLHIPEEKAKRLKEKGYAGEQMIAGVRPEHITQMTGNDQLFDSVFQANVEVNENLGSELIVHVMAGDERLKVRLDGNTRIDAGDSIQLSVKMDHVVFFDAETEEAVY

SEQ ID NO: 37022 - DNA, 1116 bp, Thermoplasma acidophilum DSM 1728
  CDS (1)..(1116)
atgacggtagtgaggctggaacatgtaaccagagatttcggaaagaattcgcctaatggacctcatacaggtgttttcgatatcaatctcacgatcaacaatggtgaattttttgttattctcggccctagcggctctgggaaatctaccatgctgaggataatagcaggactagagaaagttgattccggtcatatattcctagatgagtatgaaatcacggattttcctccgaaggatagggatatggcaatggtcttccagaactatgctctttatcccttcatgaccgtttacgacaatatagcatttcccctcaagatccagaagatcagtaaacaggagatagacgaacgcgtaagggaggttgctaagctacttgatatagagggcattttaaacatgaaaccgggacagatatcggggggacagaggcaaagagttgcgctgggacgtgcaatcattaggaggccggctgttttcctcatggatgagccattatcgaacctcgacgcgaaactgcgaggcacgatgagagttgaattgaagaaattgcacgagcagttgggtatcacaacaatatacgtcactcatgatcagatcgaggctatgacacttgccgatagggttggcgttataaacaggggaaatctcatacaggtaggagggcctatggatgtctatgattcacctgctaatacctttatagctggatttgtcggagatccaccaataaacttcatagatggaacaatagtcaccgaaggccgtgataagattctgaggatcaacgaattcaagcttgacatagggcaggaattcccagacaatgtcgctgaagtgactgtaggcattagacctgaggatattggagaaggcgatgaaggcttcgttgctgagcttgaagcgatacagcctcttggacggagacggcttgagtattatatcgtgaagaatactggcacaagaattgtgagagctacttctttgctccaagaaagaagaataggcgaggaggttaaactgatacctctgaataacaggctgctcatctttgacaaaagctcaggaaaattactgtggaacggaaaaaagataagcgttgccgaggcctga

SEQ ID NO: 37023 - protein, 371 aa, Thermoplasma acidophilum DSM 1728
MTVVRLEHVTRDFGKNSPNGPHTGVFDINLTINNGEFFVILGPSGSGKSTMLRIIAGLEKVDSGHIFLDEYEITDFPPKDRDMAMVFQNYALYPFMTVYDNIAFPLKIQKISKQEIDERVREVAKLLDIEGILNMKPGQISGGQRQRVALGRAIIRRPAVFLMDEPLSNLDAKLRGTMRVELKKLHEQLGITTIYVTHDQIEAMTLADRVGVINRGNLIQVGGPMDVYDSPANTFIAGFVGDPPINFIDGTIVTEGRDKILRINEFKLDIGQEFPDNVAEVTVGIRPEDIGEGDEGFVAELEAIQPLGRRRLEYYIVKNTGTRIVRATSLLQERRIGEEVKLIPLNNRLLIFDKSSGKLLWNGKKISVAEA

SEQ ID NO: 37024 - DNA, 1119 bp, Thermoplasma acidophilum DSM 1728
  CDS (1)..(1119)
atgagcgttataatagagaatctcacagcaagatatggagacaagtacatattgaagaatttcaacctgagggtggaagacggagagttcttcgtcatcctcggatcttcgggaagtggaaagacaacgctgcttagaagcatagccggcctgataccaatcgatgatggcaggatactcatagatggcaatgatgtaacggatctgtatccatcggacaggaacattgccatggtcttccagaacttcgcgctctatccccatatgaccgtatacgacaacatctcactgaatcttaagatcaagcacgttccaaaggatgagatcaagaagaaggttagtgacgttgcagagatgcttcacataagccagcatctgcagaaatacccgagacagctatccggcggtgaacagcagcgtgttggtatcgcaagggccatggttcgtgatccttcggtttttctgatggacgaaccgctatcgaaccttgatgccaagcttcggcgggagatgctcggtgagctaagatcattccatgagaaggtaaagaagaccataatctacgtgtgccacgatcaggatgaggcgatggcgcttgcggacaggatacttgtcctcaaccaggggcagataatgcagctcggaactcctgatgaactgtacgatcaccccgcgaacgtttttgtagctggattcataggaaatcccccaatgaacattcttgaatgcgacgccgaggagaaatcaggaggtacaaggatagacgtcatgaattctggatacctggaagttgatgatgaaataccagagggcaagatgttcatcggcataaggcctgagctgataggcctatccgatcatgatggcatatctgcttcattcgactatttcataaattccggccttaacgccgaggtgcacgttaagatcggtgatacgcccatcagggcggtcattcccaaagaggagatccctgcaaatctcagagatctgcgcaacggagaatccatacatttgaaggtgaaacccggcacgatatatctctacgacagggagagcggatcgatagtaaaggaggttgattacggtgcttccagagagatcaagaaggctgattga

SEQ ID NO: 37025 - protein, 372 aa, Thermoplasma acidophilum DSM 1728
MSVIIENLTARYGDKYILKNFNLRVEDGEFFVILGSSGSGKTTLLRSIAGLIPIDDGRILIDGNDVTDLYPSDRNIAMVFQNFALYPHMTVYDNISLNLKIKHVPKDEIKKKVSDVAEMLHISQHLQKYPRQLSGGEQQRVGIARAMVRDPSVFLMDEPLSNLDAKLRREMLGELRSFHEKVKKTIIYVCHDQDEAMALADRILVLNQGQIMQLGTPDELYDHPANVFVAGFIGNPPMNILECDAEEKSGGTRIDVMNSGYLEVDDEIPEGKMFIGIRPELIGLSDHDGISASFDYFINSGLNAEVHVKIGDTPIRAVIPKEEIPANLRDLRNGESIHLKVKPGTIYLYDRESGSIVKEVDYGASREIKKAD

SEQ ID NO: 37026 - DNA, 1140 bp, Halobacterium salinarum NRC-1
  CDS (1)..(1140)
atgagtacgatcacactcaccgacctcaccaaacactacgacagcatcgccgcggttgacgggatcgatctcgatgtcctcgacgaggagttcctcgtcgtcgttggcccctcgggctgtggcaaatcgacgacgcttcggctcatcgctggcctcgaggacgccacggccggcaccatccggatcggcggcactgatgtcaccgactcaccacccgaggaccgtgacatcgctatggtgttccagaactacgccctgtatccacacatgactgccgccgagaacatgaccttcgggatgcagtcagtcaccgattactccagcgccgagatcgaggaccgcgtcgccgacgcagccgcaacactcggtatcacggagttactcgaccggaccccagacgccctctccggtggtgagcgccagcgcgtggccatcgggcgcgcgctcgttcgcgagccgtccgtgttcctgctcgacgaaccactgtcgaacctcgacgcgaagctccgcgtccacatgcgggcggagctgtcgaaactccatcgagaactcgacaccacaaccgtctacgtgacccacgaccagaccgaagcgatgacgcttggcgaccgcgtcgccgtcctcaacgacggcaccgtccaacaggtcgcgccgccacagcaactctatgatttccccgcaaaccagttcgtcgccggattcatcggcgaaccggcaatgaacctggttcccgtgcgggttcgcgaccgcccccgtggtctcgttgccgaccacgaggggttcgctcacccgcttcccgacggcggctccaactcggcactcgttgaccgccgcctgacattcggggttcgacccgaggacgtcctattggctgggcgctctgccactggacacgaggagtcctttgaggcgagggtaaccgtccgagaaccgctcggtgaacagctcctgttacactgcaccatcggtgacgacgagctacaggtgaaagtccaacctcgccgggacgtttcgaccggggacacgatccgtctgtgcttcgatcagcaacgcctccacctgtttgaccccgagaccggtgacgcgatctaccacgcggcgtccgaagaccaacccgccaaaccaaccccgtcacagtag

SEQ ID NO: 37027 - protein, 379 aa, Halobacterium salinarum NRC-1
MSTITLTDLTKHYDSIAAVDGIDLDVLDEEFLVVVGPSGCGKSTTLRLIAGLEDATAGTIRIGGTDVTDSPPEDRDIAMVFQNYALYPHMTAAENMTFGMQSVTDYSSAEIEDRVADAAATLGITELLDRTPDALSGGERQRVAIGRALVREPSVFLLDEPLSNLDAKLRVHMRAELSKLHRELDTTTVYVTHDQTEAMTLGDRVAVLNDGTVQQVAPPQQLYDFPANQFVAGFIGEPAMNLVPVRVRDRPRGLVADHEGFAHPLPDGGSNSALVDRRLTFGVRPEDVLLAGRSATGHEESFEARVTVREPLGEQLLLHCTIGDDELQVKVQPRRDVSTGDTIRLCFDQQRLHLFDPETGDAIYHAASEDQPAKPTPSQ

SEQ ID NO: 37028 - DNA, 1074 bp, Yersinia pestis CO92
  CDS (1)..(1074)
atggcatgtttaaaattacaggcagtaaccaaatcttatgacggcgtgacgccagtgattaagcagattgatttggatgtcgccgatggcgaattcatcgtgatggtcggtccgtccgggtgtggtaaatcaacgctgttacgcatggtcgcggggttagaacgcacgaccactggggatatctatatcggggatcagcgggtaaccgatctggaacctaaagaccgtggtatcgcgatggtatttcagaattacgtgctttatccccatatgaacgtattcgataacatggcttatggcctaaaaatccggggttttggcaaagaacagatccgccaacgggtggatgaagcggcacgtattctggagttgcagccgctactgaaacgcaaaccgcgtgagttatccggtggtcagcggcagcgggtagcgatggggcgtgccattgtgcgcgagcccgcagttttcttatttgatgagccgctctctaatctggatgccaagttacgggtgcagatgcgccttgaactgcaacaactgcaccgccgcctgaaaaccactagcttgtatgtcacacatgatcaggttgaggccatgacattggcacagcgggtgattgtgatgaacaaaggggttgccgagcaaatcggtacccccagcgaggtttataaacggcctgcgtcactgtttgtcgccagttttatcggctcgcccgcgatgaatttattagacggtacggtcagcccagatgggcgcacgtttattttatccgatggtctgactctgccactggagatccctcagccacaatgggggggccggcgcttgactctaggtattcgcccggagcatattcagcagacaacctcagcgcagggtgtgccgatgaacctgctaacgctggaattattaggcgcagataatctggcgcacggcctgtggggcgggcaaagtatcattgctcgcttatcccatgaagaaatgccagtggcaggcagtacattgcatttatatttaccgccagcagcgctgcacttctttgataccgatagcggactacggatagaaccatga

SEQ ID NO: 37029 - protein, 357 aa, Yersinia pestis CO92
MACLKLQAVTKSYDGVTPVIKQIDLDVADGEFIVMVGPSGCGKSTLLRMVAGLERTTTGDIYIGDQRVTDLEPKDRGIAMVFQNYVLYPHMNVFDNMAYGLKIRGFGKEQIRQRVDEAARILELQPLLKRKPRELSGGQRQRVAMGRAIVREPAVFLFDEPLSNLDAKLRVQMRLELQQLHRRLKTTSLYVTHDQVEAMTLAQRVIVMNKGVAEQIGTPSEVYKRPASLFVASFIGSPAMNLLDGTVSPDGRTFILSDGLTLPLEIPQPQWGGRRLTLGIRPEHIQQTTSAQGVPMNLLTLELLGADNLAHGLWGGQSIIARLSHEEMPVAGSTLHLYLPPAALHFFDTDSGLRIEP

SEQ ID NO: 37030 - DNA, 1110 bp, Escherichia coli K12
  CDS (1)..(1110)
gtgccttcgtgcgcggcctggtcgatagtgagaaataagatggcaggactgaaattacaggcagtaaccaaaagctgggatggtaaaacccaggtcattaaaccgctgacccttgatgtggcggatggcgaatttatcgtgatggtcgggccgtctggctgcgggaaatcgacgctgctgcgcatggttgccgggctggagcgggtgacagaaggcgatatctggatcaacgaccagcgcgtgactgaaatggagccaaaagatcgcgggattgcgatggtgttccagaactacgcgctttatccgcatatgagtgtcgaagaaaacatggcgtgggggctgaaaattcgcggcatgggcaagcagcaaattgccgagcgcgttaaagaagcggcgcgcattctggagctggacggtctgctcaaacgtcgcccgcgcgagctttccggcggtcagcgccagcgtgtggcgatgggccgcgcgattgtgcgcgatccggcggtgttcctgtttgatgagccgctctctaacctcgatgccaagctgcgcgtgcagatgcgtcttgaactgcaacagttgcaccgtcgcctgaaaacgacttcactctacgttactcacgatcaggttgaagcgatgacgctcgcccagcgagtaatggtgatgaacggcggtgttgccgaacagattggcacaccagttgaagtctacgaaaagcccgccagcctgtttgtagcgagttttatcggcagtccggcgatgaacctgctgacaggccgcgtgaataacgaaggcacgcatttcgaactggacggcggtattgagctgccgctaaacggtggctaccgtcagtatgccgggcgtaaaatgactctcggcattcgcccggaacatattgcgctaagctcgcaggcagaaggcggcgtaccgatggtgatggacacgctggagatcctcggcgcagataacctggcgcacggacgctggggcgagcagaagctggtggtgcgactggcgcatcaggagcgcccgacggcaggcagcacgctgtggctgcatctggcggaaaatcagctgcatctttttgatggtgaaacaggacaacgagtatga

SEQ ID NO: 37031 - protein, 369 aa, Escherichia coli K12
MPSCAAWSIVRNKMAGLKLQAVTKSWDGKTQVIKPLTLDVADGEFIVMVGPSGCGKSTLLRMVAGLERVTEGDIWINDQRVTEMEPKDRGIAMVFQNYALYPHMSVEENMAWGLKIRGMGKQQIAERVKEAARILELDGLLKRRPRELSGGQRQRVAMGRAIVRDPAVFLFDEPLSNLDAKLRVQMRLELQQLHRRLKTTSLYVTHDQVEAMTLAQRVMVMNGGVAEQIGTPVEVYEKPASLFVASFIGSPAMNLLTGRVNNEGTHFELDGGIELPLNGGYRQYAGRKMTLGIRPEHIALSSQAEGGVPMVMDTLEILGADNLAHGRWGEQKLVVRLAHQERPTAGSTLWLHLAENQLHLFDGETGQRV

SEQ ID NO: 37032 - DNA, 1098 bp, Sinorhizobium meliloti 1021
  CDS (1)..(1098)
atggcgcccgttacgctcaagaaactcgtcaagcgctacggcgctctggaagtcgtccacggcatcgatctcgaagtgaaggatcgcgaattcatcgcgctcgtcggaccttcgggctgcggcaagtcgacgacgctgcgcatgatcgccgggctcgaagaggtcagcggcggcgcgatcgagatcggcgggcggaaggtcaatgacctgccgccgcgggcgcgcaacatctcgatggtctttcagtcctatgcactctacccgcatatgacggttgccgagaatatgggcttctcgctgaaaatcgccgggcgtccggcggaagagatcaagacgcgtgttgccgaggcagcggcgatcctcgatctcgcccatcttctcgaacgccgcccttcgcaactgtcgggcggccagcgccagcgcgtcgccatgggacgcgcgatcgtgcggcagccggacgtctttctcttcgatgagcctctatcgaacctcgatgcgaagctcaggacccaggtgcgcaccgagatcaagaaactgcacgcccgcatgcaggcgacgatgatctacgtcacccacgatcaggtggaggcgatgacgctttccgaccgcatcgtcatcatgcgcgacgggcatatcgagcaggtgggcacgccggaggatgtcttccgccgcccggcgaccaagttcgtcgccggcttcatcggctcgccgccgatgaacatggaggaggcggttctgacggacggaaagctggcctttgccagcggcgcgaccctgccgcttccgccacgcttccgatccttggttcgcgagggccagaaagtgaccttcgggctcaggccggacgatgtctatccttcggggcacggcctccatgccggcgatgcggacgccgtccacgagatcgagcttccggtcacgatcaccgaaccgctgggcaacgaaaccctggttttcactcagttcaacgggcgggactgggtctcgcgcatgctcaacccgcggccgctgcgccccggcgaggcggtgcccatgagcttcgatctggcccgggcgcatctcttcgacggcgagaccggaagggctttggcaagctga

SEQ ID NO: 37033 - protein, 365 aa, Sinorhizobium meliloti 1021
MAPVTLKKLVKRYGALEVVHGIDLEVKDREFIALVGPSGCGKSTTLRMIAGLEEVSGGAIEIGGRKVNDLPPRARNISMVFQSYALYPHMTVAENMGFSLKIAGRPAEEIKTRVAEAAAILDLAHLLERRPSQLSGGQRQRVAMGRAIVRQPDVFLFDEPLSNLDAKLRTQVRTEIKKLHARMQATMIYVTHDQVEAMTLSDRIVIMRDGHIEQVGTPEDVFRRPATKFVAGFIGSPPMNMEEAVLTDGKLAFASGATLPLPPRFRSLVREGQKVTFGLRPDDVYPSGHGLHAGDADAVHEIELPVTITEPLGNETLVFTQFNGRDWVSRMLNPRPLRPGEAVPMSFDLARAHLFDGETGRALAS

SEQ ID NO: 37034 - DNA, 1089 bp, Sinorhizobium meliloti 1021
  CDS (1)..(1089)
atgtccggaatcaaattgaccggcgtcagcaagtcgttcggcgccgtgaaggtgatccatggtgtcgatatagaaatagggcagggcgaattcgctgtcttcgtcgggccctcgggctgcgggaagtcgacactgttgcgcatgatcgcggggctggaggagacgaccggcggcgaaatcaggatcgatgccgaggacgtcacccacaaggagccatcgaagcgcggcgtcgccatggtcttccagtcctatgcgctctatccgcacctctccgtattcgacaacatggcgttcagcctttccatcgcccgccggccgaaggcggagatcgagcagaaggtcaaggcagccgcggaaatccttcggctctcggactatctggacagcaagccgagccagctttcgggcggccagcgtcagagggtcgcaatcgggcgcgcaatcgtgcgcgagccgcgggtcttccttttcgacgagccgctttcgaatctcgatgccgagctcagggtcaagatgcgcatggagatcgcccggctgcaccgccagatcggggcgacgatggtctatgtcacccacgatcaggtcgaggcgatgacgctggcggacaggatcgtcgtgctgaaggcaggcgtggttcaacaaacgggcgcgcccctcgagctttatcgaaatccggacaacatgttcgttgcgggcttcatcggatcgccggggatgaatttcctgaaggcccgggtcgttcccggcagcggcgacaggctcacgatcgagctccacgacgcccccggggttccgttcgaaattccggcacggacgggtcccgccgtgggcgaagagattttcgtcggggtgaggccggagcacatcacgctcggcgaacgggaaggcggcgttggcctggacgtgacggccgagttcatcgaggaactcggcgggaccggctacctgcatgccctcacggtgacgggcgaggaaatgactatcgagtgccggggtgaggagcggccgcaacccaagcaggcggtccgcctgaccttggcacccgaggagatgttcgccttcgagggaagcggtgagcggctccgttga

SEQ ID NO: 37035 - protein, 362 aa, Sinorhizobium meliloti 1021
MSGIKLTGVSKSFGAVKVIHGVDIEIGQGEFAVFVGPSGCGKSTLLRMIAGLEETTGGEIRIDAEDVTHKEPSKRGVAMVFQSYALYPHLSVFDNMAFSLSIARRPKAEIEQKVKAAAEILRLSDYLDSKPSQLSGGQRQRVAIGRAIVREPRVFLFDEPLSNLDAELRVKMRMEIARLHRQIGATMVYVTHDQVEAMTLADRIVVLKAGVVQQTGAPLELYRNPDNMFVAGFIGSPGMNFLKARVVPGSGDRLTIELHDAPGVPFEIPARTGPAVGEEIFVGVRPEHITLGEREGGVGLDVTAEFIEELGGTGYLHALTVTGEEMTIECRGEERPQPKQAVRLTLAPEEMFAFEGSGERLR

SEQ ID NO: 37036 - DNA, 1068 bp, Sinorhizobium meliloti 1021
  CDS (1)..(1068)
atggcaggcgtggattttgtcgatgtccggaagtccttcggtgctttccctgtcatcaagggcgtgaacatcgagatcgaggatggcgagttcgtcattctcgtcggcccttccggttgcggcaaatccaccttgcttcggatgctggcgggcctcgaaaacatcaccgcgggcgaaatccgcatcggcaatcaggtggtcaaccgcttgccgccgaaggaccgcgacatcgccatggtgttccagaattatgcgctctatccgcatatgacggtcgccgacaacatggccttctcgctgatgctggcagcgagaccgaaatccgaaatcgacaaacgcgtcggtgtggcggccgaaattcttggcctttcgaagctgctggaccgctatccgcgtcagctttccggcggtcagcgccagcgcgtcgccatggggcgggcgatcgtgcgcgacccgcaggtgtttctcttcgacgaaccactttccaatctcgatgccaagctgcgcgtcgccatgcgcgccgagatcaaggaactgcaccagcggctgaagaccacgaccgtctacgtgacgcatgaccagatcgaggcgatgaccatggccgacaagatcgtcgtcatgcatgacggcatcgtcgagcagatcggcgcaccgctcgagctctacgacaaccccgccaatctcttcgtggccggtttcataggctcgcctgcgatgaacatgctcaagggccgcctcgatccggccgatccgagtgtcttcctcacggccgacggaacggctctgcccgtggcgcggccggcggcagccgcccaggggcgcgatctcgtctacggactgaggcccgaatacatggctctcgatccgaacgggctgccggccgaaatcgcggtgatcgagccgaccggctacgagacgcagttgatcgcaaggctcggcggccacgatgtgacctgtgttttccgcgagagggtgaatgccaagcccggcgaaacgatccatctcgcaatcgatgccgcgcatgtgcacttgttcgacgccggaaccggacggcggctggtcgcctga

SEQ ID NO: 37037 - protein, 355 aa, Sinorhizobium meliloti 1021
MAGVDFVDVRKSFGAFPVIKGVNIEIEDGEFVILVGPSGCGKSTLLRMLAGLENITAGEIRIGNQVVNRLPPKDRDIAMVFQNYALYPHMTVADNMAFSLMLAARPKSEIDKRVGVAAEILGLSKLLDRYPRQLSGGQRQRVAMGRAIVRDPQVFLFDEPLSNLDAKLRVAMRAEIKELHQRLKTTTVYVTHDQIEAMTMADKIVVMHDGIVEQIGAPLELYDNPANLFVAGFIGSPAMNMLKGRLDPADPSVFLTADGTALPVARPAAAAQGRDLVYGLRPEYMALDPNGLPAEIAVIEPTGYETQLIARLGGHDVTCVFRERVNAKPGETIHLAIDAAHVHLFDAGTGRRLVA

SEQ ID NO: 37038 - DNA, 1092 bp, Synechocystis sp. PCC 6803
  CDS (1)..(1092)
atggccagtgtcagttttgaacaggtaactaaacagtttgatgattatgttgccgttaataacttgaatttggaaattgaggacggggagtttttagtttttgtggggccgtctggttgcggcaaaactacctccctacgacttttagccgggctggaaaccgttagtcaaggacaaatctgcattggcgatcgccgggtgaatgaactatctcccaaagaccgggacattgccatggtattccagtcctatgccctctatccccacatgagtgtttatgaaaatatggcctttagcctcgacttacagggcaaacccaaagaagaaattaggcaaagggtctgtagcgccgctgaattgttgggcatcgaaaaattactgcatcgtaaacccaaggaattgtcggggggacagcggcaacgggtggcagtggggagagccattgtccgtaaaccctctgtgtttttgatggatgaacccctttctaatctggatgccatgctccgggtgcaagcccgcaaagaaatcagtaaactccatagcgacctggccactactttcatttacgttacccatgaccaggtggaagctatgaccatgggcgatcgcattgctgtgatgaaggatggcattttgcaacaggtggacagtccagctaatttgtacaatcagcccgctaacctatttgtggctggtttcattggcagtcccgccatgaacttttttcaggtggaaagattaagtcaggaaggaaaagaaaagctgagtttggacggtgttgttttaccaatgccagacagtgtagccaaaaacggcgatcgccccctaaccctcggtattcgccctgaaaatatttaccatccccaatatttgcccttggaaattgaacccatggagttgccagccacagttaacctagtggaaatgatgggcaatgaattaattgtttatgcccaaactcctgccggtacagaatttgtggcccgcattgaccccagggtaaatattaagcagaaagactcagttaaatttgtggttgatacccaacgtttttactattttgaccgggaaatggaaacggcgatcttttaa

SEQ ID NO: 37039 - protein, 363 aa, Synechocystis sp. PCC 6803
MASVSFEQVTKQFDDYVAVNNLNLEIEDGEFLVFVGPSGCGKTTSLRLLAGLETVSQGQICIGDRRVNELSPKDRDIAMVFQSYALYPHMSVYENMAFSLDLQGKPKEEIRQRVCSAAELLGIEKLLHRKPKELSGGQRQRVAVGRAIVRKPSVFLMDEPLSNLDAMLRVQARKEISKLHSDLATTFIYVTHDQVEAMTMGDRIAVMKDGILQQVDSPANLYNQPANLFVAGFIGSPAMNFFQVERLSQEGKEKLSLDGVVLPMPDSVAKNGDRPLTLGIRPENIYHPQYLPLEIEPMELPATVNLVEMMGNELIVYAQTPAGTEFVARIDPRVNIKQKDSVKFVVDTQRFYYFDREMETAIF

SEQ ID NO: 37040 - DNA, 1071 bp, Salmonella typhimurium LT2
  CDS (1)..(1071)
atggctggtttaaaactacaggcagtaaccaaaagctgggacggcaaaacccaggtcattcaaccgctgacgctggacgtggcggatggcgaatttatcgtgatggtcgggccgtccggctgcggcaaatcaacgttgttgcggatggtggctggtctggaacgcgtgaccagcggcgatatctggattgatcgcaaacgggtcaccgagatggagcccaaagatcgcggcatcgcgatggtatttcagaactatgctctctatccccatatgagcgtagaggagaacatggcgtggggactaaaaattcgtggtatgagcaaagcgcatattgaagaacgtgtgcgggaggcggcgcgcattctggagctggacggcctgcttaaacgccgtccacgcgagctttccggcggtcaacggcagcgcgtggcaatggggcgcgcgatcgtccgcgagccggcagtctttttattcgacgaaccgctctctaacctcgacgccaagctgcgcgtgcagatgcgtctggagttacaacatctgcatcgtcgtcttcgtaccacctcgctctatgttactcacgatcaggtagaggcgatgacgctggcccagcgggtgatggtgatgaataaaggcgtcgcagaacagattggcacgccggtagaggtatatgaaaaaccggccagtcgcttcgtggcgagctttatcggcagcccggcgatgaacctgttggatggcgttatcagcgcttccggcgaccgtttcgaattgcctggcggtctggcgttaccgataggtgcggactatcggggtcatgccggacgtaacatgacgctgggtatccgaccggagcatattgcgttaagctcgcaggcggaaggcggcgtgccgctaacggtagatacgctggagattctgggcgcggataatctggcgcatgggcgctggggcgatcagaaactggtggtgcggttggcgcatcagcagcgcccggcggcgggcagtacgctatggctgcatctgccggaacatcagcgacatctttttgatggcgaaacaggacaacgtgtatga

SEQ ID NO: 37041 - protein, 356 aa, Salmonella typhimurium LT2
MAGLKLQAVTKSWDGKTQVIQPLTLDVADGEFIVMVGPSGCGKSTLLRMVAGLERVTSGDIWIDRKRVTEMEPKDRGIAMVFQNYALYPHMSVEENMAWGLKIRGMSKAHIEERVREAARILELDGLLKRRPRELSGGQRQRVAMGRAIVREPAVFLFDEPLSNLDAKLRVQMRLELQHLHRRLRTTSLYVTHDQVEAMTLAQRVMVMNKGVAEQIGTPVEVYEKPASRFVASFIGSPAMNLLDGVISASGDRFELPGGLALPIGADYRGHAGRNMTLGIRPEHIALSSQAEGGVPLTVDTLEILGADNLAHGRWGDQKLVVRLAHQQRPAAGSTLWLHLPEHQRHLFDGETGQRV

SEQ ID NO: 37042 - DNA, 1101 bp, Listeria innocua Clip11262
  CDS (1)..(1101)
ttggcacaattatcattagaacatatttataaaatatacgataacaaagtaactgcggtatctgactttaatttagaaatcgatgacaaagagttcatcgtttttgtaggaccatctggttgtggtaaatctacaactttacgtatgattgctggtctagaagaaatttctaaaggcgaactatctattgatggtaaagtaatgaacaatgttgcgccaaaagaccgtgacatcgcaatggtattccaaaactacgcattatatccacatatgactgtatatgataatatggcattcggtttaaaacttcgtaaaatgccaaaagacgaaattaaaaaacgtgttgagcatgcagcaaatattctcggcttaactgaatacttaaaacgtaaaccaagtgcactttccggtggtcaacgtcaacgtgttgctctaggtcgtgcaatcgttcgtgatgcaaaagtcttcctaatggatgaaccactttccaacttagatgcgaaattacgtgtgcaaatgcgtgcggaaatcacaaaacttcaccaacaattagatactaccatgatttatgttacccatgaccaaacagaagcaatgacaatggcaactcgtatcgttatcatgaaagacggtgttatccaacaagttggttcaccaaaacaagtttacgatcacccagtgaatatgttcgtagccggctttattggtagcccagcaatgaacttcttcaaaggtcgtttagaaggttctaactttatcggtgatgatttcactatcgctgttccagaaggtaaacttaaacttcttaaagacagaggatttgacggtaaagaaatcgttttcggtattcgtccagaagacattcatgatgaaccaatcgttattgaagcaaacccaggttacactttcaaagcgactactattgttgccgagcttactggtgctgaattcatgcttcatagccgcgttggtacacacgaattcgtagctcgtgttgatgctcgctctgaacaccaaccaaatgaagtattaactttagcatttgaaatgtctaaatctcacttctttgacccagaaacagaagataacttaactgactaa

SEQ ID NO: 37043 - protein, 366 aa, Listeria innocua Clip11262
MAQLSLEHIYKIYDNKVTAVSDFNLEIDDKEFIVFVGPSGCGKSTTLRMIAGLEEISKGELSIDGKVMNNVAPKDRDIAMVFQNYALYPHMTVYDNMAFGLKLRKMPKDEIKKRVEHAANILGLTEYLKRKPSALSGGQRQRVALGRAIVRDAKVFLMDEPLSNLDAKLRVQMRAEITKLHQQLDTTMIYVTHDQTEAMTMATRIVIMKDGVIQQVGSPKQVYDHPVNMFVAGFIGSPAMNFFKGRLEGSNFIGDDFTIAVPEGKLKLLKDRGFDGKEIVFGIRPEDIHDEPIVIEANPGYTFKATTIVAELTGAEFMLHSRVGTHEFVARVDARSEHQPNEVLTLAFEMSKSHFFDPETEDNLTD

SEQ ID NO: 37044 - DNA, 1101 bp, Nostoc sp. PCC 7120
  CDS (1)..(1101)
atggcaaaagttcgtttagaagatataaagcgtcggtttaacaatgtcaccgcaattgaggaaatctcctttgaaattccggatggtgagttttgggttttggtggggccttctggttgtgggaagtctacaattttacgaacgatcgctggtttagaaaatgccacatcaggtaatctgtttattggcgatcgcttggtaaataacatccccgcaagagcgcgcgatgtggcgatggtgttccaaaattacgctctttatccccacatgacggtggcggaaaatatcgcctttgggttgaaaatgcggaaaattaacccgaaaattgtccaagaacgggtggtggatgtggcgcgatcgctttctttggatcatctgttagatcgcaaacccaaacaactttccgggggtcagcaacaacgggtagcattagggagagcgatcgcccgtgaaccacaagtatttttattagatgaaccattgtctaatttagatgcccaattgcgagatgatactagggcagaattaaagcagttacatcaacaattaggcattacaactatctacgtcacccatgatcaagtcgaggcgatgactttggctgataagattgtggttttaagtggcggacggattcaacaaattggcgaacctcaagggatttatgctcgtcctgctaatcaaatggtggcaacttttttaggtaatccaccgatgaatattttacctgcaacttatcaacttgcaggttttgatatcaatggacaattactcgcaattccagcatttctcagggagaagttacaactccggtcagcacaacgggtgaatttgggtattcgtccagaacacatatcaattaattctgacgcaattaatgaccagagttcaggattgttagtcgatgtcaaattagttgaacctttaggaagagaaacattagttcgtgtgagtttacccgattcaacggtactattgagcgttcaattgagtggaaacgtgcgtctacatccaggcgatcgcctttctctacaacttgatttaaatcagttgtttatttttgatcctcagactggctataaaatatcaccccaggattaa

SEQ ID NO: 37045 - protein, 366 aa, Nostoc sp. PCC 7120
MAKVRLEDIKRRFNNVTAIEEISFEIPDGEFWVLVGPSGCGKSTILRTIAGLENATSGNLFIGDRLVNNIPARARDVAMVFQNYALYPHMTVAENIAFGLKMRKINPKIVQERVVDVARSLSLDHLLDRKPKQLSGGQQQRVALGRAIAREPQVFLLDEPLSNLDAQLRDDTRAELKQLHQQLGITTIYVTHDQVEAMTLADKIVVLSGGRIQQIGEPQGIYARPANQMVATFLGNPPMNILPATYQLAGFDINGQLLAIPAFLREKLQLRSAQRVNLGIRPEHISINSDAINDQSSGLLVDVKLVEPLGRETLVRVSLPDSTVLLSVQLSGNVRLHPGDRLSLQLDLNQLFIFDPQTGYKISPQD

SEQ ID NO: 37046 - DNA, 1098 bp, Ralstonia solanacearum GMI1000
  CDS (1)..(1098)
atggcaaaactgtctctacgcaacgtccagaagcactacgccggcctgcaggtcgtgcacggcatcgacatggagatcggcgacggggagttcatcgtcatcgtcgggccgtcgggctgcggcaagtccacgctgctgcgcatggtggccggcctggaggcgatcaccggcggcgaggtctggatcggcgatcgcgtggtcaacgaactggagccggccgagcgcgacatcgccatggtgttccagaactacgcgctgtatccgcacatgaccgtgttcgacaacatggcgtacggcctgaagatccgcgggctgcccaagagtgagatcctggcgcgcgtgcagcaggccgccggcatcctcgagctcggcaagctgctcgagcgcaagccgcgccaactctcgggcgggcagcgccagcgcgtggcgatgggccgcgccatcgtgcgcgagccggcggtgttcctgttcgacgagccgctgtccaacctggacgccaagctgcgcgtgcagatgcggctggagctcaaggagctgcaccgccgcctgcgcaccaccagcctgtacgtgacgcacgaccaggtcgaggcgatgacgctggccgaccgcatgatggtgctcagcggcggccgcgtcgagcagatcggtacgccgctggaagtctatgcgcgcccggccagcaccttcgtcgccggcttcatcggctcgccgccgatgaacctcgtgccggtgtcgcgtcacgcgggcgagggcgcccagatccgcgtcgacggcgcgcaggcgggcgatgcgcccgccacgctcggccatttgccgatgggtttgcatctgcccgagcacgcgctgatgggcctgcgccccgagcacatcgagccgtgcgccgccgaccgggccatcgccttcgtcgaggtgcggctggtcgaggcgctcggcgccgatgcgtttgcctatggcgcgctggccggccatccggtcgtcgtccggctggacccgcacgccagcgtcaaggccggcgaccggctgcccatcaccgcctcggccgaccatctgcactggttcgacccgcagaccacccgccgcatcgaggccctggcatga

SEQ ID NO: 37047 - protein, 365 aa, Ralstonia solanacearum GMI1000
MAKLSLRNVQKHYAGLQVVHGIDMEIGDGEFIVIVGPSGCGKSTLLRMVAGLEAITGGEVWIGDRVVNELEPAERDIAMVFQNYALYPHMTVFDNMAYGLKIRGLPKSEILARVQQAAGILELGKLLERKPRQLSGGQRQRVAMGRAIVREPAVFLFDEPLSNLDAKLRVQMRLELKELHRRLRTTSLYVTHDQVEAMTLADRMMVLSGGRVEQIGTPLEVYARPASTFVAGFIGSPPMNLVPVSRHAGEGAQIRVDGAQAGDAPATLGHLPMGLHLPEHALMGLRPEHIEPCAADRAIAFVEVRLVEALGADAFAYGALAGHPVVVRLDPHASVKAGDRLPITASADHLHWFDPQTTRRIEALA

SEQ ID NO: 37048 - DNA, 1101 bp, Agrobacterium tumefaciens str. C58
  CDS (1)..(1101)
atggccgcgatagaaattagtcaggtctgcaaggattatcatggcggcgtacgcgccgtgcatcacgtcgatatcgacatccgggatggcgagttcatcgttctcgtcggcccctccggctgcggcaagtccacgcttctgcgtatggtcgccggcctcgaggatatttccgagggtacagtgaagatcggtgaccgggtcgtcaaccagaccgatccggccgatcgtgatatcgccatggtattccagaactacgcgctttacccgcatatgtcggtgcgcgagaacctggaatatgggctgaagaaccgcaagacagcgaagacggaaatcgatgcgcgtgtggccgaagccgcgcgcatgctgcagctcgaaccctatctggagcgcaagccgcgcgcactttccggcggtcagcggcagcgtgtcgccatggggcgcgccatcgtgcgcaagcctgccgccttcctgttcgatgagcccctgtccaacctcgatgccaagctgcgtgtttccatgcgcggtgaaatcaagcgtctgcagaagcgcctcggcaccacctccatctatgtcactcacgaccagcttgaggccatgacgctggcggatcgcctggtcgtgctgaatggcggtcgcatcgaacagatcggcgcgccgctcgatgtctatcacacccccgcctcgaccttcgttgcgagcttcatcggctctcccgccatgaacctgctgaatgccgaactgcacggtgatagtctcgccatcggtccgtcgctgtttgcgctcaatggtttcgcgcccacctccgggccggtgacggtgggcatgcgggcagaggatttccgcctcgctgcggcaggcgagcagggttttgcattcagggttgattacattgaggaactgggttcccagcgcctcatccacggcatgatcggcgaccagaacctgacaatcgctttcccgccggacgtcgatgttcccgcagcactttcgatcacgatcgcgtcggaaaagctgcatttcttctccagcgaaaccggcaagcgcattgccggcaaggcggagcagctcggtgtgcagtccgctcagatggcgacggcctga

SEQ ID NO: 37049 - protein, 366 aa, Agrobacterium tumefaciens str. C58
MAAIEISQVCKDYHGGVRAVHHVDIDIRDGEFIVLVGPSGCGKSTLLRMVAGLEDISEGTVKIGDRVVNQTDPADRDIAMVFQNYALYPHMSVRENLEYGLKNRKTAKTEIDARVAEAARMLQLEPYLERKPRALSGGQRQRVAMGRAIVRKPAAFLFDEPLSNLDAKLRVSMRGEIKRLQKRLGTTSIYVTHDQLEAMTLADRLVVLNGGRIEQIGAPLDVYHTPASTFVASFIGSPAMNLLNAELHGDSLAIGPSLFALNGFAPTSGPVTVGMRAEDFRLAAAGEQGFAFRVDYIEELGSQRLIHGMIGDQNLTIAFPPDVDVPAALSITIASEKLHFFSSETGKRIAGKAEQLGVQSAQMATA

SEQ ID NO: 37050 - DNA, 1089 bp, Agrobacterium tumefaciens str. C58
  CDS (1)..(1089)
atgacaagtctcgttctcaaggatatccgcaaatcctacgggcaggtgaaggtcctgcacggcatcgacctgcagatcgaacagggcgaattcatcgttttcgtcgggccttcgggctgcggaaaatcgacgttgctgcgcatgatcgccggtctggaggaaatcaccggcggcgagatgttcatcgacggccagctggtcaacgaaattccgccctcgcggcggggcatcgccatggtgttccagtcctatgcgctttatccgcacatgactgtctacgacaacatggccttcggcatgaagatcgccaaggaaaacaagcaggagatcgaccgccgcgttcgcgccgctgccgaaatcctgcagctgacgcaatatctggagcgtctgcccaaggcgctttccggtggccagcgccagcgtgtcgccatcggccgcgccatctgccggaatcccaaggtcttcctgttcgatgagcctctgtcgaacctcgacgcggcgctgcgcgttgccacccgcatcgagatcgccaagctcaacgaacagatggccgatacgacgatgatctacgtcacccacgaccaggtggaggcgatgacgctggcggaccgcatcgtcgttttgaatgcgggccgtgtggaacaggtcggcccgccgctcgaactttacgaaaggcccgccaatcttttcgtggcgaagttcatcggctcgcccgccatgaacatcatcgcggcaaagattgtcggaaccggcgaacgcacctcgatcgaactggccggtggcaagacgctggccgtcgatgttccgacacccgcgaccgagcagggcaaggctgcaagcttcggggttcggccggaagatctgagcattgtcaccggcgatgactatcttttcgaaggcaaggtcgcgatcgtcgaggctttgggtgaagtgaccctgctttatctcgaagcgcccaaggggcaggagccgatcatcgtcaaggtgccgggcattgtttccgtcggcaagggagaaacattgcggtttgccgcgccccaggaaaagcttcacctctttgatgccgcgggcaagacttaccgcccataa

SEQ ID NO: 37051 - protein, 362 aa, Agrobacterium tumefaciens str. C58
MTSLVLKDIRKSYGQVKVLHGIDLQIEQGEFIVFVGPSGCGKSTLLRMIAGLEEITGGEMFIDGQLVNEIPPSRRGIAMVFQSYALYPHMTVYDNMAFGMKIAKENKQEIDRRVRAAAEILQLTQYLERLPKALSGGQRQRVAIGRAICRNPKVFLFDEPLSNLDAALRVATRIEIAKLNEQMADTTMIYVTHDQVEAMTLADRIVVLNAGRVEQVGPPLELYERPANLFVAKFIGSPAMNIIAAKIVGTGERTSIELAGGKTLAVDVPTPATEQGKAASFGVRPEDLSIVTGDDYLFEGKVAIVEALGEVTLLYLEAPKGQEPIIVKVPGIVSVGKGETLRFAAPQEKLHLFDAAGKTYRP

SEQ ID NO: 37052 - DNA, 1059 bp, Agrobacterium tumefaciens str. C58
  CDS (1)..(1059)
atggcaccggtgaatattcagaacgtccagaagcgcttcggctccgtcaacgtcattcatggcatcgatatcgacatcaaggatggcgaattcgtcgtgcttgtcggcccctccggctgcggcaaatctaccctgctgcgcatgatcgccggacttgaagagctgagcgacggcgaaatccacatcggcccgcgcgaggtcagccacctgcctgcccgtgaccgcgatatcgccatggtcttccagaactacgcgctttatccgcacatgacggtgaaggataatatgggcttcgcgctgaagttgaagaaggtgagcgcggacgaaaccaaggccaaggtggacagagccgccgccattctggggctggaaaaactgctcgaccgttatccgcgccagctctccggcggccagcgtcaacgtgtcgccatgggccgcgctctggtgcgcgatccgcaggtcttcctgttcgatgaaccgctctccaatctcgacgccaagctgcgcgtgcagatgcgcggcgagatcaaggccatgcaccagcgcatcggcacgacgaccatttacgttacccacgaccaggtggaagccatgaccatggccgacaagatcgtggtgctgcatgatggcatcatcgagcagatcggcgcgccgctggagctttacgacaatcccgcaaacctcttcgttgccggcttcatcggttcgcccgccatgaatttcattcgtggccgggtggaggaaggcgtcttccgcaccataaaaggcctcagcctgccgctgcccgcccatgccgatatcggcaagctcggcggccgcgacctcgtctatggcgtacggccggaacatatccgcgccgccgagagtggtatcgagggccgggtcgaactggttgaaggcaccggctcggaaatctacaccaagctcaattgcaagggcgatgagatcgcctgcctgttccgcgagcggctcaatgtccgcttcggcgatacgatccacattgccattgatccggcaacggtgcatctgttcgacaaggacagcggcaagcgcatctga

SEQ ID NO: 37053 - protein, 352 aa, Agrobacterium tumefaciens str. C58
MAPVNIQNVQKRFGSVNVIHGIDIDIKDGEFVVLVGPSGCGKSTLLRMIAGLEELSDGEIHIGPREVSHLPARDRDIAMVFQNYALYPHMTVKDNMGFALKLKKVSADETKAKVDRAAAILGLEKLLDRYPRQLSGGQRQRVAMGRALVRDPQVFLFDEPLSNLDAKLRVQMRGEIKAMHQRIGTTTIYVTHDQVEAMTMADKIVVLHDGIIEQIGAPLELYDNPANLFVAGFIGSPAMNFIRGRVEEGVFRTIKGLSLPLPAHADIGKLGGRDLVYGVRPEHIRAAESGIEGRVELVEGTGSEIYTKLNCKGDEIACLFRERLNVRFGDTIHIAIDPATVHLFDKDSGKRI

SEQ ID NO: 37054 - DNA, 1113 bp, Agrobacterium tumefaciens str. C58
  CDS (1)..(1113)
ttgggtcagctttatctcaacaacgtccgcaagaactatggacatttcgaagtcatcaagggcgttcagctcgacatcagggatggcgagttcgtcgtttttgtcggcccttcgggatgcggcaaatccacattgctgcgcatgatcgccggccttgaggagatttccgccggtgacgtcgtcataaacggcgtgaaggtcaatgagttgccgccggtcaagcgcggtatcgccatggtgttccagtcctatgcgctttatccgcatatgacggtttttgaaaacatcgcatttcccctgcgtgtcgagaagatggcggaggaaaagatcaagcagaaggtcgagggtgtcgcgaagattctccagctcgaccagcgtctgcagcagcgccccggcaatttgtccggcggccagcgccagcgcgtggcgatcggccgggccatcgttcgcgagccgaagatattcctgttcgacgagccgctttcgaacctcgatgcggcgcttcgcgccgatatgcgcatcgaattgaccaatcttcacaagacgctgaaggcgacgatgatctatgtcacccatgatcaggtggaagccatgaccatggccgaccgtatcgtggtgttgaatgccggtgaaatcgcccaggtcggcgcgccgctcgagctttaccacaagccagcgaacctgttcgtggcgggcttcatcggcaatccgaaaatgaattttctgaaggtcacctgcaaatcggtcagcgccgagggtgtgacggtggcctatgagggccagacgatcaccgtgccggtggagcctcgtgccggtcttgagggcaagcagctgacgctcggcattcgtccggaacataccggtctcgaagcagccgatctcaacatcaaggtcgcgccgagcgttatcgagcgccttggggtgaataccattgcttatggggtcgccccgacgggtgagaattattgcgctctgcttcccggctccgcgcctgtcgtcgtggatgagccgatcgtcaccggcatcaaggcttcggattgccatctgttcgatgaaagcggcattgctctcgatcgtcgagtcgacctgtcagtcctcaagctgattcaatag

SEQ ID NO: 37055 - protein, 370 aa, Agrobacterium tumefaciens str. C58
MGQLYLNNVRKNYGHFEVIKGVQLDIRDGEFVVFVGPSGCGKSTLLRMIAGLEEISAGDVVINGVKVNELPPVKRGIAMVFQSYALYPHMTVFENIAFPLRVEKMAEEKIKQKVEGVAKILQLDQRLQQRPGNLSGGQRQRVAIGRAIVREPKIFLFDEPLSNLDAALRADMRIELTNLHKTLKATMIYVTHDQVEAMTMADRIVVLNAGEIAQVGAPLELYHKPANLFVAGFIGNPKMNFLKVTCKSVSAEGVTVAYEGQTITVPVEPRAGLEGKQLTLGIRPEHTGLEAADLNIKVAPSVIERLGVNTIAYGVAPTGENYCALLPGSAPVVVDEPIVTGIKASDCHLFDESGIALDRRVDLSVLKLIQ

SEQ ID NO: 37056 - DNA, 1116 bp, Agrobacterium tumefaciens str. C58
  CDS (1)..(1116)
atgtccgcagttcaaatcaacgacgtcgtcaagcgctatggcgccctagaagtcgtccacggtatcaatctttccatacagccgcaggaattcgttgtcctcgttggtccttcgggatgcggaaaatccaccacgctgcgtatgctcgccggactggaggacatctcggacggcaccgtttcgatggacggccgggtggtcaacaaggtcgcgccgaaagaccgcgatgtcgccatggtattccagaactatgcgctctacccccatctgagcgtggccgagaacatcgcgttcggcctgcgcgtcaggggcgagaaacgggccgtcgtcgacaaggccgttgcggaagccgcacagatattgggacttaccgaatatctggcccgcaagccggccgatctttccggtggccagcgccagcgcgtcgccatgggccgcgccatcgtgcgccaaccgaaaatcttcctgttcgacgaacccctctccaatcttgacgccaagctgcgcacccatatgcgcgccgagatcaagctgctgcacaaacggatgcaggccaccagcatctacgtgacccacgaccaggtggaggcgatgacgcttgccgaccgcatcgtcatcatgaatggcggccatatcgaacaggtcggctcgccaatggaggttttcctcgaaccggcgaacacatttgtcgcaagcttcatcggctcgccaccaatgaacctactcgacggaaccatcgaaaagcaggatggcaccgtgaaggtcaggctcacgggcggctccgggcagcgcttcagcatccccgatgccttcgcgaagaacgcaatcgaaggacagaccgtcaagctcggcctgcggccggaaatcatgtcggtggaagatagcgatggccgcgaggttctccattgcagcattgaccttgtggagccgctgggcgctgaagcactgctgcatggaaaggcggatggccagccatttatcgccaaagccgaaacgctttatggcgatcatgcccttaacggcgtcaaccggctttccatcgataccgcccgcgtccacgtctttgacgcggcgaccggaagatcgctcaaaatccgggatggagcgcagccatga

SEQ ID NO: 37057 - protein, 371 aa, Agrobacterium tumefaciens str. C58
MSAVQINDVVKRYGALEVVHGINLSIQPQEFVVLVGPSGCGKSTTLRMLAGLEDISDGTVSMDGRVVNKVAPKDRDVAMVFQNYALYPHLSVAENIAFGLRVRGEKRAVVDKAVAEAAQILGLTEYLARKPADLSGGQRQRVAMGRAIVRQPKIFLFDEPLSNLDAKLRTHMRAEIKLLHKRMQATSIYVTHDQVEAMTLADRIVIMNGGHIEQVGSPMEVFLEPANTFVASFIGSPPMNLLDGTIEKQDGTVKVRLTGGSGQRFSIPDAFAKNAIEGQTVKLGLRPEIMSVEDSDGREVLHCSIDLVEPLGAEALLHGKADGQPFIAKAETLYGDHALNGVNRLSIDTARVHVFDAATGRSLKIRDGAQP

SEQ ID NO: 37058 - DNA, 1122 bp, Agrobacterium tumefaciens str. C58
  CDS (1)..(1122)
atggctcagatcgatattcgtcaggtccgcaaatcctatggcaagacgccgaccctgcacggggtggatctttctttcgactccggcgaattcgtcgtcatcctcggcccttcgggctgcggcaaatccacgcttctgcgcatgatcgccggcctggaggagatcacctcgggcgagatcgccatcggcgggcgcgtggtcaacacgctggagccgcgtgagcgcggctgtgccatggtgttccagaattatgcgctttatccgcatatgtcggtggccgccaatatcggttatgcgctgaaggtcgccggcgttccaaaggccgagcgccagcgccgcatcgaggagaccgccaagattgtcggcctgtccgactatctggaacgcaagccggccgccctttccggcggccagcgccagcgcgtggccatggcccgcgccatcatccgcgaacccgccgtgtttctgttcgacgagccgctgtccaacctcgatgccaagctgcgcgtatccatgcgcgctgaaatccgcaagctgcaccagcgcctctcggccacctccattttcgtcacccacgaccaggtggaagccatgacgctggccgaccggctggtggtgatgaacaagggcaatgtcgagcaggtcggccatccgctcgatatctatcaccgcccggccagcacctttgtcgcctccttcatcggctcacccgccatgaacctttttaccacaaaggtggaagtggagacccctgccgtgatactctccggtaccccggtgaaactcttcccggaaaccgcgctggaactgcgcggccgcaatgtgacggtcggcatccgcccggaacaatgcgtggtgagcatggatggccccggcgtgcctgctatcgtggatttcgtcgaagaacttggctccggtcgcatcgtgcatgcggacatagccggcgaaaccttctctgccgccatcggtgaggatctcctggtaaaacccggccagcgcatccatctcgatcttcccaccgcccatctccatttcttcgacccggccaccggcaagcggatcgaaacggagggaacggcggagactgcccgaagcaagaacgagacgctgctcgcggtttga

SEQ ID NO: 37059 - protein, 373 aa, Agrobacterium tumefaciens str. C58
MAQIDIRQVRKSYGKTPTLHGVDLSFDSGEFVVILGPSGCGKSTLLRMIAGLEEITSGEIAIGGRVVNTLEPRERGCAMVFQNYALYPHMSVAANIGYALKVAGVPKAERQRRIEETAKIVGLSDYLERKPAALSGGQRQRVAMARAIIREPAVFLFDEPLSNLDAKLRVSMRAEIRKLHQRLSATSIFVTHDQVEAMTLADRLVVMNKGNVEQVGHPLDIYHRPASTFVASFIGSPAMNLFTTKVEVETPAVILSGTPVKLFPETALELRGRNVTVGIRPEQCVVSMDGPGVPAIVDFVEELGSGRIVHADIAGETFSAAIGEDLLVKPGQRIHLDLPTAHLHFFDPATGKRIETEGTAETARSKNETLLAV

SEQ ID NO: 37060 - DNA, 1074 bp, Agrobacterium tumefaciens str. C58
  CDS (1)..(1074)
atgggtgtccgtctcaacaatatagccaagtccttcggatctttcgcagcgatccgggatgtctcgatggaaatcccgaccggcagctttgcggtctttgtcgggccttccggttgcggcaaatccacgctgctgcggatgatcgccggtcttgaagagaccagcggcggccgcatcgccatcgacgaccgcgatgtcacggccgtcgaaccggccgaacgcggcgtcgccatggtgttccagaactatgcgctttatccacatctcagcgtgttcgagaacatggctttcagcctgcggcttgcccgcaggccgaaagccgaggtgaatgaaagggtgggcgaagctgcgcgcatcctgcagcttgaagaccatctgcataaaaaaccgtcgcagctttcgggcgggcagcggcagcgcgtggcgatcggccgcgccatcgtgcggcagccgaaggtcttccttttcgacgagccgctgtccaacctcgatgcggagctgcgcgtccagatgcggttggaactgacgcgtcttcaccgcaagctcggcgccacgatgatctatgtcacgcatgaccaggtggaggccatgacgcttgcggacaagattttcgtgctgaagggcggcgtcgtgcagcaggcgggtgcgccgctcaccctttatgacgatccggataaccggttcgtggccggcttcatcggctcgccggcgatgaacttcctgcaggcggagattgtcgaacagcgaaatggtgtcgtgacgctttcactcgatggcggccagagacatctcgaagcgcggctttcgcagcctgtttccgttggccagcgggtcgaaatcggcgttcggccagagcatctgacgatcgcgcaggagggcgccctgcctgtcaatgtcgaggtggcggaggagctgggggatgtttcctatctctacacacgcgcgacctccggcaaggaaatcatcgtgcaacgacagggctcgcgcgaaagtctcgatggccggtccgtcctgctgagcgcctcgcccgaccacatcatggttttcgatagcgacggtaaaagattgcgatag

SEQ ID NO: 37061 - protein, 357 aa, Agrobacterium tumefaciens str. C58
MGVRLNNIAKSFGSFAAIRDVSMEIPTGSFAVFVGPSGCGKSTLLRMIAGLEETSGGRIAIDDRDVTAVEPAERGVAMVFQNYALYPHLSVFENMAFSLRLARRPKAEVNERVGEAARILQLEDHLHKKPSQLSGGQRQRVAIGRAIVRQPKVFLFDEPLSNLDAELRVQMRLELTRLHRKLGATMIYVTHDQVEAMTLADKIFVLKGGVVQQAGAPLTLYDDPDNRFVAGFIGSPAMNFLQAEIVEQRNGVVTLSLDGGQRHLEARLSQPVSVGQRVEIGVRPEHLTIAQEGALPVNVEVAEELGDVSYLYTRATSGKEIIVQRQGSRESLDGRSVLLSASPDHIMVFDSDGKRLR

SEQ ID NO: 37062 - DNA, 1074 bp, Agrobacterium tumefaciens str. C58
  CDS (1)..(1074)
atggcaagcagcattactctggaaaaaatcgtcaagcggttcggcgcttttccggtcgttcacggtatcgatctcaagatcgagccgggtgaattcacggtgttcgtcggcccttcgggctgcggcaaatccacgcttctgcgcatgatcgccggtctcgaagaaatctccgagggtgatcttcgcatcgatggcgaaagggtgaacgaaacagccgcctccaagcgcggcattgccatggttttccagtcctatgcgctctatccgcatatgagcgtttacaaaaacctcgctttcgggctggaaacggcgggttacaagaaaccggaagtcgaggcgcgggtgcagaaagccgccgatatcctgcagatcggcccgttgttgcagcgcaagccgaaggcgctttccggcggccagcgccagcgcgtcgccatcggccgcgccatcgtgcgcgagccgaaaatcttcctgttcgatgagcctctgtccaacctcgatgccgaactgcgcgtgcagatgcgtgtcgaaatcgccaagctgcaccagacgctcggcagcaccatgatctatgtaacgcacgaccaggtggaggccatgaccatggctgacaagatcgtcgtcctgcgcgacggccgcatcatgcaggtcggccgcccgctcgatctctacaacaatccggccaaccagttcgtggccggcttcatcggctcgccgaagatgaacttcctctccgccaaagtggtttcaggcgacagttccaaccgcacaatagaggtggccggtcagcgaatcgtgctggaaaaaccggtcgcggctcagcagggcgaaactctgaccttcggcgtgcgccccgaacacgtcaacccgcaggcgcagtcctcgctcggtgaagcgtcgatccagctagtggaacatctcggtggctcgacggtggtttacaccagtacacccgatggtcagcccgccaccgtgctgctggacggccagcgccatatccgcattggcgagaccattccttttgcatttgatctggcgaaaacgcatctgttcggggcggatggacggcggatatga

SEQ ID NO: 37063 - protein, 357 aa, Agrobacterium tumefaciens str. C58
MASSITLEKIVKRFGAFPVVHGIDLKIEPGEFTVFVGPSGCGKSTLLRMIAGLEEISEGDLRIDGERVNETAASKRGIAMVFQSYALYPHMSVYKNLAFGLETAGYKKPEVEARVQKAADILQIGPLLQRKPKALSGGQRQRVAIGRAIVREPKIFLFDEPLSNLDAELRVQMRVEIAKLHQTLGSTMIYVTHDQVEAMTMADKIVVLRDGRIMQVGRPLDLYNNPANQFVAGFIGSPKMNFLSAKVVSGDSSNRTIEVAGQRIVLEKPVAAQQGETLTFGVRPEHVNPQAQSSLGEASIQLVEHLGGSTVVYTSTPDGQPATVLLDGQRHIRIGETIPFAFDLAKTHLFGADGRRI

SEQ ID NO: 37064 - DNA, 1086 bp, Agrobacterium tumefaciens str. C58
  CDS (1)..(1086)
atggcggaactttcgctcaaaaacgtggtcaagcgttacggcgcgctggaggtgatccatggtgccaatctggaagtggaggacggcgaattcgtcgtgtttgtcggcccgtccggctgcggcaaatccacgcttctcagaatgatcgccgggctggaagatatttccggcggcgatatcgtgattggcggcaagacggtcagcgacgccgatccggcggatcgcggcatcgccatggtgttccagtcctacgcgctctatccgcatatgacggtcgccgaaaacttgtccttcggtcttcggatgaacggcaaccccaaggccgatacgcaaaagcgtgtcagtcgcgccgccgaaatcctgcagatcaacgaattgatgcaacgccgcccgaaacagctttccggcggccagcggcagcgtgtggctatcggccgcgccatcgtgcgtgaacccaaggttttcctgttcgacgagccgctctccaacctcgatgcggaattacgggtgcagatgcgcgtggaaatctcgcggctgcacaagcagctgggcaccacgatgatctatgtgacgcatgaccagacagaggcgatgacgctggccgacaagatcgttgtgctgcgggcgggcaatatcgaacaggtcggcgcgccgctcgatctctatgacgatcccgccaaccgtttcgttgccggttttgtcggttcgccgaagatgaattttctcgaggcgaccatcatcggcaccggcgctgaaagcataacactttccctcgacagcgacccagctgtgcgactgaccttgccgataaaggaacgcatcaacgagggggccaaggtttcgcttggcatccggccggagcatttcgccgatgccggcgcgggtgacgccgatctcaccgttcatgtcgatgtcgccgaacatctcggcaataccagctatgtctatgcgcgcgcgcagggcggcgagcagttgatcatcgagcggccggaatcgcgcgatgtcggcaatcgcgacaagctgacggtcggtctttccgcccacaaggctttccttttcgacagcaagggcgaacgcctgcgctga

SEQ ID NO: 37065 - protein, 361 aa, Agrobacterium tumefaciens str. C58
MAELSLKNVVKRYGALEVIHGANLEVEDGEFVVFVGPSGCGKSTLLRMIAGLEDISGGDIVIGGKTVSDADPADRGIAMVFQSYALYPHMTVAENLSFGLRMNGNPKADTQKRVSRAAEILQINELMQRRPKQLSGGQRQRVAIGRAIVREPKVFLFDEPLSNLDAELRVQMRVEISRLHKQLGTTMIYVTHDQTEAMTLADKIVVLRAGNIEQVGAPLDLYDDPANRFVAGFVGSPKMNFLEATIIGTGAESITLSLDSDPAVRLTLPIKERINEGAKVSLGIRPEHFADAGAGDADLTVHVDVAEHLGNTSYVYARAQGGEQLIIERPESRDVGNRDKLTVGLSAHKAFLFDSKGERLR

SEQ ID NO: 37066 - DNA, 999 bp, Agrobacterium tumefaciens str. C58
  CDS (1)..(999)
atgggcagcatttcccttcagaacgtgtccaagctcttcggtgaggcgaaagtcatcccgtcgatcgatctggatatcaacgacggcgaattcgtcgtcttcgtcggcccgtccggctgcggcaagtcgacgcttctgcggctgattgccgggctggaagacgtctccgggggcaaaatcgtcatcgacggcaacgacgccaccgaaaaggcgccggccgagcgcggccttgccatggtgttccagtcctatgcgctctatccgcatatgagcgtgcgcaacaacatcgccttcccgctgaagatggccaagctcgacaaggccgtcatcgacaagaaggtcggggatgccgcccgcattctcaacctcaccgattatctggagcgccggccctcgcagctgtcgggcggccagcgccagcgcgtcgccatcggccgcgccatcgtgcgcgaacccaaggccttcctgttcgacgagccgctctccaacctcgatgcggctttgcgcggcaccatgcggctggaaatctccgagctgcacaacacgctgaagacgacgatgatctatgtcacccacgaccaggtggaagccatgaccatggccgacaagatcgtggtcctcaaccggggcaatatcgagcaggtcggctcgccgatgcagctttaccgctcgcccgccaacctgttcgtcgccggcttcatcggctcgccgcgcatgaacctgatgaccggcgattatgcccgcagcaagaacgccaccaccgccggcgtgcggcccgaacatctgacgctgtcgaaagaaaccggcctgtggcagggcaaggtgacggttgccgaacatctcggctccgataccttcctgcatctcgaggtgtcaggcatcggccccatcaccgccaggaccgacggtgaattcgaatgcaaacacggcgataccgtcttcatcacacccgatgataccaaaatccacagattcgatgacaagggcatcgctatatga

SEQ ID NO: 37067 - protein, 332 aa, Agrobacterium tumefaciens str. C58
MGSISLQNVSKLFGEAKVIPSIDLDINDGEFVVFVGPSGCGKSTLLRLIAGLEDVSGGKIVIDGNDATEKAPAERGLAMVFQSYALYPHMSVRNNIAFPLKMAKLDKAVIDKKVGDAARILNLTDYLERRPSQLSGGQRQRVAIGRAIVREPKAFLFDEPLSNLDAALRGTMRLEISELHNTLKTTMIYVTHDQVEAMTMADKIVVLNRGNIEQVGSPMQLYRSPANLFVAGFIGSPRMNLMTGDYARSKNATTAGVRPEHLTLSKETGLWQGKVTVAEHLGSDTFLHLEVSGIGPITARTDGEFECKHGDTVFITPDDTKIHRFDDKGIAI

SEQ ID NO: 37068 - DNA, 1077 bp, Agrobacterium tumefaciens str. C58
  CDS (1)..(1077)
atggcttccatcgagctgaagaatgtcggcaagacctatggcgacctcgccgtgctgcacggcgtcgatcttgatatcagggatggcgagttcatcgtcctcgtcggcccctccggctgcggaaaatcgacgctgctgcgcatgatcgccgggcttgaagagataacatccggcgacctgtccatcgatggcgagcgggtcaatgatcgcaggccgaaggatcgcgacatcgccatggtgttccagtcctatgcgctttatcctcatatgagcgttgccgacaatatgagctacagcctgcgcctgcgccgcagcaccaaggaaaccattgcggcggcggtggccggtgcttccgccaagctcggcctcgacccctacctcgcccgccgcccgaaggcgctctccggcggccagcgccagcgcgtcgccatgggccgcgccatcgtgcgccaacccaaggcgttcctgttcgacgaaccactttccaacctcgatgcgcggctgcgcgaacagatgcgtgccgaaatcaagcgcatgcatgccgatctcggagccacctcggtctacgtcacccatgatcagatcgaggcaatgacgctcgcatcccgtatcgtcgccatgaatgccggccatgtgcagcagatcggcgcgccgctcgatctttatgatcgccccgccaatctgttcgtcgccggtttcatcgggtctccgggcatgaatttcctcgaagggcggctcgggcaggagaatggccgcagtttcgtcgtgctgggtgacggcacgcgccttgcgcttggccgggaagtagacctcgccgatggcgagccggtcacgctgggcatccgcccggaacatgtcaccgttgcgccggctgatggcggcgtcgaagcgacggtcgatctggtcgagccgaccggcctaggcattatcctgcatctgaccgtgcatggattgcccttcaagctgttttcgtccgatcgggcgctgttgcaaccgggcaagtcgctgcgggtcggtttcccgcaggaacggctgcatgtctttgaccgaaacggtgtcaggatcaacgaggcctga

SEQ ID NO: 37069 - protein, 358 aa, Agrobacterium tumefaciens str. C58
MASIELKNVGKTYGDLAVLHGVDLDIRDGEFIVLVGPSGCGKSTLLRMIAGLEEITSGDLSIDGERVNDRRPKDRDIAMVFQSYALYPHMSVADNMSYSLRLRRSTKETIAAAVAGASAKLGLDPYLARRPKALSGGQRQRVAMGRAIVRQPKAFLFDEPLSNLDARLREQMRAEIKRMHADLGATSVYVTHDQIEAMTLASRIVAMNAGHVQQIGAPLDLYDRPANLFVAGFIGSPGMNFLEGRLGQENGRSFVVLGDGTRLALGREVDLADGEPVTLGIRPEHVTVAPADGGVEATVDLVEPTGLGIILHLTVHGLPFKLFSSDRALLQPGKSLRVGFPQERLHVFDRNGVRINEA

SEQ ID NO: 37070 - DNA, 1062 bp, Agrobacterium tumefaciens str. C58
  CDS (1)..(1062)
atggcaaaaattgcgctgaaagacgtccgcaaggtttatggcggcaatgtcgaggccatcaagagcgtatcgatggagatcgccgacggcgaaatgatcgtactcgtcggcccgtccggctgcggaaaatccaccttgctgcgtatgatcgccggactggaaggtatttccggcggccagatcatgatcggtgaccgcgtcgtcaacgatctcgagccctcagaccgcgacatcgccatggtgttccagaactatgcgctttatccgcatatgacggtgcggcagaaccttgcctacggcctgaagaaccgcaacaccccgaaagaggagatcgagcggcgcatcaccgaggcggccaaggctctggaaatcgaacagttcctggagcgcaaaccgcgccagctttccggcggccagcgtcagcgagtggccatgggtcgtgccatcgtgcgcaagcccgcggctttcctgttcgacgagccgctctccaacctcgatgccaagctgcgtgtgcagatgcgcgtcgaaatccgccgcctgcaacgctcgctcgccacgacaagcgtttatgtcacccatgaccagatggaggccatgacactggcagaccggctggtggtgctgaatgccggccgcatcgagcagatgggcacgccgatagagctttacgaaaaaccggccaccaccttcgtcgccaccttcataggttcgccctccatgaaccttctggcgcacggcgcggcctcgtccaatgtctcggccggctggtcggtgaacgccgccgccgcattgccgccaaccgtcgccacgctcggcatccgcccggaagacatcacgctggcagaagccgaacccgccgatgccgccttcgccggcacggtgcaggtggacgccgtggaactggtgggggcggaaagctatgtccacggctcgtttccagacggcaccaccatcgtctttcgcgtgccgggccgctcacagctgcgcataggcgagatgctgaagatcgccgcgcaggctaaggatttccatttgttcgatgcggcgggcaagcggatttga

SEQ ID NO: 37071 - protein, 353 aa, Agrobacterium tumefaciens str. C58
MAKIALKDVRKVYGGNVEAIKSVSMEIADGEMIVLVGPSGCGKSTLLRMIAGLEGISGGQIMIGDRVVNDLEPSDRDIAMVFQNYALYPHMTVRQNLAYGLKNRNTPKEEIERRITEAAKALEIEQFLERKPRQLSGGQRQRVAMGRAIVRKPAAFLFDEPLSNLDAKLRVQMRVEIRRLQRSLATTSVYVTHDQMEAMTLADRLVVLNAGRIEQMGTPIELYEKPATTFVATFIGSPSMNLLAHGAASSNVSAGWSVNAAAALPPTVATLGIRPEDITLAEAEPADAAFAGTVQVDAVELVGAESYVHGSFPDGTTIVFRVPGRSQLRIGEMLKIAAQAKDFHLFDAAGKRI

SEQ ID NO: 37072 - DNA, 1074 bp, Agrobacterium tumefaciens str. C58
  CDS (1)..(1074)
atggcttccgtcgaacttagggatatccgcaagtcctatgccgcactcgatgtcattcacggcatctcgcttgatatagccgacggcgaattcatcgcgctggtcgggccttcgggctgcggcaagtccacgctgctgcgcatgatcgccgggctggaggaaatcaccgatggggatattctcatcggcgacaaggtagtcaattccatgaccccgcgagaacgcaacatcgccatggtgttccagtcctatgcgctttatccgcatatgacggtggccgaaaacatgggcttcaacctgaagctcgccggccagccgaaaaacgtcatcgaggagcgcgtggcggaagccgcccgcatgctcgatctcggcaagcttctggatcgcaagccctcgcagctttccggcggccagcgccagcgtgtcgccatgggccgcgcagtggtgcgcaatccggcggttttcctgttcgatgagccgctctccaacctggatgccaagctccgcgtacagatgcggagcgaaatcaaggctttgcaccagaaggtcggcacgacatccatctatgtcacccatgaccagatcgaagccatgacgctggcggaccgggtggtggtgctcaatcacggccgcatcgaacagcagggcacgccgctcgagctttacaagacgcccgccaatctcttcgttgccgcctttatcggctcacccgccatgaacctcatcgaaggcgtggtcgacggcgagggcgaccagcccgctgcccggctgaaggatggaaccgcgatccgcattgccgcctccagaaaggtcaaacgcggccagccggtgacgattggcttgagaccggaacatatcggctcgagcatcggcggcgatattgcgctatccggacgaacggtgctggtggaaccgaccggcgcgcagacgcatgtggtctttgaattggcgggtgatcaggtgacggcggtggtggatggcgagcagccggtgaaggtcaatacgcccttcgccgccaccgtgcatcatgagcgtgtgcatgtcttcgacagggcgagcggcctggcgctttaa

SEQ ID NO: 37073 - protein, 357 aa, Agrobacterium tumefaciens str. C58
MASVELRDIRKSYAALDVIHGISLDIADGEFIALVGPSGCGKSTLLRMIAGLEEITDGDILIGDKVVNSMTPRERNIAMVFQSYALYPHMTVAENMGFNLKLAGQPKNVIEERVAEAARMLDLGKLLDRKPSQLSGGQRQRVAMGRAVVRNPAVFLFDEPLSNLDAKLRVQMRSEIKALHQKVGTTSIYVTHDQIEAMTLADRVVVLNHGRIEQQGTPLELYKTPANLFVAAFIGSPAMNLIEGVVDGEGDQPAARLKDGTAIRIAASRKVKRGQPVTIGLRPEHIGSSIGGDIALSGRTVLVEPTGAQTHVVFELAGDQVTAVVDGEQPVKVNTPFAATVHHERVHVFDRASGLAL

SEQ ID NO: 37074 - DNA, 1098 bp, Agrobacterium tumefaciens str. C58
  CDS (1)..(1098)
ttgagctatatgaacaaaagcgtttccatccgcgatctttccctgtccttcggtgccgtcaccgtgctgaaagacctcaatctcgatatttacgacggcgaatttctcgtgctgctcggctcttccggctgcggcaagtcgacccttctcaattgtatcgccggccttctggagccgaccgacgggcaaatcttcatcaaggatcgcaacgtcacctgggaggagccgaaggaccgcggcatcggcatggtgttccagtcctatgcgctttatccgcagatgacggtggagaagaacctgtcgttcggccttcaggtcgcaaagatcccaaaggacgaaatcgaacggcgtgtgaaaagggcggccggcatcctgcagatcgagccgctgctgaagcgcaagccggccgaactttccggcggccagcgccagcgcgtggcgatcggccgggcgctggtgcgcgatgtggatgtgttcctgtttgacgaaccgctctccaacctcgacgctaaactgcgttcggaactgcgcgtcgaaatcaagcggctgcaccagtcgctgaagaacaccatgatctatgtaacgcacgaccagatcgaggcgctgacgctggcggatcgcatcgccatcatgaaaagcggcgtcatccagcaattggcggacccggtcaccatctataacaagccgcggaacctcttcgtcgccggtttcatcggctcgccgtcgatgaatttcctgcgcggtgaattgatcgagaaagacggcaaggtggtcttcaccaccaatggcgtcagtttttcgttggatggctatcagccggaaacgccgcttgccgccggtcgcgccgtcgttctcggcgtgcgtcccgaacatgtgcgtgtcgatgccgatatcctcagtggcgaggtgcatgaggctgtcgtcgatatcgaggagccgatgggtgctgacaatctgatctggctgaaacatgccggccacacaatgtcggtgcgcgtcggcggccacaggcggttttcgcccggcacaaaggttcgcctcggcctcgacctgaccatggcctcgttgttcgacgctgagagcgaggagcggctttag

SEQ ID NO: 37075 - protein, 365 aa, Agrobacterium tumefaciens str. C58
MSYMNKSVSIRDLSLSFGAVTVLKDLNLDIYDGEFLVLLGSSGCGKSTLLNCIAGLLEPTDGQIFIKDRNVTWEEPKDRGIGMVFQSYALYPQMTVEKNLSFGLQVAKIPKDEIERRVKRAAGILQIEPLLKRKPAELSGGQRQRVAIGRALVRDVDVFLFDEPLSNLDAKLRSELRVEIKRLHQSLKNTMIYVTHDQIEALTLADRIAIMKSGVIQQLADPVTIYNKPRNLFVAGFIGSPSMNFLRGELIEKDGKVVFTTNGVSFSLDGYQPETPLAAGRAVVLGVRPEHVRVDADILSGEVHEAVVDIEEPMGADNLIWLKHAGHTMSVRVGGHRRFSPGTKVRLGLDLTMASLFDAESEERL

SEQ ID NO: 37076 - DNA, 1080 bp, Agrobacterium tumefaciens str. C58
  CDS (1)..(1080)
atggcaagtattcagcttcgtcaggtcaaaaagacatatggtgccctcgatgtgatcaagggtgtcgatctcgatatcaagcacggcgaattctgcgtcttcgtcggcccttccggttgcggcaagtcgaccctgctgcggatgatctctggtctcgaggaactgagcggcggcgatatcgtcatcggcggcgacgtggtcaacactgtgccggctgcggatcgtggccttgccatggtgttccagtcctatgccctctacccgcatatgaccgtgcgcgaaaacctctccttcggacttgagaatatcggcacccccaaaaaggacatcgccgagaaggtcacccaggtcgccaagatgctgcagatcgaccagctgctggagcgtcgcccgaaggacctgtcgggtggtcagcgccagcgcgtcgccatcggccgcgccgtggtgcgcgagccgcgtgtattcctcttcgacgagccgctttccaacctcgatgcggagctgcgcgtcgatatgcgcggcgagatttccaacctgcaccggcggctcggcaataccatgatctatgtgacgcatgatcaggtggaggccatgaccatggccgacaagatcgccgttttgcgcgccggcaagcttgaacagttcggcgtgccgcttgatctgtataaccgcccggccaatattttcgtggcaggcttcatcggttcgccgaagatgaacttctttgccggcgaagtaacgtcggatgcaacgccgtccctgaagatcgccaccggcgaactgatccccctgccgcagaccggttttgcctacaagtccggccagaaagtgacactcggcatccgtccgaaccacgtgcaggcgggtggcgaaggtgcactgaccatgtcggtgcgcaccgccgaacagctgggcggtgaatcctatctttacggcactctgggtgatggcacccgggtgacgttgcatctttccggccagacctcgacatcggcagacgaagtcatccgcctgtcggcgccgctggaacacatccatcttttcgatacgacgagcgggctgacgctccggcaggactga

SEQ ID NO: 37077 - protein, 359 aa, Agrobacterium tumefaciens str. C58
MASIQLRQVKKTYGALDVIKGVDLDIKHGEFCVFVGPSGCGKSTLLRMISGLEELSGGDIVIGGDVVNTVPAADRGLAMVFQSYALYPHMTVRENLSFGLENIGTPKKDIAEKVTQVAKMLQIDQLLERRPKDLSGGQRQRVAIGRAVVREPRVFLFDEPLSNLDAELRVDMRGEISNLHRRLGNTMIYVTHDQVEAMTMADKIAVLRAGKLEQFGVPLDLYNRPANIFVAGFIGSPKMNFFAGEVTSDATPSLKIATGELIPLPQTGFAYKSGQKVTLGIRPNHVQAGGEGALTMSVRTAEQLGGESYLYGTLGDGTRVTLHLSGQTSTSADEVIRLSAPLEHIHLFDTTSGLTLRQD

SEQ ID NO: 37078 - DNA, 1044 bp, Agrobacterium tumefaciens str. C58
  CDS (1)..(1044)
atggcacccgttacccttaaatccgtcaagaaaagctatggcgcactcgccactattcatggtgtcgatatcgatattgccgatggcgaattcgtcgtgctggttggcccttcgggctgcggcaaatccactctgctgcggatgatcgcaggccttgaaaccattaccggcggcgatatctcgatcagcaaccgcgtcgtcaacgagatcgaaccgaaagaccgcgacatcgcgatggtcttccagaactacgctctttatccgcatatgaccgtcgccagaaacatggccttctcgcttgagcatcgcggtggcagcaaggccgaggtcgccgagcgagtgaactgggcagcggagatattggggctgacgccattgctcgaacggttcccccgccagctttccggtgggcaacggcagcgtgtcgccatgggccgcgcgatcgtccgcaatccgcaggtttttctgttcgacgaaccgctcagcaacctcgatgccaagctgcgcgtcgtgatgcgcggtgaaatcaaggggctgcaccagcgcctgggcgttacgaccgtctatgtgacgcatgaccaggtggaagccatgaccatggccgacaagatcgtggtgatgaatgccgggcgggtcgagcagtgcggggcgccgctcgagctttatgaccgaccgtccaatcccttcgtcgccggcttcatcggttcgccggcgatgaacttcatcaagggacgactgactgccgatggcttcgaggccgacggcgtcaccttgcccctcccgcccggccacgtctcgggtgatgcgatatacggcatccgcccggaacatttcgaactggccgaccatggcctacccgcaaccgttttattggtggagccaatggggtcggaaacgcaggtcacgatgatgctcggccatcatcaggtcatcggtgtcttccgcgagcgtgtgcaggcacagccgggtgcgaccattcaggttcagcccgatctggcatcgatccacttgttcgatgccgcgaccagtcaacgcctcaattag

SEQ ID NO: 37079 - protein, 347 aa, Agrobacterium tumefaciens str. C58
MAPVTLKSVKKSYGALATIHGVDIDIADGEFVVLVGPSGCGKSTLLRMIAGLETITGGDISISNRVVNEIEPKDRDIAMVFQNYALYPHMTVARNMAFSLEHRGGSKAEVAERVNWAAEILGLTPLLERFPRQLSGGQRQRVAMGRAIVRNPQVFLFDEPLSNLDAKLRVVMRGEIKGLHQRLGVTTVYVTHDQVEAMTMADKIVVMNAGRVEQCGAPLELYDRPSNPFVAGFIGSPAMNFIKGRLTADGFEADGVTLPLPPGHVSGDAIYGIRPEHFELADHGLPATVLLVEPMGSETQVTMMLGHHQVIGVFRERVQAQPGATIQVQPDLASIHLFDAATSQRLN

SEQ ID NO: 37080 - DNA, 999 bp, Agrobacterium tumefaciens str. C58
  CDS (1)..(999)
atgggcagcatttcccttcagaacgtgtccaagctcttcggcgaggcaaaagtcatcccgtcgatcgatctcgatatcaacgacggcgaattcgtcgtcttcgtcggcccctctggctgcggcaagtcgacgcttctgcggctgatcgccgggctggaagacgtctccggcggcaaaatcgtcatcgacggcaacgacgccaccgaaaaggcaccggccgagcgcggccttgccatggtgttccagtcctatgcgctttatccgcatatgagtgtcagaaataacatcgccttcccgctgaagatggccaagctcgacaaggcggtgatcgacaagaaggtcgaagacgccgcccgcattctcaacctcaccgattatctcgagcgccggccctcgcagctgtccggcggccagcgccagcgcgtcgccatcggccgcgccatcgtgcgcgaaccgaaggcgttcctgtttgacgagccgctctccaacctcgatgcggcgctgcgcggcaccatgcggctggaaatctccgagctgcacaatacgctgaagacgacgatgatctatgtcacccacgatcaggtcgaggccatgaccatggccgacaagatcgtggtgctgaaccgcggcaatatcgagcaggtcggctcgccgatgcagctttacaagacaccgcgcaacctcttcgtcgccggcttcatcggctcaccgcgcatgaacctcatcaccggcgacttcgcccgccaaaagggtgccaccactgccggcgtgcggccggagcatctggtgctgtcgaaggaaagcgggctgtggcagggcaaggtcaccgttgccgaacatctcggatcggataccttcctgcatctcgaggtatcaggcatcggccccatcaccgccagaaccgacggtgaattcgaatgcaaacacggcgataccgtcttcatcacgcctgacgataccaagatccacagattcgatgacaagggcatcgcgatctag

SEQ ID NO: 37081 - protein, 332 aa, Agrobacterium tumefaciens str. C58
MGSISLQNVSKLFGEAKVIPSIDLDINDGEFVVFVGPSGCGKSTLLRLIAGLEDVSGGKIVIDGNDATEKAPAERGLAMVFQSYALYPHMSVRNNIAFPLKMAKLDKAVIDKKVEDAARILNLTDYLERRPSQLSGGQRQRVAIGRAIVREPKAFLFDEPLSNLDAALRGTMRLEISELHNTLKTTMIYVTHDQVEAMTMADKIVVLNRGNIEQVGSPMQLYKTPRNLFVAGFIGSPRMNLITGDFARQKGATTAGVRPEHLVLSKESGLWQGKVTVAEHLGSDTFLHLEVSGIGPITARTDGEFECKHGDTVFITPDDTKIHRFDDKGIAI

SEQ ID NO: 37082 - DNA, 1041 bp, Agrobacterium tumefaciens str. C58
  CDS (1)..(1041)
atggcgacaatcgaactcaatcaactcgtgaagcgctacggcaaggtcgaagcggtcaaaggcatagacctggccattgaagacggtgaattcgtcgttttcgtcggaccctccggctgcggaaaatccaccacgctgcgcatgatcgccgggctggaagagatttccgacggcacgttgaagatcgccggaaacgtcgtcaacgagaaggaaccgaaacagcgcaacatcgccatggtcttccagaactatgcaatctacccgcatatgacggttcgccagaatattggcttcgggctttacaccgcaaaactcgacaagacggaaaagaaccggcgcatcgaagaggcaggccgggtgctggggcttgaggccctgctcgaccgccgtcccgcggccctgtcgggcggccagcgccagcgtgtcgccatcggccgcgccatggtgcgtgatcccgccgccttcctgttcgatgagccgctgtccaatctcgacgctcagttgcgttcacagatgcgcattgaaatcaagcgcttgcaccaacgtcttaagacgacaaccgtctacgtcacccatgatcaggtggaagccatgaccatggctgaccgtatcgtagtgatgaaggatggtcatattctccaggtcggcacaccgacggagctttacgaaacgcctgtcgatattttcaccgcccgcttcatcggcagtccttccatgaacctgctgcggggttcaagaacaaccaacagcgtcgccccctccgccgcgggcgaccttctggtcggtgttcgtccgcatgacctgctggttggtgaaagccaagcccagcagggagtatttacgcttgagggaaccgtaaccgccgtcgagcccctcggcccggaaacgctggttcatctggataccgacacgacgtccgtgatcgccacggcgagggggaaatccattcccgctgtcggcagccggttgcaatgccaggcggaggcaggcgcgctctatcttttcgatgcgaagacggaaaagcttctgggccgcgcatga

SEQ ID NO: 37083 - protein, 346 aa, Agrobacterium tumefaciens str. C58
MATIELNQLVKRYGKVEAVKGIDLAIEDGEFVVFVGPSGCGKSTTLRMIAGLEEISDGTLKIAGNVVNEKEPKQRNIAMVFQNYAIYPHMTVRQNIGFGLYTAKLDKTEKNRRIEEAGRVLGLEALLDRRPAALSGGQRQRVAIGRAMVRDPAAFLFDEPLSNLDAQLRSQMRIEIKRLHQRLKTTTVYVTHDQVEAMTMADRIVVMKDGHILQVGTPTELYETPVDIFTARFIGSPSMNLLRGSRTTNSVAPSAAGDLLVGVRPHDLLVGESQAQQGVFTLEGTVTAVEPLGPETLVHLDTDTTSVIATARGKSIPAVGSRLQCQAEAGALYLFDAKTEKLLGRA

SEQ ID NO: 37084 - DNA, 1116 bp, Agrobacterium tumefaciens str. C58
  CDS (1)..(1116)
atgagtggggtcgaactaaagggtgtttcgaagagttttggcgccgttgatgtcatccatgatatcgacctctccataacagccggcgagtttgtcgttttcgtcggaccgtcaggctgtggaaaatcgacgcttctacgcctgatcgccggactggaagagaccagccggggcgagatcctgatcggtggacgcgacgtgacggatgccgatccgtccgaccgggggattgccatggtgttccagtcttacgcgctctacccgcatatgaccgttgcccagaacatgggcttcggcttgcggatggcacatcgcccgaaagaggaggtcacagcgatggtgcggcacgctgccgaaatcctgcatctgacacctctgctcgaccggcgtcccggccagctctccggtggccagcgccagcgggttgccatcgggcgcgccattgttcgcaacccggaggtcttcctgttcgacgaaccgctctccaatctcgacgctgaattgcgggttggcatgcgcatcgagatcgccaggttgcacaaacagcttggcaacaccatgatctatgtcacgcacgatcagaccgaagccatgacgctggcagacaagatcgtcgttctcagggcagggcgcatcgaacagatcggctcaccctttgagctctatagtgatcccgataacctgttcgttgccggtttcatcggcagtccaaagatgaatttcgtcccagccgggcatgaggcgggcgcactcgttgtcgccggccaccgcttaacctttgccgcgcctgccggattgcctacgaactgccagttgcagcttggcatcaggccggagaacctgacgctgacccgtgacggtgaaaggggccttgccgttaccgtcggctttactgaatttctgggaggcacaacctatctctacggtcatatcgagccgggaatgccgctgatcgttcagggtgaagccggcccggcgcctctcgtcggccaaacggttttcgtgacttcgatccgacaaatgcccgatttttcgatgccgaggggatgcgtattcgtcatgttgaggaacgtcccgaagccgtttcaggcgattagctttcaaacagccgtttga

SEQ ID NO: 37085 - protein, 371 aa, Agrobacterium tumefaciens str. C58
MSGVELKGVSKSFGAVDVIHDIDLSITAGEFVVFVGPSGCGKSTLLRLIAGLEETSRGEILIGGRDVTDADPSDRGIAMVFQSYALYPHMTVAQNMGFGLRMAHRPKEEVTAMVRHAAEILHLTPLLDRRPGQLSGGQRQRVAIGRAIVRNPEVFLFDEPLSNLDAELRVGMRIEIARLHKQLGNTMIYVTHDQTEAMTLADKIVVLRAGRIEQIGSPFELYSDPDNLFVAGFIGSPKMNFVPAGHEAGALVVAGHRLTFAAPAGLPTNCQLQLGIRPENLTLTRDGERGLAVTVGFTEFLGGTTYLYGHIEPGMPLIVQGEAGPAPLVGQTVFVTSIRQMPDFSMPRGCVFVMLRNVPKPFQAISFQTAV

SEQ ID NO: 37086 - DNA, 1092 bp, Brucella melitensis 16M
  CDS (1)..(1092)
atggcacagctttccatcaaaaatctcgtcaagcgttatggcagcatcgaagtggtgcatggcatcaatctcgaaatcgccgacaaggagtttgtcgcgctggtcggcccgtccggttgcggaaaatccacgacgctgcggatgattgccggcctggaatccatctccggtggcacgcttgaaatcggcggcaaagtcgtcaacgacttgcccccgcgtgatcgcaacatctccatggtgttccagtcctatgcgctctatccgcatatgagcgtacgcgagaacatgggtttttcgctgaagattgcaaagcagccgcaggcggaaatcgaccgccgcgtcaacgaggcggcggctgttctggggcttgaagcattgatggaccgccgccccgcgcagctttcgggcggccagcgccagcgtgtcgccatggggcgcgccatcgtgcgcaacccggaagtctttctcttcgatgagccgctctcgaacctcgatgccaaactgcgtacgcagatgcgcaccgaaatcaagaagctgcacgccaaggtgcagtctacggtcgtctatgtgacccacgatcaggtcgaggcgatgacgctggccgaccgcattgtcatcatgcgcgacggccatatcgaacaggcgggcaccccggatgaagtgttcaagcgcccggcgacgcaaatcgttgcgggcttcatcggttcgccgccgatgaacatggccgaagcgaccgtgaagggtgacgagcttcttttcgccaatggcgaccgcctgccgctgcctgcccggttcaaggcaagggtgggcgagggcgcaaaggttactttcggcctgcggcctgatgatattttcccgaaaggtcacggcctttcgaccggcgatggcgtgcatgagaaagaattgcgcgtcgtcatcaccgagccgcttggcaatgaaacactggtctttgcggaatttgccgggcgcgaatgggtggcgcgtatgctgaacccgcgcccggtgcagccgggtgagagcattgccatgcagttcgatctggcgcaggcgcatcttttcgatgccgctaccggcaagagtctgacggtgtaa

SEQ ID NO: 37087 - protein, 363 aa, Brucella melitensis 16M
MAQLSIKNLVKRYGSIEVVHGINLEIADKEFVALVGPSGCGKSTTLRMIAGLESISGGTLEIGGKVVNDLPPRDRNISMVFQSYALYPHMSVRENMGFSLKIAKQPQAEIDRRVNEAAAVLGLEALMDRRPAQLSGGQRQRVAMGRAIVRNPEVFLFDEPLSNLDAKLRTQMRTEIKKLHAKVQSTVVYVTHDQVEAMTLADRIVIMRDGHIEQAGTPDEVFKRPATQIVAGFIGSPPMNMAEATVKGDELLFANGDRLPLPARFKARVGEGAKVTFGLRPDDIFPKGHGLSTGDGVHEKELRVVITEPLGNETLVFAEFAGREWVARMLNPRPVQPGESIAMQFDLAQAHLFDAATGKSLTV

SEQ ID NO: 37088 - DNA, 1056 bp, Brucella melitensis 16M
  CDS (1)..(1056)
atgagcaaaatcgttcttgataacgtccgcaagagctatggcggcaatatcgaagtcatcaaaggcgtttcgctggagatcgcggatggtgaattcgtggtgctggttggcccgtcgggctgtggcaagtccacgctgctgcgcatgatcgcgggcctcgaaagcatcacttccggcaccatttccatcggcgagcgcgtggtcaataatgtggaacccgccgaacgcgatatcgccatggtgttccagaattatgcgctttatccgcatatgacggtgcgcgaaaacctcgcctatggcctgaaaaaccgcaaaacaccgaaagaagagatcgaacgccgcatcgccaaggccgcaaaggtgctggagatcgagcagtttctggagcgcaagccccgccagctctccggtggccagcgccagcgcgtcgccatgggccgcgccatcgtgcgcgaaccggccgccttcctcttcgatgagccgctttccaacctcgacgcaaagctgcgcgtgcagatgcgcgtagagatcaagcgcctgcaacgctcgctcggcaccaccagcgtctatgtcacccacgaccagatggaagccatgaccatggccgaccgtctcgtggtgctcaatgccggtcatatcgagcaggtcggcacgccgatcgagctttatgaaaagcccgcctcgatattcgtggcgaccttcatcggctcaccctcgatgaacctgcttcaaagcccagaatctgccgcctggcaaccgggccgcgcaatcacgcttccctccggcgggtacactttcggtgtgcgcccggaagatatccgcattctcgaagagggtgatcaggatgccgatggcttcaacgcgcaagtgcgcattgaagcagtcgaactggttggcgcggaaagctatattcatgccgcgctcagcgacggcaagccgctgatcttccgcgttgcgggccgctccacgcataatattgatgaaatggtccgcgttggtgcatccgccacggatgtacatattttcggcgcggacggacgccgcgtgagcgactga

SEQ ID NO: 37089 - protein, 351 aa, Brucella melitensis 16M
MSKIVLDNVRKSYGGNIEVIKGVSLEIADGEFVVLVGPSGCGKSTLLRMIAGLESITSGTISIGERVVNNVEPAERDIAMVFQNYALYPHMTVRENLAYGLKNRKTPKEEIERRIAKAAKVLEIEQFLERKPRQLSGGQRQRVAMGRAIVREPAAFLFDEPLSNLDAKLRVQMRVEIKRLQRSLGTTSVYVTHDQMEAMTMADRLVVLNAGHIEQVGTPIELYEKPASIFVATFIGSPSMNLLQSPESAAWQPGRAITLPSGGYTFGVRPEDIRILEEGDQDADGFNAQVRIEAVELVGAESYIHAALSDGKPLIFRVAGRSTHNIDEMVRVGASATDVHIFGADGRRVSD

SEQ ID NO: 37090 - DNA, 1074 bp, Pyrobaculum aerophilum str. IM2
  CDS (1)..(1074)
atgacatttgtagtgttagacagggttactaaacgctttggaaaagtcttagcagtagacaatgtgtctttgtctattgaaaagggtgaatttgtagtgctccttggcccctctggctgtggcaagacgacaacgcttaggatgatagctgggcttgaaattccgacgagcggcagaatttatatagatgggagagacgtcacttatctagagccaggcgagcgcgacgtcgccatggtgtttcaagactatgcaatttatccccacatgacggtgtttgaaaacatcgcctttcctctggaaatacggaggaggaagctaagactcacaaagagagatatagaagaaaaggtgcttcaagttgccaagatgcttcaaatcgaccacttgctagatagaaaggcgtcgcaactctcaggcgggcaacaacagcgtgtggcgttggccagggcgttggttagagagcctaaagtctggttaatggacgagccgctgtcaaacctcgatgcgctaattaggctacaagtaagagctgagttgaagagacttcagaaggatttgggcattaccacaatatacgtcacgcatgatcaagtagaggcgctgacgctagccgacagaattgccgtgatgaacgccgggagggtagtgcagtttgggacccctaaggagatatatgacgcccccactcacgtctttgtgggcacgttcgtaggcaatccgcctatgaacatattgaagtgtaaacctgcaggcgacgttttagagtgtccaggttttactattaaaaaccccggcgtgaagcaaacagtatttttcggcattaggccggagtatattgagtggagcgacaaggagcagcccggctatataaaaggcttggtatatgtagtggagccgatcggctcagaatatttgataaatgtaaagattgctgatgttttgttaaaaattaagactctaagggaagtaagcctaaaaccgggtgattctatatactttaaattcgacatgaaaaaagccgtcttatttgatgaagaaactggaaatgtagtgatccgcggcattgaataa

SEQ ID NO: 37091 - protein, 357 aa, Pyrobaculum aerophilum str. IM2
MTFVVLDRVTKRFGKVLAVDNVSLSIEKGEFVVLLGPSGCGKTTTLRMIAGLEIPTSGRIYIDGRDVTYLEPGERDVAMVFQDYAIYPHMTVFENIAFPLEIRRRKLRLTKRDIEEKVLQVAKMLQIDHLLDRKASQLSGGQQQRVALARALVREPKVWLMDEPLSNLDALIRLQVRAELKRLQKDLGITTIYVTHDQVEALTLADRIAVMNAGRVVQFGTPKEIYDAPTHVFVGTFVGNPPMNILKCKPAGDVLECPGFTIKNPGVKQTVFFGIRPEYIEWSDKEQPGYIKGLVYVVEPIGSEYLINVKIADVLLKIKTLREVSLKPGDSIYFKFDMKKAVLFDEETGNVVIRGIE

SEQ ID NO: 37092 - DNA, 1110 bp, Clostridium perfringens str. 13
  CDS (1)..(1110)
atggcaaatttatcacttaaacatatttataaagtttatccaggagatgttacagcagttaaagactttaacttagaaatagctgacaaagagtttatagtattcgttggaccatcaggttgtggtaagtctactactttaagaatgattgctggattagaagaaatatcaaaaggtgaattatatattggagatagattagttaacgaagttgaaccaaaggaaagagatatagcgatggttttccaaagttacgcactatatccacatatgactgtatatgataacatggcatttggacttaagttaagaaaagttccaaaggatgaaatagataaaaaggttaaagatgctgctaaaatacttgatatagagcatttattagatagaaaaccaaaggctttatcaggaggtcaaagacaaagggttgccttaggaagagctatagtaagagaacctaaagtattcttaatggacgagcctttatcaaacttagatgctaaattaagagttcaaatgagaactgagatctctaaattacatcaaagattacaaacaacattcatatatgttacacatgaccaagttgaagctatgacaatgggtacaagaatagttgttatgaaagatggtatagttcaacaagttgactcaccacaagaaatatacaataacccagctaatatattcgttgcaggattcattggaagtccacaaatgaactttattgatggtactataaaagaagaaggcggaaaatattttgcttgcttccaaagcgaaaaaattgaaatgccaatggataaagctagattattaaaagaaaaaggatatataggaaaaaatgttataataggtgtaagacctgaacatttagatgatgaccaagaattagttgcagcaaatccaacaacagtaataaaatcaaaagttgaagttacagagttaatgggagcagaaagttatatctatactaaacttggagatcaaaacataacagttagggtaaatggaagcactaagttacaaaatggtcaagaagctaagttctacgttgatgctaataagattcatatattcgataaagaaactgaattaaaattagtttaa

SEQ ID NO: 37093 - protein, 369 aa, Clostridium perfringens str. 13
MANLSLKHIYKVYPGDVTAVKDFNLEIADKEFIVFVGPSGCGKSTTLRMIAGLEEISKGELYIGDRLVNEVEPKERDIAMVFQSYALYPHMTVYDNMAFGLKLRKVPKDEIDKKVKDAAKILDIEHLLDRKPKALSGGQRQRVALGRAIVREPKVFLMDEPLSNLDAKLRVQMRTEISKLHQRLQTTFIYVTHDQVEAMTMGTRIVVMKDGIVQQVDSPQEIYNNPANIFVAGFIGSPQMNFIDGTIKEEGGKYFACFQSEKIEMPMDKARLLKEKGYIGKNVIIGVRPEHLDDDQELVAANPTTVIKSKVEVTELMGAESYIYTKLGDQNITVRVNGSTKLQNGQEAKFYVDANKIHIFDKETELKLV

SEQ ID NO: 37094 - DNA, 1119 bp, Pyrococcus furiosus DSM 3638
  CDS (1)..(1119)
atggctggtgttaggcttgtagatgtttggaaggtgtttggggaggttactgctgttagggagttgagtttggaggttaaggatggggagtttatgattcttttgggcccgagtggttgtgggaagacaacaacgctcaggatgattgctgggctggaggagccgagtagggggcagatttacattggtgataggctggttgctgacccggagaagggaattttcgtcccgccgaaggatagggatattgcgatggtttttcagagttatgcgttgtacccgcatatgactgtttatgataatattgcttttccgttgaagctcaggaaggttccgaggcaggagattgaccagcgtgttagggaggttgctgagctcctcggtttgacggagcttttgaataggaagccgagggaattaagcggtgggcagaggcagcgtgttgcgttgggtagggcgattgttaggaagccgcaggtgtttttgatggatgagcctttgagtaatttggatgctaagttgagggttaggatgcgtgctgaactgaagaagttgcagaggcagcttggtgtgacgacgatttacgtgacccacgatcaggttgaggctatgacgatgggtgataggattgctgtgatgaatgggggtgttttgcagcaggttggttcgccggatgaggtttatgataagcctgcgaatacttttgtggctggttttattggaagcccgccgatgaattttcttgatgctattgttactgaggatgggtttgtggattttggggagtttaggttgaagcttcttccggatcagtttgaggttttgggggagttgggttatgttggtagggaggtaatctttggtattcgtccggaggatttgtatgatgcgatgtttgctcgggtgagggttcctggggagaatttggttagggctgtggttgagattgtggagaatttgggtagtgagaggattgtgcatttgcgtgttggtggtgtgacttttgttggtgcttttcgttcggagtctagggttagggagggtgtggaggttgatgttgtgtttgatatgaagaagattcacatcttcgacaaaaccacaggaaaagcaatattctag

SEQ ID NO: 37095 - protein, 372 aa, Pyrococcus furiosus DSM 3638
MAGVRLVDVWKVFGEVTAVRELSLEVKDGEFMILLGPSGCGKTTTLRMIAGLEEPSRGQIYIGDRLVADPEKGIFVPPKDRDIAMVFQSYALYPHMTVYDNIAFPLKLRKVPRQEIDQRVREVAELLGLTELLNRKPRELSGGQRQRVALGRAIVRKPQVFLMDEPLSNLDAKLRVRMRAELKKLQRQLGVTTIYVTHDQVEAMTMGDRIAVMNGGVLQQVGSPDEVYDKPANTFVAGFIGSPPMNFLDAIVTEDGFVDFGEFRLKLLPDQFEVLGELGYVGREVIFGIRPEDLYDAMFARVRVPGENLVRAVVEIVENLGSERIVHLRVGGVTFVGAFRSESRVREGVEVDVVFDMKKIHIFDKTTGKAIF

SEQ ID NO: 37096 - DNA, 1113 bp, Pyrococcus furiosus DSM 3638
  CDS (1)..(1113)
atggctggtgttaggcttgtgggtgtttggaagcagtttgggagttttactgcggtgaaggatttaacgctggaggttagggatggtgaattcctagtcctcctcggcccctcgggctgtggtaagactacaactttaaggatgattgctggtttggaggaaccaacaaaaggtcaaatctacattggggataagctcgtcgctgatccagagaagggagtctttgttccaccaaaggatagggatattgccatggtcttccagagctatgcattgtacccccacatgactgtttatgagaacatcgcctttccactaaagcttaggaaggttccaaagcaggagattgacaagagggttagggaagttgcagaaatgcttgggttgaccgagcttttaaatagaaagccgagagagttgagtggtgggcagaggcagcgtgtggcactaggaagggccattgttaggagacctcaagtcttcctaatggatgagccattgtcaaacttagatgctaaattaagggtgaagatgcgtgctgaacttaaaaaactccaaaagcaattgggcgtgactacaatctacgtaacccacgaccaggttgaggcaatgaccatgggtgataggattgctgtgatgaatcaaggagtattacaacaagttgggactccagaggaggtttatgaaaagccagcaaatactttcgtcgctggtttcattggatcaccaccaatgaacttcctggatgctacgattactgaggatgggttcttggactttggtgagtttaggcttaaattactcccagatcaatttgaagtcctgcaggattacgttgggaaggaggtcatctttggcattaggcctgaagacatttacgacgcactctttgcccaagtaaagattcccggggagaatatggctaggggcgttgttgatataatcgaaaacctcggtggagaaaaaatcgtgcacataagcattggaggattgatagtaacagcaaaattcccaggagaatcaagagtcaaagaaggagacgaaatagacattgtcttcgacatgaaaaaaatccacatattcaacaaaaaaacaggaaaagcaatactttag

SEQ ID NO: 37097 - protein, 370 aa, Pyrococcus furiosus DSM 3638
MAGVRLVGVWKQFGSFTAVKDLTLEVRDGEFLVLLGPSGCGKTTTLRMIAGLEEPTKGQIYIGDKLVADPEKGVFVPPKDRDIAMVFQSYALYPHMTVYENIAFPLKLRKVPKQEIDKRVREVAEMLGLTELLNRKPRELSGGQRQRVALGRAIVRRPQVFLMDEPLSNLDAKLRVKMRAELKKLQKQLGVTTIYVTHDQVEAMTMGDRIAVMNQGVLQQVGTPEEVYEKPANTFVAGFIGSPPMNFLDATITEDGFLDFGEFRLKLLPDQFEVLQDYVGKEVIFGIRPEDIYDALFAQVKIPGENMARGVVDIIENLGGEKIVHISIGGLIVTAKFPGESRVKEGDEIDIVFDMKKIHIFNKKTGKAIL

SEQ ID NO: 37098 - DNA, 1122 bp, Pyrococcus furiosus DSM 3638
  CDS (1)..(1122)
gtggggaataacactgaggtgataaagatggttgaggtaaggttagagaatctcacaaaaaagtttggagattttaccgcagttaatagcttaaatctcacgattaaggatggagaattcctagtgttattgggcccctcaggatgtggaaagacgacaactttgagaatgattgcagggcttgaagaaccaacgtctgggaaaatatacttcggggatagagacgtcacatacctccctccaaaagatagaaatgtaagcatggttttccagagctatgccgtgtggcctcacatgacagtttatgagaacatagcctttccgcttaagatcaagaagtatccaaaagatgagatagagaggagagtcaagtgggctgcagagctcctgcaaattgaagaattacttgacagatatccagcacagctctctggaggacagaggcagagagtcgcagttgccagggccatagttgtagagccagatgtattgcttatggatgagccgttaagcaacttggatgctaaattaagagtcgctatgagggctgagataaagaagttgcaacagaagcttaaggtcactacaatctacgtaacccacgaccaagttgaggcaatgactatgggagatagaattgcagtaatgaacagaggaaagttactccaagttggctcgcctactgaagtttacttaaaccccaactccgtctttgtagccacctttataggagctccagaaatgaatattttagaagtttcagtaggcgaaggatacctggaaggagaaggatttaagatagagctcccagatgacataatggaagcattgaggaactatatagggaaaaccgttctctttggaatacgtcccgaacatatggtaattgaagggataagcgaacttgcccacatgagaagaactgcaaagataaagggagttgtggatttcgttgaggcactgggaacagatacaatagtgcacgttaggttcgaggagtcaattataaaagttaagcttcctggccatattcctttggagataggaaaagaggtatctgtgctaatagatctagacaagattcatatatttgacaagaattcagaaaaggccataatttaa

SEQ ID NO: 37099 - protein, 373 aa, Pyrococcus furiosus DSM 3638
MGNNTEVIKMVEVRLENLTKKFGDFTAVNSLNLTIKDGEFLVLLGPSGCGKTTTLRMIAGLEEPTSGKIYFGDRDVTYLPPKDRNVSMVFQSYAVWPHMTVYENIAFPLKIKKYPKDEIERRVKWAAELLQIEELLDRYPAQLSGGQRQRVAVARAIVVEPDVLLMDEPLSNLDAKLRVAMRAEIKKLQQKLKVTTIYVTHDQVEAMTMGDRIAVMNRGKLLQVGSPTEVYLNPNSVFVATFIGAPEMNILEVSVGEGYLEGEGFKIELPDDIMEALRNYIGKTVLFGIRPEHMVIEGISELAHMRRTAKIKGVVDFVEALGTDTIVHVRFEESIIKVKLPGHIPLEIGKEVSVLIDLDKIHIFDKNSEKAII

SEQ ID NO: 37100 - DNA, 999 bp, Corynebacterium glutamicum ATCC 13032
  CDS (1)..(999)
atggcaacggtcacattcgacaaggtcacaatccggtaccccggcgcggagcgcgcaacagttcatgagcttgatttagatatcgctgatggcgagtttttggtgctcgtcggcccttcgggttgtggtaaatccactacgctgcgtgctttggcggggcttgagggcgtggagtcgggtgtgatcaaaattgatggcaaggatgtcactggtcaggagccggcggatcgcgatatcgcgatggtgttccagaattatgctctgtaccctcacatgacggtggcgaagaatatgggttttgcgctgaagttggctaagctgccgcaggcgcagatcgatgcgaaggtcaatgaggctgcggaaattcttgggttgacggagtttttggatcgcaagcctaaggatttatcgggtggtcagcgtcagcgtgtggcgatgggtcgcgcgttggtgcgtgatccgaaggtgttcctcatggatgagccgctgtccaacctggatgcgaaattgcgcgtgcaaacccgcgcggaggtcgctgctttgcagcgtcgcctgggcaccaccacggtgtatgtcacccacgatcaggttgaggcaatgacgatgggcgatcgggttgcggtgctcaaggacgggttgctgcagcaggtcgcaccgcccagggagctttacgacgccccggtcaacgaattcgttgcgggcttcatcggctcgccgtccatgaacctcttccctgccaacgggcacaagatgggtgtgcgcccggagaagatgctggtcaatgagacccctgagggtttcacaagcattgatgctgtggtggatatcgtcgaggagcttggctccgaatcgtatgtttatgccacttgggagggccaccgcctggtggcccgttgggtggaaggccccgtgccagcccctggcacgcctgtgactttttcctatgatgcggcgcaggcgcatcatttcgatctggagtcgggcgagcgtatcgcttag

SEQ ID NO: 37101 - protein, 332 aa, Corynebacterium glutamicum ATCC 13032
MATVTFDKVTIRYPGAERATVHELDLDIADGEFLVLVGPSGCGKSTTLRALAGLEGVESGVIKIDGKDVTGQEPADRDIAMVFQNYALYPHMTVAKNMGFALKLAKLPQAQIDAKVNEAAEILGLTEFLDRKPKDLSGGQRQRVAMGRALVRDPKVFLMDEPLSNLDAKLRVQTRAEVAALQRRLGTTTVYVTHDQVEAMTMGDRVAVLKDGLLQQVAPPRELYDAPVNEFVAGFIGSPSMNLFPANGHKMGVRPEKMLVNETPEGFTSIDAVVDIVEELGSESYVYATWEGHRLVARWVEGPVPAPGTPVTFSYDAAQAHHFDLESGERIA

SEQ ID NO: 37102 - DNA, 1227 bp, Corynebacterium glutamicum ATCC 13032
  CDS (1)..(1227)
atggcgtcaatcgtctttgaaaacgtcacacgcaaatactctccgggcgcacgcccggccgtcgacaagcttaatttggaaatcgccgacggcgagttcctagttctcgttggaccctcaggctgtggaaagtccacttctttgcgcatgctggctggtcttgagcctatcgacgagggacgtctactcattgatggtaaagacgccacggaactgcgtccgcaggatcgtgacatcgctatggtcttccagagctacgcgctgtacccgaatatgactgttcgggacaacatgggctttgcgctgaagaatcagaaggtggctaaggctgagatcgaaaagcgtgttgctgaagcctcacgcattctgcagctggatccgtatcttgatcgtaagcctgcagctttgtctggtggtcagcgccagcgcgtggccatgggccgtgcaattgtgcgtgagccatcggtgttctgcatggatgagccactgtccaacctagatgcgaagctgcgtgtgtctacgcgtgcggagatctctggtttgcagcgtcgcatgggcgtgaccacggtgtatgtgactcacgatcaggtcgaggccatgaccatgggtgatcgcgtcgctgtgcttttgctcggtgtgctgcagcaagtagacaccccgcagaacctgtacgactacccagcaaatgcgttcgtcgccagcttcattggttccccttccatgaacttgattgagggcaccatccgtggcgataaggtcactttgggtactggaattcagatttcagttcctgatgaggtggcagcagaggttcgcaacaacccggatcgctttgagggtcgtccagtcattgttggtgctcgtcccgagcacatgtatttgaccacggcgaatgagagtggtgctgtattgggcgaagtcagccacattgatgagctcggcgcggattcaatggtctacgtattggcgtctggtgtgaagaacccgaatactgatcttttgggtgagggcattccagaggatatgcgcgtgaccgttgtcggtgctgaagagaccgataaggcccggctgggtattcgtgttgagcgccatcacggtctgaaggccggcgataaggtgcacgttgttgctgcaccgaaggatgttcacctcttcgacggtcttgatggccgtcgaatcggtgcaacggttctagctccagcccatacagtccaggctggtcactag

SEQ ID NO: 37103 - protein, 408 aa, Corynebacterium glutamicum ATCC 13032
MASIVFENVTRKYSPGARPAVDKLNLEIADGEFLVLVGPSGCGKSTSLRMLAGLEPIDEGRLLIDGKDATELRPQDRDIAMVFQSYALYPNMTVRDNMGFALKNQKVAKAEIEKRVAEASRILQLDPYLDRKPAALSGGQRQRVAMGRAIVREPSVFCMDEPLSNLDAKLRVSTRAEISGLQRRMGVTTVYVTHDQVEAMTMGDRVAVLLLGVLQQVDTPQNLYDYPANAFVASFIGSPSMNLIEGTIRGDKVTLGTGIQISVPDEVAAEVRNNPDRFEGRPVIVGARPEHMYLTTANESGAVLGEVSHIDELGADSMVYVLASGVKNPNTDLLGEGIPEDMRVTVVGAEETDKARLGIRVERHHGLKAGDKVHVVAAPKDVHLFDGLDGRRIGATVLAPAHTVQAGH

SEQ ID NO: 37104 - DNA, 1131 bp, Corynebacterium glutamicum ATCC 13032
  CDS (1)..(1131)
atggcaaccgtaacgttcaaagatgcttccctaagctacccgggagcaaaggaacccaccgtcaagaaattcaacctggaaatcgccgatggcgagttcctcgtcctcgtcggcccttccggctgtggtaaatccaccacgctgcgcatgctggccggtttggaaaacgttactgacggtgccattttcatcggagacaaggacgttacccacgttgcaccgcgtgaccgtgacatcgccatggttttccagaactatgctctctacccccacatgaccgtgggcgagaacatgggcttcgcactgaagatcgccggcaagtcccaagacgagatcaataagcgcgtcgacgaagccgccgccactttgggcctgaccgaattcttggagcgcaagccgaaggccctgtccggtggtcagcgtcagcgtgtggccatgggccgcgccattgttcgcaacccgcaggtctttctcatggatgagccgctgtctaacctcgatgccaagctgcgtgttcagacccgtacccagattgcagccctgcagcgcaagcttggggttaccaccgtttacgtcacccacgaccagacggaggccttgaccatgggtgaccgcatcgcggtgctgaaggatggctacctgcagcaggttggcgcgccccgagagctttatgaccgccccgccaacgtcttcgtcgccggcttcatcggctccccagccatgaacttgggcaccttctcggtcaaggatggtgacgctacctctggtcacgctcgcatcaagctttccccggaaaccctcgccgccatgacgccggaggataatggccgcatcaccattggtttccgcccggaggcactggagatcattccggaaggcgagtccaccgatctttccatcccaatcaagctcgacttcgtggaggaactcggttccgattccttcctctacggcaagctggtaggcgagggcgaccttggatcctccagcgaggatgtccccgagtccggccaaatcgtcgtccgcgctgctccgaacgccgcgcctgctccgggcagtgttttccacgcacgcatcgtggagggcggccagcacaacttctcggcgtcgactggcaagcgcctcccttaa

SEQ ID NO: 37105 - protein, 376 aa, Corynebacterium glutamicum ATCC 13032
MATVTFKDASLSYPGAKEPTVKKFNLEIADGEFLVLVGPSGCGKSTTLRMLAGLENVTDGAIFIGDKDVTHVAPRDRDIAMVFQNYALYPHMTVGENMGFALKIAGKSQDEINKRVDEAAATLGLTEFLERKPKALSGGQRQRVAMGRAIVRNPQVFLMDEPLSNLDAKLRVQTRTQIAALQRKLGVTTVYVTHDQTEALTMGDRIAVLKDGYLQQVGAPRELYDRPANVFVAGFIGSPAMNLGTFSVKDGDATSGHARIKLSPETLAAMTPEDNGRITIGFRPEALEIIPEGESTDLSIPIKLDFVEELGSDSFLYGKLVGEGDLGSSSEDVPESGQIVVRAAPNAAPAPGSVFHARIVEGGQHNFSASTGKRLP

SEQ ID NO: 37106 - DNA, 1071 bp, Fusobacterium nucleatum subsp. nucleatum ATCC 25586
  CDS (1)..(1071)
atggcatcagtaacaataacaggagttacaaaatcctttggaaatgtaacagtcctacaagaatttaatcaaaaatttgaagatggagaatttataacattactaggcccatctggttgtggaaaaacaactatgcttagacttattgcaggatttgaaaaaccaagtagtggagaaatatatataggtgataaattagtatcaagtgaaaaagaatttttaccacctgaaaaaagaggaattggaatggtatttcaatcttatgcagtatggcctcatatgaatgtatttgacaatattgcttatccattaaaaattcaaaaaattagtaaaaatgaaatagaagaaagagtaaatcaagttttaaaaattgtacacttagaacaatataaggatagatttccatctgagttatcaggaggacaacaacaaagggttgcattaggaagagccttagttgctcaaccagaaattttgttgttagatgaacctctttctaacctagatgcaaagttaagagaagaaatgagatatgaaataaaagaaataactaaaaaattaaaaataacagttatttatgtaactcatgaccaaatagaagcaatgaccatgagtaatagaattgtattgattaataaaggagaggtacaacaagttgcacctccacaagaaatatattctaaacctaaaaatatgtttgttgcaaactttgttggtaaggttgattttattacaggaaaggttgaaggaagtaaaattttactagataatagtaataatcaaatactttctaatacaagctcatttaaaggaaaggttgttgtagcaattcgtccagaaaatgctattctttctgatgatggagaaatcacaggaaaagtttattctaaattctatttaggagattgtaatgatttaagagttgaaattggaaatggaaatattttaagaataattgcaagagcttcaacttataacactttaaatgagggtgatgaagtaaaaataaaaatcttagattattttgtttttgaagatgatggaaaagaccaaattaaaattatgacataa

SEQ ID NO: 37107 - protein, 356 aa, Fusobacterium nucleatum subsp. nucleatum ATCC 25586
MASVTITGVTKSFGNVTVLQEFNQKFEDGEFITLLGPSGCGKTTMLRLIAGFEKPSSGEIYIGDKLVSSEKEFLPPEKRGIGMVFQSYAVWPHMNVFDNIAYPLKIQKISKNEIEERVNQVLKIVHLEQYKDRFPSELSGGQQQRVALGRALVAQPEILLLDEPLSNLDAKLREEMRYEIKEITKKLKITVIYVTHDQIEAMTMSNRIVLINKGEVQQVAPPQEIYSKPKNMFVANFVGKVDFITGKVEGSKILLDNSNNQILSNTSSFKGKVVVAIRPENAILSDDGEITGKVYSKFYLGDCNDLRVEIGNGNILRIIARASTYNTLNEGDEVKIKILDYFVFEDDGKDQIKIMT

SEQ ID NO: 37108 - DNA, 1164 bp, Thermoanaerobacter tengcongensis MB4
  CDS (1)..(1164)
atggctgaagtagtgctcaaacatgtgtacaaagtgtatcctggcggtgtaaccgcagttaaggattttaacttggagatcgccgacaaagaatttatagttttggttggcccttccggttgtgggaagaccaccactttgagaatgatagcagggcttgaggaaatcacaagcggagaattgtacattgacggaaaattggtaaacgacgtgccgcccaaagacagggacattgcgatggtttttcagaactatgccctttatcctcacatgacagtgtacgacaatatggcttttggattaaaacttagaaaagtgccaagagcagaaattgacaggaaggtaaaagaggcagccagaattttgggccttgaggagcttctcaacagaaagccaaaagctttgtctggcggtcagaggcagagggtggctttgggtcgcgctattgtgagaaatcctaaggtgttcttgatggatgagccactttcaaacttggacgcaaagttaagagttcagatgaggacagagctcaagaagttgcatgagagattgcagacaactttcatttatgtcacccacgaccagacagaggctatgacgatggggacgagaatagttgttatgaaagacggggttatacagcaggtagatgagccacaggtgatttacgattatccgaacaacttgtttgttgctggttttattggaagcccgcagatgaatttcatagatgctagactggaaaatagagatggaaaggtttatgctactttcaaaggatatagcatactggttcccgagggaatcttgaagaggttaaaagacccgagctatataggaaaagaaatagtgcttggcataaggcccgaagatttgcacgatgaagaggtgttcttagaagcctatccagaggctgttgttgaggcgaaagttgaagtcacagagcttatgggtgcggagacgtacctctatcttgatgtaaacggcgtttctctcactgcaagggtagacccaaggaccagagcgaaatctggcgatgtgattaagatagggtttgatgtgaataagcttcacatgtttgataaggaaacggaaatgacaatattgaatagaacagtgaaagagtctcccgttataattgcagataaaactgcaagttcataa

SEQ ID NO: 37109 - protein, 387 aa, Thermoanaerobacter tengcongensis MB4
MAEVVLKHVYKVYPGGVTAVKDFNLEIADKEFIVLVGPSGCGKTTTLRMIAGLEEITSGELYIDGKLVNDVPPKDRDIAMVFQNYALYPHMTVYDNMAFGLKLRKVPRAEIDRKVKEAARILGLEELLNRKPKALSGGQRQRVALGRAIVRNPKVFLMDEPLSNLDAKLRVQMRTELKKLHERLQTTFIYVTHDQTEAMTMGTRIVVMKDGVIQQVDEPQVIYDYPNNLFVAGFIGSPQMNFIDARLENRDGKVYATFKGYSILVPEGILKRLKDPSYIGKEIVLGIRPEDLHDEEVFLEAYPEAVVEAKVEVTELMGAETYLYLDVNGVSLTARVDPRTRAKSGDVIKIGFDVNKLHMFDKETEMTILNRTVKESPVIIADKTASS

SEQ ID NO: 37110 - DNA, 1095 bp, Xanthomonas campestris pv. campestris str. ATCC 33913
  CDS (1)..(1095)
atggcgaaagtgcagttggaaggtgtccgcaaggtctacgagaacgggcaggttgctgtgcaaggggccagcttcgaagtcgccgatggcgagctgatggtgctggtcgggccgtccggctgcggcaagtccaccttgctgcgcatgatcgccgggctggaggacatcagtgcgggcacgctgcgcatcggcgaccgcgtggtcaacgacgtggcgccgaaggatcgcgacatcgccatggtgttccagagctacgcgttgtacccgcacatgaccgtggccgaaaacctggcgttcgggctcaagctgcgcggccatcccaagcaggtgattgccgagcgggtgaacaatgcggccgagttactgggcttgacgcccatgctcgacaagctacccaaggcgatgtccggcggccagcgccagcgcgtggcgctggggcgcgcaatggtgcgcgagtcggcggtgttcctgctcgatgagccattgtcgaacctggatgcaaagctgcgccacagcgtgcgcaccgagatcgcgcagctgcatcgcaagctcggcaccaccatgatctacgtcacccacgaccaggtcgaagcgatgaccctgggccagcgcatcgtggtgctcaaggatggtgtgatccagcagatcgacagcccgatggcactgtacgaccgcccggccaacctgttcgtggccggcttcctcggcagcccggcaatgaacgtgctgcaggggcggctggacgcgcaggatggcctgcatctggtgatggccgatggctggcgcgtgccgctgggcgcggcgcagatcgatcagcgctggctgagccaggaggtcgtggtgggcgtgcgccccgagcacctgcagccgtcagccgacgcgcagttgggattcgatgcacgtatcgatgtcaccgagccggtgggcaatgagatcttcctcaatctcgaccgcggcgggcagccgctggtgatccgcgtcaccccgcaggcgttgccggcggtgggcgagtcgctgcggctggccttgcgcagcgaagcactgcatttcttcgacccggccagcggcgaacgcctgacgacctcggcctcctga

SEQ ID NO: 37111 - protein, 364 aa, Xanthomonas campestris pv. campestris str. ATCC 33913
MAKVQLEGVRKVYENGQVAVQGASFEVADGELMVLVGPSGCGKSTLLRMIAGLEDISAGTLRIGDRVVNDVAPKDRDIAMVFQSYALYPHMTVAENLAFGLKLRGHPKQVIAERVNNAAELLGLTPMLDKLPKAMSGGQRQRVALGRAMVRESAVFLLDEPLSNLDAKLRHSVRTEIAQLHRKLGTTMIYVTHDQVEAMTLGQRIVVLKDGVIQQIDSPMALYDRPANLFVAGFLGSPAMNVLQGRLDAQDGLHLVMADGWRVPLGAAQIDQRWLSQEVVVGVRPEHLQPSADAQLGFDARIDVTEPVGNEIFLNLDRGGQPLVIRVTPQALPAVGESLRLALRSEALHFFDPASGERLTTSAS

SEQ ID NO: 37112 - DNA, 1098 bp, Staphylococcus aureus subsp. aureus MW2
  CDS (1)..(1098)
atggcagaactaaagttagagcatattaaaaagacgtatgataacaacaatactgtagtgaaagattttaatctacatattactgacaaagaattcattgtatttgttggaccatcgggatgtggtaaatcaacaacattacgaatggttgctggactagagtctatcacatctggagatttttatattgatggggaacgcatgaacgatgttgaaccaaagaatagagatattgcgatggtatttcaaaactatgcattatatccacatatgactgtttttgaaaatatggcatttgggctaaagctacgtaaagtaaataaaaaagagattgaacaaaaagttaatgaagcagctgaaatattaggattaactgagtatcttggtcgtaaaccaaaagcgttatctggcggacagcgtcaacgtgttgctttgggcagagctattgttagggatgcgaaagtctttttaatggatgaaccattatcgaatcttgatgcgaagcttcgagtacaaatgcgcacagaaatattgaaattacataagcgacttaatactacgacaatttatgttacacatgatcaaactgaagcattgacgatggctagtcgaattgttgttttgaaagatggcgacattatgcaagtcggcacacctagagaaatatatgatgcccctaattgcatatttgtggcgcaatttatcggctcaccagcaatgaatatgttgaatgctacagttgaaatggacggattgaaggtaggaacacaccattttaaattacataataaaaaatttgaaaagttaaaagctgctggctacttagacaaggaaattattttaggtattcgagctgaagacattcatgaagaaccaatatttattcaaacttctccagagacacaatttgaatctgaagtagttgtatccgaactgttaggttcagaaattatggtacatagcacattccaaggaatggaattgatttctaaattagattcaagaactcaagtgatggcgaacgacaagattacactagcatttgatatgaataagtgtcacttttttgatgaaaaaacaggaaatcgtatcgtctaa

SEQ ID NO: 37113 - protein, 365 aa, Staphylococcus aureus subsp. aureus MW2
MAELKLEHIKKTYDNNNTVVKDFNLHITDKEFIVFVGPSGCGKSTTLRMVAGLESITSGDFYIDGERMNDVEPKNRDIAMVFQNYALYPHMTVFENMAFGLKLRKVNKKEIEQKVNEAAEILGLTEYLGRKPKALSGGQRQRVALGRAIVRDAKVFLMDEPLSNLDAKLRVQMRTEILKLHKRLNTTTIYVTHDQTEALTMASRIVVLKDGDIMQVGTPREIYDAPNCIFVAQFIGSPAMNMLNATVEMDGLKVGTHHFKLHNKKFEKLKAAGYLDKEIILGIRAEDIHEEPIFIQTSPETQFESEVVVSELLGSEIMVHSTFQGMELISKLDSRTQVMANDKITLAFDMNKCHFFDEKTGNRIV

SEQ ID NO: 37114 - DNA, 1095 bp, Yersinia pestis KIM
  CDS (1)..(1095)
atgggatcggttgtacttaaaaatgtgtgtaaatcttacggtgacatccatgtgatccgcgatgtatcgctggagatccctgatggtgagttctgcgtgctggttggccctagcggttgcggtaaatccaccttactgcgcatgattgccgggctggaggagatctccggcggcacggttggcatcaatgataaagatgtcaccgatgtggaaccgaagatgcgtgacatcgcgatggtgttccaaagttatgcgctttatccccagatgacggtacgtgaaaacatgggattcgccctgaaaatggctaagatgtccaaagctgatattaaccaaaaggtcgaatcaaccgccgagttgctcggtttacaagcgctgctggaacgcctgccaaaagatttgtccggtggtcagcgtcagcgggtcgccatgggacgggcaattgtgcgtaacccacaggtgtttctgtttgatgagccactgtcgaacctggatgccaaactacgcacacaggtgcgtggggagatccgcgaactgcatcagcggctaaaaaccacttcagtttatgtgacgcatgaccagatagaagcgatgaccatgggccagatgatcgtggtcctgcgtgaagggcgcattgaacaggttggttcaccattggacttgtatgaccgcccggctaacctgtttgttgctggctttattggatcgcctgaaatcaaccagttaaaaggcacggtggtacaagagggcgataaattcctgctgcaattggaggacaactcattactggccttgcccactggattgaacgtcactgaagggcaaaacgtggtttacgccatccggccagagcaggtgaatgtggtagatgaaacgcactgtgccagcgcattgaaagcgaccattacggcgatagaaaatacgggctcggatatgcagctcttttgcagcacgggcgggggccgctttacctctgtatttaaacaacgtttagcggtgagcgaaggggaaacggtctatctgcaacctaagcttgcgggtatccatatctttgatgctgctacggggttgcgggttgactgccaggcggcataa

SEQ ID NO: 37115 - protein, 364 aa, Yersinia pestis KIM
MGSVVLKNVCKSYGDIHVIRDVSLEIPDGEFCVLVGPSGCGKSTLLRMIAGLEEISGGTVGINDKDVTDVEPKMRDIAMVFQSYALYPQMTVRENMGFALKMAKMSKADINQKVESTAELLGLQALLERLPKDLSGGQRQRVAMGRAIVRNPQVFLFDEPLSNLDAKLRTQVRGEIRELHQRLKTTSVYVTHDQIEAMTMGQMIVVLREGRIEQVGSPLDLYDRPANLFVAGFIGSPEINQLKGTVVQEGDKFLLQLEDNSLLALPTGLNVTEGQNVVYAIRPEQVNVVDETHCASALKATITAIENTGSDMQLFCSTGGGRFTSVFKQRLAVSEGETVYLQPKLAGIHIFDAATGLRVDCQAA

SEQ ID NO: 37116 - DNA, 1074 bp, Thermosynechococcus elongatus BP-1
  CDS (1)..(1074)
gtgacggcaacactgcgcctcgagggagttacgcgacgatttgcgccgggagtagggattggtcccctatctttaaccgtacccgcaggggagttttgggtaattgttgggccgtctggttgtggtaaatccaccctattgcggctcattgccggcttggagcagcccactagcggcgacatttatattggcaaaacctgtgtcaacggcctcagtgggcgcgatcgcgatgtggccatggtctttcagaactatgccctctatccccacatgacggtggccgaaaaccttggttttggtctgaaaatgcgcggtgttgatccgacagcacggcagcagcgggtactgcaagtggctaagctactggggattgagtccctgttgcagcgcaaaccacgtcaactgtctggtggtcagcagcagcgggtggccctgggacgagccttggcgcgatcgccccaagtgtttttgctcgatgaacccctctccaacctcgatgcacaactgcgggagcaaacccgtgctgaactgaaacaattacatcgccaactcggcattaccaccctctacgtcacccacgatcaggtggaagccatgacgcttggcgatcgcattgtggtgctggatcgcggccaaattcagcaaattggcacccctgcggatctctatgagagaccggctaatacaatggtggcgcgatttttgggcaccccaccgatgaatttactgcccgctcgctggcatagcagtcgcctttggataggacagcagcccttgccctgtcctgataccccctcctggccgctcaacagtgaacagaccctcaccgtcggcattcgcccagaacatttgcacctcggcgagcagggtttaggagcgatcgccaccctcgttgaacccctaggccgcgaagccattgtccgctgtcgactcctggagagtccccaagacctgctgtggctggcccctagtcaccaaatccctcaaattggtgaccctctccagctgcaggtcagccatctttatctgtttgatgccacaaccggggcggccctcaattctaagccttcctga

SEQ ID NO: 37117 - protein, 357 aa, Thermosynechococcus elongatus BP-1
MTATLRLEGVTRRFAPGVGIGPLSLTVPAGEFWVIVGPSGCGKSTLLRLIAGLEQPTSGDIYIGKTCVNGLSGRDRDVAMVFQNYALYPHMTVAENLGFGLKMRGVDPTARQQRVLQVAKLLGIESLLQRKPRQLSGGQQQRVALGRALARSPQVFLLDEPLSNLDAQLREQTRAELKQLHRQLGITTLYVTHDQVEAMTLGDRIVVLDRGQIQQIGTPADLYERPANTMVARFLGTPPMNLLPARWHSSRLWIGQQPLPCPDTPSWPLNSEQTLTVGIRPEHLHLGEQGLGAIATLVEPLGREAIVRCRLLESPQDLLWLAPSHQIPQIGDPLQLQVSHLYLFDATTGAALNSKPS

SEQ ID NO: 37118 - DNA, 1098 bp, Oceanobacillus iheyensis HTE831
  CDS (1)..(1098)
atggctgaattacgcttagaacatattcaaaagaaatatgataaggaagtacttgcagtaaatgattttaacctacatattcaagataaggagtttatcgtctttgtaggtccttctggttgtggtaaatcaactactttaagaatgattgctggactagaagaaattaccgatggagaattttacatcgatgagaaaaaaatgaacgatgttgctccaaaagaccgtgatattgccatggtattccaaaactatgccctctacccacatatgaacgtattcgataacatggcattcggattgaagcttcgtaaatttaaaaaagaagaaattaaggaacgtgtggataatgcagctaaaattcttggtttagaagcataccttgaccgtaaaccaaaagcactttctggtggtcagcgtcaacgtgttgcattaggacgtgcaattgtccgtgatgcaaaggtattcctaatggatgaaccattatctaacttagatgctaagcttcgtgtgcaaatgcgagcagaaattcaaaaactacaccaacgcttacaaacaactacgatttatgtaacacatgatcaaacagaagcaatgacgatggctactcgcttagttgttatgaaagatggagttattcagcaagtgggtgctccaaaagaagtgtacgattatcctgaaaacatttttgttggcggatttattggttcaccatctatgaacttcttcaccgggaaattagatggaggaaactttattattggtgaatctaaattcactgtacctgaaggtaaactgaaagtacttcgtgaacaagggtacgaaggaaaagaattggtactaggtgtacgtccagaagatattcatgatgaattaatatttatcgagtcttctccaggtactaaagtaactgctaatattgaagttgcagaattaatgggtgcagaatctattctttattctagtgttgatgggcaagaatttgtagctcgtgttgattcacgtacagatgttaaaggcggagaaagtattgatctcggatttgatttaaacaaagcacatttctttgataaagatagtgaacaacgcattaaataa

SEQ ID NO: 37119 - protein, 365 aa, Oceanobacillus iheyensis HTE831
MAELRLEHIQKKYDKEVLAVNDFNLHIQDKEFIVFVGPSGCGKSTTLRMIAGLEEITDGEFYIDEKKMNDVAPKDRDIAMVFQNYALYPHMNVFDNMAFGLKLRKFKKEEIKERVDNAAKILGLEAYLDRKPKALSGGQRQRVALGRAIVRDAKVFLMDEPLSNLDAKLRVQMRAEIQKLHQRLQTTTIYVTHDQTEAMTMATRLVVMKDGVIQQVGAPKEVYDYPENIFVGGFIGSPSMNFFTGKLDGGNFIIGESKFTVPEGKLKVLREQGYEGKELVLGVRPEDIHDELIFIESSPGTKVTANIEVAELMGAESILYSSVDGQEFVARVDSRTDVKGGESIDLGFDLNKAHFFDKDSEQRIK

SEQ ID NO: 37120 - DNA, 1128 bp, Bifidobacterium longum NCC2705
  CDS (1)..(1128)
atggcagaagtcgttttcgaccacgtcactcgtatctacccgggcaacgataagccctccgtggatgatctgaatcttgatatcaaggatggcgagttcctcgtcctcgtcggcccttctggctgtggtaagtctacgacccttcgtatgctcgccggcctggaagaggtcaacaagggccgcatcctcatcggtggcaaggatgtcaccacgatgcagccgaaggaccgcgacatcgcaatggtgttccagaactacgctctgtacccgcacatgaccgttgccgacaacatgggcttcgccctgaagatcgccggcactccgaaggacgagattcgcaagcgcgtcgagaaggccgctgagattctcgacctgaccgagtacctcgaccgcaagccgaaggctctgtccggtggtcagcgtcagcgtgtggccatgggtcgtgcaatcgtccgtgagccgaaggtcttcctcatggatgagccgctgtccaacctcgacgccaagctccgtgtccagacccgtacccagatcgctgctctgcagcgccagctgggtgtcaccaccctgtacgtgacccacgatcagaccgaggccctgacgatgggcgatcgcatcgccgtcatcaagctcggtatcctgcagcaggtcggcgccccgaccgagctgtacgatcgcccggccaacgtcttcgtcgccggcttcatcggctccccgtcgatgaacctgaacacccacccggtggtcaacggcaaggcgaagatcggtgaggacaccgtggacctgccggctgaggccgtcaacaagctcaccgccgaagacaacggccagatcgtggtcggcttccgtcctgaggacgctggcctggccccggctgacgacccgaacgccttctccctgaaggttgtgaacgtcgaggatctgggctccgatggctacatctacggcaacatcatcaccgatggctccgccgctgaggcttcccaggtcatgtccgaccagaacaagctcaccacgattcgtgtgaatccgcgtgcgctgccgaaggttggcgcgaccgtcaagatcaagatcgacccggccaagatgcacctgttcgctccgtcgactgagctgcgtctgaactaa

SEQ ID NO: 37121 - protein, 375 aa, Bifidobacterium longum NCC2705
MAEVVFDHVTRIYPGNDKPSVDDLNLDIKDGEFLVLVGPSGCGKSTTLRMLAGLEEVNKGRILIGGKDVTTMQPKDRDIAMVFQNYALYPHMTVADNMGFALKIAGTPKDEIRKRVEKAAEILDLTEYLDRKPKALSGGQRQRVAMGRAIVREPKVFLMDEPLSNLDAKLRVQTRTQIAALQRQLGVTTLYVTHDQTEALTMGDRIAVIKLGILQQVGAPTELYDRPANVFVAGFIGSPSMNLNTHPVVNGKAKIGEDTVDLPAEAVNKLTAEDNGQIVVGFRPEDAGLAPADDPNAFSLKVVNVEDLGSDGYIYGNIITDGSAAEASQVMSDQNKLTTIRVNPRALPKVGATVKIKIDPAKMHLFAPSTELRLN

SEQ ID NO: 37122 - DNA, 1005 bp, Corynebacterium efficiens YS-314
  CDS (1)..(1005)
atggccactgtttcctttgacaaagtctccatccggtaccccggtgcggagcgccccaccgtccatgagctcgacctcgagatagccgacggtgaattcctcgtactcgtcggcccgtcggggtgtggaaaatcaaccacgctgcgagcgctcgccgggctcgaggaggtcgaatccggtgtgatccgcatcgacgggcaggatgtcaccagtcaggaacctgcggagcgtgacatcgcgatggtgttccagaactacgccctctacccccacatgtccgtggcgcggaatatgggtttcgccctcaaactggccaaactgccccaggcggagatcgacgccaaggtccgggaggccgccgagatcctcggcctcaccgactacctggaccgcaaaccgaaggacctctccggtggtcagcgccagcgtgtggccatgggccgggccctggtgcgcaacccgaaggtcttcctcatggatgagcccctgtccaacctcgatgccaaactgcgtgtgcagacgcgcgcggaagttgccgcactgcagcgtcgcctgggtaccaccaccgtctatgtcacccatgatcaggtggaggccatgacgatgggcgaccgcgtcgcggtgctcaaggacggactgctccagcaggtggccccaccccgggagctctacgacaccccggtcaatgcgttcgtcgccggtttcatcggctccccatcgatgaatctcttcccctacgacggtgtgaccctgggtgtgcgtccggaatccatgctggtggtcaccggcgaggccccggccggttacaccgtggtggacgggacggtggacatcgtcgaggagctcggttccgagtcctatgtttacgccacctgcgacggcaaccgcctggtggcgcgctgggaggacgccgtggtgcccgcgccgggtgaccgggtgcggttcgccttcgacccggcgggttcacaccgtttcgacccgaccagcggttaccggctcagctga

SEQ ID NO: 37123 - protein, 334 aa, Corynebacterium efficiens YS-314
MATVSFDKVSIRYPGAERPTVHELDLEIADGEFLVLVGPSGCGKSTTLRALAGLEEVESGVIRIDGQDVTSQEPAERDIAMVFQNYALYPHMSVARNMGFALKLAKLPQAEIDAKVREAAEILGLTDYLDRKPKDLSGGQRQRVAMGRALVRNPKVFLMDEPLSNLDAKLRVQTRAEVAALQRRLGTTTVYVTHDQVEAMTMGDRVAVLKDGLLQQVAPPRELYDTPVNAFVAGFIGSPSMNLFPYDGVTLGVRPESMLVVTGEAPAGYTVVDGTVDIVEELGSESYVYATCDGNRLVARWEDAVVPAPGDRVRFAFDPAGSHRFDPTSGYRLS

SEQ ID NO: 37124 - DNA, 1182 bp, Corynebacterium efficiens YS-314
  CDS (1)..(1182)
atggccaccatcaccctggaccacgtggacaagctgtaccccagcggctaccacgccatcaccgacgccaacctcgacatccgtgacggcgagttcgtcatcctcgtcgggccgtcgggatgcggaaagtccacgctgctcaacatgatcgccgggctcgaggacatcaccggcggcgagctgcgtttcgacgaccaggtcgtcaacgacctctccgcccgcgaccgcgacatcgccatggtcttccagtcctacgccctctacccgcacatgacggtccgcgagaacatcgagttcccgctcaagctctcccgcatgcccaaaagcgagatccaggacaaggtcgcggaggtctccgcctccctcggcctcgacgagtacctcgaccgcaagcccgcgcagctttcgggcggtcagcgccagcgcgtggccatgggccgcgccatcgtccgccgcccgaaggtcttcctcatggatgagccgctgtccaacctcgacgcgaagctccgcgtccagatgcgcgccgagatcgcccgcctccagcaggacctcggtgtcaccaccgtctacgtcacccacgaccagaccgaggccatgaccctcggcgaccgcgtcgtggtcatgcgcaagggcgtcatccagcaggccggctcccccgatgagctgtacgcctcccccaccaacctcttcgtggccagcttcatcggctcgccgtcgatgaacttcatgcccggccgcctgcgcggcacggtcgtctccaccggtttcggtgacatccacctcccggacgtgcttatcgacgccgcctcccgcgccacctccgaatctgtcattctcggcctgcgcccggaggccttcgacgacgcctacctcgtcgccccggagaagcgcgaccagggcctgaccatctccgcgaccctcagcctggtggaatccaccggcgccgaccgcttcgtgtacttctccccgacggagaaggagcagcccagcgaggccgcccgcgaggccgcccgggaggccggcgtcgatgagctcggcggcgaactcgtcgcccgcctgaccaacgccacccgcgtggtcaccggcgacaccatggacctgtggttcagccccgaatccctctacctcttcgacggtgagaccggcgacgcgctccgcagggatgaggtggcagtccagtga

SEQ ID NO: 37125 - protein, 393 aa, Corynebacterium efficiens YS-314
MATITLDHVDKLYPSGYHAITDANLDIRDGEFVILVGPSGCGKSTLLNMIAGLEDITGGELRFDDQVVNDLSARDRDIAMVFQSYALYPHMTVRENIEFPLKLSRMPKSEIQDKVAEVSASLGLDEYLDRKPAQLSGGQRQRVAMGRAIVRRPKVFLMDEPLSNLDAKLRVQMRAEIARLQQDLGVTTVYVTHDQTEAMTLGDRVVVMRKGVIQQAGSPDELYASPTNLFVASFIGSPSMNFMPGRLRGTVVSTGFGDIHLPDVLIDAASRATSESVILGLRPEAFDDAYLVAPEKRDQGLTISATLSLVESTGADRFVYFSPTEKEQPSEAAREAAREAGVDELGGELVARLTNATRVVTGDTMDLWFSPESLYLFDGETGDALRRDEVAVQ

SEQ ID NO: 37126 - DNA, 1209 bp, Corynebacterium efficiens YS-314
  CDS (1)..(1209)
atggcttccatcgtcttcgacggtgtctcacgcatctactccaagggcgcccgccccgcggtggataaactcaccctggaaatcgccgacggggaattcctcgtcctggtcggaccgtcgggatgtggtaaatccacctccctgcgcatgctcgccgggctcgagcccatcgacgagggccgtctgcttatcgacggccgcgacgccaccgggttgcgcccccaggaccgcgatgtggccatggtgttccagagctacgccctgtacccgaacatgaccgtccggcagaacatgggctttgccctgaagaaccagaaataccccaaggacgagatcaaccggcgcgtcaccgaggcctcacgcatcctccagctcgacccctacctggaccgcaagccggcggccctgtcgggtggtcagcgccagcgtgtggccatggggcgcgccatcgtgcgtgaacccgccgtgttctgcatggatgaaccgctgtccaacctggatgcgaaactgcgggtgtccacccgtgcggagatctccgccctccagcgccgcatgggggtgaccaccgtctatgtcacccacgaccagatcgaggccatgaccatgggcgaccgcgtcgcggtgctgctccacggggtgctgcagcaggtggacaccccgcagaacctctacgaccatccggtcaatgcgtttgtggccagcttcatcggctcgccgtcgatgaacctcatcgagggcacgatccggggtgactccgtcaagctgggtaccggcatcaccatccgggtgcccggtgaggtcgccgcccacatccgcggcaaccgcgccgattatgagggccggtcggtcatcgtgggtgcccgcccggaggcgatgtatctgaccagcccccaggaatcgggggcgatcgcctgcgaagtcagccacattgatgaactgggtgctgactccatggtctatgtccgggccgccggggtgaaaaaccccaacaccgatgtcctgggcgagggcgtcccggaggatatgcgcatccaggtctccccggccggtcagcaggacaccgctgaactggggatccgggtggaacgccaccacgggctgcgcccgggagacgtcgtccatgtggtggcggccccggacagtgtccacctcttcgacggcacccatggccgccgcgtcggggagggcaccagcaccctggttggctaa

SEQ ID NO: 37127 - protein, 402 aa, Corynebacterium efficiens YS-314
MASIVFDGVSRIYSKGARPAVDKLTLEIADGEFLVLVGPSGCGKSTSLRMLAGLEPIDEGRLLIDGRDATGLRPQDRDVAMVFQSYALYPNMTVRQNMGFALKNQKYPKDEINRRVTEASRILQLDPYLDRKPAALSGGQRQRVAMGRAIVREPAVFCMDEPLSNLDAKLRVSTRAEISALQRRMGVTTVYVTHDQIEAMTMGDRVAVLLHGVLQQVDTPQNLYDHPVNAFVASFIGSPSMNLIEGTIRGDSVKLGTGITIRVPGEVAAHIRGNRADYEGRSVIVGARPEAMYLTSPQESGAIACEVSHIDELGADSMVYVRAAGVKNPNTDVLGEGVPEDMRIQVSPAGQQDTAELGIRVERHHGLRPGDVVHVVAAPDSVHLFDGTHGRRVGEGTSTLVG

SEQ ID NO: 37128 - DNA, 1155 bp, Pseudomonas putida KT2440
  CDS (1)..(1155)
atggcaacgctcgaacttcgcaatgtgaacaagacctacggcagcggcctgccggataccctcaaggacatccagctgtcgatcaaggacggcgagttcctgatcctggtgggcccgtcgggctgcggcaagtcgaccctgatgaactgtatcgccggcctggagcagatcaccggcggcgccatcctcatcgacgaacaggacgtcagtggcatgagcccgaaggaccgcgatatcgccatggtgttccagtcctatgcgctgtaccccaccatgagcgtgcgtgaaaacatcgagttcggcctgaagattcgcaagctgccccaggccgccatcgacgaggaagtggcgcgggtggccaagttgctgcagatcgaacacctgctggcgcgcaagccggcgcagctgtccggtggccaacagcagcgcgtggccatgggccgggcattggcgcggcgacccaagatctacctgttcgatgaacccctgtccaacctcgatgccaagctgcgggtcgaaatgcgcaccgaaatgaagttgatgcaccagcgcctgaagaccaccacggtgtacgtcacccatgaccagatcgaggccatgaccctgggcgacaaggtggcggtgatgaaggacggcatcatccagcagttcggcaccccgcagcagatctacaacgacccggccaaccagttcgtggccagcttcatcggttcgccgccaatgaacttcattccggtgcgtctggccaggcaggatggccgcttgctggcgctgctcgacagcggccaggcgcgctgcgaactgcccttgggggaggctgctgacgcgcttgaggggcgcgagatcatcctcggcatccgccctgagcagatcgccctgggcgctgctgacggcaatggtttgccggctatccgcgccgaggtgcaggtgacagagcccaccgggccggacctgctggtgttcgtcacgctcaaccagaccaaggtgtgctgccgcctggcgccagatgtggcgtgccgggtgggtgacaccctcaacctgcaattcgacccggcccgggtgctgctgttcgacgccgccaatggcgagcgcctgcacctggccagtactggcgcaaccgcaaaggacaacgtggctcacttcaaaggccgttga

SEQ ID NO: 37129 - protein, 384 aa, Pseudomonas putida KT2440
MATLELRNVNKTYGSGLPDTLKDIQLSIKDGEFLILVGPSGCGKSTLMNCIAGLEQITGGAILIDEQDVSGMSPKDRDIAMVFQSYALYPTMSVRENIEFGLKIRKLPQAAIDEEVARVAKLLQIEHLLARKPAQLSGGQQQRVAMGRALARRPKIYLFDEPLSNLDAKLRVEMRTEMKLMHQRLKTTTVYVTHDQIEAMTLGDKVAVMKDGIIQQFGTPQQIYNDPANQFVASFIGSPPMNFIPVRLARQDGRLLALLDSGQARCELPLGEAADALEGREIILGIRPEQIALGAADGNGLPAIRAEVQVTEPTGPDLLVFVTLNQTKVCCRLAPDVACRVGDTLNLQFDPARVLLFDAANGERLHLASTGATAKDNVAHFKGR

SEQ ID NO: 37130 - DNA, 1086 bp, Bradyrhizobium japonicum USDA 110
  CDS (1)..(1086)
atggctaacgtcaccctgcgcaatgtccgcaagacctacaccggcggcttcgaggccatcaaaggcgtcaacgtcgatgtcgccgacgggcagttctgcgtgctggtcggcccctccggctgcggcaagtccacgctgctgcgcatggttgcggggctcgagaccgtcaccggcggcgagatcgacatcggcggccgcgtcgtcaaccagatcgagcccgccgatcgcgacatcgcgatggtgttccagaactacgcgctctatccgcatatgagcgtctacaacaacatggcttacggcctgcgcaaccgcggcatggcggaagccgagatcaagacccgcgtcgaggaagccgcgcgcgtgctcgagctcacatcgatgctggagcgcaagccgcgccagctctccggcggccagcgccagcgcgtcgcgatgggtcgcgccatcgtgcgccagccgaaggtgtttttgttcgacgagccgctgtcgaacctcgatgccaagctgcgcatcgcgatgcgcgtcgagatccgcaaattgcagcgccggctcaacacgacctcgatctacgtcacccacgaccagctcgaggcgatgacgctcgccgacgttctcgtcgtgatgaacggcggacaggtcgagcaggtcggcaatcccttggcgatctacgagaagccggccacgaccttcgtcgcctcgttcatcggggcaccgccgatgaatctgatgtcgacgcgctccgacgagatcaaatcgcagctcggtggcagtgcggctgaggccggcgtcctcggcatccgtccggaagatttcgtcatcaccgaccagaccccggccggcggcgtcgccctcccgctcacggtggaagcgatcgagcgcgtcggcgccgagaccttcgtctacggttcccgcgagcaggaagaccagcgcgtcgccgccacgcccggcgagctgccgcccggcgaggtcatcgtccgcatccccggaaccgaagcccccaccatcggcgcgagaatccgcgtcgccgcgatacggccgaagctgcaccttttcagcggcgacgggcggacgcggctggaggcctga

SEQ ID NO: 37131 - protein, 361 aa, Bradyrhizobium japonicum USDA 110
MANVTLRNVRKTYTGGFEAIKGVNVDVADGQFCVLVGPSGCGKSTLLRMVAGLETVTGGEIDIGGRVVNQIEPADRDIAMVFQNYALYPHMSVYNNMAYGLRNRGMAEAEIKTRVEEAARVLELTSMLERKPRQLSGGQRQRVAMGRAIVRQPKVFLFDEPLSNLDAKLRIAMRVEIRKLQRRLNTTSIYVTHDQLEAMTLADVLVVMNGGQVEQVGNPLAIYEKPATTFVASFIGAPPMNLMSTRSDEIKSQLGGSAAEAGVLGIRPEDFVITDQTPAGGVALPLTVEAIERVGAETFVYGSREQEDQRVAATPGELPPGEVIVRIPGTEAPTIGARIRVAAIRPKLHLFSGDGRTRLEA

SEQ ID NO: 37132 - DNA, 1101 bp, Bradyrhizobium japonicum USDA 110
  CDS (1)..(1101)
atggctgacgttgcattgcgtaaggtcgtcaagcgttacgatgatgtcgaagccgtgcgcggcatcgacctcgatatcgccgaccatgagttcatcgtgctggtgggcccctcgggctgcggcaagtcgacgacgctgcgcatgatcgcaggtctcgaggacatcagcgacggcgacatcatgatcggcggcgacgtcgtcaacgacgtgccgccgaaggaccgcgacatcgcgatggtgttccagaactatgcgctctacccgcacatgacggtcgccgagaacatgtcgttcgggctgcgcctgaagcactatcccaaggccgagatcaaggcgcgggtgacggaagccgcacggctcctcgacatcaccgacctgatcgaccgcaagccgaagcagctctccggcggccagcgccagcgcgtcgcgatggggcgcgccatcgtgcgcaatccaaaggtcttcctgttcgacgagccgctgtccaacctcgatgccaagctgcgcgtgcagatgcggatcgagatcaagaaggtgcaccagaaggtgcgcaccaccacggtctacgtcacccacgaccaggtcgaggcgatgacgctggccgatcgcgtggtggtgatgaacaagggacgcatcgagcagatcggcacgccgaacgagctctaccacaagccggcgacacgcttcgtcgcgggcttcatcggctcgccggcgatgaacttcatcccgtgccggctggaggacgtcggcggcacgctccagatccgcctcaccgatcgcatcgcctttgcgctgccgccggcccgcgccgcgcgctacaacgcgctgccgcgcaccgacaagctgctgctcggtctccggcccgagcatctcaccgaggcgcatgcgcatctggggccgggcgttgagagcttcgacaccgtgctcgacgtcaccgagccgatgggtatggagaccctggtctatttcggcctcgagggcacgccggtctgcggccgcgtcgatcccaatgccggcgccaaggacggggcacccatgcgtttggcgatggacctcaacaatatgcacctgctaaacgaagacaccggcgtcgtgttgtga

SEQ ID NO: 37133 - protein, 366 aa, Bradyrhizobium japonicum USDA 110
MADVALRKVVKRYDDVEAVRGIDLDIADHEFIVLVGPSGCGKSTTLRMIAGLEDISDGDIMIGGDVVNDVPPKDRDIAMVFQNYALYPHMTVAENMSFGLRLKHYPKAEIKARVTEAARLLDITDLIDRKPKQLSGGQRQRVAMGRAIVRNPKVFLFDEPLSNLDAKLRVQMRIEIKKVHQKVRTTTVYVTHDQVEAMTLADRVVVMNKGRIEQIGTPNELYHKPATRFVAGFIGSPAMNFIPCRLEDVGGTLQIRLTDRIAFALPPARAARYNALPRTDKLLLGLRPEHLTEAHAHLGPGVESFDTVLDVTEPMGMETLVYFGLEGTPVCGRVDPNAGAKDGAPMRLAMDLNNMHLLNEDTGVVL

SEQ ID NO: 37134 - DNA, 1116 bp, Bradyrhizobium japonicum USDA 110
  CDS (1)..(1116)
atggcagcgctgagcatccgtgccttgtccaagcgctacgccaatctggaggtgctgaagggcatcgatctcgatatcgagagcggcgagttcaccgtgctggtggggccgtccggctgcggcaagtccacgctgctcaacatcgtggccggtctcgatcgcccgagcgcggggacgatcgagatcggcggacgcgtcgtcaacgacgtcccgcccaaagaccgcgacatcgccatggtgttccagtcctacgcgctctatccgtccatgacggtgcgccagaacatcaccttcggcatggaatgccggcatgtgccgaaggccgagcaggagaaggcactggcgaatgtggctcgcctgctccagatcgaacccctgctcggccgcaagccgtcgcagctctccggcggccagcgtcagcgcgtggcgatgggccgggcgctggtgcgcgatcccctgctcttcctgttcgacgagccgctctccaatctcgacgcaaaactgcgcgtggagatgcggatggagatcaagcgcctgcaccagcgcatcggcgccaccatcgtctatgtcacccacgaccagatcgaggcaatgacgatggcgacccggatcgcggtgatgcatcggggcgtggtgcagcagtttgccgaccccgataccgtgtatcgttatcccgccaatctgttcgtcgcccgcttcatgggctcgccgcccatgaacacgatgcccgcacggctcgatgccgacgccgacgggccggtggtcgtgatcggcgcgggacgcccggacgaggtccgtctccgcctccagggttacgatgccgcggcgtcctatgtcggccgcgaggtggtgctcgggatcaggccggaatgcatcgccgagggggaccgcgtgttctccggtagtaccggcacaccggtcgtcgtcaccgcgccggtcgagatggtcgagcccaccggggccgagacgatcgtcctgctgcggcttggcggcgagcccgcgcaggcgcgcatctcgcccgacatccgccccacgccgggcgccgtggcgccgttcgcgctcgacacccgccgcatctgcctgttcgaccccgagacggagcgactgatcgcatga

SEQ ID NO: 37135 - protein, 371 aa, Bradyrhizobium japonicum USDA 110
MAALSIRALSKRYANLEVLKGIDLDIESGEFTVLVGPSGCGKSTLLNIVAGLDRPSAGTIEIGGRVVNDVPPKDRDIAMVFQSYALYPSMTVRQNITFGMECRHVPKAEQEKALANVARLLQIEPLLGRKPSQLSGGQRQRVAMGRALVRDPLLFLFDEPLSNLDAKLRVEMRMEIKRLHQRIGATIVYVTHDQIEAMTMATRIAVMHRGVVQQFADPDTVYRYPANLFVARFMGSPPMNTMPARLDADADGPVVVIGAGRPDEVRLRLQGYDAAASYVGREVVLGIRPECIAEGDRVFSGSTGTPVVVTAPVEMVEPTGAETIVLLRLGGEPAQARISPDIRPTPGAVAPFALDTRRICLFDPETERLIA

SEQ ID NO: 37136 - DNA, 1137 bp, Lactobacillus plantarum WCFS1
  CDS (1)..(1137)
atggttgaaattaatttagatcatatttataaacgttatccaaatgcagaaactaactcagtgaatgacttcgatcttcatattaaggacaaggaatttattgtctttgttggaccttccggctgtggtaagtcgacaacattacggatgattgccggattggaagatattacgcaaggaacgttagaaattggcggtaaggtgatgaatgatatctcgccgaaagaccgtgacattgcgatggttttccaaaactatgcgttatacccacacatgaccgttgcgggtaatatggcgtttgggttgaagctacgtaagtataaaaaagatgatattgccaagcgagttgaccaagctgctgaaattttaggactaactgaatttttggaccgtaagccagctgatttatctggtgggcaacgacaacgggttgccctaggccgggcgattgtacgggatgcaccgatctttttaatggatgagccattatctaacttggatgccaagttacgggtatcgatgcgggccgaaattgccaagttacatcagcggcttagcacgacgacaatctatgtgacccatgatcaaactgaagcaatgaccatggctgatcgggtggttgtcatgtcagttggtgagattcaacagattggaacaccttcagaaatttatgatcgtccacggaatatgtttgttgctggctttattggctcacctgctatgaacttcttcaatgttcattatcaagatcaggttattgatgaccataagggcgtacaactaacaattcctgaagggatggctaaagttttagataaacgtggttataatggcaaggatatcgtcttcggaattcgaccggaagatattcatactgaagagatcttcattgatacgtggccaaattcgacagttgaagccacaattaacgtgtctgaattattaggtgctactagccagctctatagtcaagttggtaatactgagtttgtggctaatgttgattctcgtgattttcatcaacccggtgcaaaagtgcagatgggctttgatattaacaaagcgcacttcttcgataaagaaacacagaactccattatgttggatgaagaggaagaaacaggtaagtcgcactaa

SEQ ID NO: 37137 - protein, 378 aa, Lactobacillus plantarum WCFS1
MVEINLDHIYKRYPNAETNSVNDFDLHIKDKEFIVFVGPSGCGKSTTLRMIAGLEDITQGTLEIGGKVMNDISPKDRDIAMVFQNYALYPHMTVAGNMAFGLKLRKYKKDDIAKRVDQAAEILGLTEFLDRKPADLSGGQRQRVALGRAIVRDAPIFLMDEPLSNLDAKLRVSMRAEIAKLHQRLSTTTIYVTHDQTEAMTMADRVVVMSVGEIQQIGTPSEIYDRPRNMFVAGFIGSPAMNFFNVHYQDQVIDDHKGVQLTIPEGMAKVLDKRGYNGKDIVFGIRPEDIHTEEIFIDTWPNSTVEATINVSELLGATSQLYSQVGNTEFVANVDSRDFHQPGAKVQMGFDINKAHFFDKETQNSIMLDEEEETGKSH

SEQ ID NO: 37138 - DNA, 1146 bp, Pseudomonas syringae pv. tomato str. DC3000
  CDS (1)..(1146)
atgatgaaattgaagctagccaacatcgacaagcaattgggcggcatgcgcattctgcgcgacgtcagcctggagatcgctgcaggtgagttcgttgtgttcgtcggcccgtctggctgcggaaagtcgacgctgctgcgcttgatcgccggactggactcgatctgtagtggcgacctgctgatcgacggacgacgggtcaatgacctggaaccgcgcgagcgtggtgtcggtatggtctttcagtcctacgcgctgtacccgcacatgagcgtctacgacaacatcagttttggtctcaagctggccaagacagaaaaaagcagcctgcgcgagcgcgtgctgaaaaccgcacagattctgcaactggacaaactcctgcagcgcaaacccaaggaactgtccggtgggcagcgtcagcgggtagcaatgggcagagccatggcgcgggaaccggacattttgctgttcgacgaaccgctctccaacctcgatgcgtcgttgcgggtgcagatgcgcaacgaaatcgcgcggctgcataagcggctgggctcgaccatgatctatgtcacgcacgatcaggtagaggcaatgaccctggcggacaagattgtcgtgctcaacggcggtcaggtcgaacaggttggctcaccacgcgaactctatgagcgtcccgccagccgcttcgtggccggttttctgggctcaccgagaatgaattttctgccagtacgcttgcaggcaccaggccgcaacagcctgatcgatgtcccggcactgggcatgacgtccctgccctttgacagctcgaacctcgccaacggtgcgcaattgaccctgggtgttcgtccggaacacatcgccctgacggctgcgaacaacggtgttggcgtcatggtgaccggtgtcgaatacctgggcagcgaggtttacgtgcacctggctaccggcgagagcgaacccttgatttgtcgctgcgatgccaaggctggttggcaggcaggcgaccaggtcgcgctgcaactggatgacagcaacctgcacgtgttcgacgccgatggcctggccctgaagcgtcatgcagacgccggtcagcagctgacacccggcaccacgccgcacctcgtacaagcaggcaccctatga

SEQ ID NO: 37139 - protein, 381 aa, Pseudomonas syringae pv. tomato str. DC3000
MMKLKLANIDKQLGGMRILRDVSLEIAAGEFVVFVGPSGCGKSTLLRLIAGLDSICSGDLLIDGRRVNDLEPRERGVGMVFQSYALYPHMSVYDNISFGLKLAKTEKSSLRERVLKTAQILQLDKLLQRKPKELSGGQRQRVAMGRAMAREPDILLFDEPLSNLDASLRVQMRNEIARLHKRLGSTMIYVTHDQVEAMTLADKIVVLNGGQVEQVGSPRELYERPASRFVAGFLGSPRMNFLPVRLQAPGRNSLIDVPALGMTSLPFDSSNLANGAQLTLGVRPEHIALTAANNGVGVMVTGVEYLGSEVYVHLATGESEPLICRCDAKAGWQAGDQVALQLDDSNLHVFDADGLALKRHADAGQQLTPGTTPHLVQAGTL

SEQ ID NO: 37140 - DNA, 1137 bp, Streptomyces avermitilis MA-4680
  CDS (1)..(1137)
atggccacagtctcgttcgacaaggcgacccgcatctacccgggttccgagaagcccgccgtcgatgccctggagatcgacatcgaggacggcgagttcctcgtcctcgtcggtccctccggttgcggcaagtccacctcgctccgcatgctcgcggggctcgaggacgtgaacgccggcgccatccgcatcggtgaccgcgacgtcacgcacctgccgccgaaggaccgggacatcgccatggtgttccagaactacgcgctctacccgcacatgaccgtcgccgacaacatgggcttcgcgctcaagatcgccggcgtcaacaaggcggagatccgccagaaggtcgaggacgcggcgaagatcctcgacctcaccgagtacctcggccgcaagccgaaggccctctccggcggtcagcgccagcgtgtcgccatgggccgcgccatcgtgcgtgagccccaggtgttcctcatggacgagccgctgtccaacctcgacgccaagctccgcgtgtcgacgcgtacgcagatcgcctcgctccagcgccgcctcggcatcaccaccgtgtacgtcacccacgaccaggtcgaggccatgaccatgggcgaccgcgtggccgtgctcaaggacggtctgctccagcaggtcgactcgccgcgcaacatgtacgaccgcccggcgaacctcttcgtcgccggcttcatcggctcccccgcgatgaacctcgtcgaggtcccgatcaccgacggcggcgtgaagttcggcaacagcgtcgtgccggtcaaccgcgaggcgctgaaggccgcctccgacaagggtgaccgcacggtcacggtcggtgtccgccccgagcacttcgacatcgtcgagcagggcggcgccgccgccaaggccctgaccaaggagagcgaggacgccccggcgggcctcgccgtgtcggtgaacgtcgtcgaggagctcggcgccgacggctacgtctacggcagcgccaaggtcgacgacaagctcacggacctggtcgtccgcgtgagcggccgcgcggtcccggacaagggcgccacgctgcacgtcgtgccgcggccgggcgagacccacgtgttctcgacctccacgggcgagcgcctctccgactga

SEQ ID NO: 37141 - protein, 378 aa, Streptomyces avermitilis MA-4680
MATVSFDKATRIYPGSEKPAVDALEIDIEDGEFLVLVGPSGCGKSTSLRMLAGLEDVNAGAIRIGDRDVTHLPPKDRDIAMVFQNYALYPHMTVADNMGFALKIAGVNKAEIRQKVEDAAKILDLTEYLGRKPKALSGGQRQRVAMGRAIVREPQVFLMDEPLSNLDAKLRVSTRTQIASLQRRLGITTVYVTHDQVEAMTMGDRVAVLKDGLLQQVDSPRNMYDRPANLFVAGFIGSPAMNLVEVPITDGGVKFGNSVVPVNREALKAASDKGDRTVTVGVRPEHFDIVEQGGAAAKALTKESEDAPAGLAVSVNVVEELGADGYVYGSAKVDDKLTDLVVRVSGRAVPDKGATLHVVPRPGETHVFSTSTGERLSD

SEQ ID NO: 37142 - DNA, 1098 bp, Bacillus cereus ATCC 14579
  CDS (1)..(1098)
gtgattgaattgaaaaatgtttcaaaggtatataaaaatgcagaagagacagcggttaaaggcgtatcggttcatattaagaagggtgaattttttgttttagttggaccttcgggatgcgggaaaagcacattattacgaatgatcgctggcttagaagagatttcttcaggagatttaattattaatgaacgtgttgcaaatgatctagagccgaaagaccgtaatctatcaatggtatttcaaaattatgcattatatccacacttatctgtagaagaaaatattttatttggacttaaggtaagaaaagtacaaaaagaagagcgacaaaagcgattaatggaagctattgaaatgataggactgaaagagtatgtgaaaatgaaaccaggccaattatcaggcggacaaagacagcgtgttgcacttgccagggcaattgtgagtcaagcgccaatctgtttaatggatgaaccactttcgaatttggatgcgaaattacgtgcgcaaatgagaattgaaattagagaaattcagcagcgattaggaattacgatgatttacgttacccacgatcaaatagaagcgatgactatgggtgatcgtatcatggttttaaataaaggaagtatacagcaagttggaacaccacttaacatatataacgaaccagcaaacgaatttgttgcaagctttataggttctccttctatgaatataaatgatggggaagtaaataaagaaaaaggtgtattacatataggacaattgcaaattccattatctattagacagttaaagcaattaccagaaggaacaattcgcataggcatgcgccctgagcatattgcactgtctgaggagggacaagaagtgacgttgcaatctgtagaagtattagggaatgaatctatattgaactttgcggtaaatggaacaacttggagtgcgaaagttatcggacagttactcctgaacaaaggtgacaaagtaaaattattattctcgcaagaaaagttatgcttctttaacgaaaacacgaatgaacgcttaaaagtggtagctgaagaagagttgaaagtggtggcgaaataa

SEQ ID NO: 37143 - protein, 365 aa, Bacillus cereus ATCC 14579
MIELKNVSKVYKNAEETAVKGVSVHIKKGEFFVLVGPSGCGKSTLLRMIAGLEEISSGDLIINERVANDLEPKDRNLSMVFQNYALYPHLSVEENILFGLKVRKVQKEERQKRLMEAIEMIGLKEYVKMKPGQLSGGQRQRVALARAIVSQAPICLMDEPLSNLDAKLRAQMRIEIREIQQRLGITMIYVTHDQIEAMTMGDRIMVLNKGSIQQVGTPLNIYNEPANEFVASFIGSPSMNINDGEVNKEKGVLHIGQLQIPLSIRQLKQLPEGTIRIGMRPEHIALSEEGQEVTLQSVEVLGNESILNFAVNGTTWSAKVIGQLLLNKGDKVKLLFSQEKLCFFNENTNERLKVVAEEELKVVAK

SEQ ID NO: 37144 - DNA, 1089 bp, Bordetella pertussis Tohama I
  CDS (1)..(1089)
atggctactctcagctttcgcaacgtcaagaaaacctatgccggcaacgtgccggtgatccacggcatcgacatggacgtcgccgatggcgagttcatcgtcatcgtcggcccgtcgggctgcggcaaatccaccctgatgcgcatggtggccggcctggaaaccgtcaccgagggcgagatcctcatcgacgacaaggtcgtcaacacgctggagccggccgagcgcgatatcgccatggtgttccagaactatgcgctctacccgcacatgagcgtgttcgacaacatggcctacggcctgaagatccgcaggctgcccaaggacgagatccgcaagcgcgtcgaggccgccgcgcagatcctcgagctgggcaagctgctggaccggcgcccgcgcgccctgtccggcggccagcgccagcgcgtggccatgggccgcgccatcgtgcgcgaacccaaggtattcctgttcgacgagccgctgtccaacctggacgccaagctgcgcgtggcgatgcggctggaaatcctcaagctgcatcgccgcctgaacaccaccagcctgtacgtcacgcacgaccaggtcgaggccatgacgctggcgcaccgcatggtggtgatgtaccagggcgtgcccgagcagatcggcacaccgatggaggtgttcgagaagccggcctcgaccttcgtggcgggcttcatcggctcgccgcccatgaatctgctggaagtcgccgtgggcggcgacggcatcgtgcataccagcgatggcatcgcgctcgacatttcgccgctggccgtgccgcagcaggtgcgcggccgcaaggtcgtcatgggcctgcgtcccgagcacatgctgctcaacgcgcagggcctggccgccgaaatcgaaatggtcgagacactgggctccgagcaactcgtccatggccgctgcggcaagcacatggtggtggtgcgctgcagcacccgccagttttccgagacgcccgcccgggtcggcgacacgctgaccatcggccccgacggccgccaccccctgcactggttcgaggccgataccggccgccgcgtcgaagggctctga

SEQ ID NO: 37145 - protein, 362 aa, Bordetella pertussis Tohama I
MATLSFRNVKKTYAGNVPVIHGIDMDVADGEFIVIVGPSGCGKSTLMRMVAGLETVTEGEILIDDKVVNTLEPAERDIAMVFQNYALYPHMSVFDNMAYGLKIRRLPKDEIRKRVEAAAQILELGKLLDRRPRALSGGQRQRVAMGRAIVREPKVFLFDEPLSNLDAKLRVAMRLEILKLHRRLNTTSLYVTHDQVEAMTLAHRMVVMYQGVPEQIGTPMEVFEKPASTFVAGFIGSPPMNLLEVAVGGDGIVHTSDGIALDISPLAVPQQVRGRKVVMGLRPEHMLLNAQGLAAEIEMVETLGSEQLVHGRCGKHMVVVRCSTRQFSETPARVGDTLTIGPDGRHPLHWFEADTGRRVEGL

SEQ ID NO: 37146 - DNA, 1248 bp, Prochlorococcus marinus str. MIT 9313
  CDS (1)..(1248)
gtggccggcgttcgcttcaaggctctcaacaagagctacccaggcaggcggaatgaaccctctgttgaggtcattcgtcaactgaatctacaaatcaacgatggtgaattccttgtgcttgttggcccctccggctgtggcaaaagcacactactaaggctgctcgcgggcctcgaagcccctacaagcggcgagatctacgtaggcaaacaacctgtctcgcagctacgacctgcccaaagggacgtggcgatggtgttccaaaactacgcgctttatccccacttaagtgtgcgagacaacctggtcttcggcctacggcgcagccagcagcgatctttaggccaactcctgcaagaccaactccatcgcaagacccgcaactttcctccacttctgcaggtttcatctatccgagagcaacgaatcgagcgccggacaagggaagttgctgaagccctggagcttcaaccactgctcaatcgccaacccaaagaactctctggcggtcaaaaacaacgtgttgctctcggccgggcaatggcgagagagccgtctgtattcctgatggacgaaccactcagcaacttggacgcaaaactgcgcaacagcacgcgcactcaaatcgttgacctccagcgtcaacttggcaccaccaccatctacgtcacccacgaccaagtcgaggcgatgacgatgggtcatcggattgcggtactgaatcaagggcaactacagcaattaggcacgccaatcgagctctatcaatggccatcaaacctttttgttgcgcagttcatcggcagtccgcccatgaacgtactgccagtatttgctggccccgccaatacgctcctactaggtgatcgtcgcctagcggttgaaggaccaatggccgaagcgctgctgcatctggaagaggggcaaccgctcagcgctggtcttcgaccggagcatttgcgcgtagctccttccaccaatcgcaatctcgcggcaatcgtgagtcatctagaagtcttaggaaatgaacaactgatcacctgcaaacttgttgacgggaaccatctggttcaagtgagggcctcgcccgaactctcgctcagtgctggaagcaacctgcatctagagccagatcctcgaggctggcgactgtttggtgccgacggggaagccatcgcaatgacagttcaagacaacactgaacaagacccaaacgaccgcaaactccacttgcccattctgggctaa

SEQ ID NO: 37147 - protein, 415 aa, Prochlorococcus marinus str. MIT 9313
MAGVRFKALNKSYPGRRNEPSVEVIRQLNLQINDGEFLVLVGPSGCGKSTLLRLLAGLEAPTSGEIYVGKQPVSQLRPAQRDVAMVFQNYALYPHLSVRDNLVFGLRRSQQRSLGQLLQDQLHRKTRNFPPLLQVSSIREQRIERRTREVAEALELQPLLNRQPKELSGGQKQRVALGRAMAREPSVFLMDEPLSNLDAKLRNSTRTQIVDLQRQLGTTTIYVTHDQVEAMTMGHRIAVLNQGQLQQLGTPIELYQWPSNLFVAQFIGSPPMNVLPVFAGPANTLLLGDRRLAVEGPMAEALLHLEEGQPLSAGLRPEHLRVAPSTNRNLAAIVSHLEVLGNEQLITCKLVDGNHLVQVRASPELSLSAGSNLHLEPDPRGWRLFGADGEAIAMTVQDNTEQDPNDRKLHLPILG

SEQ ID NO: 37148 - DNA, 1119 bp, Chromobacterium violaceum ATCC 12472
  CDS (1)..(1119)
atgtccagactctcgctgaagaacatccgcaaggtgtacgacgacggcaacgccgtgatccacgacgtcagcctggacatccgcgacggcgaattcatggtcttcgtcggcccgtccggctgcggcaaatcgacgatgatgcggatgatcgccgggctggaggacatcagcgccggcgaattgtggatagacgacaggctggccaacgacatcgagccggccaagcgcggcctggcgatggtgttccagagctacgcgctgtacccgcacatgacggtgcgcgacaacatggccttcagcctgaagctggccggcaagagcaaggcggagatcgacgccgcggtgcggcgcgcggcgcagacgctgcagatcgaacacctgctggagcgcaagcccaaggccctgtccggcggccagcgccagcgcgtcgccatcggccgcgccatcgtcaggaagcccggcgtgttcttgttcgacgagcccctgtccaacctggacgccgcgctcagggtgcagatgcggatcgagctggcgcggctgcaccaggagctgggcagcaccatgatctacgtcacccacgaccaggtggaggcgatgaccatgggccaccgcatcgcggtgttcaacgccggccgcatcgagcaggtgggcacgccgctggatctgtacaaccgcccggccaaccgcttcgtcgccggcttcctcggttcgccgaagatgaacttcatcccggcgcaggcgctggaccagcacgccaacggcgtggagctggagctgcccggacactgccggctgacgctgccgctggccggcgccggcgatggcccgctgacgctgggggtgcgcgccgagcacctgtacttcgccgagtccggcctgccgacgacggtgcagctggtcgagcatctgggcgaccagcagatcgtctatctgcgccacgaaggcgagggcgagaccatcgcgctgaagctgcccggccacgagcccgagccgcgtcccggcgagcgccgcttcctggcgccggacccgcgccactgccacttgttcgacggcggcgggctggccatcgcgcggcgggcggacccggcggcgctgccggaggccgagctgatcgcgtga

SEQ ID NO: 37149 - protein, 372 aa, Chromobacterium violaceum ATCC 12472
MSRLSLKNIRKVYDDGNAVIHDVSLDIRDGEFMVFVGPSGCGKSTMMRMIAGLEDISAGELWIDDRLANDIEPAKRGLAMVFQSYALYPHMTVRDNMAFSLKLAGKSKAEIDAAVRRAAQTLQIEHLLERKPKALSGGQRQRVAIGRAIVRKPGVFLFDEPLSNLDAALRVQMRIELARLHQELGSTMIYVTHDQVEAMTMGHRIAVFNAGRIEQVGTPLDLYNRPANRFVAGFLGSPKMNFIPAQALDQHANGVELELPGHCRLTLPLAGAGDGPLTLGVRAEHLYFAESGLPTTVQLVEHLGDQQIVYLRHEGEGETIALKLPGHEPEPRPGERRFLAPDPRHCHLFDGGGLAIARRADPAALPEAELIA

SEQ ID NO: 37150 - DNA, 1113 bp, Chromobacterium violaceum ATCC 12472
  CDS (1)..(1113)
atggcaaaactgagtctgaagaatatcgccaagcgctatcccggcgccgagcgccgggtgctggaagagatttcggcggagatcgccgacggcgagttcgtggtcatcgtcggcccgtccggctgcggcaaatccacgctgctgcggatggtggccgggctggagagcaccgaggacggcgagatccgcatcggcgagcgcctagtcaaccagttggagcccaaggaccgcgacatcgcgatggtgttccagaactacgcgctgtatccgcacatgacggtggcggagaacatgggctacgcgctcaagctcaagggcctgaagaaggttgagatcatggagcgggtgctgaaggtggccgcggtgctggagctggagcagctgttgcagcgcaagccgcgcgagctgtccggcggccagcgccagcgggtggcgatgggccgcgccatcgtgcgcgagccggcggtgttcctgttcgacgagccgctgtccaacctggatgccaagctgcgcggccagatgcggctggaaatccagcgcctgcaccgccggctggccaccaccagcctgtatgtcacccacgatcaggtggaggcgatgacgctggccgaccgcgtgatcgtgctgaacaaaggccatatcgagcagatcggcgcgccggacgaaatctacgaccggccggccaccgccttcgtcgccgccttcatgggctcgccggggatgaatctgttcgacgcgcaggcggacgagagcggcgagcggctattgctcggcgacggcgtatcgctggcgctgccggcggccaatccggcgctggcggggcgcaggctgaaggccggcatccgccccgagcatctgcgcgcggcgggcgagggcggcgagacgctgagcctgcgggtggacagcctggagatgctgggcgccgacaattatgtctacggcttgctggccgggcagaacgtggtggcgcggctggcgcatggccatcggcccgagccgggcagccggctggaagtggcggtgcgcgccgagtcgctgcacctgttcgacgcggaaacacagaggagaatcgagcatgccgcagcatcgcaagcaagcctggccgtatcctga

SEQ ID NO: 37151 - protein, 370 aa, Chromobacterium violaceum ATCC 12472
MAKLSLKNIAKRYPGAERRVLEEISAEIADGEFVVIVGPSGCGKSTLLRMVAGLESTEDGEIRIGERLVNQLEPKDRDIAMVFQNYALYPHMTVAENMGYALKLKGLKKVEIMERVLKVAAVLELEQLLQRKPRELSGGQRQRVAMGRAIVREPAVFLFDEPLSNLDAKLRGQMRLEIQRLHRRLATTSLYVTHDQVEAMTLADRVIVLNKGHIEQIGAPDEIYDRPATAFVAAFMGSPGMNLFDAQADESGERLLLGDGVSLALPAANPALAGRRLKAGIRPEHLRAAGEGGETLSLRVDSLEMLGADNYVYGLLAGQNVVARLAHGHRPEPGSRLEVAVRAESLHLFDAETQRRIEHAAASQASLAVS

SEQ ID NO: 37152 - DNA, 1089 bp, Gloeobacter violaceus PCC 7421
  CDS (1)..(1089)
gtgggtcaagtagaactgtccggcgtcggtaagcgcttcgagcagtacacggcactgcaacggatcgatcttgacattgcccccggcgaattgttggtgctggtgggaccgagcggctgcggcaaatcgaccctgctgcgcacgatcgccggactggagaccatcgacgcaggcgagatgcgcatcggcggccgactggtggccggggcaaaagcctttgtgcccgcccgcgaacgcgacgtggccatggtgtttcaaaattatgcgctctatccgcacatgagcgttgccgacaacctcgccttcggtctgcgcatgcgtggggtagcttccgaggatcgccgccacaaagtgcgggagatggccaagttgctgggccttgaagcactcctggaccgcaagcccgcccaactgtcgggcggtcagcagcagcgcgtcgcggtcggtcgcgcgctggtgcgcgacccgcaggtgttcttgctggacgaaccgctctcgaacctggataccgaactgcgaaaccagacgcgcagcgaactgaagcgcctgcaccagcgcctgtcgacgacaatgatctacgtcactcacgatcaagtggaggcgatgaccctggcggaccgcatcgccgtgatggaaaagggccacctgcggcaggtgggcacccccgagcagatctacgccgagcccgaaaacgtcatggtcgcccagtttttgggccacccgcctatgaacctgttcgaaatcgtgcgcggtgggcacagctggttgtggcagggagaagcgcttgcccttcccgaagccgcccaggcccggttgaagcaatgtacgagcgaacaggttcggcttggggtgcgaccggaggctatctgtccccatccagaagcggcgatgcctcggggaaaattcaccgtcgaacttatcgagcctctcggaaacgaaacgatcgtgttcggttcactaggtggcgtccaggcgagcctgcgcaccccgggttccgttgattggcgcagcggcgattcgatccccgtcggtctggaccttgcgggggcggtgctcttcgacccggcaagcggcgagcggctgcgctga

SEQ ID NO: 37153 - protein, 362 aa, Gloeobacter violaceus PCC 7421
MGQVELSGVGKRFEQYTALQRIDLDIAPGELLVLVGPSGCGKSTLLRTIAGLETIDAGEMRIGGRLVAGAKAFVPARERDVAMVFQNYALYPHMSVADNLAFGLRMRGVASEDRRHKVREMAKLLGLEALLDRKPAQLSGGQQQRVAVGRALVRDPQVFLLDEPLSNLDTELRNQTRSELKRLHQRLSTTMIYVTHDQVEAMTLADRIAVMEKGHLRQVGTPEQIYAEPENVMVAQFLGHPPMNLFEIVRGGHSWLWQGEALALPEAAQARLKQCTSEQVRLGVRPEAICPHPEAAMPRGKFTVELIEPLGNETIVFGSLGGVQASLRTPGSVDWRSGDSIPVGLDLAGAVLFDPASGERLR

SEQ ID NO: 37154 - DNA, 1098 bp, Vibrio vulnificus YJ016
  CDS (1)..(1098)
atggcacgagtggaatttcgcgatatcaaaaaatcgtacgacgatgtggaagtggtcaaacactttgatttcaccgtcgaagatggtgagtttgtggtgtttttaggcccctcgggctgtggaaaatccaccacgttgcgcatgctcgcgggcttagaaagcatcacctcgggggagatttacgttggcgacaaactgatgaacaagatcgacgccaaagatcgcgatttggcgatggtgttccaaagttacgcgctctacccgcacatgacggtgtacgaaaacatcgcctttgccctcaaactgaaagggatggcaaaagcgcaaattgacgttgaagtacgcaaagccgccaaaatgttggaactggaagcgctgctggatcgcaaacccaaagagctttccggtggtcagcgtcagcgtgtggcgatgggccgcgctatggtccgtacccccaaagtgttcctctttgatgagccgttatcaaacttggatgccaaactgcgtggcaccatgcgtgaagagatcaaacaactgcatcgagagctgaaaaccaccaccatctatgtgacgcacgaccaagtagaagcgatgacgctggctgaccgcattgtgatcctcaaagatggctatgtggcgcaagtgggcacgccaacggaggtgtttaaacgcccggccaacaagtttgtggctcagtttattggcaacccgtcgatgaacatgcttgaagccaagttggtcggtgaagagggcaactggcacatcgcattgggtgacgtgaccattccgttgccagagcgctttcacgcccatgcttcgaagaatcttgctttgcattttggcattcggccgacagacattcatttgcgagccgagcaagtggcgcacgatcgcgtgttgccgatagaggtggcgatcaaagacaaagagctgctgggcgcgagcatcttgctcaaaaccgaagtggcagggcagcccttgatggtggaaacccaagcggcagaggtggacgttcgccaactgaccttgtacctcgacttggacgccattcatctgtttgatgctttgagtgagaagtcgctggcgagctttgggtga

SEQ ID NO: 37155 - protein, 365 aa, Vibrio vulnificus YJ016
MARVEFRDIKKSYDDVEVVKHFDFTVEDGEFVVFLGPSGCGKSTTLRMLAGLESITSGEIYVGDKLMNKIDAKDRDLAMVFQSYALYPHMTVYENIAFALKLKGMAKAQIDVEVRKAAKMLELEALLDRKPKELSGGQRQRVAMGRAMVRTPKVFLFDEPLSNLDAKLRGTMREEIKQLHRELKTTTIYVTHDQVEAMTLADRIVILKDGYVAQVGTPTEVFKRPANKFVAQFIGNPSMNMLEAKLVGEEGNWHIALGDVTIPLPERFHAHASKNLALHFGIRPTDIHLRAEQVAHDRVLPIEVAIKDKELLGASILLKTEVAGQPLMVETQAAEVDVRQLTLYLDLDAIHLFDALSEKSLASFG

SEQ ID NO: 37156 - DNA, 1137 bp, Corynebacterium diphtheriae NCTC 13129
  CDS (1)..(1137)
atggcttcagtaacctttgatgcagcaacacgcatctacccaggcgctactaccccatcggtagacaaattcacccttgacatcgcagacggcgaatttttggttctcgtcggaccttccggctgcggtaagtccaccaccctgcgcatgctcgctggcctagaggaggtcaacgacggtcgcattttgattggtgagcgcgacgttaccgacatgccaccacgcgaccgcgacatcgctatggtgtttcagaactacgccctgtacccccacatgacagtgcgcgaaaacatgggctttgcactcaagattgataagcgccccaaggaagagatcgatcgtcgtgtcgaagaggccgcacgcaccttggatctcaccgcgttcctcgatcgcaagccaaaggcactgtccggtggtcaacgccagcgtgttgccatgggccgcgctatcgtgcgtaaaccagaggtcttcctcatggatgagccactatctaacttggacgcaaagcttcgtgttcaaacccgtacacagattgcagcgctgcagcgcaagctcggcgtgaccaccttgtacgtcacccacgaccagacggaagcactgaccatgggcgaccgcatcgccgttctcaactttggcaagctccagcaagtgggcaccccacgcgagctctatgatcggccagcaaatgagttcgtcgctggcttcattggctccccagcgatgaacttgggtaccttcaccgtcgaaggcaaccacgcagtgctcggcaatgcccgcgtaccactgagcgacgcaaccctcgacgccatcaccccagccgacaacggccagatcgtgattggcttccgcccagaggcactcgagatcgtcccagaaggaaccccgaacaccattccggtgaaactccaccttgttgaggagctcggttccgatgccttcatgtacggcaagctcgttggtggcggcggactcggctccggcacggacgctaacccagatgatgtctccaccgaccagatcatcatccgtactgcacctcacgctgctccacctattggttcggttgttcacgtccgcatccgtgagggtgcacagcacaacttctccaaggcaaccggcgatcgcctgcctgagtag

SEQ ID NO: 37157 - protein, 378 aa, Corynebacterium diphtheriae NCTC 13129
MASVTFDAATRIYPGATTPSVDKFTLDIADGEFLVLVGPSGCGKSTTLRMLAGLEEVNDGRILIGERDVTDMPPRDRDIAMVFQNYALYPHMTVRENMGFALKIDKRPKEEIDRRVEEAARTLDLTAFLDRKPKALSGGQRQRVAMGRAIVRKPEVFLMDEPLSNLDAKLRVQTRTQIAALQRKLGVTTLYVTHDQTEALTMGDRIAVLNFGKLQQVGTPRELYDRPANEFVAGFIGSPAMNLGTFTVEGNHAVLGNARVPLSDATLDAITPADNGQIVIGFRPEALEIVPEGTPNTIPVKLHLVEELGSDAFMYGKLVGGGGLGSGTDANPDDVSTDQIIIRTAPHAAPPIGSVVHVRIREGAQHNFSKATGDRLPE

SEQ ID NO: 37158 - DNA, 1092 bp, Rhodopseudomonas palustris CGA009
  CDS (1)..(1092)
gtggctgatgtcgttctccgcaatgtccgcaagacctatccgggtggcttcgaggctatcaagggtgtcgacttcgcggtcggcgatggccagttctgcgtgctggtcggcccctccggctgcggcaagtccacgttgctaaggatggtcgccgggctggaaacgataaccgcaggcgaaatcgagatcggcggccgtgtcgtcaacgacgtcgagccggccgatcgcgatatcgcgatggtgtttcagaactacgcgctctacccccatatgaccgtgtacaacaacatggcttacgggctgcgcaatcgcggcatggccaaagcggagatcgacgcgcgggtgcaggaagcggcgcgcatcctcgaactcggtccaatgctcatccgcaagccgcggcaattgtccggcggccagcgccaacgggtcgcgatgggccgcgccatcgtgcggcaccccaaggtgtttctgttcgacgagccgttgtccaatcttgacgccaagctgcgggtcgcgatgcgggtcgaaatccgcaagctacagcgccggctcgccaccacggcgatttacgtcacccatgaccagctcgaggcgatgacgctggccgatgtgcttgtggtgatgaatggcgggcaggtcgaacagatcggttcgccgctcgacgtctacgccaagccggcgacgaccttcgtggcttcgttcatcggcgcaccgccgatgaacctgctgaccctggcacacgatctgcggagccagctcagtggcgcgccgcccgaggcgggcattctgggcgttcgcccggaggacctcgtcatcggcccagggacggcagctcaaggcggattggcactcgatatcaccgtcgaggcgatcgagcgggtcgggccggagacgttcgtctatggggttcgagccgggcatgaggcgcggccggtggtcgctgggaaacccggcgaaggggccgggggggatgtcatcgtccggattcccggccaagctgcgccgccggtcggcgagcgcattacggtcgtggcgccgccgcacggcctgcatctgttttccgccgacgggcgccgccggattgccggctag

SEQ ID NO: 37159 - protein, 363 aa, Rhodopseudomonas palustris CGA009
MADVVLRNVRKTYPGGFEAIKGVDFAVGDGQFCVLVGPSGCGKSTLLRMVAGLETITAGEIEIGGRVVNDVEPADRDIAMVFQNYALYPHMTVYNNMAYGLRNRGMAKAEIDARVQEAARILELGPMLIRKPRQLSGGQRQRVAMGRAIVRHPKVFLFDEPLSNLDAKLRVAMRVEIRKLQRRLATTAIYVTHDQLEAMTLADVLVVMNGGQVEQIGSPLDVYAKPATTFVASFIGAPPMNLLTLAHDLRSQLSGAPPEAGILGVRPEDLVIGPGTAAQGGLALDITVEAIERVGPETFVYGVRAGHEARPVVAGKPGEGAGGDVIVRIPGQAAPPVGERITVVAPPHGLHLFSADGRRRIAG

SEQ ID NO: 37160 - DNA, 1065 bp, Rhodopseudomonas palustris CGA009
  CDS (1)..(1065)
atggcgtcggtgcagattcacgacgtgcgtaagtctttcggcggcttcgaagtattgcacggcgtgactgttcccatcgaggatggtgagttcgtcgttctggtcggcccgtccggctgcggcaaatccactttgctgcggatgctcgcagggctggagaagatcaccgccggaacgatctcgatcggtgagcgcgtcgtcaacgacgtgcagccgaaggagcgggacatcgccatggtgttccagaactacgcgctgtatccgcacatgaccgtcgcccagaacatgggcttctcgctgaagctgcgcggcgccgaccagaaggccatcgacagcaaagtgcagcgggcggccgacatcctcgatctcggcaagctgctcgaccgctatccgcgccagctctccggcggccagcgccagcgcgttgccatggggcgggcgatcgtgcgcgatccgcaggtgttcctgttcgacgagccgctgtcgaacctcgacgccaagctgcgggtggcgatgcgcaccgagatcaaggagctgcatcagcggctgaagaccaccacggtttacgtcacccacgatcagatcgaggcgatgacgatggccgacaagatcgtggtgatgcaggacggtatcgtcgagcagatcggggcgccgctcgacctgtacgaccggcccgacaataagttcgtggccggcttcatcggttcgccggcgatgaacttcctcgacggcacgctgaaagtgaacggcggccaaccttatgtcgagaccgccagcggcgccaagctgccgatcgccgcggcacctgcgaacggcaatggccgcgcggtgtcctacggcattcgccccgagcatctcgactttgcagatagtggcatcccggccgaggtcgcggtggtcgaaccgaccggctcggaaacccagatcgtggcccgggtcggcaatcaggaagtgatcgcggtgtttcgcgagcggcatccggtcgggcccggcgatctgatccatctgcagccgcgcgccgacgtcgcgcatctgttcgacaaggagagcggccggcggatctag

SEQ ID NO: 37161 - protein, 354 aa, Rhodopseudomonas palustris CGA009
MASVQIHDVRKSFGGFEVLHGVTVPIEDGEFVVLVGPSGCGKSTLLRMLAGLEKITAGTISIGERVVNDVQPKERDIAMVFQNYALYPHMTVAQNMGFSLKLRGADQKAIDSKVQRAADILDLGKLLDRYPRQLSGGQRQRVAMGRAIVRDPQVFLFDEPLSNLDAKLRVAMRTEIKELHQRLKTTTVYVTHDQIEAMTMADKIVVMQDGIVEQIGAPLDLYDRPDNKFVAGFIGSPAMNFLDGTLKVNGGQPYVETASGAKLPIAAAPANGNGRAVSYGIRPEHLDFADSGIPAEVAVVEPTGSETQIVARVGNQEVIAVFRERHPVGPGDLIHLQPRADVAHLFDKESGRRI

SEQ ID NO: 37162 - DNA, 1071 bp, Mycobacterium avium subsp. paratuberculosis str. k10
  CDS (1)..(1071)
atggcttcggtgactttccagcaagcgacccggcgttacccgggggcggaccggcccgccctggacaatctgaacctcattgtcggcgacggtgaattcgtggtgctggtcggaccctccggctgcggcaagaccacctcactgcggatggtggccgggctggaaaccgtggactccggacgcatcctgatcggtgaccgggacgtcaccaacgtcgaccccaagcaacgagacgtggcgatggtcttccagaactatgcgctgtacccgcacatgacggtggcccagaacatggggttcgccatgaagatcgccaagatccccaaggcgcagatccgcgagcgggtgctggacgccgcgaaactgcttgacctgcaaccgtatctggatcgcaaacccaaagatctgtccggcggtcagcggcagcgagtggcgatgggtcgcgcgatcgtgcgccggccgcaggtcttcctgatggatgaaccgctgtccaatctcgacgccaagctgcgggtgcagacccgcaaccagatcgccgcgctgcagcggcggctgggcaccaccaccgtctacgtcacccacgaccaagtggaggcgatgacgatgggtgaccgcgtcgccgtgctgcgcgacggtgtgctgcaacagttcgcgccgccccgcgagctctaccgcaacccgagcaacgtcttcgtggcgggcttcatcggatcgccggcgatgaacctgttcaccttgcaggtagtggattcggctgtgtcacttggtgattggccgatcgcactgccacgcgagatcgccgccgcggcaagcgaagtcgtcgtcggggtgcgtcccgagcatttcgagctgggcggcctcggtgtcgagatggaggtcgacgtggtcgaggagttgggtgccgacgcctacctgtacggccggatcaccggttcgggcaaggtgatcgacgcgccgatcgtcgcgcgtgtcgacgggcgcaaccccccggagaagggcagcagggtgcgcctgcatcccgcgcccgggcacctgcacttcttcgggcgcaacggccagcgaatcgggtaa

SEQ ID NO: 37163 - protein, 356 aa, Mycobacterium avium subsp. paratuberculosis str. k10
MASVTFQQATRRYPGADRPALDNLNLIVGDGEFVVLVGPSGCGKTTSLRMVAGLETVDSGRILIGDRDVTNVDPKQRDVAMVFQNYALYPHMTVAQNMGFAMKIAKIPKAQIRERVLDAAKLLDLQPYLDRKPKDLSGGQRQRVAMGRAIVRRPQVFLMDEPLSNLDAKLRVQTRNQIAALQRRLGTTTVYVTHDQVEAMTMGDRVAVLRDGVLQQFAPPRELYRNPSNVFVAGFIGSPAMNLFTLQVVDSAVSLGDWPIALPREIAAAASEVVVGVRPEHFELGGLGVEMEVDVVEELGADAYLYGRITGSGKVIDAPIVARVDGRNPPEKGSRVRLHPAPGHLHFFGRNGQRIG

SEQ ID NO: 37164 - DNA, 1179 bp, Mycobacterium avium subsp. paratuberculosis str. k10
  CDS (1)..(1179)
atggccgagattgtgctggaccatgtcagcaagagctacccggacggcgcgacggcggtgcgcgacctcaacctcaccatcgccgacggcgaattcctgatcctggtcggcccgtccggctgcggcaagaccacgaccttgaatatgattgccgggcttgaagatatctcatccggcgagctgcgcatcggcggcgaacgggtgaacgagaaggcgcccaaggaccgcgatatcgccatggtgttccagtcctatgcgctgtacccgcacatgacggtgcgccaaaacatcgcgtttccgttgacactggccaagatgaagaagcccgagatcgcccagaaggtcgccgagacggccaaaatccttgacctgaccgactttctggaccgcaagccgtcgcagctgtccggcgggcagcggcagcgggtggcgatgggccgggccatcgtgcggcacccgaaggcgttcctgatggacgagccgctgtccaacctggacgccaaactgcgggtgcagatgcgcggcgagatcgcccggctgcagaagcggctgggcaccaccacggtctacgtcacccacgaccagaccgaggccatgaccctgggtgaccgcgtggtggtgatgcattccggtgtggcacaacagatcggcacccccgacgagctgtacgagaacccggccaacctgttcgtcgccggcttcatcggctcgccggcgatgaatttcttccccgccacgctgacgccgatcgggctgaagctgcccttcggcgaggtgatgctgacaccggaagttcaacaggtgatcgccgagcatcccgagccggacaacgtcatcgtcggcgcgcgacccgaacacctgtccgacgccgcgctgatcgacggctaccagcggatcagggcgctgaccttcgaggtaaaggtcgacatggtcgagtcgctgggcgccgacaagtacgtgtacttctccaccgcggcgtgggccgcgcactcgacccagttggacgaactggccgccgaggcggatgcacacgaaaaccagttcgtggcaagggttcccgccgaatccaaagcggccatcggccagacggtcgagttggcgctggacacgacgaagctgatggtcttcgacgccgactccggggtgaacctgaccgtcgcgccgtccggctcgccgtga

SEQ ID NO: 37165 - protein, 392 aa, Mycobacterium avium subsp. paratuberculosis str. k10
MAEIVLDHVSKSYPDGATAVRDLNLTIADGEFLILVGPSGCGKTTTLNMIAGLEDISSGELRIGGERVNEKAPKDRDIAMVFQSYALYPHMTVRQNIAFPLTLAKMKKPEIAQKVAETAKILDLTDFLDRKPSQLSGGQRQRVAMGRAIVRHPKAFLMDEPLSNLDAKLRVQMRGEIARLQKRLGTTTVYVTHDQTEAMTLGDRVVVMHSGVAQQIGTPDELYENPANLFVAGFIGSPAMNFFPATLTPIGLKLPFGEVMLTPEVQQVIAEHPEPDNVIVGARPEHLSDAALIDGYQRIRALTFEVKVDMVESLGADKYVYFSTAAWAAHSTQLDELAAEADAHENQFVARVPAESKAAIGQTVELALDTTKLMVFDADSGVNLTVAPSGSP

SEQ ID NO: 37166 - DNA, 1104 bp, Lactobacillus johnsonii NCC 533
  CDS (1)..(1104)
atggttgaagtagatttaaaccatatctataaaaagtacgaaggaaatgataaatattcagttaatgactttgatttacatatcaaagataaagaatttatcgtttttgttggaccatctggttgtggtaaatcaactactttgagaatggttgctggtctagaagatatttctaaaggtactttagagattgaccataaggtaatgaatgacgttgcacctaaagatagagatattgccatggttttccaaaactatgctttgtaccctcatatgtcaatttacgacaacatggcttttggattaaagcttcgtcattataagaaagatgaaattgataaacgagttaagcatgcagcagatattttaggtttatcagaatatcttgataaaaagccagctgaattatctggtggtcaaagacagcgtgttgccttaggacgggcaattgtccgagatgctccaattttcttaatggatgaacccttatcaaacttggatgcaaaattacgtgtcacaatgcgtgccgaaattgctaagttgcaccaaaatttgggaactactacgatttatgttactcacgatcaaactgaagccatgactttagcagatcgggtagtagttatgtcagttggtaaagttcaacaaattggcacacctctagaggtttacaatacgccggtaaatatgtttgttgctggttttatcggatctcctcaaatgaacttctttaatgttcactttaaaggaaatcgaattagcgatggaaaaggtctagatatcgaaatccctgaaggtaaagcaaagatgcttaaagaaaagggatatgacgataaagatctagtatttggtatccgtccagaagatattcattcagaggaagcattccttgaaacttggcctaaccaaattgttgaatcaactgttgttgtttcagaattgcttggttcaactattcagctttatcaaaaagtagatggaacagaatttgtagccattgtaaatgcccgtgattaccatactccaggcgataaagtaagaatgggatttgatgttaataaagcccacttctttgataaagatacaacgaatgctattcgttaa

SEQ ID NO: 37167 - protein, 367 aa, Lactobacillus johnsonii NCC 533
MVEVDLNHIYKKYEGNDKYSVNDFDLHIKDKEFIVFVGPSGCGKSTTLRMVAGLEDISKGTLEIDHKVMNDVAPKDRDIAMVFQNYALYPHMSIYDNMAFGLKLRHYKKDEIDKRVKHAADILGLSEYLDKKPAELSGGQRQRVALGRAIVRDAPIFLMDEPLSNLDAKLRVTMRAEIAKLHQNLGTTTIYVTHDQTEAMTLADRVVVMSVGKVQQIGTPLEVYNTPVNMFVAGFIGSPQMNFFNVHFKGNRISDGKGLDIEIPEGKAKMLKEKGYDDKDLVFGIRPEDIHSEEAFLETWPNQIVESTVVVSELLGSTIQLYQKVDGTEFVAIVNARDYHTPGDKVRMGFDVNKAHFFDKDTTNAIR

SEQ ID NO: 37168 - DNA, 1044 bp, Bdellovibrio bacteriovorus HD100
  CDS (1)..(1044)
atggcaaaaattcagttttccaacatcaaaaaaagtttcggttctgccgatgtcttgaaaggcatcgatctggacatcgctccgggggaatttctggttctggtcggaccttccggttgcggcaaatcgactttgttaagaaccctggcggggcttgagtccgcggattccggaaccatcagcatcgacggaaaaaagatcaacgacatcgaaccgcaaaaccgcgacatcgccatggtcttccagtcctatgctctgtacccgcacatgaccgtggcggaaaatatgggatttggtttgaagctaaaaaatctggcggcggctgaaatcaccaaacgcgtgaatgaaatttccgagcttttgcagatcaaacaccttctggatcgcaaaccgaaagaactttccggcggtcagcgccagcgtgtggctttgggccgtgcgctcagccgtcagactccggtgattttgtttgatgaaccgctgtcgaatctggatgcccatcttcgttcccagatgcgtctggaaatcaaacgcctgcatcacaactcgaaaagcacgatgatctatgtgacccacgatcagatggaagccacaaccttgggggaccgtatcgcggttctgaaagacggcgtgattgagcagatcggaactccgtctgagatttatcaccgtcccaagaacacctttattgcgaccttcatcggctcaccggaaatgaacttcctggaaggcgcggttctggaaaagatcccatggcctgaagcacgcaaggcggatcagattctgggcatccgcccggatgcttttgccttgaatcaggggcccttgggaacccaagaagttgctttgggggacttccaaattgatatttccgaaaacctgggcggccagcagatgcttcacggaacacttgccggtaacaacgtacgcatcctggtggattcgatggataatttttccatgaagcagaccctgcccctgaagatcgacctgacaaaggcccacctgtttgataaaaaaacgggcctgaatcaaaggctttaa

SEQ ID NO: 37169 - protein, 347 aa, Bdellovibrio bacteriovorus HD100
MAKIQFSNIKKSFGSADVLKGIDLDIAPGEFLVLVGPSGCGKSTLLRTLAGLESADSGTISIDGKKINDIEPQNRDIAMVFQSYALYPHMTVAENMGFGLKLKNLAAAEITKRVNEISELLQIKHLLDRKPKELSGGQRQRVALGRALSRQTPVILFDEPLSNLDAHLRSQMRLEIKRLHHNSKSTMIYVTHDQMEATTLGDRIAVLKDGVIEQIGTPSEIYHRPKNTFIATFIGSPEMNFLEGAVLEKIPWPEARKADQILGIRPDAFALNQGPLGTQEVALGDFQIDISENLGGQQMLHGTLAGNNVRILVDSMDNFSMKQTLPLKIDLTKAHLFDKKTGLNQRL

SEQ ID NO: 37170 - DNA, 1131 bp, Bacillus cereus ATCC 10987
  CDS (1)..(1131)
atggatacaagaagaaaaaaggagtgcaatcttgtgattgaattgaaaaatgtttcaaaggtatataaaaatgcagaagagacagcggttaagggtgtatcggttcacattaagaagggcgagttttttgttttagttgggccttcaggatgtgggaaaagcacattattacgaatgatcgctggcctagaagaaatttcttcgggggatttaattattaatgaacgtgttgcaaatgatttagagccgaaagatcgtaatctatcaatggtatttcaaaattacgcactatacccacacttatctgtagaagaaaatattttatttggacttaaggtaaggaaagtacaaaaagaagagcggcaaaagagattaatggaagctattgaaatggtagggctgaaagagtatgtgaaaatgaaaccaggtcaattatcaggtggacaaagacagcgtgttgcgcttgctagagcaatcgtgagccaagcaccgatttgtttaatggatgaaccactttcgaatttagacgcgaaattacgtgcgcaaatgagaattgaaattagagaaattcagcagcgtttaggaattacaatgatttacgttactcatgatcaaatagaggcgatgactatgggggaccgtatcatggttttaaataaaggaagtatacagcaagttggaacaccgcttgacatctataacgaaccagcaaatgaatttgttgcaagttttatagggtctccttcgatgaatataaatgatggagaagtagacaaaggaaaaggtgtattacatatagggcaattgcaaattccgttatctattggacagttaaagcaattaccagaaggaataattcgcataggcatgcgtcctgagcatattgccctgtctgaggaaggacaagaagttacgctacaatctgtagaagtattaggcaacgaatctatattaaacttcgcaataaatggaacaacttggagtgcaaaagtcattggacagctactcctgaacaaaggtgacaaagtaaaattattattctcacaagataagttatgcttctttcatcaaaatacgaatgaacgattaaaagtggtagctgaagaagagttgaaagtggtggcgaaataa

SEQ ID NO: 37171 - protein, 376 aa, Bacillus cereus ATCC 10987
MDTRRKKECNLVIELKNVSKVYKNAEETAVKGVSVHIKKGEFFVLVGPSGCGKSTLLRMIAGLEEISSGDLIINERVANDLEPKDRNLSMVFQNYALYPHLSVEENILFGLKVRKVQKEERQKRLMEAIEMVGLKEYVKMKPGQLSGGQRQRVALARAIVSQAPICLMDEPLSNLDAKLRAQMRIEIREIQQRLGITMIYVTHDQIEAMTMGDRIMVLNKGSIQQVGTPLDIYNEPANEFVASFIGSPSMNINDGEVDKGKGVLHIGQLQIPLSIGQLKQLPEGIIRIGMRPEHIALSEEGQEVTLQSVEVLGNESILNFAINGTTWSAKVIGQLLLNKGDKVKLLFSQDKLCFFHQNTNERLKVVAEEELKVVAK

SEQ ID NO: 37172 - DNA, 1131 bp, Thermus thermophilus HB27
  CDS (1)..(1131)
atggccaaggtcaggctggaacacgtgtggaagcgcttcggcaaggtggtggcggtcaaggacttcaacctggaaacggaggacggggagttcgtggtcttcgtgggcccctcgggctgcggcaagaccaccaccctccgcatgatcgccgggctggaggagatctccgagggcaacatctacatcggcgaccgcctggtgaacgacgtcccccccaaggaccgggacatcgccatggtcttccagaactacgccctctacccccacatgaacgtctacgagaacatggccttcgggctccgcctccggcgctaccccaaggacgagattgaccggcgggtcaaggaggccgcccgcatcctcaagattgagcacctcctcaaccgcaagccccgggagctctcgggcgggcagcgccagcgggtggccatggggcgggccatcgtgcgggaacccaaggtcttcctcatggacgagcccctctccaacctggacgccaagctccgcgtggagatgcgggccgagatcgccaagctgcagcggcgcctcggggtcaccaccatctacgtgacccacgaccaggtggaggccatgaccctggggcaccgcatcgtggtcatgaaggacggggagatccagcaggtggacacgcccttgaacctctacgacttccccgccaaccgcttcgtggctggcttcatcggcagcccctccatgaacttcgtccgcgccggggtggaggtccagggggagaaggtctacctcgtggcccccggcttccgcatccgggcgaacgccgtgctgggaagcgccctgaagccctatgctgggaaggaggtctggctcggcgtccggcccgagcacctgggcctcaaggggtacacgacgatccccgaggaggagaacgtcctccggggcgaggtggaggtggtggagcccctgggggcggagacggagatccacgtggcggtgaacggcaccctcctcgtggccaaggtggacggccacgcccccgtgaagcccggggacaaggtggagctcctcgccgacacccaaaggctccacgcctttgacctggaaaccgacaggaccatcggccacgcccaggagcgggcggccgtggcccgctag

SEQ ID NO: 37173 - protein, 376 aa, Thermus thermophilus HB27
MAKVRLEHVWKRFGKVVAVKDFNLETEDGEFVVFVGPSGCGKTTTLRMIAGLEEISEGNIYIGDRLVNDVPPKDRDIAMVFQNYALYPHMNVYENMAFGLRLRRYPKDEIDRRVKEAARILKIEHLLNRKPRELSGGQRQRVAMGRAIVREPKVFLMDEPLSNLDAKLRVEMRAEIAKLQRRLGVTTIYVTHDQVEAMTLGHRIVVMKDGEIQQVDTPLNLYDFPANRFVAGFIGSPSMNFVRAGVEVQGEKVYLVAPGFRIRANAVLGSALKPYAGKEVWLGVRPEHLGLKGYTTIPEEENVLRGEVEVVEPLGAETEIHVAVNGTLLVAKVDGHAPVKPGDKVELLADTQRLHAFDLETDRTIGHAQERAAVAR

SEQ ID NO: 37174 - DNA, 1047 bp, Thermus thermophilus HB27
  CDS (1)..(1047)
atggccgggatccgcgtggaaaaggtcagcaagcgcttcggcaaggtggaggccttgaagggggtggacctcgaggtccgggaccaggagttcctcgtcctcctcgggccctcggggtgcgggaagaccaccctcctccgcatcgtggcgggcctcgaggcccccacctccggggaggtctacatcggggagcgccgggttacccacctgcccccgaggcttagggggatcgccatggtcttccagaactacgccatcttcccccacctcaccgtttacgagaacgtggccttcggcctgcggatgaagcggcgccccgaggaggagatccggaggaaggtgggcgaggtggcggcccttctccacattgaggagcttctggaccgttaccccgcccagctttccggcggacagcgccaacgggtggcggtggcgcgggctttggccgtggagccggaggtcctcctcatggacgagcccctctccaacctggacgccctcctgcgcctggagatgcgggccgagctcaagcggctcctcaaggagacccggaccaccaccctctacgtgacccacgaccaggtggaggccatgagcctggccgaccgcatcgccgtgatgcgccagggagaaatcgtccagctcggcacgcccacggagatctaccacgccccggcggacaccttcgtgggcgggttcatcggcaacccccccatgaacttccttcgggccggggccctgggggggagggtggtcctcgagggcttcgccgtgccgagcccggtggagggggaggtgcttttgggcgtccgccccgaggacctccgcgtgtccaaggagcaggcggaaggagccttccgcgcccgggtcctggtggtggagcccctgggcccccacctccagctcaccctggaacgggagggcgagaccttccgggccctggccgacccggacttctccgtggcctttggggaggaggtctgggtgcggcctaacccgggccgggtccgcctcttccacccaaagacggggaaggccctcgcctga

SEQ ID NO: 37175 - protein, 348 aa, Thermus thermophilus HB27
MAGIRVEKVSKRFGKVEALKGVDLEVRDQEFLVLLGPSGCGKTTLLRIVAGLEAPTSGEVYIGERRVTHLPPRLRGIAMVFQNYAIFPHLTVYENVAFGLRMKRRPEEEIRRKVGEVAALLHIEELLDRYPAQLSGGQRQRVAVARALAVEPEVLLMDEPLSNLDALLRLEMRAELKRLLKETRTTTLYVTHDQVEAMSLADRIAVMRQGEIVQLGTPTEIYHAPADTFVGGFIGNPPMNFLRAGALGGRVVLEGFAVPSPVEGEVLLGVRPEDLRVSKEQAEGAFRARVLVVEPLGPHLQLTLEREGETFRALADPDFSVAFGEEVWVRPNPGRVRLFHPKTGKALA

SEQ ID NO: 37176 - DNA, 1089 bp, Mycoplasma mobile 163K
  CDS (1)..(1089)
atgaaaatagaattaagaaatattgcaaaaaaatatgaaggaagagaaaattatactttggagaacataaatctctctattgatgataatgacttcttaatcattttaggtccttctggatgtggtaaaagtacacttttaagaatgatagcaggcctaaattcaatcacaaaaggtgatttagtttttgatggaataagagttaatggtctaagtccaaaagatagagatatcgctatggtatttcaatcttatgctttatacccacacatgactgtttatcaaaatattgcttttggtcttaaagtaagaaaagaaagaaaagatgtaattgatagaagagttaaagacattgcaaaaattttacaaatttctgagtatctttcaaataaaccttcagatatctctggaggtcaacgtcaaagagttgcattaggtagagcaatagctagaaaacctaagttatttttaatggatgagcctctttctaatcttgatgctaaattacgtgaatcaatgagaattgaattagtaagaattcatagattattagaatctacaactatttatgtaacgcatgatcaactagaagctatgactatgggtacaaaaattgttgttatgaataattctaaaattcagcaaattggaaaaccattagacttatacaataaaccagtaaatttatttgtagctaaatttattggaaatcctacaattaatgtttttgaaggtagttatgaaaatggttattttattagtgaatcaggaattttaaaaattaaattaaatgatagtgataatgaaaaaattcaaataaaaggttcaaaaaaaataactttatgtgttcgttcagaagatatttatttaactaaggaaaataatgaagataaaattattgcaaaatctgagtttgtagaaattttaggaaaagaaaaacaagctttttttgtaattgatggaaagcattcttttgttgcatcactacactcttctgctaatattcaagttgaaaaaaattatacctttacttttgacaaaaataaactacatatttttgacactgcaagtactaatagaattaactaa

SEQ ID NO: 37177 - protein, 362 aa, Mycoplasma mobile 163K
MKIELRNIAKKYEGRENYTLENINLSIDDNDFLIILGPSGCGKSTLLRMIAGLNSITKGDLVFDGIRVNGLSPKDRDIAMVFQSYALYPHMTVYQNIAFGLKVRKERKDVIDRRVKDIAKILQISEYLSNKPSDISGGQRQRVALGRAIARKPKLFLMDEPLSNLDAKLRESMRIELVRIHRLLESTTIYVTHDQLEAMTMGTKIVVMNNSKIQQIGKPLDLYNKPVNLFVAKFIGNPTINVFEGSYENGYFISESGILKIKLNDSDNEKIQIKGSKKITLCVRSEDIYLTKENNEDKIIAKSEFVEILGKEKQAFFVIDGKHSFVASLHSSANIQVEKNYTFTFDKNKLHIFDTASTNRIN

SEQ ID NO: 37178 - DNA, 1074 bp, Picrophilus torridus DSM 9790
  CDS (1)..(1074)
atggtaagtgtttcattaaaaaatataaaaaaatattacaaccagacactggtgcttaaagatgtaaatcttgatataatggacggggaattttttatactccttggctcctcaggttcaggtaaaagcacaacacttaatataatatcaggcgttgacagacagacttccggtgatatattttttgatacacagaacgttaacaatatgggtcctgtggaaagaaatatagcaatggtgtttcaggattatgcactttatccgcatatgacagtttataaaaacctagcatttccgcttaaaatgagaaaagttgacagggacagcatagaaaaaaaggtaaatgaagttgcagaaaagcttggtttagcgtctctgcttaatcgttatccaaaagaactttctggtgggcaggcacaaagagttgctctggggcgggcacttgttcgtgacccctcactgtttttacttgatgagccactatcaaatcttgatgcaaaaataaggggccagataagaactgagctaaaattaatacaggaggatttaaaaaagacatttatctatgtaacgcacgatcagcaggaggccatgtcccttggagatcatatagcaatattacacaatggaagaatagaacagtttggaaagccacttgaaatatataaaaaaccaaaaacaaggtatgttgcagcttttcttggagatcctgaaatgaacttctttgatttaaaaaagaatgatggagttttttcaaatgatgatattgatggtgttcatatagattacaatggcgatgaaataacattaggtattagaccagaggacatcatgctaaaaaaacaaaaagatagtaacataggaataaaagttatagttagaagtgttgagctttttggctcctatgcggttatcatagccgacactctttcaggaaaagagttgcgtataaggaccgataacaatgtaaatgtgtccagagaaataaatgtgtatatagatagatcctcaatgcttatttttgataaaaatggtgatgtaatagactatgaaaacacaaaagttatcgaataa

SEQ ID NO: 37179 - protein, 357 aa, Picrophilus torridus DSM 9790
MVSVSLKNIKKYYNQTLVLKDVNLDIMDGEFFILLGSSGSGKSTTLNIISGVDRQTSGDIFFDTQNVNNMGPVERNIAMVFQDYALYPHMTVYKNLAFPLKMRKVDRDSIEKKVNEVAEKLGLASLLNRYPKELSGGQAQRVALGRALVRDPSLFLLDEPLSNLDAKIRGQIRTELKLIQEDLKKTFIYVTHDQQEAMSLGDHIAILHNGRIEQFGKPLEIYKKPKTRYVAAFLGDPEMNFFDLKKNDGVFSNDDIDGVHIDYNGDEITLGIRPEDIMLKKQKDSNIGIKVIVRSVELFGSYAVIIADTLSGKELRIRTDNNVNVSREINVYIDRSSMLIFDKNGDVIDYENTKVIE

SEQ ID NO: 37180 - DNA, 1047 bp, Bartonella henselae str. Houston-1
  CDS (1)..(1047)
gtggccataatccagttatcaaatataaaaaaacaatatgaaaatggcattctagtcattgatgatttaaacttaactgttgccgataaagaacttcttgtccttgtaggtccttcagggtgcggaaaatcaactctattacgcatcattgcaggactcgagcaagtcacttcaggtgaactgtatattgacaatgagcgtatcaataatcgtgaaccagctgatcgtgacatcgctatggtttttcaaaattatgcactttatcctcatatgacagttcgtggaaatttagaatatggtcttaaaaatcgtaaaacacctaaagatgaaataaataagcgtatcacacacgctgcaaagcttttgcaaatagagccatttctggatcgtaaaccacggcaattatcaggaggacaacgacagcgtgttgcaatggggcgtgtcattgttcgtcaaccacgtgtttttctctttgatgagccactttcaaacctcgatacacaactgcgtgcgcaaatgtgtatcgagattaaaacactccagcgttcattgggaacaactagcctctacgtgactcatgatcaactagaagcgatgacactagctgatagaatagttgtcatgaataaaggggctattgagcaaattggaacgccaatggaaatttacgattatccagaaacaacatttgttgctgattttattggctctccctctatgaattttcttgatcgcaaaactttagaacagcatttaggtcattcattgtcttatagtcaagaaactgatcttttagcattcagacctgaagtaatcttgttaggcgaatatccaaatcaaggagctgtctttcacacacaaattgaacttatcaaacctgtcggaacaggatgccatgttttaacgcattggaataataatatttttaccattgaaataaaagaacgtttgacacacgattatggtcaaaaactaagctttactgttccccatcagagttttcatagttttaacaaaagtactggaaaacgcacacgtgagaattaa

SEQ ID NO: 37181 - protein, 348 aa, Bartonella henselae str. Houston-1
MAIIQLSNIKKQYENGILVIDDLNLTVADKELLVLVGPSGCGKSTLLRIIAGLEQVTSGELYIDNERINNREPADRDIAMVFQNYALYPHMTVRGNLEYGLKNRKTPKDEINKRITHAAKLLQIEPFLDRKPRQLSGGQRQRVAMGRVIVRQPRVFLFDEPLSNLDTQLRAQMCIEIKTLQRSLGTTSLYVTHDQLEAMTLADRIVVMNKGAIEQIGTPMEIYDYPETTFVADFIGSPSMNFLDRKTLEQHLGHSLSYSQETDLLAFRPEVILLGEYPNQGAVFHTQIELIKPVGTGCHVLTHWNNNIFTIEIKERLTHDYGQKLSFTVPHQSFHSFNKSTGKRTREN

SEQ ID NO: 37182 - DNA, 1131 bp, Bacillus thuringiensis serovar konkukian str. 97-27
  CDS (1)..(1131)
atggatacaagaagaaaaaaggagtgcaatcttgtgattgaattgaaaaatgtttcaaaggtatatcaaaatgcagaggagacagcggttaaaggtgtatcggttcatatgaagaagggagaattttttgttttagttggcccttcaggatgtggaaaaagtacattattaagaatgattgctggtttagaagaaatttcttcgggggatttaattattaatgaacgtgttgcaaatgatttagagccgaaagatcgtaatctatcaatggtatttcaaaattatgcactatatccacacttatctgtagaagaaaatattttattcggacttaaggtaaggaaagtacaaaaagaagagcgacaaaagagattaatggaagctgtggaaatggtaggactgaaagagtatgtgaaaatgaaaccaggccaattatcaggtggacaaagacagcgtgtcgcgcttgctagggcgattgtgagtcaagcaccgatttgtttaatggatgaaccactttcgaatttagatgcgaaattacgtgcgcaaatgaggattgaaattagagaaattcagcagcgtttaggaattacaatgatttacgttactcacgatcaaatagaagcgatgactatgggagatcgtattatggtcttaaataaaggaagcatacagcaagttggaacaccgcttgatatatataacaaaccagcgaatgaatttgttgcaagttttatagggtctccttcgatgaatataaatgatggagaagtagacaaagaaaaaggtgtattacatatagggcaattgcaaatcccattatctattggacaattaaagcaattaccagcaggaactgttcgagtaggcatgcgtccagaacatattgcattgtccgaggaaggacaagaagttacattgcaatctgtagaagtgttagggaatgaatctatattaaacttcgtgataaacggaacaacttggagtgcgaaagttatcggacagttactcctgaataaaggtgacaaagtaaaattattattctcggaagaaaagttatgcttctttaatcaaaatacgaatgaacgcttaaaagtggtagctgaagaagagctgaaagtggtggcgaaataa

SEQ ID NO: 37183 - protein, 376 aa, Bacillus thuringiensis serovar konkukian str. 97-27
MDTRRKKECNLVIELKNVSKVYQNAEETAVKGVSVHMKKGEFFVLVGPSGCGKSTLLRMIAGLEEISSGDLIINERVANDLEPKDRNLSMVFQNYALYPHLSVEENILFGLKVRKVQKEERQKRLMEAVEMVGLKEYVKMKPGQLSGGQRQRVALARAIVSQAPICLMDEPLSNLDAKLRAQMRIEIREIQQRLGITMIYVTHDQIEAMTMGDRIMVLNKGSIQQVGTPLDIYNKPANEFVASFIGSPSMNINDGEVDKEKGVLHIGQLQIPLSIGQLKQLPAGTVRVGMRPEHIALSEEGQEVTLQSVEVLGNESILNFVINGTTWSAKVIGQLLLNKGDKVKLLFSEEKLCFFNQNTNERLKVVAEEELKVVAK

SEQ ID NO: 37184 - DNA, 1089 bp, Erwinia carotovora subsp. atroseptica SCRI1043
  CDS (1)..(1089)
atggccgtgattcagttacgtaatatcagtaaacgcttcgaacacatgcaggcgctggcgtcactgtcgttagatatcgctgacggtgagtttctggtgctggtcgggccgtccggctgtggcaaaagtacgctgctgcgtatgctggccggtctggaagacgtgagcgatgggcaaattctgctgggcgacgacgacattacgacgtggagcccgaagcagcgtaatttctcgatgatcttccagaactacgcactgtttccgcatttgaccgttgagcagaacatcacttttggcatgcggatgcgcggcgaaccgaaggccgaatatccacagcgggtacagcgcgttgccagcctgcttcagcttgagccgttactcaaacgcaaaccgggaaaactgtccggtggtcagcgtcagcgcgtggcgatggcgcgtgcgatcgtgcgcgatcctcgcttgtttttgatggatgaaccactgtcgaatctggatgctcgcctgcgcagcgatgtgcgggacggcattatggatctgcatcggcagttgaaaaccaccaccgtctacgtcacgcacgatcagatcgaggcaatgacgatggcggacaggatcgccgtgctggatcgtggtgtgttgcaacaggtcggtacgccggaacagctgtattcttacccggctaacgtctttgtcgccggatttatcggcacgcccgcaatgaacatggtgacgctggtatgttccgaaggtcacgcgtttttacaagcattgcctgtggtgctgcccgtcagtgaagaaacacgttcattaaccagtgtgctgctagggattcgtcctgagcatattaccgaacacgccgcgtcagacggcgatttgtcattgtcgggaacggtgaagcaacgggagctgtttggcgcggagtatctgattcatgtggatacgccgttgggaaatattcgctaccgtcgtccaaatcgcgatggcgtgccgaacatcggcgcgtccgttgtgcttcatttttcaccgcaggattgtcattggttttctgggcaaaccgcccgtaatttatcccaggagaaaagaaatgcgtaa

SEQ ID NO: 37185 - protein, 362 aa, Erwinia carotovora subsp. atroseptica SCRI1043
MAVIQLRNISKRFEHMQALASLSLDIADGEFLVLVGPSGCGKSTLLRMLAGLEDVSDGQILLGDDDITTWSPKQRNFSMIFQNYALFPHLTVEQNITFGMRMRGEPKAEYPQRVQRVASLLQLEPLLKRKPGKLSGGQRQRVAMARAIVRDPRLFLMDEPLSNLDARLRSDVRDGIMDLHRQLKTTTVYVTHDQIEAMTMADRIAVLDRGVLQQVGTPEQLYSYPANVFVAGFIGTPAMNMVTLVCSEGHAFLQALPVVLPVSEETRSLTSVLLGIRPEHITEHAASDGDLSLSGTVKQRELFGAEYLIHVDTPLGNIRYRRPNRDGVPNIGASVVLHFSPQDCHWFSGQTARNLSQEKRNA

SEQ ID NO: 37186 - DNA, 1086 bp, Erwinia carotovora subsp. atroseptica SCRI1043
  CDS (1)..(1086)
atggctgatattttactaaagaatatagtgaagcgttacgataaaactgaaacgatccatcgtattaatcttgagattgattcaggcgaatttgtggtatttgttggcccgtcggggtgtggtaaatcaacgttactgagaatgatcgcgggattggaagagataacggatggcgagatacatattgataaccgcgtagttaaccattgcgatcctgcagagcgggggattgcgatggtgttccagtcatatgcgttgtacccgcacatgacggtggctgaaaatatggggtttgggttgagaatgaatgggcatcccaaagccgaagtcgagaaaatggtgcgaaaggctgcgatgacgctccagctagaagccttgttagatcggacaccgaaacagctatctggcggccagcgtcagcgtgttgcgattgggcgggccattgtgcgcgatcctaaagtgttcttattcgatgagcccttatcgaaccttgacgccgaattacgcgtggaaatgcgtttacaaattgcccagcttcatcaggaaatgcgtaataccatgatttatgtgacgcacgatcaagtggaagcaatgacgttggcggataaaatcgtggtgttaaacaaaggggatattgagcaggtcgggacgccgatggagctataccataagccaaaaaatctttttgtcgccggttttatcggttcgccgaatatgaattttctacccggtgaagtgttacaggttgaaggaaataaagtgagcatcttgatcaataaactcactacactttccgttaatcttgctagccacggattgcacaccgatcagaaaattaccgtgggtattcgccctgagcacctgagtattgatccgcaggggggagatgtcagcctgtcgatcaatagcgaagtaacagaaaggctgggtaatgccacgtatatttttggtacttactctggcgttaatcattttaaagtacatttgtcaggtgacaatagtattgtgccttactcaacgattccgctcacatgtcgtagtgaacatcttcatttttttgatgaaaatgggaagagaattaactaa

SEQ ID NO: 37187 - protein, 361 aa, Erwinia carotovora subsp. atroseptica SCRI1043
MADILLKNIVKRYDKTETIHRINLEIDSGEFVVFVGPSGCGKSTLLRMIAGLEEITDGEIHIDNRVVNHCDPAERGIAMVFQSYALYPHMTVAENMGFGLRMNGHPKAEVEKMVRKAAMTLQLEALLDRTPKQLSGGQRQRVAIGRAIVRDPKVFLFDEPLSNLDAELRVEMRLQIAQLHQEMRNTMIYVTHDQVEAMTLADKIVVLNKGDIEQVGTPMELYHKPKNLFVAGFIGSPNMNFLPGEVLQVEGNKVSILINKLTTLSVNLASHGLHTDQKITVGIRPEHLSIDPQGGDVSLSINSEVTERLGNATYIFGTYSGVNHFKVHLSGDNSIVPYSTIPLTCRSEHLHFFDENGKRIN

SEQ ID NO: 37188 - DNA, 1128 bp, Erwinia carotovora subsp. atroseptica SCRI1043
  CDS (1)..(1128)
atggctgaagttattttcaataaactggaaaaagtatacaccaacggcttcaaagcggttcacggcatcgacctgaccattaaagacggtgagttcatggttatcgtcggcccgtcaggctgtgcgaaatcaacgacgctgcgtatgttagcgggtctggaaaccatcagcggcggtgaagttcgcatcggcgagcgcgttgttaacaatctggcaccgaaagagcgtgggattgcaatggtgttccagaactatgcgctctaccctcatatgacggtaaaagagaacctggcgtttggtctgaagctgagcaaaatgcctaaagatcaaattgaagcgcaagtaacggaagcagccaaaattctggagctggaagacctgatggatcgtctgccacgccagctatctggtggtcaggcgcagcgtgtggccgtaggccgtgccatcgttaaaaagccggatgttttcctgtttgatgaaccgttatctaacctggatgccaaactgcgtgcttccatgcgtatccgtatttctgacctgcataagcagttgaagaaaagcggtaaagcggcaacgacggtatatgttacccacgaccagactgaagccatgaccatgggcgaccgtatctgcgttatgaagctgggtcacatcatgcaggtcgatacgccggataacctgtaccatttccctgtcaacatgttcgttgctggcttcattggctcaccagaaatgaacattaagccgtgcaaactggtcgagaaagacggtcagattggcgttgttgtgggtaataacgcgctggtattaaatactgaaaaacaagataaagtgcgcagctacgtaggacaagacgtattcttcggcgttcgcccagactatgtttccttgtcagatacgccatttgaaggcagccactcacagggtgaactggttcgcgtagaaaacatgggtcacgaattctttatgtacattaaagtcgatggctttgaattaaccagccgcattccttatgacgaaggtcggctgattatcgagaagggactgcatcgtccggtatatttccagttcgacatggaaaaatgccatatttttgatgcaaaaacagaaaaaaatatctctctttaa

SEQ ID NO: 37189 - protein, 375 aa, Erwinia carotovora subsp. atroseptica SCRI1043
MAEVIFNKLEKVYTNGFKAVHGIDLTIKDGEFMVIVGPSGCAKSTTLRMLAGLETISGGEVRIGERVVNNLAPKERGIAMVFQNYALYPHMTVKENLAFGLKLSKMPKDQIEAQVTEAAKILELEDLMDRLPRQLSGGQAQRVAVGRAIVKKPDVFLFDEPLSNLDAKLRASMRIRISDLHKQLKKSGKAATTVYVTHDQTEAMTMGDRICVMKLGHIMQVDTPDNLYHFPVNMFVAGFIGSPEMNIKPCKLVEKDGQIGVVVGNNALVLNTEKQDKVRSYVGQDVFFGVRPDYVSLSDTPFEGSHSQGELVRVENMGHEFFMYIKVDGFELTSRIPYDEGRLIIEKGLHRPVYFQFDMEKCHIFDAKTEKNISL

SEQ ID NO: 37190 - DNA, 1083 bp, Erwinia carotovora subsp. atroseptica SCRI1043
  CDS (1)..(1083)
atggcgtcgatccagttggataaagtgagtaagcattttggcaaaacgattacgcttcacgatgtgaatctaacaattgcagatggagagttcgctgtttttgttgggccgtctggctgtggtaagtcgacgctgttgagaatgattgccggactggaagatgtcacgggcggtgacatcatgattgatgatgcggtagtgaatgatgttgcccctgcgcatcgtggtgttgccatggtgttccaatcttatgcgttgtatccgcacatgaccgtcgccgagaatatgggctacggcctgcgcgttaacggcgtcccgaaagaccagattaagcaccaaatcgagatggtggcgaagacgctgcaactctctcaactgttggaacgcaagcctaaagagctgtcaggtggtcagcggcagcgcgtggcgatagggcgcgctatcgtgcgtaacccgaaagttttcctgtttgatgaaccgctgtcgaaccttgatgcggagctgcgtgtggatatgcggttgcacattgccaagctgcatcaggaattgaaaacgaccatggtttatgtaacgcacgatcaggtcgaggccatgacgctggccgataaaatcgtggtgatgaattacggtaaagtcgagcaggttggatcaccgatggagctttactatcatccggttaaccagtttgttgcggggtttatcggctcgccaaaaatgaacttcctgcctgcgcaggtcatcaattggacaccggatagcctgacggtcaatgtcgccgaacagctacagcttgagctgccggttcgtaccagtgaactgagtgttggcagtacgataacgctggggctgcgaccggaacacgtttcaccggaaggtgaggggattcgtttgtcatttggttgtgaagtcgtcgagcgtttaggcaatagcacctacctgttcggccaatgctgcggcattgataatttcaaacttctgctggcgggcgacagcgccttcaaaccctatgaacacatcgaggttttcttctctcccactaactgtctggtattcaacgccgatggtttgcgtatcagcgcttag

SEQ ID NO: 37191 - protein, 360 aa, Erwinia carotovora subsp. atroseptica SCRI1043
MASIQLDKVSKHFGKTITLHDVNLTIADGEFAVFVGPSGCGKSTLLRMIAGLEDVTGGDIMIDDAVVNDVAPAHRGVAMVFQSYALYPHMTVAENMGYGLRVNGVPKDQIKHQIEMVAKTLQLSQLLERKPKELSGGQRQRVAIGRAIVRNPKVFLFDEPLSNLDAELRVDMRLHIAKLHQELKTTMVYVTHDQVEAMTLADKIVVMNYGKVEQVGSPMELYYHPVNQFVAGFIGSPKMNFLPAQVINWTPDSLTVNVAEQLQLELPVRTSELSVGSTITLGLRPEHVSPEGEGIRLSFGCEVVERLGNSTYLFGQCCGIDNFKLLLAGDSAFKPYEHIEVFFSPTNCLVFNADGLRISA

SEQ ID NO: 37192 - DNA, 1092 bp, Erwinia carotovora subsp. atroseptica SCRI1043
  CDS (1)..(1092)
atggcgagtctggaactgaaaaacgtccacaaaaattacggtgcggtgagcatcataaaaggcgtggacttaacgattcatgatggcgagttcatggtctttgttggcccgtcgggctgtggaaaatccacgctgctgcgcatgattgccggtctggaagagatcagcaacggcgagctgctgatcgacagccgcaaggtgaacgatctcacgccagcagagcgcaagattgcgatggtgttccagtcttatgcgctctacccgcacctctcggtgcgcaagaacctcgcatttgggctggagaatttgcacttccccaaagacgaaatcatccgtcgtattgatgaagcggcccgtatgctggggctggaaccctatctggatcgcaggccgcgtgcgctgtcgggtggacagcagcagcgcgtcgccattggtcgcgctatcgtgcgtgagcccgacctgttcctgtttgatgaaccgctctcgaatctggatgccaagctgcgcgtgcagacgcgcggtgagctgtcccgtctgcatcaaaagctgcgtaccaccatgatctacgtgactcacgatcaggtggaagcgatgacgatggcgcagcgtattgtggtactgaatgcgggtcgcattgagcaggttggtacgccgctggagctgttcaatcggccgaaaaacaagtttgttgcgggcttcatcggctcaccgcgcatgaatatgtttccggcgcagattgtcgccacctgtgcagacggcgtcgaggtgcagtgcccgtccggcaatcgtttggtgctgccgtttatcggcaccgtcgggcagaacgtcacgctcggcattcgtccttcgcactgtgaactggtggaagaaggtgaggggatcgcgctgtgcgtcgatcgttgcgaaatgatgggacatgaaacctttatctacgggcggatgggcggcattgatgacgagatgatcgtccatttggcgcagcaccgcgagttcaccgcaggtgaatcggtgtttgtgcgcttcccgccgacgtattgccatctgttcgatggcgaaacggatgacacattgccgcgctgtaccgagcattaa

SEQ ID NO: 37193 - protein, 363 aa, Erwinia carotovora subsp. atroseptica SCRI1043
MASLELKNVHKNYGAVSIIKGVDLTIHDGEFMVFVGPSGCGKSTLLRMIAGLEEISNGELLIDSRKVNDLTPAERKIAMVFQSYALYPHLSVRKNLAFGLENLHFPKDEIIRRIDEAARMLGLEPYLDRRPRALSGGQQQRVAIGRAIVREPDLFLFDEPLSNLDAKLRVQTRGELSRLHQKLRTTMIYVTHDQVEAMTMAQRIVVLNAGRIEQVGTPLELFNRPKNKFVAGFIGSPRMNMFPAQIVATCADGVEVQCPSGNRLVLPFIGTVGQNVTLGIRPSHCELVEEGEGIALCVDRCEMMGHETFIYGRMGGIDDEMIVHLAQHREFTAGESVFVRFPPTYCHLFDGETDDTLPRCTEH

SEQ ID NO: 37194 - DNA, 1074 bp, Erwinia carotovora subsp. atroseptica SCRI1043
  CDS (1)..(1074)
atggcatgtttaaaacttcaggctgtcaccaagtcttacgatggcaaaacacagattatccaacccatcgatctggacgtcgcggatggcgaattcgtcgtgatggtgggaccgtcgggctgcggtaaatcgacgctgttgcgcatggtggcgggcctcgaacgtaccaccagcggcgatatctatattgataaccagcgggtcaccgatctggaaccgaaagatcgcggtattgcgatggtgttccagaattacgcgctttatccgcacatgaacgtgttcgacaatatggcttacagcctgaaaattcgtggcttcggtaagacgcagattcgtgagcgtgtggaagaagcggcacgtattctggaactgatgccgctgctgcaacgcaaaccgcgtgagttatcgggcggccagcgtcagcgcgtggcgatggggcgggcgattgtgcgtgaaccggcggtgttcctgtttgatgaaccgttgtcgaatctggatgccaaactgcgtgtacagatgcggctggaattgcagcaactgcaccagcgtctgaaaactaccagcctgtacgtcacgcacgatcaggtcgaagctatgacgttggcgcagcgcgtcatcgtgatgaataaaggtatcgctgaacaaatcggcgcaccgtctgatatttaccgccgtccagcgtcactgttcgtggccagttttattggttcaccggcgatgaacctgtgggcagggcgcattagcgatgacggttgccgctttgacatcggtgaagacatcgcgttggtgctgcctgaaccgaagccgcaatggcgtggtaaagcattgacgctgggggtgcggccggagcatattcagctggcgacgcgtgaaaccggcggtataccgttgcagatctcaacactcgaactgctgggcgcggacaatttagcgcacggtaagtggggcgggcaaaacgtgattgcgcggctatcttatgagcactgtcccgccattggctcgacgctctggctgcatttgccgacgtcatcatggcacctgtttgattcgcaaagcggattacggatggaataa

SEQ ID NO: 37195 - protein, 357 aa, Erwinia carotovora subsp. atroseptica SCRI1043
MACLKLQAVTKSYDGKTQIIQPIDLDVADGEFVVMVGPSGCGKSTLLRMVAGLERTTSGDIYIDNQRVTDLEPKDRGIAMVFQNYALYPHMNVFDNMAYSLKIRGFGKTQIRERVEEAARILELMPLLQRKPRELSGGQRQRVAMGRAIVREPAVFLFDEPLSNLDAKLRVQMRLELQQLHQRLKTTSLYVTHDQVEAMTLAQRVIVMNKGIAEQIGAPSDIYRRPASLFVASFIGSPAMNLWAGRISDDGCRFDIGEDIALVLPEPKPQWRGKALTLGVRPEHIQLATRETGGIPLQISTLELLGADNLAHGKWGGQNVIARLSYEHCPAIGSTLWLHLPTSSWHLFDSQSGLRME

SEQ ID NO: 37196 - DNA, 1320 bp, Propionibacterium acnes KPA171202
  CDS (1)..(1320)
ttgcggcaagacctcattcatagttcccctcacgcggaaaattcgccacttgacaaggagaatcgctgcatcttcaccccccggcccacctttgtgggttgtgtccattatgatcaattttggctcctcgaaacctcggagggacccggtgacatccgtcaccgattttccacaacggatcgtcgggcacgtacctgcccgtggaaaggaacaacggtcatggcaaccgtgcaatataaggaggcgactcgggtttatccgggcaccgatcgcgcagccgtcagcaagctcgacctcgacattggcgacggggagttcatggtcctcgtgggaccgtctggctgcggtaagtcgacctctctgcgaatgctagccggcctcgaagaggtcaatgccggctccatctggatcggggaccgcgatgtcactgatcttcccccgaaggaccgtgacatcgccatggtcttccagaactacgccctgtacccccacatgaccgtggccgacaacatgggctttgccctcaagatgcagaacgtgccgaaggctgaacgccagcagcgcgtcctggaagccgccaagcttctcggcctggaggacttccttaaccgtaagccgaaggcactctccggtggtcagcgtcagcgcgtcgccatgggtcgtgcgattgttcgtaacccacaggtcttcctcatggacgagccattgtcgaacctcgatgccaagctgcgcgtccagacccgtacccagatcgccgccctgcagcaacgccttggcgtgaccaccgtctacgtgacccacgatcaggttgaggccatgacgatgggcgaccgcgttgctgttatgagggacggcgttctacaacaggtcgattctcctctcgctctttacgacactccgaagaacctcttcgtcgctggcttcatcggctcccccgctatgaacctcatggaaggtgatgtcgttgacggcggcgtcgagctcggtgactacgttgtcccggtttctcgcgacgtcctagctaaggtcccgaacgagaccaagctcaccctcggtatccgcccggaggcattcaccctcgccagcgagggcatcggactcgacgttgctgttgtcgaggagctcggagctgacgcctacctgtacggctccctcgtcggatccggcaagcaggcctccatcgaggatggcgaggctcaccaggttgtcgcccgtatttcttcgcgtcgtcctccgcagcgtggcgagcaggtacgtctgggcgtagaccctgcctctgtccacgtcttcagccaggagaccaccgagcgcatctcctga

SEQ ID NO: 37197 - protein, 439 aa, Propionibacterium acnes KPA171202
MRQDLIHSSPHAENSPLDKENRCIFTPRPTFVGCVHYDQFWLLETSEGPGDIRHRFSTTDRRARTCPWKGTTVMATVQYKEATRVYPGTDRAAVSKLDLDIGDGEFMVLVGPSGCGKSTSLRMLAGLEEVNAGSIWIGDRDVTDLPPKDRDIAMVFQNYALYPHMTVADNMGFALKMQNVPKAERQQRVLEAAKLLGLEDFLNRKPKALSGGQRQRVAMGRAIVRNPQVFLMDEPLSNLDAKLRVQTRTQIAALQQRLGVTTVYVTHDQVEAMTMGDRVAVMRDGVLQQVDSPLALYDTPKNLFVAGFIGSPAMNLMEGDVVDGGVELGDYVVPVSRDVLAKVPNETKLTLGIRPEAFTLASEGIGLDVAVVEELGADAYLYGSLVGSGKQASIEDGEAHQVVARISSRRPPQRGEQVRLGVDPASVHVFSQETTERIS

SEQ ID NO: 37198 - DNA, 1095 bp, Leifsonia xyli subsp. xyli str. CTCB07
  CDS (1)..(1095)
atggcgactgtcacctatgacaaagcgacccggctctaccccggctcgaaccgccccgcggtcgacgccctcgacctcgacatcgcggacggcgagttcctcgtcctggtcggcccctccggttgcggcaagtccacctccctgcgcatgctcgccggcctcgaagaggtcaacgacggcaacatcttcatcggcgagcgcaacgtcaccgatgttccgccgaaggaccgcgacatcgcgatggtcttccagaactacgcgctgtacccgcacatgaccgtggccgagaacatgggcttcgcgctcaagatcgcgggcatcggcaaggaggagcgcgcccagcgcgtcctcgaggccgccaagctgctcgacctggagccctacctcggccggaagcccaaggccctctccggcggccagcgtcagcgcgtcgcgatgggccgcgcgatcgtgcgctccccccaggtgttcctcatggacgagccgctgtcgaacctcgacgccaagctccgcgtccagacccgcacccaaatcgcctcgctgacccgccgcctcggcgtcaccacggtctacgtcacccacgaccagaccgaggcgctcaccatgggcgaccgcatcgcggtgctcaaagacggcgtcctgcagcaggtcggcaccccgcgcgacctgtacgcgcagccgaagaacgtcttcgtcgccggcttcatcggaagcccagccatgaacctgttcacggccgacgtcgccgacggcggcgtccagttcggcaacgcggtcgtcccggtcgagcgcgtcaccctcgccgacgccggctccaccgtcaccatcggtgtccgcccggaggacgtcgtcgtgtcgtccgccgagggcactggcctcaaggtcacggtcgacctcgtcgaggagctcggcgccgaaggctacctctacggccactcggaggtcgacggcaagcgcaccgacatcgtcggccgcgtcgacggccgcgtccacccgaacgccggtgacaccgtgtacatcaccccgaagccgggccacatccacctgttccacgcggagtcgggcgagcgtctcggcggcgcggtggtcgactag

SEQ ID NO: 37199 - protein, 364 aa, Leifsonia xyli subsp. xyli str. CTCB07
MATVTYDKATRLYPGSNRPAVDALDLDIADGEFLVLVGPSGCGKSTSLRMLAGLEEVNDGNIFIGERNVTDVPPKDRDIAMVFQNYALYPHMTVAENMGFALKIAGIGKEERAQRVLEAAKLLDLEPYLGRKPKALSGGQRQRVAMGRAIVRSPQVFLMDEPLSNLDAKLRVQTRTQIASLTRRLGVTTVYVTHDQTEALTMGDRIAVLKDGVLQQVGTPRDLYAQPKNVFVAGFIGSPAMNLFTADVADGGVQFGNAVVPVERVTLADAGSTVTIGVRPEDVVVSSAEGTGLKVTVDLVEELGAEGYLYGHSEVDGKRTDIVGRVDGRVHPNAGDTVYITPKPGHIHLFHAESGERLGGAVVD

SEQ ID NO: 37200 - DNA, 1095 bp, Symbiobacterium thermophilum IAM 14863
  CDS (1)..(1095)
atggctgaggtcagtttgcggcacgtttccaagaagttcggcgacgtgacggtcgtccgggactttaacctggacatcgccgaccgcgagttcatcgtgttcgtcgggccgtcggggtgcggcaagtccaccaccctgcgcatgattgccggcctggaggaaattactgagggtgagatctacatcggcgaccggctggtgaacaacgtggcgccgaaggaccgggacatcgccatggtcttccagaactacgcgctgtacccgcacatgaacgtttacgaaaacatggccttcggcctgaagctccggagggtcccgaaggccgagatcgaccggcgggtgaaggaggcggcggccatcctgggcctcagtgacctgctgggccgcaagcccaagtcgctctccggcggccagcggcagcgggtggccttggggcgcgccatcgtgcgcaaccccaaggtgttcctgatggacgagccgctctccaacctggacgccaagctgcgggcatccatgcgcaccgagctggccaagctgcacgagcggctgcagacgacgacgatctacgtcacccacgaccaggtggaggccatgaccatgggccaccgcatcgtggtcatgcgggacggcgtgatccagcaggtggcgccgccccaggagctgtacgaccggccggccaacctgttcgtcgccgggttcatcggctcgccggccatgaacttcctgcggggccggctctccgaggacggccaggtgttccgcgccgccaccttccagttccggctgcccgagcggctggccgcagccgcccgcccctacgccggtaaggagatgatcctgggcatccggccggagaacatccacgcggatcccacctacctggcgacccacgacgggccgcgcatcccggcgcggatcgaggtggtcgagccgctgggcgcggagatctacctgtacctgcgcaccggcgaggacgaggtcaccgcgcgggtcgaaccccacctgcgcttccgcccccacgaccagctcgacctggccttcgacgcggacaaggtgcacctgttcgacgccgcgacggagatggcggtccgctga

SEQ ID NO: 37201 - protein, 364 aa, Symbiobacterium thermophilum IAM 14863
MAEVSLRHVSKKFGDVTVVRDFNLDIADREFIVFVGPSGCGKSTTLRMIAGLEEITEGEIYIGDRLVNNVAPKDRDIAMVFQNYALYPHMNVYENMAFGLKLRRVPKAEIDRRVKEAAAILGLSDLLGRKPKSLSGGQRQRVALGRAIVRNPKVFLMDEPLSNLDAKLRASMRTELAKLHERLQTTTIYVTHDQVEAMTMGHRIVVMRDGVIQQVAPPQELYDRPANLFVAGFIGSPAMNFLRGRLSEDGQVFRAATFQFRLPERLAAAARPYAGKEMILGIRPENIHADPTYLATHDGPRIPARIEVVEPLGAEIYLYLRTGEDEVTARVEPHLRFRPHDQLDLAFDADKVHLFDAATEMAVR

SEQ ID NO: 37202 - DNA, 1119 bp, Mannheimia succiniciproducens MBEL55E
  CDS (1)..(1119)
atggcgaatgtatcgttacgcaacgtgggtaaatcttatggcgacgttcatatttctaaagatattaatttagaaattaatgaaggcgaatttgttgttttcgtcggtccgtcaggctgtggaaaatcaaccctattgcgtatgattgcaggtctcgaagatattaccacaggcgaactgtatattggcgagaaattaatgaatgacgtcgagccttccaaacgcggtatcggtatggtgttccaatcttacgcgctttacccccatttggacgtagcggacaatatgtctttcggtttgaaattggcgggcgtgaaaaaaaacgagcgggatcaacgggtcaaccaggtagcggaaatcctgcaacttgcccatttactggatcgcaaaccgaaagcgctttccggcggtcaacgccagcgtgtggcgataggccgcacccttgtctcccagcccgaagtattcttattggacgaaccgctctctaatcttgatgccgcattgcgcgtacaaatgcgggtagaaatttctaaattacataaaaaattaaaccgcaccatgatctatgtaactcacgaccaagtggaagcgatgactctcgctgataaaattgtggtgttaaacgcaggcggtgttgctcaggtaggcaaacctttagagctttatcattatccggcaaatcgttttgtagccggatttatcggttctccgaaaatgaattttctgccggtgaaagtcactgcagtggaagagaaccaagtcaaaattgaattgccggatgcaaatcatcacaacttctggattcctgtttccggcgaaggggtaaatataggggaaaatttatctttgggtattcgccccgagcatttagtaccggcagaacaagcgcaagttagtttaaggggcattgtgcaagtagtggaattgttaggtaacgaaacccagattcatttagaaattccggaaattaaacaaccgtctttaatttatcgccaaaacgacgtgatactagttaatgaaggcgatgaaatgaacatcggtattgtgccggagcgttgtcatctgtttaaagaagacggcacagcctgccaacgtttatttgcggaaaaaggcgtataa

SEQ ID NO: 37203 - protein, 372 aa, Mannheimia succiniciproducens MBEL55E
MANVSLRNVGKSYGDVHISKDINLEINEGEFVVFVGPSGCGKSTLLRMIAGLEDITTGELYIGEKLMNDVEPSKRGIGMVFQSYALYPHLDVADNMSFGLKLAGVKKNERDQRVNQVAEILQLAHLLDRKPKALSGGQRQRVAIGRTLVSQPEVFLLDEPLSNLDAALRVQMRVEISKLHKKLNRTMIYVTHDQVEAMTLADKIVVLNAGGVAQVGKPLELYHYPANRFVAGFIGSPKMNFLPVKVTAVEENQVKIELPDANHHNFWIPVSGEGVNIGENLSLGIRPEHLVPAEQAQVSLRGIVQVVELLGNETQIHLEIPEIKQPSLIYRQNDVILVNEGDEMNIGIVPERCHLFKEDGTACQRLFAEKGV

SEQ ID NO: 37204 - DNA, 1107 bp, Bacillus licheniformis ATCC 14580
  CDS (1)..(1107)
atggcggaactcgtgctcgatcggatatacaaagtgtatgacaacaaagttacggctgtggataattttaatcttcatatcgaggataaggaatttatcgtctttgtcggaccgtcaggctgcggcaagtcgacaacgctcagaatgatcgcaggccttgaggaaattacggatggcgaattcacaatcgacggcaaacggatgaatgatgtcgctcctaaagaccgcgacattgcgatggtattccaaaactatgccctgtatccgcacatgaacgtctatgacaatatggctttcggcttgaagctgcggaagtttccgaaggatgaaatcaaacggcgtgtccatgaagcggccaaaattctgggccttgaacaatatttggatagaaagccaaaagcgctttccggcggacagcgccagcgcgtcgccttaggccgggcaattgttcgggatgcaaaggtgttcttgatggatgagccgctatcaaaccttgatgccaaattgcgcgtacaaatgcgcgcggaaatcacaaagcttcatcagcgtctgcagacgacgaccatctatgtcacccacgaccagacggaagcgatgacgatggctacgcggctcgtcgtcatgaaagacggaatcatccagcaggtcggggcgccgaaggaagtctacgaaaatccggaaaacgtgtttgtcggcggctttatcgggtctcctgcaatgaacttctttaccggcactctgaaagaagacatgtttacattcgacggcgtttcggttcgcgtgccggaaggaaaaatgaaagttctgcgcggccagggttatgtcggcaaggaaatcatcatgggaatcaggcctgaagatatccatgatgaacctgttttcattgaagcgtcaaaagactcgaaagtcgatgcgaaaattgaggtagccgagctgatgggcgcggaaacgatgctttattcgcaggccggcactcagccgtttatcgccagagtcgattcaaggaccgacgttcaggccggcgatacgattccactggcgcttgacatgaataaagctcacttttttgataaagaaacggagctccgcatccgctctgaaggataa

SEQ ID NO: 37205 - protein, 368 aa, Bacillus licheniformis ATCC 14580
MAELVLDRIYKVYDNKVTAVDNFNLHIEDKEFIVFVGPSGCGKSTTLRMIAGLEEITDGEFTIDGKRMNDVAPKDRDIAMVFQNYALYPHMNVYDNMAFGLKLRKFPKDEIKRRVHEAAKILGLEQYLDRKPKALSGGQRQRVALGRAIVRDAKVFLMDEPLSNLDAKLRVQMRAEITKLHQRLQTTTIYVTHDQTEAMTMATRLVVMKDGIIQQVGAPKEVYENPENVFVGGFIGSPAMNFFTGTLKEDMFTFDGVSVRVPEGKMKVLRGQGYVGKEIIMGIRPEDIHDEPVFIEASKDSKVDAKIEVAELMGAETMLYSQAGTQPFIARVDSRTDVQAGDTIPLALDMNKAHFFDKETELRIRSEG

SEQ ID NO: 37206 - DNA, 1119 bp, Burkholderia mallei ATCC 23344
  CDS (1)..(1119)
atggcaagcctttccatccgtgacgtgtacaagacctacccgaacggcgtgcccgtcctgaagggcgtcgacatcgacatcgaggacggtcagttcctgattctcgtcggcggctcgggctgcgggaagtcgacgctgctcaacatgatcgcgggcctcgagaccgtgacgaagggcgagatccggatcggcgataaggtcgtcaacgatctgtcgccgaaggatcgcgacatcgcgatggtgttccagtcgtacgcgctctatccgtcgatgacggtgcgcgagaacatctcgttcgggctgaacatccgcaaggtgccgaagaacgagcagaagcagatcgtcgatcgcgtcgccgcgatgctgcagatcgagcacctgctcgagcgcaagccgggccagctctcgggcggccagcggcagcgcgtcgcgatgggccgcgcgctcgcgcgcgacccggcgctgttcctgttcgacgagccgctgtcgaacctcgacgcgaagctgcgcatcgagatgcgcgccgagatcaagctcttgcatcagcgcctcggcacgacgatcgtctacgtgacgcacgaccagatcgaggcgatgacgctcggcgaccggatcgcggtgatgaaggacggcgtcgttcagcagttcggcgcgccgcaggacatctacgatttgccgtcgaacctgttcgtcgccggcttcatcggcgcgccgccgatgaacttcatcaacggcaagctcgtcgagcagggcagcggcgtgggcatcgagctcgatacgggcgcgatgcgcggcgtgctgaacctgccgttcgacgcgaagcggatgaacggccacgtcggccgcgacgtgatcctcggcctgcggccggagcggatcaccgatgcgcgtagcgcgcacaacggcgagggcgcgcgcctgcagcccgtcgacgtgacggtcgacgtgaccgagccgacgggccccgacacgcacgtgttcgcccaggtcaacggcaagcggatcgtgagccgcgtgcatccggccgcgaacccgcagccgcagcagaagctgtcgctgttgttcgacgtatcgaaggcggtgctgttcgatccgtcgacggaggcgcggatcgcgtga

SEQ ID NO: 37207 - protein, 372 aa, Burkholderia mallei ATCC 23344
MASLSIRDVYKTYPNGVPVLKGVDIDIEDGQFLILVGGSGCGKSTLLNMIAGLETVTKGEIRIGDKVVNDLSPKDRDIAMVFQSYALYPSMTVRENISFGLNIRKVPKNEQKQIVDRVAAMLQIEHLLERKPGQLSGGQRQRVAMGRALARDPALFLFDEPLSNLDAKLRIEMRAEIKLLHQRLGTTIVYVTHDQIEAMTLGDRIAVMKDGVVQQFGAPQDIYDLPSNLFVAGFIGAPPMNFINGKLVEQGSGVGIELDTGAMRGVLNLPFDAKRMNGHVGRDVILGLRPERITDARSAHNGEGARLQPVDVTVDVTEPTGPDTHVFAQVNGKRIVSRVHPAANPQPQQKLSLLFDVSKAVLFDPSTEARIA

SEQ ID NO: 37208 - DNA, 1071 bp, Methylococcus capsulatus str. Bath
  CDS (1)..(1071)
atgggcagtatcgcattcgaacgcctgagcaaaacctacccgggcggttttgccgcgctgtccgacctgagtctcgacatcgccgacggcgaactcctggtcgtcgtcggaccgtcggggtgcggcaaatccacgctgttgcgactgatcgccgggctggaccgccccaccgccggctcgatccggatcggcggcacggacgtgaatgcgctcgcgcctgcggagcgcaacgtcgccatggttttccaggattacgcgctctatcccaacatgacggtgaggggcaacctcgaatttccgctgaagatgcgccgcatcggtcgagccgaacgccggcgccggatcgagcaggtggccgggatgctcgaactcatgccgctgctcgaccgccgccccgcccagctctcgggcggccagcgtcagcgcgtggccatgggacgggcgctggtccgcgatccctcggtgttcctgctcgacgaacccctcgccaacctggacgcccgtctgcgcgcgcaggttcgtgccgacattgccgaactgcagcggcggacggggacgaccatgatctatgtcacccacgaccaggtcgaggccatgaccctgggccagcgcatcgcggtcctcgccggcgggcggttgcaacaggccgcctcgccccgggaactctatgcccatccggccaacactttcgtcgccggtttcataggcaatccacccatgaatctcctgccggttcggatcgggcgctccggcgagaccgtcctccccgatttcggcggcgtgccactgccgggcagggcggatgcgccgaaagatgcagctatcgccggcatccggccggaagctgtccgcctggcggaaacgtcgtccgaggggatcgccgtccgcgtccgggaggtggaatatctcggccatgaaaccttgctgcatttcacccatgaagcgggagcggccagcctcatcgcccgccttcccggtctgccgccctttggccgcggcgatgccgtccgtctcgggatggcgccggaagactggcatttcttcgatcggagcggtcaggcgttgggctga

SEQ ID NO: 37209 - protein, 356 aa, Methylococcus capsulatus str. Bath
MGSIAFERLSKTYPGGFAALSDLSLDIADGELLVVVGPSGCGKSTLLRLIAGLDRPTAGSIRIGGTDVNALAPAERNVAMVFQDYALYPNMTVRGNLEFPLKMRRIGRAERRRRIEQVAGMLELMPLLDRRPAQLSGGQRQRVAMGRALVRDPSVFLLDEPLANLDARLRAQVRADIAELQRRTGTTMIYVTHDQVEAMTLGQRIAVLAGGRLQQAASPRELYAHPANTFVAGFIGNPPMNLLPVRIGRSGETVLPDFGGVPLPGRADAPKDAAIAGIRPEAVRLAETSSEGIAVRVREVEYLGHETLLHFTHEAGAASLIARLPGLPPFGRGDAVRLGMAPEDWHFFDRSGQALG

SEQ ID NO: 37210 - DNA, 1068 bp, Nocardia farcinica IFM 10152
  CDS (1)..(1068)
gtggccacggttaccttcgagcgcgccacccggctctacccgggggcgagcaagcccgccgtcgatcgcttggaactggagatcgccgacggcgagttcctggtcctggtcggcccgtccggatgtggcaagtccacctcgctgcggatgctggccggactggaggaggtgagcgacgggcgcatcctcatcggtgcgaaggacgtgacccacgccgaacccaaggatcgcgacatcgcgatggtgttccagaactacgccctctacccgcacatgacggtggccgagaacatgggcttcgcgctgaagctggccaaggtcggtaaggcggagaaggagcagcgggtgcgggaggcggccgcgctgttggacctcgagccctacctggaccgcaagcccaaggcgctgtccggcgggcagcggcagcgggtggcgatgggccgggcgatcgtgcggcagccgcaggtgttcctgatggacgagccgctgtcgaacctcgacgccaagctgcgggtgcagacgcgcacccagatcgcgcagttgcagcgcaggctgggcaccaccacggtctatgtcacccacgatcaggtggaggccatgacgatgggtgaccgggtcgcggtgctgaaggacggcctgttgcagcagtgcgccagcccgcgcgatctctaccgcgatccggccaacgccttcgtggccggattcatgggctcaccggcgatgaacatgttcacgctgccgatccaggacggcgcggtgctgctcggcggataccggctgccggtgccgcgctcggtggccgacgcggcgggcgccacggcacaggtcgggatccggccggagcacttcgagatcggcggctcggggatcgagatggaggtcggggtcgtcgaggagctcggctcggacgcctacgtctacgggcggaccatcggcgacgcgggcgagaccatcgtggcacgcgcggactggcgcaatccgcccgccaagggcgagcggctgttcctgtcgacctcgcccgagcacgtctatttcttcggcgccgacgacggccgccgactcaactga

SEQ ID NO: 37211 - protein, 355 aa, Nocardia farcinica IFM 10152
MATVTFERATRLYPGASKPAVDRLELEIADGEFLVLVGPSGCGKSTSLRMLAGLEEVSDGRILIGAKDVTHAEPKDRDIAMVFQNYALYPHMTVAENMGFALKLAKVGKAEKEQRVREAAALLDLEPYLDRKPKALSGGQRQRVAMGRAIVRQPQVFLMDEPLSNLDAKLRVQTRTQIAQLQRRLGTTTVYVTHDQVEAMTMGDRVAVLKDGLLQQCASPRDLYRDPANAFVAGFMGSPAMNMFTLPIQDGAVLLGGYRLPVPRSVADAAGATAQVGIRPEHFEIGGSGIEMEVGVVEELGSDAYVYGRTIGDAGETIVARADWRNPPAKGERLFLSTSPEHVYFFGADDGRRLN

SEQ ID NO: 37212 - DNA, 1143 bp, Photobacterium profundum SS9
  CDS (1)..(1143)
ttgcaggcaacacaacttagaggaaaaggctcgatgacgagtgtcactttacgaaatgtatgtaaagcatatggagataacctgatttccaaaaatgttgatctcgagatcgctgaaggggaatttgtagtatttgttggtccatcaggctgtggtaaatcaactcttcttcgttgcatcgctggtttggaagatatcacgtcgggcgatttatacttcggcaaagaacgcatgaatgacgttccgccttctgatcgtggggttgggatggtattccaatcatatgctctttatccgcacttaaatctcttcgacaacatgtctttcggtatgaaattagccaaagcagataagagcgagatcaaaaagcgcgttaataacgcagctgatattcttcagcttggacacttacttgaacgccaacctaaatcgctttctggtggtcaacgtcaacgtgttgcgattggtcgtaccattgtgtctcagcccaatgtcttcctacttgatgaaccactatcgaatctagatgccgcgcttcgtgttcaaatgcgcatcgaaattgctaagctgcacaaacagctcggctgtaccatgatctacgtaacgcatgatcaagtagaagcaatgaccatggctgaaaaaattgtggttcttgatggtggttatgtttctcaggtaggtaaaccattagagttataccattatccacagaatcgctttgttgctggcttcatcggctcaccaaagatgaacttcatgagtgtgtttatcgaacaagttgaagatgagcgcgttatggtacaaacggctgatggaaaagcattctggatccctgttgacggcacaacagtcacgaaaggcgaccgtatgtcactgggtattcgccctgaacaccttgtatctgctgaagaaggtgatacaagcatcgaaggtacagtacaagttgtcgagaagctaggctacgaaactcaagtctatatccacctagatcacgtggatgcagatttcatctatcgtcgcccggatacactacaagtagaagctggtgatagctttaaagtgggcatacctgcacaccgttgtcatttattccatagcgatgggcgtgcctgccgtcgtctataccaagaagctggcatataa

SEQ ID NO: 37213 - protein, 380 aa, Photobacterium profundum SS9
MQATQLRGKGSMTSVTLRNVCKAYGDNLISKNVDLEIAEGEFVVFVGPSGCGKSTLLRCIAGLEDITSGDLYFGKERMNDVPPSDRGVGMVFQSYALYPHLNLFDNMSFGMKLAKADKSEIKKRVNNAADILQLGHLLERQPKSLSGGQRQRVAIGRTIVSQPNVFLLDEPLSNLDAALRVQMRIEIAKLHKQLGCTMIYVTHDQVEAMTMAEKIVVLDGGYVSQVGKPLELYHYPQNRFVAGFIGSPKMNFMSVFIEQVEDERVMVQTADGKAFWIPVDGTTVTKGDRMSLGIRPEHLVSAEEGDTSIEGTVQVVEKLGYETQVYIHLDHVDADFIYRRPDTLQVEAGDSFKVGIPAHRCHLFHSDGRACRRLYQEAGI

SEQ ID NO: 37214 - DNA, 1137 bp, Photobacterium profundum SS9
  CDS (1)..(1137)
atgagcaagatttcattaagaaacatcaacaaaaaatacccgaattctgatacgtgctcggtacgtgatttcaatttagacattgaagacggtgaatttattgtccttgtcggcccatcaggctgtggcaaatccaccactttgcgcatgattgcaggactagaagacatcaccgatggcgagttccttattaatggcgaagtcgtgaatgacgtcagttcaaaagatcgtgatattgcgatggttttccagagctatgcgctttacccgcacatgtcagttcgtgacaacattggttatggcttaaagctacgtaattatccaggcaatgagattaaagcgtcggttgataatatctctgaagatcttttcttaaccgaataccttgagcgtaaaccgaaagaactctctggtgggcagcgtcagcgtgttgctcttggccgtgcaatggttcgtacgccaaaattgtatttgatggatgaaccattaagtaacttagatgcgaaattacgtaccactactcgtactgaaatctctcgtatgcacaaagacaaaggtgcgatcacaatttacgtaacgcatgaccaagttgaagcaatgactatggcagatcgcatcgtattaatgtcgatgggtgaaattcaacaaattggctctccaaaagaactatttaccaaccctaaaaactgctttgtggcgactttcatgggcatgccatcaatgaacttgattgaaggaacatacgaaggcggtcaattcacttgtcaatctttcactattaccttaaatgagagcgatcaacaaattctaaatgatgcgggttataacggtaaatcagtcactttaggtgcacgttcaagtgccattcgttctggtaaaaaatatcgcgatgctttccctgattgctgctttgaaaccacagcaatgaacagtgaatacttaggagatgctatcaatgtgttcttcaatgccgcaccaatgaacctatttgttggcacattaggaacaggcgaacccgatgtggcgattgatgaaaagatcaccttagttatcgacaataccaagctgcatttttttgataccaaaaccgaagaatcgatcaagtattcaataaaatcagctgagttcaaaaaataa

SEQ ID NO: 37215 - protein, 378 aa, Photobacterium profundum SS9
MSKISLRNINKKYPNSDTCSVRDFNLDIEDGEFIVLVGPSGCGKSTTLRMIAGLEDITDGEFLINGEVVNDVSSKDRDIAMVFQSYALYPHMSVRDNIGYGLKLRNYPGNEIKASVDNISEDLFLTEYLERKPKELSGGQRQRVALGRAMVRTPKLYLMDEPLSNLDAKLRTTTRTEISRMHKDKGAITIYVTHDQVEAMTMADRIVLMSMGEIQQIGSPKELFTNPKNCFVATFMGMPSMNLIEGTYEGGQFTCQSFTITLNESDQQILNDAGYNGKSVTLGARSSAIRSGKKYRDAFPDCCFETTAMNSEYLGDAINVFFNAAPMNLFVGTLGTGEPDVAIDEKITLVIDNTKLHFFDTKTEESIKYSIKSAEFKK

SEQ ID NO: 37216 - DNA, 1161 bp, Haloarcula marismortui ATCC 43049
  CDS (1)..(1161)
atggcaaagatcacaatcgacgacgttacgaagcgattcggtgagggagatgagtcaatcatcgcggtcgacgacgtctcgctggacatccgcgatggcgagttcatcgtcttcgtcggtccgtccgggagcgggaagtccacgctcatgcgcatcgtcgcagggctggaaacgcaaacggaaggcgacattcacatcggcgacgacctcgtcaatcagctcggcccgcgagcccgggacatcgcaatggtgttccagaactacgcgctataccccaacatgaccgtcgaagagaacatgtccttcgggctgaagatgtcgacggacatgtccgccgacgaggttgaagaagccgtcacgtccgccgccgagatgatggacatcgacatgctgttggacgacaagcccggcgaactctccgggggacaacaacagcgtgtcgcgctcggccgcgctatcgtccgtgacccgaacgtcttcctgatggacgagccgctgtcgaacttagacgcgaagcttcgggcggagatgcggaccgagatcaaccggctccagaacgaccttgacgtgaccacgctgtacgtcacccacgaccagacagaggcgatgacgatgggcgaccggcttgtcgtcctcaactacggggaactccagcaggtcgggacgccgctggaatgtttctaccgtccggccaaccagttcgtcgccggcttcctcggctcgccgtcgatgaacttcttcgagggcaacgtcgagggcggaacgctccgcgcggacggcttcgacttcgacctgaccaagcggatgcagtccgctgttagcagtcgaaacgaactcgtcctcggtatccggccggaagacatgacgcttcacgaccgggcgaactcgggccacgagttcgaggccgtcgtcgacgtcgtcgaaccgatggggagtatctcctacgtctatctccgggcgcggtcacagagccacgaccagacgttcatcgtcgagacggacggccagcgcccgatcagcgagggccaacacgtctacgtcgagattccggatcgggacgtacacctgttcgacgccgccagcggcgagacgatccaccagcgccagctcggtgacgacgcggaaatggcgctcgaagagcaaataaaacccgccgagtga

SEQ ID NO: 37217 - protein, 386 aa, Haloarcula marismortui ATCC 43049
MAKITIDDVTKRFGEGDESIIAVDDVSLDIRDGEFIVFVGPSGSGKSTLMRIVAGLETQTEGDIHIGDDLVNQLGPRARDIAMVFQNYALYPNMTVEENMSFGLKMSTDMSADEVEEAVTSAAEMMDIDMLLDDKPGELSGGQQQRVALGRAIVRDPNVFLMDEPLSNLDAKLRAEMRTEINRLQNDLDVTTLYVTHDQTEAMTMGDRLVVLNYGELQQVGTPLECFYRPANQFVAGFLGSPSMNFFEGNVEGGTLRADGFDFDLTKRMQSAVSSRNELVLGIRPEDMTLHDRANSGHEFEAVVDVVEPMGSISYVYLRARSQSHDQTFIVETDGQRPISEGQHVYVEIPDRDVHLFDAASGETIHQRQLGDDAEMALEEQIKPAE

SEQ ID NO: 37218 - DNA, 1128 bp, Haloarcula marismortui ATCC 43049
  CDS (1)..(1128)
atgatgattgcgatgcttcttctactcggtatgagcgaagttacactatcaaacgtcagcaaggtatacgacgacgatgtccttgcagttgaggacctttctctggccgtcgaggacggtgagtttgtcgtcgttgtcggcccatccggatgtgggaaatcgaccacacttcggatgattgctgggctcgaaacagtcaccgacggtgagattgctatcggggggagcgtagtcaacgacgttcgtccacaggaccggaacattgcgatggtgttccagagctacgcactgtacccgcatatgaccgtgcgcgataacatgtccttcgggctccgactgtcaggcgagtacgatgatcaaatcgaacagcgcgtgactgaggccgccgaactgctggagattgcggacctcatggacgacctgccgaagcaactctcgggtggccagcaacagcgtgtcgcacttgggcgggctattgtccgcgacccggacgtgtttctgatggacgaaccgctgtcgaatctcgacgcgaagcttcggacacagatgcgcacggagatccagcggatccaagaagagttggacgtgacgacgatttacgtcacgcacgatcagacggaagcgatgacgatggccgaccggatcgtgattctcaatcagggtgaactccagcaggtcgcgccaccggaacgctgctacgatgagcccaacaacaaatttgtcgcggggttcatcgggtcaccatcgatgaacttcttcgaagcgagtgtaaccaatagcggcgggcacgcgacgttccactcgtcaaatattgagtttacgctcaacgtcgacattccggacggggagtacacgctgggcgtccgcccggaagatttcgtcgccgaggacgccggcgagtacatcaatacagttgtcgatgtcgtagaaccaatggggtctgacaacttcctctatctggagactgcaggcgggtcgaaagaagtcgttgcccgggtcagtagcgaataccgcccagaacggggcgacaaaatcgcgctcgggtttcatacagaggatatgcatctgttcggtccagatggcgagcgtgtggaactgaatcagttgcagcggacagagtcggtgtaa

SEQ ID NO: 37219 - protein, 375 aa, Haloarcula marismortui ATCC 43049
MMIAMLLLLGMSEVTLSNVSKVYDDDVLAVEDLSLAVEDGEFVVVVGPSGCGKSTTLRMIAGLETVTDGEIAIGGSVVNDVRPQDRNIAMVFQSYALYPHMTVRDNMSFGLRLSGEYDDQIEQRVTEAAELLEIADLMDDLPKQLSGGQQQRVALGRAIVRDPDVFLMDEPLSNLDAKLRTQMRTEIQRIQEELDVTTIYVTHDQTEAMTMADRIVILNQGELQQVAPPERCYDEPNNKFVAGFIGSPSMNFFEASVTNSGGHATFHSSNIEFTLNVDIPDGEYTLGVRPEDFVAEDAGEYINTVVDVVEPMGSDNFLYLETAGGSKEVVARVSSEYRPERGDKIALGFHTEDMHLFGPDGERVELNQLQRTESV

SEQ ID NO: 37220 - DNA, 1197 bp, Haloarcula marismortui ATCC 43049
  CDS (1)..(1197)
atggcacgagtacaactcgaacacgtgacgaaacgctacgacgaccagggtgacgtggtcaccgcggtcgacgacatgaacctcgacatcgaccacggcgagttcatctgcttcgtcggcccctcgggttgcgggaagtcgacgacgatggagaccatcgccgggctcaccatcccgaccgagggtgaaatatacatcggcgaccgcgaggtgacgaacctcccgccgaaggaccgcggcatcgcgatggtgttccagaacatcgcgctgttcccgcacatggacgtgtacgacaacatatccttcgggctgcggctgcgggactatccacaggacgagattgaccgacgggtcgagcgagccgcggacatcgtccagctagaggggatgctcaaccggatgcccgaggagatgtccggtggacagcgtcagcgcgttgccatcgcccgcgctatcgtgcgcgagcccgacgtgttcctgatggacgagccgctggcgaatcttgacgcgaagctcaaggtccacatgcgaacagagctccagcgcctgcacaaggagctggacacgactatcatctacgtgacccacgaccaggaggaggcgatgacgctgtcagaccggatcgctgtcctcgattcgggccaactccagcagatcgacccgccgctgacctgctacaacgagccggataacctcttcgtcgccgggttcatcggctcgccgtcgatgaacttcgtcgaagggacagtcactgagaccacactggagacgccgaacttctcgctcgagttcaatccgtcgtctatcgaaggtgttggagtcggtgacaatgtgacgcttggcatccgcccggaggacatctatccgggcgacctccagtcggaggttcccgatccctcgggaatgattacggcgacgacagacattctcgaacccatgggcgacgaaatattcgcctacctgctgctgggcgacggcgaaacgtcgatgtctcaggaactggcgacgaacgaccagttgctgatgagtatcgaccccgactcggatcttgaagaggacgaagagctgggggtcgtcatcgaccgacggaacgttcacctgtttgactcggctaccggagaggcaatcgtccacgacctcattccgtacgaggccgaaggtactgcatccagtagcgaagtagaatcagacgactga

SEQ ID NO: 37221 - protein, 398 aa, Haloarcula marismortui ATCC 43049
MARVQLEHVTKRYDDQGDVVTAVDDMNLDIDHGEFICFVGPSGCGKSTTMETIAGLTIPTEGEIYIGDREVTNLPPKDRGIAMVFQNIALFPHMDVYDNISFGLRLRDYPQDEIDRRVERAADIVQLEGMLNRMPEEMSGGQRQRVAIARAIVREPDVFLMDEPLANLDAKLKVHMRTELQRLHKELDTTIIYVTHDQEEAMTLSDRIAVLDSGQLQQIDPPLTCYNEPDNLFVAGFIGSPSMNFVEGTVTETTLETPNFSLEFNPSSIEGVGVGDNVTLGIRPEDIYPGDLQSEVPDPSGMITATTDILEPMGDEIFAYLLLGDGETSMSQELATNDQLLMSIDPDSDLEEDEELGVVIDRRNVHLFDSATGEAIVHDLIPYEAEGTASSSEVESDD

SEQ ID NO: 37222 - DNA, 1131 bp, Haloarcula marismortui ATCC 43049
  CDS (1)..(1131)
atggcacacgtagaactcaccgacctcgtaaaggaattcgacgacgttacggcagttgatggcatctcgctggacatccccgacgaaagtttcactgtcctcgtcggcccgtcagggtgtgggaagaccacgactctgcgcctcatcgcggggctcgaacgggcgaccgacggtgaaatcagaatcggcgagaatgtcgtcaacgacgctcgcgcatacgagcgggacatcgcgatggtgttccagaactacgcgctgtatccgcacaagacggtgcgggacaacatgcggttcgggctggagcaacacgacacggacgaagagatcatcaccgaacgagtccgagagacagcggagctgctacagatcgaagagttactggaacggcggccgtcggagctatccggcggtcagcaacagcgggtcgcgctgggccgcgcaatcgtccgtgacccggcagtgttcctgatggacgagccactgtcgaacttagacgcgaagctccgcgtccagatgcgcgccgaactgaacaaacttcacgaggaactctcgacgacgactgtctacgtcacccacgatcaggtggaggcgatgaccctggccgaccagatcgcagtcatggacaacgggcagatacagcaggtcggcgaaccgacgcacgtgtactcgaacccgcggaacatgttcgtcgccggattcctcggctcaccgagcatgaacttcctcgaaggcacgctcgaagagtcgtctgccggcaagttcgaactggacctcggcggcgctatccacaacgttcccgacgagttcaccgatgcgctcagctcgtatctcggagaccgcgtgacgctgggcatccgcccggagaacatcgcgcttaatcaggacggcgtcccggcgaacgtccacccggcaacagtggaggtcgtcgaaccgcagggcgagaagaccgtactcgaactcgaactcgaaaccggccagagcatcaaggccgcggttgaccccgacacgacggtcgagatgggggatgcggtgaacctccggttcgacagggactcgctccagtatttcgatcccgccacgggcgaatcgctcacgtacgacgcgaagatcgaacagcaggcgacgatctga

SEQ ID NO: 37223 - protein, 376 aa, Haloarcula marismortui ATCC 43049
MAHVELTDLVKEFDDVTAVDGISLDIPDESFTVLVGPSGCGKTTTLRLIAGLERATDGEIRIGENVVNDARAYERDIAMVFQNYALYPHKTVRDNMRFGLEQHDTDEEIITERVRETAELLQIEELLERRPSELSGGQQQRVALGRAIVRDPAVFLMDEPLSNLDAKLRVQMRAELNKLHEELSTTTVYVTHDQVEAMTLADQIAVMDNGQIQQVGEPTHVYSNPRNMFVAGFLGSPSMNFLEGTLEESSAGKFELDLGGAIHNVPDEFTDALSSYLGDRVTLGIRPENIALNQDGVPANVHPATVEVVEPQGEKTVLELELETGQSIKAAVDPDTTVEMGDAVNLRFDRDSLQYFDPATGESLTYDAKIEQQATI

SEQ ID NO: 37224 - DNA, 1113 bp, Geobacillus kaustophilus HTA426
  CDS (1)..(1113)
atggcagaactcattcttgatcatatttacaaaatttacgacaacaatgtggtcgccgtcaaagacttcaatttacatattcaagacaaagagtttatcgtatttgtcggcccgtccggctgcggcaaatccaccacgttgcggatgatcgccggccttgaggaaatttccaaaggcgatctttacatcgacggcaaacgaatgaacgatgtgccgccgaaagaccgcgacatcgccatggtgttccaaaactacgctctgtatccacatatgagcgtctatgacaacatggcgttcggtttaaaactgcgcaaattcccgaaagcggaaattgacaaacgcgtccgcgaggcggcgcgcattcttgggctcgagcaatatttggaccgcaaaccgaaagcgctctccggcgggcagcggcagcgcgtggcattgggacgggccatcgtccgcgatgcaaaagtgtttttaatggacgagccgctctcgaacttggatgcgaaactgcgggtgcaaatgcgctcagagatcgcgaagctccatcagcgcttggaaacgacgaccatttacgtcacccacgaccaaacggaagccatgacaatggccacccgtcttgtcgtcatgaaagacggcgtcatccagcaagtcgggacgccgcgcgaggtatacgaaaaaccggaaaacatttttgtcggcggctttatcggttcaccggccatgaacttccttcgtggaacgctgcaagacggcaagtttgtcgtcggccaaacatcgtttggcattccggaaggaaaaatgaaagtgttgcgtgagcaagggtatgtcggcaaggaagtgattttaggcattcgtccggaagacattcacgacgaaccgctcttccttgaagcatctccggcgacgaaagttaccgctctcgtcgaagtcgccgagctgcttggcgctgaatcgatgatctattttagcatcgacaaccaagaattggtcgctcgcatcgacgcccgcacggaaatcaagccgggccaccggattgacctggcgcttgatatgaacaaagcgcatttctttgacgttgaaacggaacggcgcatccgggcggcggatgaaaagtaa

SEQ ID NO: 37225 - protein, 370 aa, Geobacillus kaustophilus HTA426
MAELILDHIYKIYDNNVVAVKDFNLHIQDKEFIVFVGPSGCGKSTTLRMIAGLEEISKGDLYIDGKRMNDVPPKDRDIAMVFQNYALYPHMSVYDNMAFGLKLRKFPKAEIDKRVREAARILGLEQYLDRKPKALSGGQRQRVALGRAIVRDAKVFLMDEPLSNLDAKLRVQMRSEIAKLHQRLETTTIYVTHDQTEAMTMATRLVVMKDGVIQQVGTPREVYEKPENIFVGGFIGSPAMNFLRGTLQDGKFVVGQTSFGIPEGKMKVLREQGYVGKEVILGIRPEDIHDEPLFLEASPATKVTALVEVAELLGAESMIYFSIDNQELVARIDARTEIKPGHRIDLALDMNKAHFFDVETERRIRAADEK

SEQ ID NO: 37226 - DNA, 1002 bp, Silicibacter pomeroyi DSS-3
  CDS (1)..(1002)
atgaccgccctgaccctgagcaatgtgtgcaaatcctttggcccggtcgatgttctcaagaatatcgacctgaccgtcgatgacagcgagttcgtcgtctttgtcggcccctcgggctgtggcaagtccaccctgctgcgggtgatcgcggggctggaggaggcgacctcgggcagcatcgacatcgggggccaggtggtcaacgccgtgcccccggccaagcgcggcattgccatggtgttccagtcctatgcgctctatccgcacctgaccgtgtacggcaacatggcgctgggcctgaagcaggcgggccatccaaaggacgagatcgagcgcaggattgccgaggctgcgcggatgctgtcgctggaggcctatctggcgcgccgcccgtccgagctgtcgggcggccagcgccagcgtgtcgccatcggccgcgccatcgtgcgcaagcccaagctgttcctgttcgacgaaccgctgtcgaacctggacgccgccctgcgcatgaacacccggatcgagatcgccaatctgcaccggcaactgaccgcctcgatgatctatgtcacccatgaccagaccgaggcgatgacgctggccgacaagatcgtcgtgctgcgcgatggccgggtcgaacaggtgggcagcccgcttgagctttacaacaatcccgcaaaccgctttgtcgccgagttcatcgggtcgccggccatgaatttcgtggccgccgaccgggtgggcgggccggtgggcgccacgctgggcatcagacccgaacatgcccgcatcggcgacaccggcccgctatcagggcaggtcatccatatcgaaaagctgggtggcgacaccaatgtgatgctcgacctggggcaggacagccggttcaccgttcgcgtctttggccaatacgagatcgacccgggcgccgaggtcaagatcgactatgacccggcgcgcacgctgctgttcagcgccgagggcaagcgccttgccggctga

SEQ ID NO: 37227 - protein, 333 aa, Silicibacter pomeroyi DSS-3
MTALTLSNVCKSFGPVDVLKNIDLTVDDSEFVVFVGPSGCGKSTLLRVIAGLEEATSGSIDIGGQVVNAVPPAKRGIAMVFQSYALYPHLTVYGNMALGLKQAGHPKDEIERRIAEAARMLSLEAYLARRPSELSGGQRQRVAIGRAIVRKPKLFLFDEPLSNLDAALRMNTRIEIANLHRQLTASMIYVTHDQTEAMTLADKIVVLRDGRVEQVGSPLELYNNPANRFVAEFIGSPAMNFVAADRVGGPVGATLGIRPEHARIGDTGPLSGQVIHIEKLGGDTNVMLDLGQDSRFTVRVFGQYEIDPGAEVKIDYDPARTLLFSAEGKRLAG

SEQ ID NO: 37228 - DNA, 1305 bp, Synechococcus elongatus PCC 6301
  CDS (1)..(1305)
gtgatcaatgaactgcatggcggtgaggaatcaaactttcattttaggcggttgccgcgctcggccgctcgagtcacgagtgctaagctgttcccgacctttggccgggattgcaacgtggctggcgttgtttttgaagagatcgagaagcgttttccagaacaggcccgatcgccccagaaaggcgaagttgtcgtcctgaatggcatcaatctcgaaattgccgacggcgaatttatggtcgtggtcggtccttcgggctgtggcaaaagtacgctgttacggctgctggcaggtctggagacgcccagccgaggcttgatcaaagtgggcgatcgccgagtcgatcgactgcctgccaaggctcgcgatattgccatggtctttcagagctacgcgctctatccccacctcagcgtctacgacaatctggcctttggactgcgacggcagggcgatcgcccttggtggcaacagcaactggctctggcgacgcgatcgctgccgaaatccttgcagtatgaaccggagcaggaagcgcggatcaagcggcgggtacgggaagtggccacaatgctgcagctcgatacgttgctcgatcgccagcccaaacaactctcgggcggccaaaaacaacgggtcgctttgggacgggcgatcgctcgtaatccccaagtctttttgatggacgagccgctttcgaatttggatgcgaaattacgggccgaaacccgcgctcagatcgtttcgctccagcggcaactgggtgtgacgacgctctacgtcacccacgatcagaccgaagcaatgaccatgggcgatcgcattgcggtgttgaatcgtggtcatctgcaacaggttgcttcgccgctggaaatctacgatcgccccgccaatcgatttgtggcgcaattcattggatcgccgccgatgaacctaattcccgtcaccgtgcgggcacccctgcaactgacgactgaaaactttcgctgcacactgccggaagcttgggagccggtgttgcgcctttacgacggccaaacggtggagctcggcattcgcccagagcatttggaagtgggggctgccgcctcgaagaacttgctgatcactgtaacgggcgtcgaagccctcggcagcgatacctttatcgctggtgaactcaaagagagtggcatcgcggttcaggcccgcttggcaccgcaacaatgctggcagatgggcgatcgcctctggctaaccttcaagcccgatcagattcatctgtttgatttagaaactggaaaagcgattcgccccagctag

SEQ ID NO: 37229 - protein, 434 aa, Synechococcus elongatus PCC 6301
MINELHGGEESNFHFRRLPRSAARVTSAKLFPTFGRDCNVAGVVFEEIEKRFPEQARSPQKGEVVVLNGINLEIADGEFMVVVGPSGCGKSTLLRLLAGLETPSRGLIKVGDRRVDRLPAKARDIAMVFQSYALYPHLSVYDNLAFGLRRQGDRPWWQQQLALATRSLPKSLQYEPEQEARIKRRVREVATMLQLDTLLDRQPKQLSGGQKQRVALGRAIARNPQVFLMDEPLSNLDAKLRAETRAQIVSLQRQLGVTTLYVTHDQTEAMTMGDRIAVLNRGHLQQVASPLEIYDRPANRFVAQFIGSPPMNLIPVTVRAPLQLTTENFRCTLPEAWEPVLRLYDGQTVELGIRPEHLEVGAAASKNLLITVTGVEALGSDTFIAGELKESGIAVQARLAPQQCWQMGDRLWLTFKPDQIHLFDLETGKAIRPS

SEQ ID NO: 37230 - DNA, 1113 bp, Bacillus clausii KSM-K16
  CDS (1)..(1113)
atgaaacaagtggaattaatcaatgcaacaaagtcatatgacaaagagacaaatgtcctaaatgaaattgaccttgaaattgaacaaggggaattttttgtgctagttggcccctctggctgtggcaagagcacattgctcagaatgatagctggtctagaagaaatgacgggggggatcttaaaaataaacggcagggaagcaaataggcttgccccgaaagaccgcaacctatcgatggttttccaaaattatgcgttataccctcacttatctgtagaacaaaatattctatttggcttacatgcaaaaaaagtgaacaaagaggaaggcaaacggcgtttgcaagaggcggccgagatgatgggacttacgacgctgttaaagcgaaagccgagggaactttcaggcggtcaacggcaacgggtagcgctagcacgcgctgttgtcagtgaagctccactgtgcttgatggatgagccgctctcaaatcttgacgctaaactaagggcgcatatgcgcattgaaatccggagattgcagcgaaagctcgggctaacgatgatctatgtgacccatgaccaaattgaagcgatgacaatgggcgatcgtattatggtgctaaacgaagggcatatccagcaagtaggcaaaccaattgagttgtataacacaccggcgaacttatttgttgctacgtttattggttctccaaagatgaacataggaaaagcccgtttcgtatcggagaatgggcagctgctcatagaagagacaattgccttgccaatcaaacagccattagacagcaatctagtagaaccgcgattgacgattggcattcgctctgagcacatccgatttgagaaagaaaagccgaccgtcacattgcttgttgctagtgtggaacagctagggaatgagactgttgttgttttcgaagtcggcaaggagttatggacagccaagtggagtgggcaatgggcaattacagccggcgacctcgtaccagtcgcgattgatttggcccatatcagtttctttgactcagtaacaggcaagcttttgaagcctgcaaccaccaatgtccaacaagaggttgtcgctttatga

SEQ ID NO: 37231 - protein, 370 aa, Bacillus clausii KSM-K16
MKQVELINATKSYDKETNVLNEIDLEIEQGEFFVLVGPSGCGKSTLLRMIAGLEEMTGGILKINGREANRLAPKDRNLSMVFQNYALYPHLSVEQNILFGLHAKKVNKEEGKRRLQEAAEMMGLTTLLKRKPRELSGGQRQRVALARAVVSEAPLCLMDEPLSNLDAKLRAHMRIEIRRLQRKLGLTMIYVTHDQIEAMTMGDRIMVLNEGHIQQVGKPIELYNTPANLFVATFIGSPKMNIGKARFVSENGQLLIEETIALPIKQPLDSNLVEPRLTIGIRSEHIRFEKEKPTVTLLVASVEQLGNETVVVFEVGKELWTAKWSGQWAITAGDLVPVAIDLAHISFFDSVTGKLLKPATTNVQQEVVAL

SEQ ID NO: 37232 - DNA, 1110 bp, Rhodobacter sphaeroides 2.4.1
  CDS (1)..(1110)
atggctgatctgaagctgaccggggtcgagaaggcctatggcgaggtgcgcgtcctgcgcgacatcgatctgaccatcgagaagggcgaactcatcgtcttcgtcgggccttcgggctgcggcaagtccacgctcctgcggatgatcgcggggctcgagcggatcagcggcggcacgctcgagatcgacgggcaggtggtcaacgacgtgccgcccgcgcagcgcggcatcgccatggtgttccagagctacgctctgtatccgcatatgaccgtgcggcagaacatggaattcgcgctgaagatcgcgggccagtcgaaggccgagatcgccctcgccgtcgagaacgcggcccggatcctgcagctcacgccctatctcgaccggctgccccgtgcgctctccggcgggcagcgccagagggtcgccatcggccgggccatcgtgcgcgatcccaaggtctatctcttcgacgagccgctctcgaacctcgatgcggcgctccgggtggccacgcggatcgagatcgcccagctcaaggagaagatgcccgaccggacgatgatctacgtcacgcacgatcaggtcgaggcgatgacgctggcaagccggatcgtcgtgctggagggtggcgggatcagccaggtgggcacgccgctcgagctctacacccgcccgcgcaatgccttcgtcgcccgcttcatcggctcgcccgcgatgaacctcctgccgggcgagatcgtcgagaccggccccgagacggtcgtgcggctcgattcaggcggcgtggcgcgcacggcgattccgacgagcccggaggatctggggcttctggtcgatctcggtgtgcgtcccgaagatctggtcaagaccgacggccctccgctctacgagggcgaggtcgagattaccgaggccctgggcgaggtgacgctgctctatttcgtgccgcgcgacgagggcgggcaggtggtggcgaagctgcccggcattcaggccgacctgcgccaccggaccgtgcgcctcggcgccgaccccgcccggctgcacctcttccacgagggccagtccctgctctaccgcgaccggacggagctcgccccggcctga

SEQ ID NO: 37233 - protein, 369 aa, Rhodobacter sphaeroides 2.4.1
MADLKLTGVEKAYGEVRVLRDIDLTIEKGELIVFVGPSGCGKSTLLRMIAGLERISGGTLEIDGQVVNDVPPAQRGIAMVFQSYALYPHMTVRQNMEFALKIAGQSKAEIALAVENAARILQLTPYLDRLPRALSGGQRQRVAIGRAIVRDPKVYLFDEPLSNLDAALRVATRIEIAQLKEKMPDRTMIYVTHDQVEAMTLASRIVVLEGGGISQVGTPLELYTRPRNAFVARFIGSPAMNLLPGEIVETGPETVVRLDSGGVARTAIPTSPEDLGLLVDLGVRPEDLVKTDGPPLYEGEVEITEALGEVTLLYFVPRDEGGQVVAKLPGIQADLRHRTVRLGADPARLHLFHEGQSLLYRDRTELAPA

SEQ ID NO: 37234 - DNA, 1026 bp, Rhodobacter sphaeroides 2.4.1
  CDS (1)..(1026)
atgcgcaagagctatgcggggatcgaggtgatccacggggtcgatttcgagattgcggacggcgaattcgtggtgatcgtgggcccttcgggctgcggcaagagcacgcttctgcgcatggttgcggggctcgaggagatcaccgcgggcgagatcgccatcggcggccgcgtggtcaaccggctggaaccgcgcgagcgcgacatcgcgatggtgttccagaactacgcgctctacccccacatgacggtgcgcgagaacatggcctacggcctgaggatcgcgaagctctcgaaggcggagatcgaggaacgggtcgcgcgctcggccaccatgctggaactgggccagcttctcgaccgcaagccgcgccagctgtcgggcgggcagcggcagcgggtggcgatgggccgggcgctggtgcgcaaccccgcggccttcctgctggatgagccgctctcgaacctagatgcgaagctgcgggtgcagatgcgtttgcagatcaaggagttgcagcgcactgttcgcaccacctcgatctatgtcacccacgatcaggtcgaggcgatgacgctcgccgaccggctggtggtgatgaatgcgggcgtggccgagcagatcgccacgccggccgagatctacgaccggcccgccaccaccttcgtggcggggttcatcggttcgcccgcgatgaacatgctgcccgcccgaggccttggcgacgcgctggaggtggcggggcagcgtctcgccgtgcccgcgccagcgggacgcgatctgatcctcggcgtccggcccgagcatctccatgccgcgggccccgaggagccgggcttcgagctccatgtgcaggcggtcgaatggctgggcgcggacgccttcgctcatggacggctggcggacggcaccgagctcgtgctgcggaccccgggcaaggcgccggtgcgcgagcgcgaccgactgaaggtcgcccccgatgcggcggccctgcatctcttcgatgcagaaaccggccggcggctctga

SEQ ID NO: 37235 - protein, 341 aa, Rhodobacter sphaeroides 2.4.1
MRKSYAGIEVIHGVDFEIADGEFVVIVGPSGCGKSTLLRMVAGLEEITAGEIAIGGRVVNRLEPRERDIAMVFQNYALYPHMTVRENMAYGLRIAKLSKAEIEERVARSATMLELGQLLDRKPRQLSGGQRQRVAMGRALVRNPAAFLLDEPLSNLDAKLRVQMRLQIKELQRTVRTTSIYVTHDQVEAMTLADRLVVMNAGVAEQIATPAEIYDRPATTFVAGFIGSPAMNMLPARGLGDALEVAGQRLAVPAPAGRDLILGVRPEHLHAAGPEEPGFELHVQAVEWLGADAFAHGRLADGTELVLRTPGKAPVRERDRLKVAPDAAALHLFDAETGRRL

SEQ ID NO: 37236 - DNA, 999 bp, Rhodobacter sphaeroides 2.4.1
  CDS (1)..(999)
atgggcaagataaccctgcgcaacgtccagaagcggttcggtgaggcggtcgtcatcccctcgctcgacctcgacatcgaggatggcgagttcgtcgtcttcgtcggcccctcgggctgcggcaaatccacgctgctgcgcctaatcgcgggcctcgaggatgtgtcggacggccagatcatgatcgacgggcgcgacgccaccgagatgccgccggcgaagcgcggcctcgccatggtgtttcagagctacgcgctctatccgcacatgacggtgaagaagaacatcgccttcccgctgcggatggcgaagatggagccgcaggagatcgagcggcgcgtggcgaatgcggccaagatcctgaacctcaccaactatctcgaccgccgccccggccagctctcgggcgggcaacgccagcgggtggccatcgggcgcgccatcgtgcgcgagccggcggccttcctgttcgacgagccgctctcgaacctcgatgccgcgctgcgggtcaacatgcggctcgagatcaccgagctgcaccagtcgctcgagaccacgatgatctatgtcacccacgatcaggtcgaggccatgaccatggccgacaagatcgtggtgctgaacgcgggccggatcgagcaggtgggctcgcccctcaccctctaccgcaatccggcgaacctcttcgtggcgggcttcatcggcagcccgaagatgaacctgatcgaggggccagaggccgcgaaacacggcgccaccaccatcgggatccgccccgagcatatcgacctgtcgcgcgaggcgggggcgtgggagggcgaggtcggcgtctcggaacatctcggctcggacacgttcctgcatgtgcatgtcgcggggatgtccaccctcaccgtgcggacgggcggagagttcggcgtccaccacggcgaccgggtctggctcacgccgcaggccgacaagatccaccgcttcggcgccgacggaaaggcgctctga

SEQ ID NO: 37237 - protein, 332 aa, Rhodobacter sphaeroides 2.4.1
MGKITLRNVQKRFGEAVVIPSLDLDIEDGEFVVFVGPSGCGKSTLLRLIAGLEDVSDGQIMIDGRDATEMPPAKRGLAMVFQSYALYPHMTVKKNIAFPLRMAKMEPQEIERRVANAAKILNLTNYLDRRPGQLSGGQRQRVAIGRAIVREPAAFLFDEPLSNLDAALRVNMRLEITELHQSLETTMIYVTHDQVEAMTMADKIVVLNAGRIEQVGSPLTLYRNPANLFVAGFIGSPKMNLIEGPEAAKHGATTIGIRPEHIDLSREAGAWEGEVGVSEHLGSDTFLHVHVAGMSTLTVRTGGEFGVHHGDRVWLTPQADKIHRFGADGKAL

SEQ ID NO: 37238 - DNA, 1080 bp, Rhodobacter sphaeroides 2.4.1
  CDS (1)..(1080)
atggcacgcatcagtctgcagaagatcgtgaagcggtatggcgggatggaggccatccacggcgtcgatctcgaggtggaggacggcgagttcgtggccttcgtggggccctcgggctgcgggaaatccaccatgctgcggatgattgccgggctcgaggacatcagcggcggccatatgcgcatcggcgaccggctggtgaacgatatcgagcccaagggccgcgacgtggcgatggtgtttcaggattacgcgctctatccgcacatgacggtgcgcgacaacatcggcttcgggctgaagatgcgcggcgagcccgccgagacgattcggaagaaggtcgaggaagccgcgcgcatcctccagctcgaggacctgctcgaccgccgccccggccagctctcgggcggccagcgtcagcgcgtggccatgggccgcgccatcgtgcgcaagcccaaggtcttcctgttcgacgagccgctctcgaacctcgacgccaagctgcgggtcgaaatgcgcacccagatcaagcggctgcaccggatgctgcgcacgacgacgatctatgtgacccacgatcaggtcgaggcgatgacgctggccgaccgcgtggtggttctgcgcaagggcagcatcatccagcacggccgtccgctcgagctctacgagcggccctcctgccgcttcgtggccgaattcatcggctcgccgcagatgaacatcctgccgggtcgcgtggcctcgtcggatcgcggcacggtgatcgaggtgggcggcggcgcgatcccgctttcgcatctgccggtgccggtgggcaccagcctcgatgtgggcctgcgccccgagcatctggagccctgcgcgcccgaggaggccgatttcgtcgcagaggtggacgtgctcgaggagctggggtcggatacgctcgccatctgcctcatgggcgagcgcgagatcaccgtgcgggtgccggccgaccgggcccgcagcctcggccgcacgcagccgctgcgcttcgaccgccagaacctgcatctcttcgatgcggcgaacggccagcggatcgacttcatcgcctga

SEQ ID NO: 37239 - protein, 359 aa, Rhodobacter sphaeroides 2.4.1
MARISLQKIVKRYGGMEAIHGVDLEVEDGEFVAFVGPSGCGKSTMLRMIAGLEDISGGHMRIGDRLVNDIEPKGRDVAMVFQDYALYPHMTVRDNIGFGLKMRGEPAETIRKKVEEAARILQLEDLLDRRPGQLSGGQRQRVAMGRAIVRKPKVFLFDEPLSNLDAKLRVEMRTQIKRLHRMLRTTTIYVTHDQVEAMTLADRVVVLRKGSIIQHGRPLELYERPSCRFVAEFIGSPQMNILPGRVASSDRGTVIEVGGGAIPLSHLPVPVGTSLDVGLRPEHLEPCAPEEADFVAEVDVLEELGSDTLAICLMGEREITVRVPADRARSLGRTQPLRFDRQNLHLFDAANGQRIDFIA

SEQ ID NO: 37240 - DNA, 1122 bp, Rhodobacter sphaeroides 2.4.1
  CDS (1)..(1122)
atggccgaactgacgctgcgccaggtgcgcaagacctatggctcgatggaagtcctgcacgggatcgacctcgacatcccctcgggctcgttcgtcgtcttcgtgggcccctcgggatgcgggaaatccacgcttctgcgcgccatcgcggggctcgaggacatcagctcgggcgaattcgccatcgacggcgagcggatgaacgaggtggccccctcgcgccgcggcatcgccatggtgttccagtcctacgcgctctatccgcacatgacggtgttcgagaacatggccttcgggatgcggatcgcgggcctgaagaaggacgagatcgcccgccgcgtcacccgcgcggccgaggtgctgcagctcgccccctatctcgaccgctatccccgcgcgctctcgggcgggcagcgccagcgggtggccatcgggcgggccatcgtgcgcgaccccaaggtgttcctgttcgacgagccgctctcgaacctcgatgccgcgctccgggtggcgacgcggatcgagatcgccaagctcaagcaggcgatgccgggggccacgatgatctatgtgacccacgatcaggtcgaggccatgacgctggccgaccggatcgtggtgctgcgggcggggcggatcgagcaggtgggctcgccgctcgatctctaccggcggcctgccaacctcttcgtcgcgcgcttcatcggctcgcctgcgatgaacgtgatcccgggcacggtgcggatcgggcccgagggcgcgcggctcgacctcgccaccggcggcgggctgcgggcgcccttcccgctcgacgcgggccttgcgggccggacggtgcaggtgggcatccgccccgaggacctgcggctggccgagggcgcgccgctcctcgaagggcggatctcctacatcgagcagctgggcgaggtgcagctcacctatatcgaggcgcgcgggctggccgagccgctgatcgcgaagctgccgggcgttctcgacctgcaggccggcgcccccatcgcgctcacggccgatgtccagagcctgcacctcttcggggaggacgagcgcagcctgcgccccgaggccgccctgccggaggtcacttccgcacgaagctga

SEQ ID NO: 37241 - protein, 373 aa, Rhodobacter sphaeroides 2.4.1
MAELTLRQVRKTYGSMEVLHGIDLDIPSGSFVVFVGPSGCGKSTLLRAIAGLEDISSGEFAIDGERMNEVAPSRRGIAMVFQSYALYPHMTVFENMAFGMRIAGLKKDEIARRVTRAAEVLQLAPYLDRYPRALSGGQRQRVAIGRAIVRDPKVFLFDEPLSNLDAALRVATRIEIAKLKQAMPGATMIYVTHDQVEAMTLADRIVVLRAGRIEQVGSPLDLYRRPANLFVARFIGSPAMNVIPGTVRIGPEGARLDLATGGGLRAPFPLDAGLAGRTVQVGIRPEDLRLAEGAPLLEGRISYIEQLGEVQLTYIEARGLAEPLIAKLPGVLDLQAGAPIALTADVQSLHLFGEDERSLRPEAALPEVTSARS

SEQ ID NO: 37242 - DNA, 1185 bp, Xylella fastidiosa Dixon
  CDS (1)..(1185)
atgtcatcatcgctagatgcggctaaggccgcgcggtccggttgctttcggggccgggacagcgatgtttgttccgttgaggcttatggcatggccaaagtgcagttggaagcgatccgtaaggtgtacgacaacggccaggtggtagttcctggagtcagtttcgaagttgctgacggtgagctgatggtgttggtgggaccgtcaggatgcggtaaatcgacattgttgcgcatgatcgctgggctggaagatatcagcagcggcacgttgcgtattggtgagcgtgtggtgaataacgtgccgccgaaggatcgtaatgttgcaatggtgtttcagagctatgcgttgtatccccatatgacggccgctgagaatttggcgttcgggctgaagctgcgggggtattccactgaggccattgccgagcgcattaagaatgtggccgagatgcttggtttgacttctctgctggataccttgcctaaagcgatgtctggtgggcagcgccagcgtgttgcgttggggcgggcgatggtgcgtgaatcagcagtgtttttattggatgagccgttgtccaatttagacgcaaaactgcgtaacagtgtgcgttccgatatcacgcgtctgcatcgcaagcttggtacgacgatgatttacgtgacccacgatcaggttgaggcgatgactctcggtcaccgtattgtgttgctcaaagatggagtgatccagcagattgataccccgatggtgctttacgaccatccggcgaatctgtttgttgctggttttcttggtaatccagcaatgaacatgttgtctggccgattggaggtggttgcaggtggaatggaactgcacttggtatccggtgagcgcgtcatgtttgctggtgcgattccgaagtcagtttggttcgggcgtgatgtggtgttgggggtacgtccggagcacatacgtccggcgggtcttggtgaaccagtggcattggaggcgactatcgaagctttggagccagtcggtaatgaggtttttttacatctgcgctgtggtgccttggcactcattttgcgggtgccgcctcaggagttgccagggatcggcgagtcattgccgttggcggtgcagcctgatcggttacatctgtttgacgcggtttctggtgaatgtttggccggtcattaa

SEQ ID NO: 37243 - protein, 394 aa, Xylella fastidiosa Dixon
MSSSLDAAKAARSGCFRGRDSDVCSVEAYGMAKVQLEAIRKVYDNGQVVVPGVSFEVADGELMVLVGPSGCGKSTLLRMIAGLEDISSGTLRIGERVVNNVPPKDRNVAMVFQSYALYPHMTAAENLAFGLKLRGYSTEAIAERIKNVAEMLGLTSLLDTLPKAMSGGQRQRVALGRAMVRESAVFLLDEPLSNLDAKLRNSVRSDITRLHRKLGTTMIYVTHDQVEAMTLGHRIVLLKDGVIQQIDTPMVLYDHPANLFVAGFLGNPAMNMLSGRLEVVAGGMELHLVSGERVMFAGAIPKSVWFGRDVVLGVRPEHIRPAGLGEPVALEATIEALEPVGNEVFLHLRCGALALILRVPPQELPGIGESLPLAVQPDRLHLFDAVSGECLAGH

SEQ ID NO: 37244 - DNA, 1185 bp, Xylella fastidiosa Ann-1
  CDS (1)..(1185)
atgtcagaatcgctagatgcggctaaggccgcgcggtccggttgctttcggggccgggacagcgatgtttgttccgttgaggcttatggcatggccaaagtgcagttggaagcgatccgtaaggtgtacgacaacggccaggtggtagttcctggaatcagtttcgaagttaatgacggtgagctgatggtgttggtgggaccgtcaggatgcggtaaatcgacgttgttgcgcatgatcgctgggttggaagatatcagcagcggcacgttgcgtattggtgagcgtgtggtgaatgacgtgccgccgaaggatcgtaatgttgcaatggtgtttcagagctatgcgttgtatccccatatgacggccgctgagaatttggcgttcgggctgaagctgcgggggtattccactgaggccattgccgagcgcattaagaatgtggccgagatgcttggtttgacttctctgctggataccttgcctaaagcgatgtctggtgggcagcgccagcgtgttgcgttggggcgggcgatggtacgtgaatcagcggtgtttttattggatgagccgttatccaatttagacgcaaaactgcgtaacagtgtgcgttctgatatcacgcgtctgcatcgcaagcttggtacgacgatgatttacgtgacccacgatcaggttgaggcgatgactctcggtcaccgtattgtgttgctcaaagatggagtgatccagcagattgataccccgatggtgctttacaaccatccggcgaatctgtttgttgctggttttcttggtaatccagcaatgaacatcttgtctggccgattggaggcggttgcaggtggaatggaactgcacttggtatccggtgagcgcgtcatgtttgctggtgcgattccgaagtcagtttggttcgggcgtgatgtggtgttgggggtacgtccggagcacatacgtccggcgggtcttggtgaaccagtggcattggaggcgactatcgaagcgttggagccagtcggtaatgaggtttttttacatctgcgctgtggtgccttggcactcattttgcgggtgccgcctcaggagttgccggggatcggcgagtcattgccgttggcggtgcagcctgatcggttacatgtgtttgacgcggtttctggtgaatgtttggccggtcattaa

SEQ ID NO: 37245 - protein, 394 aa, Xylella fastidiosa Ann-1
MSESLDAAKAARSGCFRGRDSDVCSVEAYGMAKVQLEAIRKVYDNGQVVVPGISFEVNDGELMVLVGPSGCGKSTLLRMIAGLEDISSGTLRIGERVVNDVPPKDRNVAMVFQSYALYPHMTAAENLAFGLKLRGYSTEAIAERIKNVAEMLGLTSLLDTLPKAMSGGQRQRVALGRAMVRESAVFLLDEPLSNLDAKLRNSVRSDITRLHRKLGTTMIYVTHDQVEAMTLGHRIVLLKDGVIQQIDTPMVLYNHPANLFVAGFLGNPAMNILSGRLEAVAGGMELHLVSGERVMFAGAIPKSVWFGRDVVLGVRPEHIRPAGLGEPVALEATIEALEPVGNEVFLHLRCGALALILRVPPQELPGIGESLPLAVQPDRLHVFDAVSGECLAGH

SEQ ID NO: 37246 - DNA, 1104 bp, Lactobacillus gasseri
  CDS (1)..(1104)
atggttgaagtagatttaaaccatatctataaaaagtacgaaggaaatgataaatattcagttaatgactttgatttacacatcaaagacaaggaatttatcgtttttgttgggccatctggttgtggtaagtcaactactttaagaatggttgctggtctggaagatatttctaagggtactttagaaattgaccataaagtaatgaacgatgttgctcctaaagatagaaacatcgccatggtattccagaactatgctttataccctcacatgtcaatttacgacaacatggcttttggattgaaacttcggcactacaagaaagatgaaatcgataaacgggttaaacatgctgctgaaattttaggcttgtctgaataccttgataaaaagccatcagaactatctggtggtcaaagacagcgtgttgccttagggcgtgcaattgttcgagatgcaccaatcttcttgatggacgaacctttatcaaacctagatgcaaaattacgtgtcacaatgcgtgctgaaattgctaaattacaccaaaacttaggaactactactatctatgttactcacgatcaaactgaagccatgactttagctgaccgagtagttgttatgtcagttggtcaagttcagcagatcggaacgccacttgaagtttataacaagcctgtaaatatgtttgttgctggttttattggttctccgcaaatgaacttcttcaatgttcactttaaaggtaatcgaattagtgatggcaaaggattaaatatcgaaattcctgagggtaaggctaagatgcttaaagataagggatatgaagataaagacttagtctttggtattcgtccagaagacattcactcagaagaagccttccttgaaacttggccaaatcaaactgttaaatctacagttgtcgtttctgagttgctgggatcaacgattcaactttatcaaaaagtagacggcacagaatttgtagctatcgtaaatgcccgtgattaccatactccaggcgataaggtagaaatgggatttgacgttaacaaagctcacttctttgataaagatacaacgaatgcaattcgttaa

SEQ ID NO: 37247 - protein, 367 aa, Lactobacillus gasseri
MVEVDLNHIYKKYEGNDKYSVNDFDLHIKDKEFIVFVGPSGCGKSTTLRMVAGLEDISKGTLEIDHKVMNDVAPKDRNIAMVFQNYALYPHMSIYDNMAFGLKLRHYKKDEIDKRVKHAAEILGLSEYLDKKPSELSGGQRQRVALGRAIVRDAPIFLMDEPLSNLDAKLRVTMRAEIAKLHQNLGTTTIYVTHDQTEAMTLADRVVVMSVGQVQQIGTPLEVYNKPVNMFVAGFIGSPQMNFFNVHFKGNRISDGKGLNIEIPEGKAKMLKDKGYEDKDLVFGIRPEDIHSEEAFLETWPNQTVKSTVVVSELLGSTIQLYQKVDGTEFVAIVNARDYHTPGDKVEMGFDVNKAHFFDKDTTNAIR

SEQ ID NO: 37248 - DNA, 1110 bp, Azotobacter vinelandii
  CDS (1)..(1110)
atgtccgatctgacaataaaaaatctgaagaagggcttcgatggaaccgaaatcatcaagggcatcgatctggaaatcaaagatcatgagttcgtggtgttcgtcggaccttccggctgcggcaaatccacactgctgcgcttgatcgccggcctcgaggaggtgaccagcggccacattcatctcgatggccaggacatcaccgatgtcgccccggccaagcgtaacctggcgatggtgttccagacctatgcgctctatccgcacatgtcggtgagcaagaacatgtccttcgcgctgagcctggcgggcgccgacaaggccgagatcgagcgcaaggtgaaagaggcggcgcgcatcctcgaactcgaacacctgctggagcgcaagccgaaggcgctctccggcgggcagcgccagcgggtggcgatcggccgcgccatcgtgcgccatcccaaggtgttcctgttcgacgagccgctttccaacctcgatgccgcgctgcgcgtccagatgcgcctcgaactggcgcggctgcacaaggagctgaacgcgaccatgatctacgtgacccacgaccaggtcgaggcgatgaccctggccgacaaggtcgtggtcttcaacggcggccgtgtcgagcaggtgggcagtccgctggagctgtaccaccatccgctgaaccagttcgtcgccggcttcatcggcacgccgaaaatggccttcctcggcggctcggtcaaggcggcggacgcctcgggcgtcaccgtcgcgctggcctgcgggcccgagtattgcctgccgctcgatggcagcgcgctgaaggcgggcgacagggtgacgctcggcgtgcgccccgagcatctgcagatcgccgctgcggagcacagtccgttcaaggtgcggctcgatgtgtccgagcatctcggcgcggacacctattgctacgtgcggacagagagcggcgagctgttgacggtacgcgcgcccggcgatttcgccgggcagttcggcgagcgggcgagcctgatcccggacctggcccactgtcacctgttcgatgccgacggccgcaccctgcccaaaccgggagcatcggccagagcggcctga

SEQ ID NO: 37249 - protein, 369 aa, Azotobacter vinelandii
MSDLTIKNLKKGFDGTEIIKGIDLEIKDHEFVVFVGPSGCGKSTLLRLIAGLEEVTSGHIHLDGQDITDVAPAKRNLAMVFQTYALYPHMSVSKNMSFALSLAGADKAEIERKVKEAARILELEHLLERKPKALSGGQRQRVAIGRAIVRHPKVFLFDEPLSNLDAALRVQMRLELARLHKELNATMIYVTHDQVEAMTLADKVVVFNGGRVEQVGSPLELYHHPLNQFVAGFIGTPKMAFLGGSVKAADASGVTVALACGPEYCLPLDGSALKAGDRVTLGVRPEHLQIAAAEHSPFKVRLDVSEHLGADTYCYVRTESGELLTVRAPGDFAGQFGERASLIPDLAHCHLFDADGRTLPKPGASARAA

SEQ ID NO: 37250 - DNA, 1122 bp, Desulfitobacterium hafniense DCB-2
  CDS (1)..(1122)
atggcgggtttacatctgaaaaatttagctaagacctaccccggcggggttgcggcagtcagggatttctctctggaaatcaaggatcaggaatttttaatcctggtaggtccctccggctgtggcaaaacaaccgttttaaggatgatagccgggctggaggagatttcagccggtgaattatatattgacgaccggctggttaatgaggtggccgccaaggaccgggatatcgccatggtttttcaaaattacgctctttatccccatctgtcggtctatgacaatatggcttttggacttaagttgagaaaactgcccaaggtcgagatcaggaaaaatgtagaggaagcggccaggattctgggacttgaagctctgcttcagcgcaaacccaaggaactttccggcgggcaaaggcaaagggtggccctggggcgggccattgtcaggaaacccaaggttttcttgatggatgagccgttgtccaacctggatgcccagctgagaacccagatgagaatagaaattgccaaacttcacaaaaatctgcagacaacctttgtttatgtaacccatgatcaaaccgaagccatgaccatgggcaccagaatcgtggtgatgaaggacggcctgatccagcaaatcgacagcccccaagccatctatgaccatccggtcaatatgtttgtggccggttttctaggcagcccggggatgaactttctggaagttttgatgatcgaggaaaagggctgtatttatgccaagctggccgacgccctgctgcctgttcctgctgccgggggacaaagattaaaagagcaggggtatctggaccggaaagtggtcctggggatcagagcggaacatctctggggcagcggagattttggggaccgtcattccgagtgggcattggagggaaggctggagttcagcgaattgagaggggctgagacttaccattatgtaaggatcgccggcagggaggtggttgtcagggtgagtccggagctgcgcgccgcaaccggacaggaagtcagggtaggttttaatatggccaaggcccattttttcgatcaggaaaatggggtgaatatctgtattctgaataattaa

SEQ ID NO: 37251 - protein, 373 aa, Desulfitobacterium hafniense DCB-2
MAGLHLKNLAKTYPGGVAAVRDFSLEIKDQEFLILVGPSGCGKTTVLRMIAGLEEISAGELYIDDRLVNEVAAKDRDIAMVFQNYALYPHLSVYDNMAFGLKLRKLPKVEIRKNVEEAARILGLEALLQRKPKELSGGQRQRVALGRAIVRKPKVFLMDEPLSNLDAQLRTQMRIEIAKLHKNLQTTFVYVTHDQTEAMTMGTRIVVMKDGLIQQIDSPQAIYDHPVNMFVAGFLGSPGMNFLEVLMIEEKGCIYAKLADALLPVPAAGGQRLKEQGYLDRKVVLGIRAEHLWGSGDFGDRHSEWALEGRLEFSELRGAETYHYVRIAGREVVVRVSPELRAATGQEVRVGFNMAKAHFFDQENGVNICILNN

SEQ ID NO: 37252 - DNA, 1104 bp, Desulfitobacterium hafniense DCB-2
  CDS (1)..(1104)
ttgcagggtgtctcgaaagtctacggcaccacaacagctgtagcccctactgatctcatcattgaggacggagagtttctggttctcgtcgggccttccggatgcggcaagacgacgactttgcggatgatctgcgggttggaggcaccatctgaagggaacatatttatcggggaacgcaatgtcaccaagcttgaacccaaagatcgggatatcgctatggtttttcagagttatgccttatatccccacaaaaacgtttatgacaacatggcttttggtttacgcatcaggaagaggtccaagcaggagatcgacgccgcagttaaagagactgcggaaatgttgggcatatctcagtatcttaatcgttatcctaaagaattatccggaggacaacggcagagagttgctttagggcgggccattgtcaggcatcctcaggctttcttaatggacgaacctttaagtaatcttgatgctaaactgcgggtccagaccagagccgaacttataaaactccatcaaaaactcaaaattacggttatttatgtaacccatgatcagattgaagccatgaccatgggttcacgtctcgtggtcatgaaagatggcctggttcaacaagttggttcccccaaggatatttacggttaccctgccaacaaatttgtggcaggttttgtcggctccccaccgatgaattttatcaaaggtgttgttgaggttaatgacatggtgtgcttcaaggcaccggagctgacaattcacttgcctttgcaagggggcttgcaatcactcgggaaatttgaggccttcctgggagttcggccggaaggctttgtttgggttgactcaactgagaccaggaattgcctggcctgcagggtcgaagttgtggaacatgtgggggcggagatcattatccatgctaggttcggcaccgatgaagaaattgtgatcaagcaaaatggctatgaagtggaacctgagataggctctctgattaaagtaagacctcatcagggaaatattcacttgtttgatgcgcatacccaacaaagagtcatgactgcaacagttgtcgacggtaagatactttag

SEQ ID NO: 37253 - protein, 367 aa, Desulfitobacterium hafniense DCB-2
MQGVSKVYGTTTAVAPTDLIIEDGEFLVLVGPSGCGKTTTLRMICGLEAPSEGNIFIGERNVTKLEPKDRDIAMVFQSYALYPHKNVYDNMAFGLRIRKRSKQEIDAAVKETAEMLGISQYLNRYPKELSGGQRQRVALGRAIVRHPQAFLMDEPLSNLDAKLRVQTRAELIKLHQKLKITVIYVTHDQIEAMTMGSRLVVMKDGLVQQVGSPKDIYGYPANKFVAGFVGSPPMNFIKGVVEVNDMVCFKAPELTIHLPLQGGLQSLGKFEAFLGVRPEGFVWVDSTETRNCLACRVEVVEHVGAEIIIHARFGTDEEIVIKQNGYEVEPEIGSLIKVRPHQGNIHLFDAHTQQRVMTATVVDGKIL

SEQ ID NO: 37254 - DNA, 1179 bp, Desulfitobacterium hafniense DCB-2
  CDS (1)..(1179)
atggcaggactgctgctcaaaaacatatcgaaaacctatcccggccaggtcaccgccgtcaggaatctttccctggagatccaggacaaagaattcctggttttggtaggcccttccggttgcggcaaaacaacaactctgagaatgatcgccggccttgaggatatttccgccggggaactctatatcggggacagactggtcaatgatgtccctcccaaagaccgggatatcgccatggtttttcagaattatgctctttatccccacctgtcggtctacgacaatatggctttcgggcttaaattaaggaaaatgcctaaaggggagatcaggcaaaacgtgttggaagccgcccgcatccttgacctggaagatctgctgggccgcaaacccaaggagctttccggcgggcagcggcagagggttgccctggggcgggccatggtgagaaagcctcaggtgttcttgatggatgaacccctgtccaatctggatgcccagttaagaacccagatgcgcatagagatcgccaggcttcataaaaagctggccacaacctttatctatgtgacccatgatcaaacggaagccatgaccatgggcacccggattgtggtgatgaaagaaggccttgttcagcaagtggacacaccccagcacatctataaccacccggccaatcggttcgccgccggttttatcggcaatcccagaatgaatttccttgaagtttcttttaaagaacaaaagaacggcctctgtgccggtctggggggggttctcctgtcggttccccctgtccggggggcggcacttcgggcaaaaggctgccggcagggcgggaaggcaattctgggcatcagagctgaacatcttgccttgcgccccctggaggggagatttccggcctgcccgccggagctgcctttggtgcggggaaggctggaatttaccgagctgcggggagcggagaactatcactacgtcacggttcagggaagggaggttgtggtcagagcccagccggaataccggggagaagcagggcaggaagtggagatcgtttttaatctggcccaagctcatttctttgctccggaaagcggggtgaatatggaaacggaggggcaggaacactgcgtatccagggaacaaatggatagtggacttatgtaa

SEQ ID NO: 37255 - protein, 392 aa, Desulfitobacterium hafniense DCB-2
MAGLLLKNISKTYPGQVTAVRNLSLEIQDKEFLVLVGPSGCGKTTTLRMIAGLEDISAGELYIGDRLVNDVPPKDRDIAMVFQNYALYPHLSVYDNMAFGLKLRKMPKGEIRQNVLEAARILDLEDLLGRKPKELSGGQRQRVALGRAMVRKPQVFLMDEPLSNLDAQLRTQMRIEIARLHKKLATTFIYVTHDQTEAMTMGTRIVVMKEGLVQQVDTPQHIYNHPANRFAAGFIGNPRMNFLEVSFKEQKNGLCAGLGGVLLSVPPVRGAALRAKGCRQGGKAILGIRAEHLALRPLEGRFPACPPELPLVRGRLEFTELRGAENYHYVTVQGREVVVRAQPEYRGEAGQEVEIVFNLAQAHFFAPESGVNMETEGQEHCVSREQMDSGLM

SEQ ID NO: 37256 - DNA, 1134 bp, Nostoc punctiforme PCC 73102
  CDS (1)..(1134)
atggcaaatgttcgtctagaagatattaaacgtagatttaataatgtcaccgcgatcgaggatattacctttgaaattcctgatggcgagttttgggttttagttggcccatcgggttgtggtaagtctacaattttgcgaacgatcgcaggtttagaaaccgctacatcaggcaaactctttattggcgatcgcttggtgaataatatcccagccagacagcgagatgtggcgatggtattccaaaactacgccctctatcctcacatgagcgtggcccaaaacatcggctttggcttgcagatgcggaaggttgaccgaaaaatcattcaagaacgagtgatgaatgtggcgcgatcgctttctctggatcacttgctggatcgtaaacccaaacaactttctgggggacagcaacaacgggtagcattagggagagcgatcgctcgtgaaccccaagtttttttacttgatgaacctttatctaatttagatgcccaattgcgcgacgatacaagggcagaattgaaacagttacatcaagaattaggcattaccacaatttacgtcacccacgatcaagttgaagcgatgactttggctgataaaatagtcgtgctaaatcgcggacggattcaacaaatcggcgatccccaaactatttatgcaagtcctgctaatcaaatggtggcaacttttttaggcagcccaccaatgaatatcttgcctgcaatctatcacaataacggttttgatgttagtgggcagttattaacgattccagcagttgtaaaagaaaaattacagttgcgtcaggaacacagttatgatttggggattcgtccagagcatatttttattaacgaacggccctccgggttcacagtcgcctacaacgctggttcaccaaatcgccaagaagaaaatgagagtcaactgattgtagaagttaaagtagtggaacctttgggaagagaaactttgattcgtgctggtttacctggttcggcggtggtgttgaatattcaggtgggagcggatgtgcgtccgcgtccaggcgatcgcctttctctacaacttgatttaaatcacttgtttgtatttgatcccaaaactggcgacagaattttataa

SEQ ID NO: 37257 - protein, 377 aa, Nostoc punctiforme PCC 73102
MANVRLEDIKRRFNNVTAIEDITFEIPDGEFWVLVGPSGCGKSTILRTIAGLETATSGKLFIGDRLVNNIPARQRDVAMVFQNYALYPHMSVAQNIGFGLQMRKVDRKIIQERVMNVARSLSLDHLLDRKPKQLSGGQQQRVALGRAIAREPQVFLLDEPLSNLDAQLRDDTRAELKQLHQELGITTIYVTHDQVEAMTLADKIVVLNRGRIQQIGDPQTIYASPANQMVATFLGSPPMNILPAIYHNNGFDVSGQLLTIPAVVKEKLQLRQEHSYDLGIRPEHIFINERPSGFTVAYNAGSPNRQEENESQLIVEVKVVEPLGRETLIRAGLPGSAVVLNIQVGADVRPRPGDRLSLQLDLNHLFVFDPKTGDRIL

SEQ ID NO: 37258 - DNA, 1359 bp, Nostoc punctiforme PCC 73102
  CDS (1)..(1359)
atgtcccaagttattttagaaaacgtttataaaagtttttcctcacgtaaaggtgaaggtgttacctcacaaaaccaatcttcccccacgactggggagaaaactgatgcagcgcaagaacgtgcgggaagtgttaacgtcttgcggcggattaacctaacgatcgcagatggcgagtttatggtgctggtaggcccttctggttgtgggaaaagtaccttgctacggttaatcgctgggttagaagtaatgactggcggtaatatctgggtaggcgatcgcttaatcaatgatctaccaccaaaagaacgcgatatcgcaatggtgtttcaaaattacgccctctatccccacatgacggtgtatgacaacatcgcttttggactgcgccgtaggggaagcaggggagccgaggagcatacttctccacgagaggctgcgccaacgactgcgctcagtaaccgggggagcaaaggagaaaatactccctatcttcggacgtgggcagaaaatctcttcgtgggggcgacaagaaagttacctaaaggattgcgctacacttctgagaaagaacgagcggtggatcggcaggtgcgcagtgttgcccaattgttgcaaattgaaacattgctgaatcgcttacccaaacagctctctgggggacaaagacaacgggttgcattgggaagagcgatcgcacgtgacccccaagtattcttaatggatgagccgctttctaacttagatgccaaattgcgggcagaaacccgcgcccaaattgtcaaattgcagcgccaactggggacaacgacaatttacgttacccacgatcaaacagaagcgatgacaatgggcgatcgcattgcgattatgtctgagggtaaaattcagcaagttgcttctcccctagaactttacaaccgtcctgccaatctttttgtcgcagagttcattggctcaccaccgatgaattttattcctgtggaatttcatgccccgcagttaattactcattctcagttgcgtttcaccctgccagaagtttggggaaaagccctacaaaaatatgatgggaaaactctaattttaggcattcgcccagaacacttgaacttgagtatgcctgccaccaaaaatttaccagtgcaagtagatttagtagagaatctcggcaacgattcctttctcgctgttaagattgccgaacctggttctcagcctgctactacagcaaattccctacaagtacgaatcccaccagaccgtctggtacaacctggtgagcaactatggttatctctaactccagagaaaattcacttttttgacccagaaacccagttagcaatatttccttaa

SEQ ID NO: 37259 - protein, 452 aa, Nostoc punctiforme PCC 73102
MSQVILENVYKSFSSRKGEGVTSQNQSSPTTGEKTDAAQERAGSVNVLRRINLTIADGEFMVLVGPSGCGKSTLLRLIAGLEVMTGGNIWVGDRLINDLPPKERDIAMVFQNYALYPHMTVYDNIAFGLRRRGSRGAEEHTSPREAAPTTALSNRGSKGENTPYLRTWAENLFVGATRKLPKGLRYTSEKERAVDRQVRSVAQLLQIETLLNRLPKQLSGGQRQRVALGRAIARDPQVFLMDEPLSNLDAKLRAETRAQIVKLQRQLGTTTIYVTHDQTEAMTMGDRIAIMSEGKIQQVASPLELYNRPANLFVAEFIGSPPMNFIPVEFHAPQLITHSQLRFTLPEVWGKALQKYDGKTLILGIRPEHLNLSMPATKNLPVQVDLVENLGNDSFLAVKIAEPGSQPATTANSLQVRIPPDRLVQPGEQLWLSLTPEKIHFFDPETQLAIFP

SEQ ID NO: 37260 - DNA, 1128 bp, Bifidobacterium longum DJO10A
  CDS (1)..(1128)
atggcagaagtcgttttcgaccacgtcactcgtatctacccgggcaacgataagccctccgtggatgatctgaatcttgatatcaaggatggcgagttcctcgtcctcgtcggcccttctggctgtggtaagtctacgacccttcgtatgctcgccggcctggaagaggtcaacaagggccgcatcctcatcggtggcaaggatgtcaccacgatgcagccgaaggaccgcgacatcgcaatggtgttccagaactacgctctgtacccgcacatgaccgttgccgacaacatgggcttcgccctgaagatcgccggcactccgaaggacgagatccgcaagcgcgtcgagaaggccgctgagatcctcgacctgaccgagtacctcgaccgcaagccgaaggctctgtccggtggtcagcgtcagcgtgtggccatgggccgtgcaatcgtccgtgagccgaaggtcttcctcatggatgagccgctgtccaacttggacgccaagctccgtgtccagacccgtacccagattgctgccctgcagcgccagctgggtgtcaccaccctgtacgtgacccacgatcagaccgaggctctgacgatgggcgatcgcatcgccgtcatcaagctcggtatcctgcagcaggtcggcgctccgactgagctgtacgatcgtccggccaacgtcttcgtcgccggcttcatcggctccccgtcgatgaacctgaacacccacccggtggtcaacggcaaggcgaagatcggtgaggacaccgtggacctgccggctgaggccgtcgccaagctcaccgccgaagacaacggccagatcgtggtcggcttccgtcctgaggacgctggtctggccccggctgacgacccgaacgccttctccctgaaggttgtgaacgtcgaggatctgggctccgatggctacatctacggcaacatcgtcaccgatggctccgcagctgaggctgcccaggtcatgtccgaccagaacaagctcaccacgattcgtgtgaatccgcgtgcgctgccgaaggttggcgcgaccgtcaagatcaagattgacccggccaagatgcacctgttcgctccgtcgactgagctgcgtctgaactag

SEQ ID NO: 37261 - protein, 375 aa, Bifidobacterium longum DJO10A
MAEVVFDHVTRIYPGNDKPSVDDLNLDIKDGEFLVLVGPSGCGKSTTLRMLAGLEEVNKGRILIGGKDVTTMQPKDRDIAMVFQNYALYPHMTVADNMGFALKIAGTPKDEIRKRVEKAAEILDLTEYLDRKPKALSGGQRQRVAMGRAIVREPKVFLMDEPLSNLDAKLRVQTRTQIAALQRQLGVTTLYVTHDQTEALTMGDRIAVIKLGILQQVGAPTELYDRPANVFVAGFIGSPSMNLNTHPVVNGKAKIGEDTVDLPAEAVAKLTAEDNGQIVVGFRPEDAGLAPADDPNAFSLKVVNVEDLGSDGYIYGNIVTDGSAAEAAQVMSDQNKLTTIRVNPRALPKVGATVKIKIDPAKMHLFAPSTELRLN

SEQ ID NO: 37262 - DNA, 1137 bp, Actinobacillus pleuropneumoniae serovar 1 str. 4074
  CDS (1)..(1137)
atgacagatgttcgattagtaaacgtatgcaaatcgtatggcaatgtacatatttctaaagatgttaatttagaaattaaagacggcgaatttgttgtttttgtcggcccgtcaggctgtggtaaatcaaccgtattacgaatgattgctggcttggaagaaattacctccggtgatttatttatcggggataaacgaatgaatgatgtaccgccggcaaatcgaaatatcggtatggtattccaatcttatgccctctatccccatctttctgttgcagaaaatatgtcatttggtttgaaactcgccggagcaaaaaaagaagaaattgaccagcgagttaaccaagtcgcggaaattctgcaactcgctcatttactaaatcgcaagccgaaagaattatcgggcggtcaacgtcagcgtgttgcaattggacgtaccttagtctcacaacctgaagtgtttttattggatgaaccgctttcaaatttagatgcggcattacgtgtgcaaatgcgtgtagaaatttcaaaattacataaaaaacttggcagaacaatgatttatgtaacgcatgaccaaatcgaagccatgacgctcgccgataaaattgttgttttacaagcgctttctgcaggcagcaatcttacaacgaacgttgctcaagtgggtaagccattagagctttatcattatccggcaaatcgttttgtggcaggttttatcggatcacctaagatgaatttcttaccggtgcgagtgatagatgtacgtgaaggtggagtgaaaattgaattaccggactcaacccatttgaatttctgggtaccggttgaaagtggtggcgtaaaagtaggagataacctttcattaggtattcgtccggaacatttattaccgtgtgaacaaagtgaagtttgtatttccggcacggtaaaagtggtagaacaattgggtaatgaaacgcaagttcatattgaaatgccaccgattaaacagagtttggtctatcgccaaaatgacattgtattagtgaaagaaggcgatttattaatccgaatcgttgtcatcttttccgagaagatggcacggcatgcaaacgtttatttgtcgagcaaggcgtataaatgttcttaa

SEQ ID NO: 37263 - protein, 378 aa, Actinobacillus pleuropneumoniae serovar 1 str. 4074
MTDVRLVNVCKSYGNVHISKDVNLEIKDGEFVVFVGPSGCGKSTVLRMIAGLEEITSGDLFIGDKRMNDVPPANRNIGMVFQSYALYPHLSVAENMSFGLKLAGAKKEEIDQRVNQVAEILQLAHLLNRKPKELSGGQRQRVAIGRTLVSQPEVFLLDEPLSNLDAALRVQMRVEISKLHKKLGRTMIYVTHDQIEAMTLADKIVVLQALSAGSNLTTNVAQVGKPLELYHYPANRFVAGFIGSPKMNFLPVRVIDVREGGVKIELPDSTHLNFWVPVESGGVKVGDNLSLGIRPEHLLPCEQSEVCISGTVKVVEQLGNETQVHIEMPPIKQSLVYRQNDIVLVKEGDLLIRIVVIFSEKMARHANVYLSSKAYKCS

SEQ ID NO: 37264 - DNA, 1113 bp, Pseudomonas aeruginosa UCBPP-PA14
  CDS (1)..(1113)
atggctgatctcaagatccgcaacctgcagaaaggcttcgacggccaggccatcatcaagggcatcgacctcgacgtccgcgaccgcgagttcgtggtcttcgtcggcccctccggctgcggcaagtcgaccctgctgcgcctgatcgccggcctcgaagaggccagcggcggcagcatcgccctcgacggcacggacatcaccgacaccccgccggcgaaacgcgacctggcgatggtcttccagacctacgcgctgtacccgcacatgacggtgcgcaggaacctctccttcgccctcgacctggccggcgtcgacaagcgcgaggtcgccgccaaggtcgacgccgccgcacgcatcctcgaactgcaagcgctgctggagcgcaagccgcgccagctctccggcggccagcggcagcgagtggcgatcggccgggcgatcgtgcgcaacccgaagatattcctcttcgacgaaccgctgtccaacctcgacgccgccctgcgcgtgcagatgcgcctggaactggcgcggctgcaccaggaactggcggcgaccatgatctacgtgacccacgaccaggtcgaggcgatgaccctggcggacaaggtcgtggtgctcaacggcggacgcgtcgagcaggtcggctcgccgctggagctttaccaccatccggccaacctgttcgtcgccggcttcctcggcacgccgaagatgggcttcctgcgcggccatctcagccgcaatcagggcgagcgctgcgaggtcgccctcgaatgcggcgcgcgcgtcggcctgccgctatgcgccggcgagctggccaccggcagcccggtgaccctcggtatccgcccggaacacctgaacatcgcccgcccgggccatgccttccagggcctgctgcgggtcgccgccgacgtcagcgagcgcctgggcagcgacagcttctgccatgtccgcgccgactcgggggaaatgctcaccctgcgcgtgcgcggcgatttcgcaccggactacggcgcccccctggagctgggcttcgatccggcgcactgccatctgttcgacagcaacggccaggccctcgacaaacgactgcaacaggcggcctga

SEQ ID NO: 37265 - protein, 370 aa, Pseudomonas aeruginosa UCBPP-PA14
MADLKIRNLQKGFDGQAIIKGIDLDVRDREFVVFVGPSGCGKSTLLRLIAGLEEASGGSIALDGTDITDTPPAKRDLAMVFQTYALYPHMTVRRNLSFALDLAGVDKREVAAKVDAAARILELQALLERKPRQLSGGQRQRVAIGRAIVRNPKIFLFDEPLSNLDAALRVQMRLELARLHQELAATMIYVTHDQVEAMTLADKVVVLNGGRVEQVGSPLELYHHPANLFVAGFLGTPKMGFLRGHLSRNQGERCEVALECGARVGLPLCAGELATGSPVTLGIRPEHLNIARPGHAFQGLLRVAADVSERLGSDSFCHVRADSGEMLTLRVRGDFAPDYGAPLELGFDPAHCHLFDSNGQALDKRLQQAA

SEQ ID NO: 37266 - DNA, 1101 bp, Anabaena variabilis ATCC 29413
  CDS (1)..(1101)
atggcaaaagttcgtttagaagatatcaagcgtcgatttaacaacgtcaccgcaattgaggacatcacctttgaaattcctgatggtgagttttgggttttggtggggccttcgggttgtgggaagtctacaattttacggacgatcgctggtttagaaagtgctacatccggtaatctgtttattggcgatcgcttggtcaataatatccccgcaagagcgcgcgatgtggcgatggtgttccaaaactatgctctttatccccacatgacggtggcggaaaatatcgcctttgggttaaagatgcggaaaattaacccgaaaattgtgcaagaacgggtggtggatgtggcgcgatcgctttctttggatcatttgttagatcgcaaacccaaacaactttccgggggtcagcaacaacgggtagcactagggagagcgatcgctcgtgaaccacaggtatttttattagatgagcctttgtctaatttagatgcccaattgcgagatgatactagggcagaattaaagcagttacatcaacaattaggcattacaactatctacgttacccatgatcaagtcgaggcgatgactttggctgataagattgtggtgttaagtggtggacggattcaacaaattggcgaacctcaagggatttatgctcgtcccgctaatcaaatggtggcaacttttttaggtaatccaccgatgaatattctgcctgcaacttatcaacttgcaggttttgatgtcaatggacaattactcgcaattccagggtttctcagggagaatttacaactgcgtccgggacaacgggtgaatttgggtattcgtccagaacacatctcaattaattctgatgaaatcaacgcgcagaattcaggattgttagtcgatgtcaaattagttgaacctttaggaagggaaacattagttcgtgtgagtttacccgattccacagtactattgagtgttcaattgagtggaaatattcgtctacatccaggcgatcgcctttctttacaactcgatttaaatcagttgtttatttttgatcctcagactggttatagaatatcacctcaggattga

SEQ ID NO: 37267 - protein, 366 aa, Anabaena variabilis ATCC 29413
MAKVRLEDIKRRFNNVTAIEDITFEIPDGEFWVLVGPSGCGKSTILRTIAGLESATSGNLFIGDRLVNNIPARARDVAMVFQNYALYPHMTVAENIAFGLKMRKINPKIVQERVVDVARSLSLDHLLDRKPKQLSGGQQQRVALGRAIAREPQVFLLDEPLSNLDAQLRDDTRAELKQLHQQLGITTIYVTHDQVEAMTLADKIVVLSGGRIQQIGEPQGIYARPANQMVATFLGNPPMNILPATYQLAGFDVNGQLLAIPGFLRENLQLRPGQRVNLGIRPEHISINSDEINAQNSGLLVDVKLVEPLGRETLVRVSLPDSTVLLSVQLSGNIRLHPGDRLSLQLDLNQLFIFDPQTGYRISPQD

SEQ ID NO: 37268 - DNA, 1254 bp, Synechococcus elongatus PCC 7942
  CDS (1)..(1254)
ttgccgcgctcggccgctcgagtcacgagtgctaagctgttcccgacctttggccgggattgcaacgtggctggcgttgtttttgaagagatcgagaagcgttttccagaacaggcccgatcgccccagaaaggcgaagttgtcgtcctgaatggcatcaatctcgaaattgccgacggcgaatttatggtcgtggtcggtccttcgggctgtggcaaaagtacgctgttacggctgctggcaggtctggagacgcccagccgaggcttgatcaaagtgggcgatcgccgagtcgatcgactgcctgccaaggctcgcgatattgccatggtctttcagagctacgcgctctatccccacctcagcgtctacgacaatctggcctttggactgcgacggcagggcgatcgcccttggtggcaacagcaactggctctggcgacgcgatcgctgccgaaatccttgcagtatgaaccggagcaggaagcgcggatcaagcggcgggtacgggaagtggccacaatgctgcagctcgatacgttgctcgatcgccagcccaaacaactctcgggcggccaaaaacaacgggtcgctttgggacgggcgatcgctcgtaatccccaagtctttttgatggacgagccgctttcgaatttggatgcgaaattacgggccgaaacccgcgctcagatcgtttcgctccagcggcaactgggtgtgacgacgctctacgtcacccacgatcagaccgaagcaatgaccatgggcgatcgcattgcggtgttgaatcgtggtcatctgcaacaggttgcttcgccgctggaaatctacgatcgccccgccaatcgatttgtggcgcaattcattggatcgccgccgatgaacctaattcccgtcaccgtgcgggcacccctgcaactgacgactgaaaactttcgctgcacactgccggaagcttgggagccggtgttgcgcctttacgacggccaaacggtggagctcggcattcgcccagagcatttggaagtgggggctgccgcctcgaagaacttgctgatcactgtaacgggcgtcgaagccctcggcagcgatacctttatcgctggtgaactcaaagagagtggcatcgcggttcaggcccgcttggcaccgcaacaatgctggcagatgggcgatcgcctctggctaaccttcaagcccgatcagattcatctgtttgatttagaaactggaaaagcgattcgccccagctag

SEQ ID NO: 37269 - protein, 417 aa, Synechococcus elongatus PCC 7942
MPRSAARVTSAKLFPTFGRDCNVAGVVFEEIEKRFPEQARSPQKGEVVVLNGINLEIADGEFMVVVGPSGCGKSTLLRLLAGLETPSRGLIKVGDRRVDRLPAKARDIAMVFQSYALYPHLSVYDNLAFGLRRQGDRPWWQQQLALATRSLPKSLQYEPEQEARIKRRVREVATMLQLDTLLDRQPKQLSGGQKQRVALGRAIARNPQVFLMDEPLSNLDAKLRAETRAQIVSLQRQLGVTTLYVTHDQTEAMTMGDRIAVLNRGHLQQVASPLEIYDRPANRFVAQFIGSPPMNLIPVTVRAPLQLTTENFRCTLPEAWEPVLRLYDGQTVELGIRPEHLEVGAAASKNLLITVTGVEALGSDTFIAGELKESGIAVQARLAPQQCWQMGDRLWLTFKPDQIHLFDLETGKAIRPS

SEQ ID NO: 37270 - DNA, 1110 bp, Ralstonia eutropha JMP134
  CDS (1)..(1110)
atggcaaaactgtcgcttcgcaatgttcagaagacctatgccggcaacgtcaaagtcgtgcacggtatcgacatggagatcgctgacggcgagttcatcgtcatcgtcggcccatcgggctgcggcaaatccacgctgctgcgcatggtggcggggctggagaccatcaccggcggggatattcatatcggcgatcgggtcgtcaacaatctggagccggccgagcgcgacatcgccatggtgttccagaactacgcgctgtacccgcatatgagcgtgtacgacaacatggcgtacgggctcaagatacgcggcatggccaaggccgagatcgagcagcgcgtcaaacatgcggccggcattctcgaacttgcgccgctgctggaccgcaagccccggcagctttccggcggccagcgccagcgcgtggcgatggggcgtgccatcgtgcgcgagccgtcggtgttcttgtttgacgagccattgtcgaacctcgatgccaagctgcgggtgcagatgcgcctggagctcaaggagctgcatcgacgacttggtacaacgagcctttacgtgacgcatgaccaggtcgaggccatgacgctggctgaccgcatgatggtgctcaacggcgggcgtgtcgaacagatcggtacgccgctggaggtctatacgcgcccggccagtactttcgtggccggctttatcggttcgccgccgatgaatctggtcccggtcgcgcgcaacggcggcatggcgggagcgggcggcgtggcgcagatgcgcgtgttagggaaggaggggggcgccagcgacgcgacgcttggacacctgccgatgggtttgcatctgccggccgaagcgctgctcgggctgcggccggagcatatcgagccgtgtgctgcgcatgatgcgattgccgaagtcgacgtgcgcgtggtcgaagcactgggtgcggattcctttgcctatggatcactgggtggccagcccatcgtcgtgcggctcgacagccatgcccgggtgcgcgccggcgacaagctgccggtgacatcgtcgccggatcatcttcacttcttcgacgcccaatcgggcaagcgcatcgaggcctga

SEQ ID NO: 37271 - protein, 369 aa, Ralstonia eutropha JMP134
MAKLSLRNVQKTYAGNVKVVHGIDMEIADGEFIVIVGPSGCGKSTLLRMVAGLETITGGDIHIGDRVVNNLEPAERDIAMVFQNYALYPHMSVYDNMAYGLKIRGMAKAEIEQRVKHAAGILELAPLLDRKPRQLSGGQRQRVAMGRAIVREPSVFLFDEPLSNLDAKLRVQMRLELKELHRRLGTTSLYVTHDQVEAMTLADRMMVLNGGRVEQIGTPLEVYTRPASTFVAGFIGSPPMNLVPVARNGGMAGAGGVAQMRVLGKEGGASDATLGHLPMGLHLPAEALLGLRPEHIEPCAAHDAIAEVDVRVVEALGADSFAYGSLGGQPIVVRLDSHARVRAGDKLPVTSSPDHLHFFDAQSGKRIEA

SEQ ID NO: 37272 - DNA, 1140 bp, Methylobacillus flagellatus KT
  CDS (1)..(1140)
atggcaacgcttagcctgcagcgtctgggcaagcacttcgcccaaacgcgcattctccaggagatcgacctggacattgcatcaggggaattcattgtgctggtcggcccctctggttgtggcaagtccacattgctacgcattctggccggcctggaagaagctgacgaggggcaagtgatcctagacggtcgcagcatcaaccgcctgccgccgcgcgaacgcaacatggcactggtgttccaggactatgcgctctatccgcacaagacggtttacgacaacctggcgtttggcctcagcatacgcggcacccccaagcagcaaatccagcagaaagtgcacgccgcagcggagcttttgcaattaacccccttgttgcagcgcaagcccgccgcgctttcaggcggccagcgccaacgcgtggcgatcggccgcgcactcgtgcgcgacgcccagctgttcctgttcgacgagccgctgtccaatctggacgccaaactacgcacggaaatgcgtatggaaatcaagcgcctgcaccagcgcatcggcaagaccatgatctacgtcacgcatgaccaggtggaagccatgacgctggctgaccgcattgcagtgatcaatcacggccgcatcgagcaattgggcacaccggcagaaatctaccagtctccagccaccaccttcgtggccggcttcatgggctcaccttcaatgaacctgctcgacctgccgctgcaatggtctgccgattacagatccgcctttgttgccgggcagtcggtgcccgtcaatcatctggagatcgatccggaacaacagatcaccctgggcatccgccctgagcacatccatatcgacgccgctgccctcaatggccaggcggcgctacgcctcaacgccgtagttgaactaatcgagcccttgggcgcggagaccattgccacgctgcggctggagcaattgactgcaaacctcgggcaatacacggtgcaggcgcgcctgcccggccaccagacggtatcccctgggcagcaactgcaaatccaggtagcacacgccaacctgcactggtttgacgacggacaaggcacgcgcattgcctctcgcccaacaggcaacacggagccagcggcatga

SEQ ID NO: 37273 - protein, 379 aa, Methylobacillus flagellatus KT
MATLSLQRLGKHFAQTRILQEIDLDIASGEFIVLVGPSGCGKSTLLRILAGLEEADEGQVILDGRSINRLPPRERNMALVFQDYALYPHKTVYDNLAFGLSIRGTPKQQIQQKVHAAAELLQLTPLLQRKPAALSGGQRQRVAIGRALVRDAQLFLFDEPLSNLDAKLRTEMRMEIKRLHQRIGKTMIYVTHDQVEAMTLADRIAVINHGRIEQLGTPAEIYQSPATTFVAGFMGSPSMNLLDLPLQWSADYRSAFVAGQSVPVNHLEIDPEQQITLGIRPEHIHIDAAALNGQAALRLNAVVELIEPLGAETIATLRLEQLTANLGQYTVQARLPGHQTVSPGQQLQIQVAHANLHWFDDGQGTRIASRPTGNTEPAA

SEQ ID NO: 37274 - DNA, 1098 bp, Crocosphaera watsonii WH 8501
  CDS (1)..(1098)
atggctagtgttacatttgaccaagttatcaagcgatttggagattacaccgcagttaataatctcaatttagatatcaaaaatggggaatttttggtgtttgttggcccctctgggtgtggcaaaagtacctccctaagattattggccgggttagaatctatcacagaagggactatatccattggagatcgccctgtaaacggactatcccctaaagatcgagacattgccatggtctttcaatcttacgccctttacccccacatgagcgtctttgataacatggcctttagtttagaattacaagggaaatctcgtaccgatattaaacaacgagttcatagtgcagcgcaacagttaggcatagaaaaactactccatcgtaaacccaaagaactttcagggggacaacgccaacgggttactgtggggagggcgatcgtgagacaacctgctgtatttttgatggatgaacccctatcaaacctggatgcaaaattacgggttcaagcgagaaaagaaattagtaaactccatcaagacttaaacaccacctttatctatgtcacccacgatcaagtagaagcgatgactatgggcgatcgcattgcagtgatgaaagagggtattttgcaacaagtagacacccccacaaacctttataaccatcctatcaataagtttgtggcaggatttatcggcagtccctccatgaactttttccctgtagaaaggagagaaaaggagggaaaatcatacctcaaatggggtgaaaccttgattgatctgcaaacctatctgcctaacatggcaaaagatataggaaacccatccttaactctgggtattcgtcccgaaaacatctatcatccccaatatacccccccagatattcaaggattaaccatacaagtaacagttaccctcatagaaaacatgggggactcattggtggtttatggtgacacccccaacggagaggaattagtagcccgtttggacccccgtgctaaagtaaggtcaaaagaaaccctagacctattaatagatagtcaacgtctttatctctttgatagcaatgaacatactctctga

SEQ ID NO: 37275 - protein, 365 aa, Crocosphaera watsonii WH 8501
MASVTFDQVIKRFGDYTAVNNLNLDIKNGEFLVFVGPSGCGKSTSLRLLAGLESITEGTISIGDRPVNGLSPKDRDIAMVFQSYALYPHMSVFDNMAFSLELQGKSRTDIKQRVHSAAQQLGIEKLLHRKPKELSGGQRQRVTVGRAIVRQPAVFLMDEPLSNLDAKLRVQARKEISKLHQDLNTTFIYVTHDQVEAMTMGDRIAVMKEGILQQVDTPTNLYNHPINKFVAGFIGSPSMNFFPVERREKEGKSYLKWGETLIDLQTYLPNMAKDIGNPSLTLGIRPENIYHPQYTPPDIQGLTIQVTVTLIENMGDSLVVYGDTPNGEELVARLDPRAKVRSKETLDLLIDSQRLYLFDSNEHTL

SEQ ID NO: 37276 - DNA, 1230 bp, Rubrobacter xylanophilus DSM 9941
  CDS (1)..(1230)
atggctgaggtaacgctcgagaacgtcaccaaagtctacggagaggacgtagtcgcggtcagggacatgaacctcgacatccccgacggggagttcgtggtcttcgtcgggccctcggggtgcggcaagagcacggcgctgcgcatgatcgccgggctcgaggacatctccagcggcaagatcttcatcggcgacgagctcgtcaacgacaagccgccgcgcgagcgcgacatcgccatggtcttccagaactacgcgctatacccgcacatgaacgtcagggagaacatgggcttcgcgctcaagctccggaagatgcccaaggacgagataaaccggcgggtggaggaggcggcgcgcatcctcggcatagagcgctttctggaccgcaagcccaaggcgctctccggcggccagcggcagcgggtcgcgctcgggcgggccatcgtccgggaacccaaggccttcctcatggacgagcccctctccaatctggacgccaagctcagggtgcagatgcgcaccgagatcgccaagctgcacaacaggatcgggaccaccaccatctacgtcacccacgaccagaccgaggccatgacgatggccgacaggatcgtggtcctcaaggacggggtggtgcagcagatagccccgccgcaggagatgtacgaccacccggagaacatcttcgtggccgggtttatcggctctccggcgatgaacttcatcatggcgcgcctggagagggaggactctggctttgtggcgaccttcggccggacccgggtccccatccacgaggaggccgtacgcttcgccagggagcgcggcagggagctggaggcctacgccggcaaggaggtcgtcctggggataaggcccgagcacatagaggacgcccggttcgccgaggaggcgggcgcccgggagagcaccatagaggtcgagccgcaggtcatagagagcatgggcagcgagaagtacgtctacttcgacgtgccccgggagcagcacgcccacacccggaccatcgacgagatggaggccgaggtcggcaccggcgacgggggcgccgagtcggaggccgccggcggcggggagagcggcgagctgatggtggccagggtctcggcggagagcgacgcccgggagggccacaaggttctgctggtcatcgactcctccaaggtccacctcttcgacccggagaccgagaaggccatcctgtag

SEQ ID NO: 37277 - protein, 409 aa, Rubrobacter xylanophilus DSM 9941
MAEVTLENVTKVYGEDVVAVRDMNLDIPDGEFVVFVGPSGCGKSTALRMIAGLEDISSGKIFIGDELVNDKPPRERDIAMVFQNYALYPHMNVRENMGFALKLRKMPKDEINRRVEEAARILGIERFLDRKPKALSGGQRQRVALGRAIVREPKAFLMDEPLSNLDAKLRVQMRTEIAKLHNRIGTTTIYVTHDQTEAMTMADRIVVLKDGVVQQIAPPQEMYDHPENIFVAGFIGSPAMNFIMARLEREDSGFVATFGRTRVPIHEEAVRFARERGRELEAYAGKEVVLGIRPEHIEDARFAEEAGARESTIEVEPQVIESMGSEKYVYFDVPREQHAHTRTIDEMEAEVGTGDGGAESEAAGGGESGELMVARVSAESDAREGHKVLLVIDSSKVHLFDPETEKAIL

SEQ ID NO: 37278 - DNA, 1086 bp, Rubrobacter xylanophilus DSM 9941
  CDS (1)..(1086)
atggagatcgtgctggagaacctcacgaagcgcttcgacactgtggtggccgtcgacgggatagacctgagcgtggccagcggggagttcgtggccctgctcggcccctccggctgcggcaagaccaccacgctgcttacgatcgcggggatctaccggcccacggaggggcgggtgctcttcgacgggcgggacgtgagccgcctggcgccgcgggagcgcaacctggggatggtcttccagagctacgccctctacccgcacatgagcgtctacgagaacctgaccttcccgctgcggctggcgaaggtgccggcgaaggagatgcggacgcgggccgaccggatcgccgccctgctggacatctcggagctcatggaccgcaggcccggccagctctccggcggccagcagcagcgggtggccctgggccgcgccctgataaaggagccggacgccctgctcttcgacgagcccctgagcaacctggacgcccgcctccgcctcaccacccgcacggagataaagcggctgcagcaggagctgggcatcacctcggtcttcgtcacccacgaccagacggaggcgatgacgatggccgacaggattgcggtgatcaaccgcggcaggctggagtcctacgcctccccggacgacacctataaccgcccccggacccgctttgtggcgggcttcgtgggcagcccgccgatgaacttcctggaggtggagctctcggccgccggggagggcttcgtggcccgccgggcgggggtggagctgcccgtctgcgcggagcgggcgcggcgggcgctggagcggggcggcggggggagggtggtgctcggcgtccgcccggaggacgtcgccctcggcggcgggggggtgcccggcgaggtgatagacgtcgagcccctgggccgggagaacctggtggtcgtctcgatcggggagggggaccagctccgcgcgatcaccggcgccggcacccggcccgcggtgggggaccggctctccctggccgtagacccggagagggtccagctcttcgacccctcctccggccgctccctgctctggagctga

SEQ ID NO: 37279 - protein, 361 aa, Rubrobacter xylanophilus DSM 9941
MEIVLENLTKRFDTVVAVDGIDLSVASGEFVALLGPSGCGKTTTLLTIAGIYRPTEGRVLFDGRDVSRLAPRERNLGMVFQSYALYPHMSVYENLTFPLRLAKVPAKEMRTRADRIAALLDISELMDRRPGQLSGGQQQRVALGRALIKEPDALLFDEPLSNLDARLRLTTRTEIKRLQQELGITSVFVTHDQTEAMTMADRIAVINRGRLESYASPDDTYNRPRTRFVAGFVGSPPMNFLEVELSAAGEGFVARRAGVELPVCAERARRALERGGGGRVVLGVRPEDVALGGGGVPGEVIDVEPLGRENLVVVSIGEGDQLRAITGAGTRPAVGDRLSLAVDPERVQLFDPSSGRSLLWS

SEQ ID NO: 37280 - DNA, 1056 bp, Mesorhizobium sp. BNC1
  CDS (1)..(1056)
ttggcgacagtagatatcgatggtgtgcaaaagcacttcggcgcgctgcatatcatccgggacatttccatacacatcgacaacggtgagttcatcattctggttgggccttctggctgcggaaagtccacgctgctgagaatgattgccggcctggagaatgtcactggcggccagattcgcattgggaaccgggtggtcaacgatctggctcccaaggaccgcgacattgccatggttttccagaactatgcgctctatccgcacatgactgtgcagagaaacatggatttctccttgcggatgcgcaatgcgatggacgcagaagcggatcagcgcgtggcaaatgccgcatccattctaggtatcgatcacctgttggaccgctttcccaagcagctttccggcggccagcgccagcgggtggccatgggccgcgcgatcgtgcgcaacccgcaggccttcctcttcgacgagccgctctccaacctggatgccaagctgcgcgtggcgatgcgtgccgagatcaaggagctgcaccagcgcctcggaacgacgacgatctatgtcacccacgaccagatcgaagccatgaccatggccgaccgcatcgtcgttatgaacggcggtatcatagagcagattggaaagccgctcgatctctacgacaatccacgcaacgtcttcgtggcctcgttcatcggctcgccttcgatgaatcttgtagagggccggataactggtgggatgtttcaggcaggcgacggcatcctctcgctcaagcttgcaagcggcccagcgaatatggaagggcgcccggtaacctgcggcttcaggcccgaacatctcaacataacgagcaccggttcgccggcgacggtggctatcgtcgagccgacgggatccgagacgcagatcatactacgcgcgggagacaaggaattggtctgcttgtcccgcgagcgcgtgtcgctaaggccgggcgatccggtgacgatcaacgtcgagcccaaacatctgcttctcttcgattccaagactggcctgcgcctctga

SEQ ID NO: 37281 - protein, 351 aa, Mesorhizobium sp. BNC1
MATVDIDGVQKHFGALHIIRDISIHIDNGEFIILVGPSGCGKSTLLRMIAGLENVTGGQIRIGNRVVNDLAPKDRDIAMVFQNYALYPHMTVQRNMDFSLRMRNAMDAEADQRVANAASILGIDHLLDRFPKQLSGGQRQRVAMGRAIVRNPQAFLFDEPLSNLDAKLRVAMRAEIKELHQRLGTTTIYVTHDQIEAMTMADRIVVMNGGIIEQIGKPLDLYDNPRNVFVASFIGSPSMNLVEGRITGGMFQAGDGILSLKLASGPANMEGRPVTCGFRPEHLNITSTGSPATVAIVEPTGSETQIILRAGDKELVCLSRERVSLRPGDPVTINVEPKHLLLFDSKTGLRL

SEQ ID NO: 37282 - DNA, 1143 bp, Pseudomonas syringae pv. syringae B728a
  CDS (1)..(1143)
atgaaattgaagctagacaacatcaacaagcaattgggcggcacgcgtattctgcgcgacgtcagcctggagatcgctgccggtgagttcgttgtgttcgtcggcccgtcgggctgcggaaagtcgacgctgctgcgcttgatcgccggcctggattcgatctgtgctggcgacctgctgatcgacggacgacgggtcaatgacctggaaccacgcgagcgtggtgtcggtatggtctttcagtcctacgccctgtacccgcacatgagcgtctacgacaacatcagtttcggcctcaagctggccaagacggaaaaaagcagcctgcgcgaacgcgtgctgaaaaccgcgcagatcctgcaactggacaaactgctgcagcgcaagcccagggaactgtccggcgggcagcgccagcgtgtggccatgggccgagccatggcgcgggaaccggacatcctgttgttcgatgaaccgctttccaacctggatgcctcgttgcgggttcagatgcgcaacgaaatcgcccgcctccacaagcggctgggctcgacgatgatctacgtcacccacgatcaggtagaggcgatgaccctggcggacaagattgtcgtactcaacggcggtcaggtcgaacaggtcggctcaccacgcgaactctacgagcgtcctgccagcctcttcgtcgccggttttctgggctcgccaagaatgaattttctgcccgtgagcttgcaggcaccgggtcgcagcagcctgatcgatatcccggcactgggcatgaaatccctgcccttcgacagctcgaatctgaccgaggatgcgcaactgaccttgggtgtgcgcccggagcacatcaccctcaatgctgcgaacaacggcgttggcgtcacggtatccggtgtcgaatacctgggcagcgaggtctatgtgcacctggctaccggcgcgagcgagcccttgatttgtcgctgcgatgccaaggctggctggcaggtgggtgaccaggtcgcgctgcaattcgacgacagcaacctgcacctgttcgacgccgatggcctggccctgaagcgccacacagacgccagtcaacacctgacacccggcaccacaccgcacctcgtacaagcaggcaccctatga

SEQ ID NO: 37283 - protein, 380 aa, Pseudomonas syringae pv. syringae B728a
MKLKLDNINKQLGGTRILRDVSLEIAAGEFVVFVGPSGCGKSTLLRLIAGLDSICAGDLLIDGRRVNDLEPRERGVGMVFQSYALYPHMSVYDNISFGLKLAKTEKSSLRERVLKTAQILQLDKLLQRKPRELSGGQRQRVAMGRAMAREPDILLFDEPLSNLDASLRVQMRNEIARLHKRLGSTMIYVTHDQVEAMTLADKIVVLNGGQVEQVGSPRELYERPASLFVAGFLGSPRMNFLPVSLQAPGRSSLIDIPALGMKSLPFDSSNLTEDAQLTLGVRPEHITLNAANNGVGVTVSGVEYLGSEVYVHLATGASEPLICRCDAKAGWQVGDQVALQFDDSNLHLFDADGLALKRHTDASQHLTPGTTPHLVQAGTL

SEQ ID NO: 37284 - DNA, 1059 bp, Rhodobacter sphaeroides 2.4.1
  CDS (1)..(1059)
atgagcaccgtccacgtccgcaacgtcaaaaagagctactccgacctgaccgtgatcgaggatctgtccttcgacatccacgacggcgagttcatggtcttcgtcggcccctccggctgcggcaagtccaccctcctgcgcatgatcgccgggctcgaatcctttcagggcggcgaggtggccatcggcgcgcgcgtcgtgaacggcgtgcccgcgcgcgaccgcaacatcgccatggtgtttcaggattacgcgctctatccgcacatgacgatccgggacaacatgtccttcggcctcaagatgcggaagacgcccaaggccgagatcgagcggcgggtggcggcggcggccgagatcctccagatcggccacctgctcgaccgcaagccccgcgcgctttcgggcggccagcgccagcgcgtggccatgggccgcgccatcgtgcgcgagcccgacgtgttcctgttcgacgagccgctctcgaacctcgatgccaagctccgcgtcgaggtccgcaccgagatcaagcggcttcatgcccgcctcggcgccacgatgatctatgtgacccacgatcaggtcgaggccatgaccatggccgaccggatcgtggtgctgaagggcggcgcggtcgagcagatcggcaccccgcaggagctctatcgcgagccgcgcacccggttcgtcgcgggcttcatcggctcgccggggatgaacttcgcccccgcccggatcgagggcgacgtggccacgctcgtgaccggcgaccgggtggccgtgcgccgcgtcacccccggcacgggcgcggtgcagggcgagatcggcatccgccccgaacatgtgcagctggccgacccgcacggcccgggcgtcgagacactggtcgatgtggtcgaaccgctcggcgccgacacgctggtcgcggtccggctcgacgaggcgcagctcatggtgcgcctgcccggcgagatcatccccgccgagggcgaccgcctgcggctttccttcacccccggcgcgacgatggccttcgacgcgcagggactgcggatctga

SEQ ID NO: 37285 - protein, 352 aa, Rhodobacter sphaeroides 2.4.1
MSTVHVRNVKKSYSDLTVIEDLSFDIHDGEFMVFVGPSGCGKSTLLRMIAGLESFQGGEVAIGARVVNGVPARDRNIAMVFQDYALYPHMTIRDNMSFGLKMRKTPKAEIERRVAAAAEILQIGHLLDRKPRALSGGQRQRVAMGRAIVREPDVFLFDEPLSNLDAKLRVEVRTEIKRLHARLGATMIYVTHDQVEAMTMADRIVVLKGGAVEQIGTPQELYREPRTRFVAGFIGSPGMNFAPARIEGDVATLVTGDRVAVRRVTPGTGAVQGEIGIRPEHVQLADPHGPGVETLVDVVEPLGADTLVAVRLDEAQLMVRLPGEIIPAEGDRLRLSFTPGATMAFDAQGLRI

SEQ ID NO: 37286 - DNA, 1101 bp, Bacillus cereus G9241
  CDS (1)..(1101)
atggcagaactaaaattagaaaacatttataaaatatatgataataacgtaacagctgtaacagacttcaatttacacattcaagataaagaatttatcgtatttgtcggtccttctggatgcggaaaatctacaacattacgaatggtggctggacttgaagatatttcaaaaggagagttttcaattgatggtaagctaatgaatgatgtccctccaaaagatcgcgatatcgcaatggtcttccaaaactatgccctatatccacatatgagtgtgtatgataatatggcatttggattaaaacttagaaaaataccaaaagatgaaattgatcgtcgtgtgaaagatgcagcaaaaattttaggactggaacaatatttagatagaaaaccgaaagctttatccggtggacaacgccaacgtgttgcgttagggagagcaatcgttcgagacgcgaaagtgttcttaatggacgagcctttatctaacttagatgctaaattacgtgttgcaatgcgctcagaaatttctaagttacaccaccgccttggaacgacaacaatttatgtaacgcatgatcaaactgaagcgatgacaatggcttctcgtcttgttgttatgaaagacggaaaaattcaacaaatcggtactcccaaagaagtatatgaaacacctgaaaatattttcgttggtggatttatcggctctccagcgatgaatttcttccgtggtaaattaactgaaactgatttcgttatagacaatgcaataaaaattaaagtaactgaaggaaaaatgaagatgttacgtgaacaagactatgtaaataaagacattgttttagggattcgtcctgaagatattcatgatgaactattatttttagaagcttcacaatctactgcctttacaacaaacatagaagttgctgaattgttaggtgctgaatctattttatatatgaaacttggaaatcaagattttgcagcacgtgttgatgcaagacatacattctcacctggtgaccaaattaaactagcatttgatatgaataaagcgcatttctttgatagccaaaccgaacaacgtattcgttaa

SEQ ID NO: 37287 - protein, 366 aa, Bacillus cereus G9241
MAELKLENIYKIYDNNVTAVTDFNLHIQDKEFIVFVGPSGCGKSTTLRMVAGLEDISKGEFSIDGKLMNDVPPKDRDIAMVFQNYALYPHMSVYDNMAFGLKLRKIPKDEIDRRVKDAAKILGLEQYLDRKPKALSGGQRQRVALGRAIVRDAKVFLMDEPLSNLDAKLRVAMRSEISKLHHRLGTTTIYVTHDQTEAMTMASRLVVMKDGKIQQIGTPKEVYETPENIFVGGFIGSPAMNFFRGKLTETDFVIDNAIKIKVTEGKMKMLREQDYVNKDIVLGIRPEDIHDELLFLEASQSTAFTTNIEVAELLGAESILYMKLGNQDFAARVDARHTFSPGDQIKLAFDMNKAHFFDSQTEQRIR

SEQ ID NO: 37288 - DNA, 1161 bp, Pseudomonas fluorescens PfO-1
  CDS (1)..(1161)
atggctacgctcgaacttcgcaatgtaaacaagacctacggtgccggcctgccggacaccctgaagaacatcgaactgtcgatcaaggacggtgagttcctgatcctcgtcgggccttcgggctgcggcaagtcgaccctgatgaactgcatcgccggcctggaaaccatcaccggcggcgcgatcatgatcggtgaccaggacgtcagcggcatgagccccaaggatcgcgacatcgccatggtgttccagtcctacgcgctgtacccgaccatgagcgtgcgcgagaacatcgagttcggtctgaagatccgcaagatgagccagtcggcgatcgacgaagaagttgcccgcgtggccaagctgctgcagatcgagcacctgctcaatcgcaagccgggccagctctccggcggtcagcaacagcgcgtggcgatgggccgtgcgctggcgcgtcgaccgaagatctacctgtttgacgaaccgctgtccaacctcgacgccaagctgcgcgtcgagatgcgtaccgaaatgaaactgatgcaccagcgcctgaaaaccaccacggtctacgtgacccacgaccagatcgaagcgatgaccctgggcgacaaagtggcggtgatgaaggacgggatcatccagcagttcggtacgccgaaagagatctacaacgacccggccaacctgttcgtggcgagcttcatcggttcgccgccgatgaacttcatcccgctgcgcctgcaacgcaaggacggtcgtctgctggcgctgctcgacagcggccaggcccgttgcgaattgccgatggcgatgcaggacgccggactcgaagaccgcgaagtgatcctcggcctgcgcccggagcagattgtcctggccaatggcgagggcaatggattgccgagcatcaaggctgaagtgcaggtcaccgagccgaccggtccggacaccctggtgttcgtcaacctcaacgacaccaaggtctgctgccgtctggcgccggatgtggcgccgcaggtgggtgagacgctgaccctgcaattcgatccgtcgaaagtgctgctgttcgatgccaagtccggcgagcgcctgggggttgcgggcctgccgaaaaccgagtcgcacagcgccaacgtggcccagttcaagggtcgctga

SEQ ID NO: 37289 - protein, 386 aa, Pseudomonas fluorescens PfO-1
MATLELRNVNKTYGAGLPDTLKNIELSIKDGEFLILVGPSGCGKSTLMNCIAGLETITGGAIMIGDQDVSGMSPKDRDIAMVFQSYALYPTMSVRENIEFGLKIRKMSQSAIDEEVARVAKLLQIEHLLNRKPGQLSGGQQQRVAMGRALARRPKIYLFDEPLSNLDAKLRVEMRTEMKLMHQRLKTTTVYVTHDQIEAMTLGDKVAVMKDGIIQQFGTPKEIYNDPANLFVASFIGSPPMNFIPLRLQRKDGRLLALLDSGQARCELPMAMQDAGLEDREVILGLRPEQIVLANGEGNGLPSIKAEVQVTEPTGPDTLVFVNLNDTKVCCRLAPDVAPQVGETLTLQFDPSKVLLFDAKSGERLGVAGLPKTESHSANVAQFKGR

SEQ ID NO: 37290 - DNA, 1119 bp, Rhodospirillum rubrum
  CDS (1)..(1119)
atggcatcactcggcattcgcggcatcaccaagcgctttggcgccaccgaggtgctcaagggcatcgatcttgatctcgacgacggcgaattcctggttcttgtcgggccctcgggctgtggcaaatcaaccctgctcaatatcatcgccggcctggaaacccccagcgagggcgaggtggtgatcggcggcgccgtggtcaacgacgtggcgccgcgcgaccgcgacatcgccatggtcttccagtcctatgcgctttatccgacgatgaccgtgcgcgagaacatcaccttcggcctgcgcatgcgcggcgtggccaagcccgagcgcgagcgggcggtggccaaggtcgccaccatgctgcagatcgggccgctgcttgatcgcaagccgggccagttgtcgggcggacagcgccagcgcgtggcgatgggccgggccctggtgcgcgatccgcagatttttttgttcgacgagccgctgtccaatctcgatgccaagctgcgcgtcgagatgcgccacgagatcaagaccctgcaccgcgccgtggcgcggacgatggtttatgtcacccacgatcaggtcgaggcgatgaccctggccagccgcatcgccgtgatgcatcagggcgtcatccagcattatggcaccccggccgagatttacgagcggccggccaatctgttcgtcgccggcttcatgggcgcccaatcgatgaatttcgccaagggcctgctggtcggcgacagccagggcggcggcatggcagtgcgcctggacgaggccaaggggccgcttgatctgccgctcgcccggcccggcaacggttggcgatcgcaccttggccggccggtgatcctgggcttgcggcccgaatacatcggggcggccgatccggcgggcctgccgccggggctggtggcggtcgagcgccgggtcgatatgatcgagccgacgggggccgacaccatggtgttcttccagcttggcggcaccccggcctcggcccgcgtcgccccacgggccatccccggcgttggtccgggagcgttgtcgaccctggccttcgatatgaccgccgcctcgctgttcgacccggacaccgaacgccggctgtga

SEQ ID NO: 37291 - protein, 372 aa, Rhodospirillum rubrum
MASLGIRGITKRFGATEVLKGIDLDLDDGEFLVLVGPSGCGKSTLLNIIAGLETPSEGEVVIGGAVVNDVAPRDRDIAMVFQSYALYPTMTVRENITFGLRMRGVAKPERERAVAKVATMLQIGPLLDRKPGQLSGGQRQRVAMGRALVRDPQIFLFDEPLSNLDAKLRVEMRHEIKTLHRAVARTMVYVTHDQVEAMTLASRIAVMHQGVIQHYGTPAEIYERPANLFVAGFMGAQSMNFAKGLLVGDSQGGGMAVRLDEAKGPLDLPLARPGNGWRSHLGRPVILGLRPEYIGAADPAGLPPGLVAVERRVDMIEPTGADTMVFFQLGGTPASARVAPRAIPGVGPGALSTLAFDMTAASLFDPDTERRL

SEQ ID NO: 37292 - DNA, 1110 bp, Burkholderia fungorum LB400
  CDS (1)..(1110)
atggcaagcgtaactctgcgcaacatcaggaaggcgtacgacgacaacgaagtgatgcgcgacatcaacctcgatatcgccgacggcgagttcgtcgtgttcgtgggcccgagcggttgcggtaaatcgacgctgatgcggatgatcgccggcctcgaagatatcagcggcggcgatctcaccatcgacggcacgcgcatgaacgacgtgccgcccgccaagcgcggcatcgcaatggtgttccagtcgtacgcgctctatccgcacatgacgctatacgacaacatggcattcggcctgaaactcgccggcaccaaaaagccggaaatcgacgccgccgtgcgcaatgcggcgaagatcctgcacatcgaccatctgctcgatcgcaagccgaagcagttgtccggcggccagcgtcagcgcgtggcgatcggccgcgcgattacgcgcaagccgaaggtgttcctgttcgacgaaccgctgtcgaatctcgacgccgcgctgcgcgtgaaaatgcgcctcgaattcgcgcgtctgcatgacgaactgaagaccacgatgatctatgtgacgcacgatcaggtcgaagccatgacgctggcggacaagatcgtggtgctgtcggcgggcaatctggagcaggtcggcagcccgaccatgctgtatcacgcgccggccaatcgcttcgtggcgggattcatcggttcgccgaaaatgaacttcatggaaggggtggtgcagtcggtcacgcacgacggcgtcacggtacgctacgaaaccggcgagacgcagcgcgtggcggtggagccggcctcggtcaagcagggtgacaaggtgacggtcggcatccgccccgagcatctgcatgtgggcatggccgacgacggcgtctcggcccgcacgatggcggtcgaatcgctcggcgactcggcgtatctgtatgcagaatcgagcgtcgcgccggatggactgatcgcgcggattccaccgcttgagcggcataccaagggcgagatgcagaaactcggcgccgcgcccgagcattgccatctgttcgacagcgcaggcaaagcattccagcgcaagatcgtcgaagtgctagctgcgtga

SEQ ID NO: 37293 - protein, 369 aa, Burkholderia fungorum LB400
MASVTLRNIRKAYDDNEVMRDINLDIADGEFVVFVGPSGCGKSTLMRMIAGLEDISGGDLTIDGTRMNDVPPAKRGIAMVFQSYALYPHMTLYDNMAFGLKLAGTKKPEIDAAVRNAAKILHIDHLLDRKPKQLSGGQRQRVAIGRAITRKPKVFLFDEPLSNLDAALRVKMRLEFARLHDELKTTMIYVTHDQVEAMTLADKIVVLSAGNLEQVGSPTMLYHAPANRFVAGFIGSPKMNFMEGVVQSVTHDGVTVRYETGETQRVAVEPASVKQGDKVTVGIRPEHLHVGMADDGVSARTMAVESLGDSAYLYAESSVAPDGLIARIPPLERHTKGEMQKLGAAPEHCHLFDSAGKAFQRKIVEVLAA

SEQ ID NO: 37294 - DNA, 1110 bp, Enterococcus faecium
  CDS (1)..(1110)
atggtagaaatggctctgaaaaacgtatataaaaaatatgacaatgcagaaaattattctgtaactgattttaatctatcaatcaaagaccgtgaatttatcgtttttgttggtccttccggttgtggaaagtcaactactttgcgaatgatcgcgggactggaagatatctctgaaggagaactaaatatcggcggaaaagtcatgaatgacgtggcacctaaagaccgtgatattgccatggttttccaaaactacgcattgtatcctcatatgactgtttttgataatatggcttttggcttgaaattacgtaaatatgataaagcagacatcaaaaaacgtgtggacaatgcagcagagatcttaggtctgacagaatacttgaaacgaaaaccagctgctttatctggtggacaacgccaacgtgtggcattgggacgggcaatcgttcgggatgcaaaagtcttcttaatggatgagccattatcaaatttagatgctaaattacgtgtagccatgcgtgctgagattgccaaacttcaccagcgtcttgaaacaacgaccatctatgttactcacgatcagacagaagcaatgactatggctgaccgaatcgttatcatgaaagacggatttatccaacaaatcggtacaccgaaagaagtttatgatacacccgtcaatatgttcgttgccggctttattggatctcctgccatgaacttctttaatgtgacattgaaaaatggtgttatcacagatggacatgggcttaagcttcgtattcctgaaggaaaaaacaaagtattagttgaaaaaggttatgaaggaaaagaagttatcttcggtattcgtccagaagacatccacagtgaacaagtagcccttgaagcttcacctgaagccgtagtgaaatcagaagttgtcgtttccgaattacttggagctgaaacgatgctttacacaaaaactggttctactgagttcatctcaaaagtagatgcaagagatttccataaaccaggcgaaatagtcgaccttgccttcaacatcagcaaaggccacttctttgataaagaaacagaacaagtcatcaaacttccataa

SEQ ID NO: 37295 - protein, 369 aa, Enterococcus faecium
MVEMALKNVYKKYDNAENYSVTDFNLSIKDREFIVFVGPSGCGKSTTLRMIAGLEDISEGELNIGGKVMNDVAPKDRDIAMVFQNYALYPHMTVFDNMAFGLKLRKYDKADIKKRVDNAAEILGLTEYLKRKPAALSGGQRQRVALGRAIVRDAKVFLMDEPLSNLDAKLRVAMRAEIAKLHQRLETTTIYVTHDQTEAMTMADRIVIMKDGFIQQIGTPKEVYDTPVNMFVAGFIGSPAMNFFNVTLKNGVITDGHGLKLRIPEGKNKVLVEKGYEGKEVIFGIRPEDIHSEQVALEASPEAVVKSEVVVSELLGAETMLYTKTGSTEFISKVDARDFHKPGEIVDLAFNISKGHFFDKETEQVIKLP

SEQ ID NO: 37296 - DNA, 1233 bp, Thermobifida fusca
  CDS (1)..(1233)
atggccgagatcgtcctcagcggcgtcgacaaggtctacagcggcggcgtcaaagccgtggacaacctcaacctcgagatcaaggacggcgagttcatggtgctcgtcggtccgtccggatgcggcaagtcgaccgcgctgcggatgatcgccggcctggaggagatcaccgcgggcaccctcaccatcggcggcaaggtcgtcaacgacctcccgccgaagagccgcgacatcgccatggtcttccagaactacgccctctacccgcacatgacggtggagcagaacctggcgttcggtctgaagctgcgcaagacccccaaggctgagatcgagcgccgggtcaaggaagccgcggccatgctcggtctggagccctacctcaagcgcaagccggccgcgctctccggtggtcagcgccagcgtgtggcgatgggccgggccatcgtccgtgaaccgcaggcgttcctcatggacgagccgctgtccaacctggacgccaagctgcgcgtgcagatgcgcgcctccctgcaccagctccacgagcggctgggcgtcaccaccgtctacgtcacccacgaccaggtcgaggcgatgaccctgggcgaccgggtggcggtcctcaaggacggcaagctgcagcaggtcgacacgcccaagaacctcttcgaccacccggtcaacctgttcgtcgccgggttcatcggctcgcccgcgatgaacttcgtcaacgcccgcatcgaggcggagaacggcggcgccgcgctgcgcttcgccgagcacgtgctgcacgtcagcgaagagagcctgcgcgagcaccccggcctggagaagtacttcggccgcgagatcatcctgggcatccgcccgtccgacttcgacgacgccaacttcgcttcccaccgcggcagcaccatcaacgtgaccgccaacgtcaccgaggagctcggcaccgagatcaacgtgatcttcgcggtggacgccccgccggtgcagcacgaagccacggccgcgctggctgccggggccgccggcaacggggacagcgacgacgcggcgctgccgctggccggtgagaacaagaccttcttcaccgcccgagtcaacccgcgcagctcggtccgccccggccacccgatctccttgaccgtggacacccgccgcctgcactacttcgacccgtccagcggtctggccatcggccaccccgccaacaccgcggccggcgtctag

SEQ ID NO: 37297 - protein, 410 aa, Thermobifida fusca
MAEIVLSGVDKVYSGGVKAVDNLNLEIKDGEFMVLVGPSGCGKSTALRMIAGLEEITAGTLTIGGKVVNDLPPKSRDIAMVFQNYALYPHMTVEQNLAFGLKLRKTPKAEIERRVKEAAAMLGLEPYLKRKPAALSGGQRQRVAMGRAIVREPQAFLMDEPLSNLDAKLRVQMRASLHQLHERLGVTTVYVTHDQVEAMTLGDRVAVLKDGKLQQVDTPKNLFDHPVNLFVAGFIGSPAMNFVNARIEAENGGAALRFAEHVLHVSEESLREHPGLEKYFGREIILGIRPSDFDDANFASHRGSTINVTANVTEELGTEINVIFAVDAPPVQHEATAALAAGAAGNGDSDDAALPLAGENKTFFTARVNPRSSVRPGHPISLTVDTRRLHYFDPSSGLAIGHPANTAAGV

SEQ ID NO: 37298 - DNA, 1113 bp, Clostridium thermocellum ATCC 27405
  CDS (1)..(1113)
atggcaagcgttaaacttaaaggtgtgtacaaaagatatccaggtggggttactgcggtaaacgactttaatttggatattgaagacaaggaatttattatattggtaggaccgtctggatgtggaaaaactacaacattgagaatggttgccggattggaagaaattacggaaggtgagctttatataggtgacaaactggtcaacgacgtggcacctaaagatagagatatagcgatggttttccagaactacgctttgtatccgcatatgtctgtgtttgacaacatggcatttggattgaagcttagaaaagttcccaaagatgagattaagaggagagttttggaggctgcaaagattcttgacatagaacacttgctggaaagaaagccgaaggcattgtccggaggtcagagacagagggttgcgcttggacgtgccatagttcgtaatcctaaggtattcttgatggatgagcctctgtcaaaccttgacgcaaaactcagagttcagatgagaaccgaaatcagcaagctgcaccagagacttcagacaacattcatctacgttactcacgaccagacagaagctttgacgatgggtacaagaattgttgttatgaaagacggatacattcaacaggttgatactcctacaaatctttatgagagaccttgcaacatgttcgtagcaggatttatcggaagcccgcagatgaactttgtaaatgcaagaattgaaaaacgcggggatgaaatgcaccttctgtttggaaaacaggatattaaacttccggaaggaaaggcaaagaagcttgagtccagcgaatatgtgggcagagaagtggtaatgggtatacgtcctgaaaacattcgtgatgaagagatttatcttgaatcaatgtctgagaatgttgtagagggaagagttgaagttgttgaaatgctcggttccgaaacattgatttacatggtaatagatgactttgagtttactgcaagagttaatccgagatcaaaggctagaccgggcgatgtgattaaggttgcttttgatgccaacaagattcatctctttgacaaggaaactgaaaaaacaataatgaactaa

SEQ ID NO: 37299 - protein, 370 aa, Clostridium thermocellum ATCC 27405
MASVKLKGVYKRYPGGVTAVNDFNLDIEDKEFIILVGPSGCGKTTTLRMVAGLEEITEGELYIGDKLVNDVAPKDRDIAMVFQNYALYPHMSVFDNMAFGLKLRKVPKDEIKRRVLEAAKILDIEHLLERKPKALSGGQRQRVALGRAIVRNPKVFLMDEPLSNLDAKLRVQMRTEISKLHQRLQTTFIYVTHDQTEALTMGTRIVVMKDGYIQQVDTPTNLYERPCNMFVAGFIGSPQMNFVNARIEKRGDEMHLLFGKQDIKLPEGKAKKLESSEYVGREVVMGIRPENIRDEEIYLESMSENVVEGRVEVVEMLGSETLIYMVIDDFEFTARVNPRSKARPGDVIKVAFDANKIHLFDKETEKTIMN

SEQ ID NO: 37300 - DNA, 1209 bp, Oenococcus oeni PSU-1
  CDS (1)..(1209)
atggttgaaatgtctttggaacatattcggaaggtttatcctggccagattgtggctgctattcctgactacaatttgaaaattaacgatggagaatttacggttttcatcggtccttcgggatctggcaagtcgacaatcttgcgaatgattgccggacttgaagatatcacttccggtgaattcaaaatggatggcaggctcatgaatgatgttgagcctaaaaaccgcgatattgcaatggtctttcaaaattatgctttatatccacatatgacggtttttgacaatatggcttttggtttaaaacttcgtaaagagccaaaggataaaatcaaagaagcagttgacaaagcagctgaattattgggtttaacggattttttggatcgtaaaccagctaatctgtccggtggccagcgtcagcgagtcgctcttggacgagcgatggtgcgcgatgctaaagtgatgttgttggatgaacctttgtcaaaccttgatgccaagttacgagtagaaatgcgttcaacagttgccaagcttcatcaggaactaggcaacaatttcatttatgtaactcatgaccaaattgaggcgatgacgatggctgaccgaattgttttgattgaccatggtgttattcaacaggtcggatctccggaagagctttataacaatccgggtaataaattcgttgccggatttatgggttcaccgtcaatgaatttcttgaatctaattttaaagggcgaccaactagtttccaaggatggcaaagtcaacctgaaaattcctaaaggagattccaagtttctaagggaaaagggctatgaaaacaaggaactcatttttggtattcgtcccgaggacattcataccgaatcagttgccaaagatgcctatccgggagatacagtcaaagtaaaattggatctggtcgagccgttgggttctgaaacgatgtattattttgaacttaataatcaacagttcgttgcccgggtcagtgctcgtgaaattgcccagaccggggatcaagctgaattgactttccagatttccagtgctcatttcttcgatccaataacagaattagcaattgttcctccggaagcgaaggtttataaaagtccgacgaggcaggaatccgatgttgccaatacgaagggaacctcgctggaaggacaaaagttttctgaaaaatattaa

SEQ ID NO: 37301 - protein, 402 aa, Oenococcus oeni PSU-1
MVEMSLEHIRKVYPGQIVAAIPDYNLKINDGEFTVFIGPSGSGKSTILRMIAGLEDITSGEFKMDGRLMNDVEPKNRDIAMVFQNYALYPHMTVFDNMAFGLKLRKEPKDKIKEAVDKAAELLGLTDFLDRKPANLSGGQRQRVALGRAMVRDAKVMLLDEPLSNLDAKLRVEMRSTVAKLHQELGNNFIYVTHDQIEAMTMADRIVLIDHGVIQQVGSPEELYNNPGNKFVAGFMGSPSMNFLNLILKGDQLVSKDGKVNLKIPKGDSKFLREKGYENKELIFGIRPEDIHTESVAKDAYPGDTVKVKLDLVEPLGSETMYYFELNNQQFVARVSAREIAQTGDQAELTFQISSAHFFDPITELAIVPPEAKVYKSPTRQESDVANTKGTSLEGQKFSEKY

SEQ ID NO: 37302 - DNA, 1122 bp, Oenococcus oeni PSU-1
  CDS (1)..(1122)
atgccaaatatagttgttagtcatctaaccaaaaaatacccaaaggctgttaaagaaactttgagcgattcaaactttacgattgctaatggcgagttttgggcaattatcggcccttcaggatgcggtaaatcaacttttttaagaatgcttgccggtttggaacctattagtggcggaacaatttctgttgataataaagtaattaacaaattgccaccccagcaacgcaagatggcaatggtttttcaagactacgctctctatccgcacatgaatgtctacggaaatatggcttttaacctcaagatgaagaaaaaaacaaagaaagagattgaaacaaaaattaaaaaagccgctaacgccttgggacttaatgacttattaaatagaaaaccggctgagctttccggtgggcaaaggcaacgcgttgctttgggaagagcgatggtccgcgatcccgatttctttttaatggacgaaccattatccaatcttgatgctaaattacgagtcgatatgcggagcttgatcatcaagctgcatcatcaactaaaaacaacaacaatttacgtaacacacgatcaggccgaagcgatgacgatggccgatcgaattttgcttttaaatgacggcggcattcagcaagttggcacaccttttgagttgtacaatgcaccggttaatttatttgtcgctcaatttattggatcacccagcatgaatatattaaaggggaaattagattccggaaagttttctatcaatcaaagtgatttggatttaagtcatattttacccgataaattaaaaaattatcagggatcaattttaattggctttcgaccagaaagtatcaaaaatatccaagtagagaaagaaacaaaaaacaaaaaaatatcaaacaacttaaatctacaaggaaaattgaattttatcgaatatcttggcggacacagcttgctgtcgcttgatatgtttggtcaaacaattattattcaaaccgaaaaaaacttctcgagaaatactgataaaaattttcagatttcaattccaaacaacaaattgttttactttgatcccaaaagtgggaagaatttatcacttatggaagaaaaataa

SEQ ID NO: 37303 - protein, 373 aa, Oenococcus oeni PSU-1
MPNIVVSHLTKKYPKAVKETLSDSNFTIANGEFWAIIGPSGCGKSTFLRMLAGLEPISGGTISVDNKVINKLPPQQRKMAMVFQDYALYPHMNVYGNMAFNLKMKKKTKKEIETKIKKAANALGLNDLLNRKPAELSGGQRQRVALGRAMVRDPDFFLMDEPLSNLDAKLRVDMRSLIIKLHHQLKTTTIYVTHDQAEAMTMADRILLLNDGGIQQVGTPFELYNAPVNLFVAQFIGSPSMNILKGKLDSGKFSINQSDLDLSHILPDKLKNYQGSILIGFRPESIKNIQVEKETKNKKISNNLNLQGKLNFIEYLGGHSLLSLDMFGQTIIIQTEKNFSRNTDKNFQISIPNNKLFYFDPKSGKNLSLMEEK

SEQ ID NO: 37304 - DNA, 1140 bp, Moorella thermoacetica ATCC 39073
  CDS (1)..(1140)
atgccggtaatagccggggatattctttttgacaaagtacgaaaagtttatggccgggtaacggcgttgcagcaactggacctcaaggtcgaggccggggaacgactggtactcctgggtccgtcaggttgtggcaagacgacagccttacgcctggtagccggtctggaaagggtgaccagcggtaaattgtacttaaacggccggctggccaacaatctggaacccggtgagcgggatgtggccatggtcttccagaactatgccctctatccccatatgacggtatgggagaacatcgcctttggactgcaggtgcggcgggtggcgaaggaggaaattaaagccagaattaaggaggctctggctatcctcggcctggaaggattggaggagcgccggccacgggaattgtcaggagggcagcgccagcgggtggcccttgcccgggctatagttaaacaggccccctatttcctcctggatgagcccctttctaacctggatgcccaattgcgtacccaggcccgcagtgagctggtacgcctgcatcggaaactgaattcgaccatgatctatgttacccatgaccaggtagaggccatgaccatagggcagcggatagccatcctggcaggcggcgtcctgcagcaggtagataccccggagaatatctacaaccgcccggccaatacctttgtggccaaatttataggcaacccgcccatgaacctcttgccgggaatagtaaaagggaaccagttgttcctcggcgaaggtctcaaacttataataccaggcaactggagcgcctggctcctgggtaagtcccaaagcaaggtgatcatgggccttaggcccgaagacgttaccttgagggaagaaggggtagccgaaggggaaggcctgccagtacgaattacctggcgagaaaattgtggtaaggagagattatattacctggcagccggcgacaaggagctaatagcttctttcagcgagggccgtacggaaccccggggaggagaattatggctgaccattgactggaataaggttcatttctttaccgaagggaatggcaattccctgggttacccctggaatacccgggagttgtcgctaaaggcttatgcctga

SEQ ID NO: 37305 - protein, 379 aa, Moorella thermoacetica ATCC 39073
MPVIAGDILFDKVRKVYGRVTALQQLDLKVEAGERLVLLGPSGCGKTTALRLVAGLERVTSGKLYLNGRLANNLEPGERDVAMVFQNYALYPHMTVWENIAFGLQVRRVAKEEIKARIKEALAILGLEGLEERRPRELSGGQRQRVALARAIVKQAPYFLLDEPLSNLDAQLRTQARSELVRLHRKLNSTMIYVTHDQVEAMTIGQRIAILAGGVLQQVDTPENIYNRPANTFVAKFIGNPPMNLLPGIVKGNQLFLGEGLKLIIPGNWSAWLLGKSQSKVIMGLRPEDVTLREEGVAEGEGLPVRITWRENCGKERLYYLAAGDKELIASFSEGRTEPRGGELWLTIDWNKVHFFTEGNGNSLGYPWNTRELSLKAYA

SEQ ID NO: 37306 - DNA, 1059 bp, Silicibacter sp. TM1040
  CDS (1)..(1059)
atgactggtgtcacgctgacaaatgccgtcaagaaatacggcgaagtgcagaccatctttgatgtgaacctcgagattgaggacggcgagttctgcgtcttcgtggggccttcgggctgcgggaaatccaccttgctgcgcatggtggcggggcttgaggaaaccacggcgggcaagatccacatcggcagccgcgatgtgacagatctggatgccgccgagcgtggtgtcgcaatggtattccagtcctacgcgctctatccccatatgacggttgaggaaaacatgggctttggcctcaagatgaccggccaccccaaggcggagatcaaggagaaggtcgcagaggcctcgcgcatcctgcaactcgatcaatacctcaaacgcaagcccaaggcgctctctggtggccagcgccagcgcgttgccatcggccgcgccatcgtgcggggccccgaggtgttcctgtttgacgagccgctctccaatcttgacgcagagctgcgcgttgacatgcgggtggagatcgcgcgtctgcacaaggaaattggcgcaacgatgatctatgttacccatgatcaggtcgaggccatgacccttgcggacaagatcgtggtgctgcgcgccgggcgcgtcgagcaggtcggcaagccgatggagttgtataacgatcccgacaatcgctttgtcgccgggttcatcggctctccgagcatgaattttgtcgagggagaggttcgcggtggcaaggttgtggtaagagcctttggcggacgcgagatcaccacttcggtagcgttgccgcaagacggggccaaggtcatcgtgggcctgcgtccgcaacacatccgactgagcgccgatggtcctgccacgttggatctgcgcgaacgcttgggaggggtctcttacgatcacctgatctgcgcagagggcgccaagctcatcgtggaaacccgcgaagaagacagcctagaggaaggcgactccgtcggctttgactttgaagaccgcgacgtgttcctgtttgacgcgcaatccgaagaacggttgcgctag

SEQ ID NO: 37307 - protein, 352 aa, Silicibacter sp. TM1040
MTGVTLTNAVKKYGEVQTIFDVNLEIEDGEFCVFVGPSGCGKSTLLRMVAGLEETTAGKIHIGSRDVTDLDAAERGVAMVFQSYALYPHMTVEENMGFGLKMTGHPKAEIKEKVAEASRILQLDQYLKRKPKALSGGQRQRVAIGRAIVRGPEVFLFDEPLSNLDAELRVDMRVEIARLHKEIGATMIYVTHDQVEAMTLADKIVVLRAGRVEQVGKPMELYNDPDNRFVAGFIGSPSMNFVEGEVRGGKVVVRAFGGREITTSVALPQDGAKVIVGLRPQHIRLSADGPATLDLRERLGGVSYDHLICAEGAKLIVETREEDSLEEGDSVGFDFEDRDVFLFDAQSEERLR

SEQ ID NO: 37308 - DNA, 1098 bp, Silicibacter sp. TM1040
  CDS (1)..(1098)
atggcgaatttgaaactgaccggggtagagaaaacctacgctggcgcggtgaatgtcctgagagacatcaatctcgacatcaagcagggggagttgattgtctttgtgggtccgtcgggatgcggcaagtccacgctcctgcgcatgatcgcggggctggaacgcataaccggtgggacattggaaatcgacggcgcggtgatgaatgacatcccgcccgcccagcggggcatcgccatggtgttccagagctacgcgctctatccacatatgacggtgcgcgacaacatgggctttgcgctcaagatcgcaggtaaaagcgcaagcgagattgaggaggcgatcacacgagcagccaagatcctgcagcttgaggactatctcgaccgtctgcccaaggcgctttcaggtgggcagcggcagcgggtggcaatcggtcgggcgattgtgcgcgatccaaaggtctatctctttgatgagcctctctccaatctggacgcggccctgcgggtggcgacgcggatcgagattgcgcagctcaaggaagcgatgccggacagcaccatgatctatgtgacccacgaccaggtggaggcgatgacgctcgcttcacgcatcgttgtgctcgccaataaggggatcgcgcaggtgggcacgccgctcgaactctacgagcggcccgaaaacgaatttgtcgcccagtttattggttctccggcgatgaacctgctgccgggcgaggtcatcgcaacgggcgatctgacccgcattcgcctggagaatggtgaagaggtcgcctccaccgtgcccacccgcacgagcgacatggggctcaaggtcaatgtgggcgtgcgaccagaggatctctttgaggagggggagggcggcgcgatgatcgacgctacggtcgacatcgtcgaagcacttggtgaagtgacggtgctctatttcaaggcgcaagccgggcaagatgcgcctgttgcaaaattgtctggtattcacaaaggtttgcgtggaagccaagtgcgactctacgcggatccgaagaaggtacacctctttcacaatgggcattctcttctgtatcgcgaggggtga

SEQ ID NO: 37309 - protein, 365 aa, Silicibacter sp. TM1040
MANLKLTGVEKTYAGAVNVLRDINLDIKQGELIVFVGPSGCGKSTLLRMIAGLERITGGTLEIDGAVMNDIPPAQRGIAMVFQSYALYPHMTVRDNMGFALKIAGKSASEIEEAITRAAKILQLEDYLDRLPKALSGGQRQRVAIGRAIVRDPKVYLFDEPLSNLDAALRVATRIEIAQLKEAMPDSTMIYVTHDQVEAMTLASRIVVLANKGIAQVGTPLELYERPENEFVAQFIGSPAMNLLPGEVIATGDLTRIRLENGEEVASTVPTRTSDMGLKVNVGVRPEDLFEEGEGGAMIDATVDIVEALGEVTVLYFKAQAGQDAPVAKLSGIHKGLRGSQVRLYADPKKVHLFHNGHSLLYREG

SEQ ID NO: 37310 - DNA, 1095 bp, Silicibacter sp. TM1040
  CDS (1)..(1095)
atgaccgaagttactctgacagacgtgatcaaacgctatggccagcatcaggctgtgcatggcatcaatctcgatattcaggacggtgagttcgtcgtcctggttggcccctcgggatgcggaaagtccacgaccctgcgcatgattgccgggcttgaggatatctctggtggagaggtcaagatcggtggacgggtggtgaatgatctccccccgcgcgagcgcaacatctccatggtgtttcagaattacgcgctttatccgcacatgaccgtgcgcgagaacctcggcttttcactgaagattgccaagcgccctgaggctgagatcgaacgcgccgtcacagaagccgcgcaaattctcggcctggacgagttgatggagcgcaaacctgccgcgctttctggggggcaacgccagcgggttgccatggggcgcgcgatcgtgcgtcagccggatgtgttcctgttcgacgagccgctctcaaaccttgatgcgaaactgcgtactcagatgcgggtcgagatcaagaagctgcaccagaaagtcgggaatacagtgatctatgtgactcacgatcaggtcgaagcaatgacgctggcggatcggatcgtgttgatgcgcgatggtcatatcgtgcagactggcacaccgctcgacctgttcaatgcgccagttgatacctttgtcgccacctttattggctcaccgccgatgaacctcgttgatgggatagtcaccgaaaccggtgcgctccgacttggtgatcacatcacgttgccgatgccgagcgaagcccgcggtgctgtgcggccaggtcaggaaatcagctttggtttccgggccgacaatctgatgcccgacggccactcggtcgaggaaagcgggcagatggccccgctggaactggaggtcgccctgacggagcctctgggcacggaaacacttctctttgccgagtttgcgggccgtgaggtgcaggccaagatgctcaacccgcgtcccgtgcagccgggcgaacggctgccgtttcatctgatgctcgacaaatgtcacgtctttgaccgcaaaagcggcaaggcgctgagagggtag

SEQ ID NO: 37311 - protein, 364 aa, Silicibacter sp. TM1040
MTEVTLTDVIKRYGQHQAVHGINLDIQDGEFVVLVGPSGCGKSTTLRMIAGLEDISGGEVKIGGRVVNDLPPRERNISMVFQNYALYPHMTVRENLGFSLKIAKRPEAEIERAVTEAAQILGLDELMERKPAALSGGQRQRVAMGRAIVRQPDVFLFDEPLSNLDAKLRTQMRVEIKKLHQKVGNTVIYVTHDQVEAMTLADRIVLMRDGHIVQTGTPLDLFNAPVDTFVATFIGSPPMNLVDGIVTETGALRLGDHITLPMPSEARGAVRPGQEISFGFRADNLMPDGHSVEESGQMAPLELEVALTEPLGTETLLFAEFAGREVQAKMLNPRPVQPGERLPFHLMLDKCHVFDRKSGKALRG

SEQ ID NO: 37312 - DNA, 1005 bp, Silicibacter sp. TM1040
  CDS (1)..(1005)
atgggacgtattacactcgacaaagtcaccaaaagctttggggcgacagaagttatcccgccactggacctgacgattgaggacggtgaattcacagtcttcgtcggcccttcgggctgcggaaaatccaccctcctgcgcctcattgcagggcttgaggacgtgacctctggtcagatccgcattgacggtcaagatgcaaccatgacgccgcctgccaaacgcggccttgccatggtgtttcaatcctacgcgctctatccgcatatgtcggtgcgcaaaaacatcgcctttccgatgaaaatggcaggcatcgacgacgccgagcaaacgcgccgcatcgatgccgctgcaaaggcgctcaatctgaccgactatctggatcgcaagcccggccagctctctggcggacagcgtcagcgggttgccattggtcgtgccatcgtgcgggaacctgcagcgttcctctttgatgagccgctctccaatctcgatgccgccctgcgggtcggaatgcggatggagatctcagaacttcacaagaaactcgcaaccacaatgatttacgtcacgcatgaccaagtcgaagccatgacgatggctgacaagatcgtggtgctgcgcgcgggtcacatcgagcaggtcggcagcccgctagagctttatcacagcccccgcaacctctttgtggcaggtttcatcggctcgcccaagatgaactttatcgaaggcgacgaggccgcaaaatacgacgcgcacaccattggcgtgcgtcccgagcatatcgacatcggcgagagcggcggcatgtggtcgggcgtggtcggggtctccgaacacctggggtcggataccttctttcacatccacgacacgggtctcgccgagaccatcaccgtgcgtgccgacggcgaggttggctttcgccacggcgatcgggtcagcctgacgccacgtacggatgtgatgcatcgctttgacgcccaaggcctgaggatcccctaa

SEQ ID NO: 37313 - protein, 334 aa, Silicibacter sp. TM1040
MGRITLDKVTKSFGATEVIPPLDLTIEDGEFTVFVGPSGCGKSTLLRLIAGLEDVTSGQIRIDGQDATMTPPAKRGLAMVFQSYALYPHMSVRKNIAFPMKMAGIDDAEQTRRIDAAAKALNLTDYLDRKPGQLSGGQRQRVAIGRAIVREPAAFLFDEPLSNLDAALRVGMRMEISELHKKLATTMIYVTHDQVEAMTMADKIVVLRAGHIEQVGSPLELYHSPRNLFVAGFIGSPKMNFIEGDEAAKYDAHTIGVRPEHIDIGESGGMWSGVVGVSEHLGSDTFFHIHDTGLAETITVRADGEVGFRHGDRVSLTPRTDVMHRFDAQGLRIP

SEQ ID NO: 37314 - DNA, 1101 bp, Desulfovibrio desulfuricans G20
  CDS (1)..(1101)
atggaaaaagtttcgctcaacggtataagcaagcgcttcggcgacgtacgggtcattcacgatgtcagcctgtccatcagagaaaatgaattcatcgtgctggtggggccttccggctgcggaaaatccaccatactgcgcatgatagcggggctggagagcgtgagcggcggcgaaatacgcatagggggccgcgtagtcaatgacgtgccgcccaaggaacgcgatgtggccatggtgtttcagaactacgccctgtatccgcacatgaccgtgggagaaaacatggggttcagtcttaaaatgcagaaacgccccggagccgaaatcgagtcgaaagtgcaggaggctgcagccgttctggggttgaccgaatatctgcaccgcaaacccgcggctctttccggcgggcaacggcagcgcgtggccatgggccgcgccattgtgcgcaaaccgcaggtctttctgttcgacgagcctctttcaaatctggacgcccagctgcgcacccagatgcgcatggaactgaaaaaactgcacctgaagctgaacaccaccaccatctacgtcacccacgatcaggtggaggccatgacgctggccgaccgcattgtactgctgaaagacggacatatacagcaggtgggggcccctgtggatgtctttgaacgtccggccaatgtgttcaccgggcgttttatcggcaacccgcccatgaacgtgctgcaggcggtgctgcataaagacgcggacgatgcggggcgccatgtggccgcagagggcctgcgcattgcagtggcagacacggtaggcgccgcgttgccccacggtacgccggtaaccgtgggcatacggcccgatgccgtcaaaaccggcgacgcgcttatgcatctgccggaacactgccatatggatgcgcgtgtggaagtggccgaaattctgggcggtcagtcgctgctggaagtatcggcggcgggtgttccgctcatagcggaagtggcaggccgcgtgctggtgcgccccggagactccatacgcataggcgttgaccctgcacgggttctgctttttgacgcgcagacccagaacgccgtcgactga

SEQ ID NO: 37315 - protein, 366 aa, Desulfovibrio desulfuricans G20
MEKVSLNGISKRFGDVRVIHDVSLSIRENEFIVLVGPSGCGKSTILRMIAGLESVSGGEIRIGGRVVNDVPPKERDVAMVFQNYALYPHMTVGENMGFSLKMQKRPGAEIESKVQEAAAVLGLTEYLHRKPAALSGGQRQRVAMGRAIVRKPQVFLFDEPLSNLDAQLRTQMRMELKKLHLKLNTTTIYVTHDQVEAMTLADRIVLLKDGHIQQVGAPVDVFERPANVFTGRFIGNPPMNVLQAVLHKDADDAGRHVAAEGLRIAVADTVGAALPHGTPVTVGIRPDAVKTGDALMHLPEHCHMDARVEVAEILGGQSLLEVSAAGVPLIAEVAGRVLVRPGDSIRIGVDPARVLLFDAQTQNAVD

SEQ ID NO: 37316 - DNA, 1107 bp, Chloroflexus aurantiacus
  CDS (1)..(1107)
atggcctcgattaagtatgaccacgtctggaagcgcttcggcgaagtaaccgtgctcaagaatctcgaccttgacattgccgacggtgaatttctggtgctggtgggtccttcgggctgcggaaagtcaaccgctctccgctgtctggccggtctggaagagatcaccgagggccgcatcttcatcggtgaccgtgatgtgaccgacgttccacccaaggatcgcgacatcgcgatggtcttccagtcgtatgcgctctacccccacatgagcgtctacgacaacatggccttcggtctcaaactccgtcgcgttcccaaagccgaaatcgaccgccgggtaaaggaagcggcagagatgctgagcatcggccacctcctcgaccgcaaacccaaagcgctttcgggtggtcagcgccagcgtgttgcgttgggccgcgccatcgtccgcgatcccgccgtcttcttaatggacgagccactctccaaccttgacgccaagctgcgcgtgcagacccgcgccgagatcagcaagctccaccagcgcctcaagaccaccttcatctacgtgacccacgaccagaccgaggcgatgaccatggggtcacggattgccgtcatgcgtgatggtatcttgcagcaactcgacacaccccagaacctctacgaccacccggccaacatgtttgtggccggcttcattggcagcccggcgatgaacttcttcgaggcgcgcctggagcgcaccgatggcggcgtgagtgtggtcgtcggcaaagatttcgtcttgccggtgccggcaagcaagctcgatcacgtcagcagccacatcggcaagaacgtctacttcggcatccgccccgaagacctgcacgatgcgcatttcgtgccccgtggtgttgacgaacgggcgaaggttcacgcagcggttaacgtggttgagccgatgggagcagaaatctacgcctacgtcgagaacagcggcaaagagtttatcggtcgcttcgatccgcgctcgaacgctcgcaccggccataccatcgaagtggtcttcgacatggagaagatgcacatcttcgaccgcgaaaccgagaaggcgttgacataa

SEQ ID NO: 37317 - protein, 368 aa, Chloroflexus aurantiacus
MASIKYDHVWKRFGEVTVLKNLDLDIADGEFLVLVGPSGCGKSTALRCLAGLEEITEGRIFIGDRDVTDVPPKDRDIAMVFQSYALYPHMSVYDNMAFGLKLRRVPKAEIDRRVKEAAEMLSIGHLLDRKPKALSGGQRQRVALGRAIVRDPAVFLMDEPLSNLDAKLRVQTRAEISKLHQRLKTTFIYVTHDQTEAMTMGSRIAVMRDGILQQLDTPQNLYDHPANMFVAGFIGSPAMNFFEARLERTDGGVSVVVGKDFVLPVPASKLDHVSSHIGKNVYFGIRPEDLHDAHFVPRGVDERAKVHAAVNVVEPMGAEIYAYVENSGKEFIGRFDPRSNARTGHTIEVVFDMEKMHIFDRETEKALT

SEQ ID NO: 37318 - DNA, 1071 bp, Polaromonas sp. JS666
  CDS (1)..(1071)
atggcatccgtatcgttccagaaaattgaaaagagtttcggcaagttcaagatcattcacggcatcagcttcgacattgccgatggcgagttcgtcgtgctggttggcccctcgggctgcggcaagtcgactttgctgcgcatgctggccgggctggaggaaatcagtggcggcgagatcgcgatcgacggcaaggtggtcaacgacctcgactccaaggaccgcgacatcgcgatggtgttccagagctacgcgctgtatccgcacatgacggtgcgcgacaacatggctttcagcctgaagctgcgcaaggccgacgacgacctgacgaataagcgcgttggcaatgcggcgcgcatcctgaacctcgaccccttgctcgaccgcttcccgcgcgagctctcgggcgggcagcgccagcgcgtcgcgatggggcgggccatcgtgcgcgaccccaaggtgtttctgtttgatgagccgctgtccaacctggacgccaaactgcgcgtggccatgcgtgccgagatcaaggcgctgcaccagcggctgaaaaccaccacggtctacgtcacgcacgaccagatcgaagccatgaccatggccgaccgcatcgtcgtgatgcacgatggcatcattgaacagataggcacgccgctggccctgttcgaccggcctgccaatctctttgtggcgcagttcatcggctcgccggcgatgaacgtgctcaacggtgtattgcgccagggccagggcggcagctgggtcgaggctcagggcagccgctggccggtaggcgttctccagcacggccacgacggtcaggcggtgaactatggcatccggccgggcgatctgaagatttcaaccacgggccagggcatcgcggccaaggtcattgtggtggagccaaccggcgcggagaccgagctgctgctgcaggtgggcgatgaacagctgatcgtcgtgatgcatgggcgtaccaatgtccagccggatgaactcgtcacgctggagatcgcggccggcaaggcccatgtgttcgatgctgccagcggcgaccgggttgactga

SEQ ID NO: 37319 - protein, 356 aa, Polaromonas sp. JS666
MASVSFQKIEKSFGKFKIIHGISFDIADGEFVVLVGPSGCGKSTLLRMLAGLEEISGGEIAIDGKVVNDLDSKDRDIAMVFQSYALYPHMTVRDNMAFSLKLRKADDDLTNKRVGNAARILNLDPLLDRFPRELSGGQRQRVAMGRAIVRDPKVFLFDEPLSNLDAKLRVAMRAEIKALHQRLKTTTVYVTHDQIEAMTMADRIVVMHDGIIEQIGTPLALFDRPANLFVAQFIGSPAMNVLNGVLRQGQGGSWVEAQGSRWPVGVLQHGHDGQAVNYGIRPGDLKISTTGQGIAAKVIVVEPTGAETELLLQVGDEQLIVVMHGRTNVQPDELVTLEIAAGKAHVFDAASGDRVD

SEQ ID NO: 37320 - DNA, 1032 bp, Polaromonas sp. JS666
  CDS (1)..(1032)
atgaacgacggcgaattcatggtcttgctcggcccctcgggctgcggcaaatcgaccacattgcgcatgattgccggcctcgaatcgatcaccaaaggccagctggatatcgatggccgcgaagtcaacgaggtcgcggccaaagatcgcgatatcgccatggtgttccagtcttacgcgctctacccccacatgaccgtggctgaaaacctgggttttggcctgaagcgccgcaaggtcgacaagaacgaaatcgccgcaagggtcaagaaagcctgcggcattctcggcctggacgagttgctggagcgcaagccttttgcgctgtcaggcggccagcgccagcgcgtggcgctgggccgtgccatcgtgcgtgagcccaaggttttcctgtttgacgaaccgctgtccaacctggacgcggccttgcgcgtcaacacccgcaacgaactggtgcgcttgcaccagcgcctgaacgcaaccatgatttacgtgacgcacgaccaggtcgaggcgatgaccatgggccagcgcatctgcgtcatgaacaaaggacgcgtggcgcagatcggtcggccactggacgtgtaccgggcaccggccgatgccttcgttgcacgcttcctgggcaacccaccgatgaacatcgtgcgggcccaattgcttgaacacaatggcctgcgccacgcgatggtgggcgggtgcgcactgcccctggagcgctggaaaggcgtctcattcagcgctgctgacgaggtattgctgggggtgcggcctgaagaactgtcgctgaccacgacgccaggcagcgagcaggcatcactgcggggcacagtatccggagtagaacccctgggcgcagaaacgcttgtgatcgtcgaactggagcgccaggcgggcgaggtcacggcgcggctgcaccgcgaaacatcagtcagggtcggtgacacggtaggcctcagctgcgcttcggaggccatctatctgtttgacccggtcagcgagaaagccattgtggcaacggatcattaa

SEQ ID NO: 37321 - protein, 343 aa, Polaromonas sp. JS666
MNDGEFMVLLGPSGCGKSTTLRMIAGLESITKGQLDIDGREVNEVAAKDRDIAMVFQSYALYPHMTVAENLGFGLKRRKVDKNEIAARVKKACGILGLDELLERKPFALSGGQRQRVALGRAIVREPKVFLFDEPLSNLDAALRVNTRNELVRLHQRLNATMIYVTHDQVEAMTMGQRICVMNKGRVAQIGRPLDVYRAPADAFVARFLGNPPMNIVRAQLLEHNGLRHAMVGGCALPLERWKGVSFSAADEVLLGVRPEELSLTTTPGSEQASLRGTVSGVEPLGAETLVIVELERQAGEVTARLHRETSVRVGDTVGLSCASEAIYLFDPVSEKAIVATDH

SEQ ID NO: 37322 - DNA, 1074 bp, Polaromonas sp. JS666
  CDS (1)..(1074)
atggccggcgtcacgatcagggcagtcaagaagaacttcggcgaagtccccatccttcatggcgtggacatcgagatccaggatggttcgtttactgtgctggtcggcccctcgggctgcggcaagtcaacgctgctgcgcatgattgccgggctggagcagatcagcggcggcgagatccgcatcggcgacaagcgcgtcaacgacttaccgccgaaggcgcgcgacatcgcgatggtgttccagaactacgcgctgtacccgcacatgacggtgcgcgagaacatggcgttctcgctcgaactggccaagcaggacaaggcaacgatagccagcaaggtggcgcgcgccgccgagatcctggcgctgggcgcgctgctcgagcgctatccgcgccaactgtcgggcggccagcggcaacgcgtcgcgatggggcgcgcgatcgtgcgcgatccgcaggtgttcctgttcgatgaaccactctcgaatctcgacgccaagctgcgcgtcgcgatgcgcagcgagatcaaggaactgcacttgcgcctgaagaccacctcgatctacgtcacccacgatcagatcgaggcgatgacgatgggcgacaagattgtcgtgatgcgcgatggccgcatcgagcagaccggcagcccgctggatctgtacgaccatcctgccaaccagttcgtcgccggcttcatcggctcgccggcgatgaacttcctgcccggcacgctgaagcgcgccggtggcagcgcgcgcatcgagctgggcgacggcacccagctcgacgcaccgccgcgctcgggcggcgcggatggccagccggtgatctttggcacccggcccgagcatttgacgctcgttgacgccggcggcattccggcccatgtggtcgtgatggagcccaccgggatggacaccttcatcgcctgccgacacgagggcgtggacctctcggcggtgtttcgcgagcgacacgacttcgcacccggccgcaccatccatctgctgcccgacctgcagcgcgcgcacctgttcgatgcgagcaccggccagcgcctcgcggcctga

SEQ ID NO: 37323 - protein, 357 aa, Polaromonas sp. JS666
MAGVTIRAVKKNFGEVPILHGVDIEIQDGSFTVLVGPSGCGKSTLLRMIAGLEQISGGEIRIGDKRVNDLPPKARDIAMVFQNYALYPHMTVRENMAFSLELAKQDKATIASKVARAAEILALGALLERYPRQLSGGQRQRVAMGRAIVRDPQVFLFDEPLSNLDAKLRVAMRSEIKELHLRLKTTSIYVTHDQIEAMTMGDKIVVMRDGRIEQTGSPLDLYDHPANQFVAGFIGSPAMNFLPGTLKRAGGSARIELGDGTQLDAPPRSGGADGQPVIFGTRPEHLTLVDAGGIPAHVVVMEPTGMDTFIACRHEGVDLSAVFRERHDFAPGRTIHLLPDLQRAHLFDASTGQRLAA

SEQ ID NO: 37324 - DNA, 1023 bp, Polaromonas sp. JS666
  CDS (1)..(1023)
atggcatccatctcactgaacaacgtcatcaagcgctacggcgccggcaaaagcagcgtgcagatcctgcacggcgtgaatgccgaaatcgcagaccgagaattcatcgtcatcgtcggcccgtccggctgcggcaaatcgacgctgctgcgcatggttgccggcctggaggaaatcagtgaggggcaaattgccattgggggcaaggtggtcaacgacctggagcccgccgagcgcgacatcgccatggtgtttcagaactacgcgctgtacccgcacatgagcgtgttcgacaacatggcgtacggcctgaagattgcgaaagttccgaaaaatgacatcaagacccgcgtcgacaaggccgcagacatcctggaactgggccacctgctggatcgcaagcccaggcagctgtccggcggccagcgccagcgggtggccatgggccgagccatcgtgcgccagccccaggtgtttctgttcgacgagccgctctccaacctggacgcgaagctgcgcgtgcagacccggctggagatccagaagctgcaccgcgaactgggcatcacgtccctttttgtcacgcacgaccaggtcgaggcgatgaccctggcgcagcgcatgatcgtgatgaacgcgggccgcatggagcagttcggcactcccgaagaggtctataaccgccccgccaccacctttgtggcgagcttcatgggctcaccgccgatgaacctgctcaggcacgcccccaacaccgacttcggcggcaagccgggcgcgcttctgggcatacgccccgagcacctgcaaatcggcaccaccggctgggcggtgcaggtcgacacgctggagatgctgggcgccgagcgtctggtgtactgccgcatgggcgacgagttcctgatcgtgcgcaccgatgaaagcctgtcatccgcccccgacatcggcgccaccatccacgtcgccccccgccgtgaccgcctccactggtttgacgccgagaccgggaaacgtttgccatga

SEQ ID NO: 37325 - protein, 340 aa, Polaromonas sp. JS666
MASISLNNVIKRYGAGKSSVQILHGVNAEIADREFIVIVGPSGCGKSTLLRMVAGLEEISEGQIAIGGKVVNDLEPAERDIAMVFQNYALYPHMSVFDNMAYGLKIAKVPKNDIKTRVDKAADILELGHLLDRKPRQLSGGQRQRVAMGRAIVRQPQVFLFDEPLSNLDAKLRVQTRLEIQKLHRELGITSLFVTHDQVEAMTLAQRMIVMNAGRMEQFGTPEEVYNRPATTFVASFMGSPPMNLLRHAPNTDFGGKPGALLGIRPEHLQIGTTGWAVQVDTLEMLGAERLVYCRMGDEFLIVRTDESLSSAPDIGATIHVAPRRDRLHWFDAETGKRLP

SEQ ID NO: 37326 - DNA, 1104 bp, Pseudomonas fluorescens
  CDS (1)..(1104)
atggccaacctcaaaatcaagaatctgcaaaaaggcttcgaaggtttctcgatcatcaagggcatcgacctggaagtgaacgacaaggaattcgtggtcttcgtcggcccctcgggctgcggtaaatccaccctgctgcgcctgatcgccggcctcgaagaagtgagcgaaggcaccatcgaactggatggccgcgacatcaccgaagtcaccccggccaagcgcgacctggcgatggtgttccagacctatgccctgtacccgcacatgagcgtgcgcaagaacatgtcatttgccctggacctggccggcgtcgacaagcagctggtggagagcaaggtcaacgaagcggcgcgcatcctcgaactgggcccgctgctggagcgcaagcccaagcaactctccggtggccagcgccagcgtgtggcgatcggccgggcgattgtgcgcaacccgaagatcttcctgttcgacgagccgttgtccaacctcgacgccgccctgcgcgtgcagatgcgcctggaactggcgcgcctgcacaaagagctgcaagcgaccatgatctacgtgacccatgaccaggttgaagccatgaccctggccgacaaggtggtcgtgttgaacagcgggcgtatcgagcaggtcggctcgccgctggagctgtaccaccagccggccaacctgtttgtggcgggttttctcggcacgccgaaaatgggcttcctcaagggcaaggtcacccgcgtcgacggccaaggctgtgaggtgcagctggacgccggcactctgatcagcctgccgctgagcggcgccagcctgagcgtgggcagcgcggtgaccctgggcattcgtccggagcacctggaaatcgcgtcgcctgggcaaaccaccctgacggtgacggccgacgtcggcgagcgcctgggcagcgacaccttctgccacgtcatcacctcgaatggcgagccgctgaccatgcggattcgcggcgacatggccagccagtatggcgaaacgctgcacctgcacctggacccggcgcactgccatctgttcgacaccgacggcgtggctgtggccgtcccattgcgcgccgccgcctga

SEQ ID NO: 37327 - protein, 367 aa, Pseudomonas fluorescens
MANLKIKNLQKGFEGFSIIKGIDLEVNDKEFVVFVGPSGCGKSTLLRLIAGLEEVSEGTIELDGRDITEVTPAKRDLAMVFQTYALYPHMSVRKNMSFALDLAGVDKQLVESKVNEAARILELGPLLERKPKQLSGGQRQRVAIGRAIVRNPKIFLFDEPLSNLDAALRVQMRLELARLHKELQATMIYVTHDQVEAMTLADKVVVLNSGRIEQVGSPLELYHQPANLFVAGFLGTPKMGFLKGKVTRVDGQGCEVQLDAGTLISLPLSGASLSVGSAVTLGIRPEHLEIASPGQTTLTVTADVGERLGSDTFCHVITSNGEPLTMRIRGDMASQYGETLHLHLDPAHCHLFDTDGVAVAVPLRAAA

SEQ ID NO: 37328 - DNA, 999 bp, Rhodobacter capsulatus
  CDS (1)..(999)
atgggtgaaatcctcctcaagggcgtgacgaaacgcttcggcgatgtcgaggtgatcccgccgatcgaccttgccatcaacgacggggaattcgtcgtcttcgtcgggccttcgggctgcgggaaatcgacgctgctgcggctgatcgcggggctcgaagatgtctcgggcggggtggtcgagatcgacggcaaggatgccaccgcaaccgcccccgccgaccgcggtctggcgatggtgtttcaatcttatgcgctttatccgcatatgtcggtgaaaaagaacatcgcctttccgctgaagatggcgaaactgcccgcggccgagatcgaggccaaggtgcaggcggcggccaaggtgctgaacctgaccgcttacctggaccgcaagccggggcagctttcgggcgggcaacgccagcgcgtcgccatcggccgcgccatcgtgcgcaacccgcaggccttcctcttcgacgagccgctctcgaacctcgatgccgcgctgcgggtgaacatgcggttggaaatctccgaactgcaccacagcctgaagacgacgatgatctatgtgacccatgatcaggtggaagccatgaccatggccgacaagatcgtggtgctgcaggcggggcggatcgaacaggtgggcagcccgctggaactttaccgcacgcccagaaaccgcttcgtcgcgggtttcatcggcagcccgaagatgaacttcctcgaagggcccgaggccgcgaaacagggcgcccatgcgatcggcatccgcccggaacatctccgcatctcgacaaccgaggggatgtggccgggcaccgtgggcgtctccgaacatctgggctcggacactttcctgcatgtgacgacagaccacgggctgatcaatgtccgcgccggcggcgaggtcgggctgcaccatggcgaccgcgtttttctgagcccggacatgggccagctgcaccgcttcgatgcgcaaggaggcgcgctgaaatga

SEQ ID NO: 37329 - protein, 332 aa, Rhodobacter capsulatus
MGEILLKGVTKRFGDVEVIPPIDLAINDGEFVVFVGPSGCGKSTLLRLIAGLEDVSGGVVEIDGKDATATAPADRGLAMVFQSYALYPHMSVKKNIAFPLKMAKLPAAEIEAKVQAAAKVLNLTAYLDRKPGQLSGGQRQRVAIGRAIVRNPQAFLFDEPLSNLDAALRVNMRLEISELHHSLKTTMIYVTHDQVEAMTMADKIVVLQAGRIEQVGSPLELYRTPRNRFVAGFIGSPKMNFLEGPEAAKQGAHAIGIRPEHLRISTTEGMWPGTVGVSEHLGSDTFLHVTTDHGLINVRAGGEVGLHHGDRVFLSPDMGQLHRFDAQGGALK

SEQ ID NO: 37330 - DNA, 1101 bp, Bacillus firmus
  CDS (1)..(1101)
atggcagatattcaattaaaaaacatatataaaatttatgatggtgatgtgactgcagtaactgactttaatcttgatattaaagataaagagtttattgtttttgttgggccatctggttgtggtaaatcaacgacattacgtatgattgcaggacttgaggatatctcaaaaggtgatttatacatcggcgaccgccgcgttaatgatgtagcaccaaaagatcgtgatattgcgatggtattccaaaactacgctctatacccacatatgaatgtatacgaaaatatggctttcggtttaaagcttcgtaaatttaaaaaagatgaaattgatcgtcgcgtgagagatgcagcaaaaattctaggccttgaagcgatgttagatcgtaaaccaaaagcaatgtctggtggtcagcgtcaacgtgttgccctgggtcgtgcaatcgttcgtgatcctcaagtattcttaatggatgagccattatcaaacttagatgcgaaattacgtgtacaaatgcgtgctgagatcactaaactacacaagcgtttgcaaacaacaacgatttacgtaacacacgaccaaacagaagcgatgacgatggctactcgcattgttattatgaaagatggatttattcagcaagtaggtacacctaaagacgtatatgataacccagagaatgttttcgttggtggatttattggttctccttcgatgaactttatcactggaaaaattgaaggcgattactttaaagttggtgatgtaaccgttaaagtaccagctggtaagttgtctgttcttcgtgataaaggatacatgaacaaagagattattttaggcattcgtccagaagatattcatgatgaacttctgtttatcgaatcatcaccagaaacaaaattaacggctgaaattgatgtagccgagctgacaggtgcagaaaccgttctttattcttctgttaatggccaagcatttgttgctagaattgattcgcgaacagatatagaaggcggtcagtcactagatcttgcctttgatatgaataaatctcacttctttgatgcagaaactgaattacgtatccgtccataa

SEQ ID NO: 37331 - protein, 366 aa, Bacillus firmus
MADIQLKNIYKIYDGDVTAVTDFNLDIKDKEFIVFVGPSGCGKSTTLRMIAGLEDISKGDLYIGDRRVNDVAPKDRDIAMVFQNYALYPHMNVYENMAFGLKLRKFKKDEIDRRVRDAAKILGLEAMLDRKPKAMSGGQRQRVALGRAIVRDPQVFLMDEPLSNLDAKLRVQMRAEITKLHKRLQTTTIYVTHDQTEAMTMATRIVIMKDGFIQQVGTPKDVYDNPENVFVGGFIGSPSMNFITGKIEGDYFKVGDVTVKVPAGKLSVLRDKGYMNKEIILGIRPEDIHDELLFIESSPETKLTAEIDVAELTGAETVLYSSVNGQAFVARIDSRTDIEGGQSLDLAFDMNKSHFFDAETELRIRP

SEQ ID NO: 37332 - DNA, 1134 bp, Streptomyces reticuli
  CDS (1)..(1134)
atggccactgtcacgttcgacaaggcgacccggatctacccgggttccgacaagcccgccgtcgaccagctcgacatcgcgatcgaggacggcgagttcctcgtcctggtcggcccgtccggttgcggcaagtccacctccctgcggatgctcgcgggcctggaggacgtcaacggcggcgccatccgcatcggcgaccgcgacgtcacgcacctgccgcccaaggaccgggacatcgccatggtgttccagaactacgccctctacccgcacatgacggtcgccgacaacatgggcttcgcgctcaagatcgccggcgtgccgaaggcggagatccggcagaaggtcgaggaggccgcgaagatcctcgacctcacccagtacctggaccgcaagccgaaggcgctctccggcggtcagcgccagcgtgtcgccatgggccgcgcgatcgtccgcgagccgcaggtcttcctcatggacgagccgctgtccaacctggacgccaagctccgcgtctcgacccgtacgcagatcgcctccctccagcgccgcctcggcatcaccaccgtctacgtcacccacgaccaggtcgaggccatgacgatgggcgaccgggtcgcggtcctcaaggacggcctgctccagcaggtcgactcgccgcggaacatgtacgacaagcccgcgaacctcttcgtcgccggcttcatcggctccccggccatgaacctggtcgaggtgccgatcaccgacggcggcgtgaagttcggcaacagcgtcgtcccggtcaaccgggaggcgctgagcgccgccgacaagggtgaccgcaccgtcaccgtcggcgtccgccccgagcacttcgacgtggtcgagctgggcggcgcggtcgcggcctccctgtccaaggactccgccgacgccccggccggcctcgccgtctccgtgaacgtcgtcgaggaactgggcgccgacggctatgtgtacggcaccgccgaggtcggcggcgaggtcaaggacctggtcgtccgcgtcaacggccggcaggtgccggagaagggctccacgctgcacgtcgtcccgcggccgggcgagacccacgtgttctccacgtccaccggtgagcggctgtccgactga

SEQ ID NO: 37333 - protein, 377 aa, Streptomyces reticuli
MATVTFDKATRIYPGSDKPAVDQLDIAIEDGEFLVLVGPSGCGKSTSLRMLAGLEDVNGGAIRIGDRDVTHLPPKDRDIAMVFQNYALYPHMTVADNMGFALKIAGVPKAEIRQKVEEAAKILDLTQYLDRKPKALSGGQRQRVAMGRAIVREPQVFLMDEPLSNLDAKLRVSTRTQIASLQRRLGITTVYVTHDQVEAMTMGDRVAVLKDGLLQQVDSPRNMYDKPANLFVAGFIGSPAMNLVEVPITDGGVKFGNSVVPVNREALSAADKGDRTVTVGVRPEHFDVVELGGAVAASLSKDSADAPAGLAVSVNVVEELGADGYVYGTAEVGGEVKDLVVRVNGRQVPEKGSTLHVVPRPGETHVFSTSTGERLSD

SEQ ID NO: 37334 - DNA, 1131 bp, Klebsiella oxytoca
  CDS (1)..(1131)
atggcaacggttagtttgcggaaaattgaaaaaagatatgaaaatggctttaaggctgtccatggtatcgatctcgaaatccatgacggtgaatttatggtttttgtcgggccttccggttgtgcgaaatcaacaactttgagaatgattgccggtcttgaagatattagcggaggcgaaatttatatcggaaatagaaaggttaatgaccttccgcccaaagaccgtggtattgccatggttttccaaaactatgcactttatccgcataaaaccgttttcgacaacatggcttttggtctaaaaatgcagaaacgacctaaggatgagattaaacgccgggttgaagacgcggccgaaaaacttgaaattaccgaactgctttatcgtaagccgaaagaaatgtcgggcggacagcgccagcgtgtcgctgttggccgggcgattgtacgtaaacctgatgtttttttattcgatgagcctttatcaaaccttgatgccaagctcagggtatcgatgcggatgaaaattgcccaactacatcgttctctgaaagaggaggggcatcctgctacaatgatttatgttactcacgatcagactgaagcgttaactctaggagatcgcatttgtgttcttaaccatgggaatatcatgcaggttgatacacctactgatctttataattatcctaataataagttcgttgccagttttatcggttcaccatcaattaatttgatagatactgctatccgtaagaataatgagaggttgtatgttgaaattgctcctggcgttgaaatattaattccacatagtaagcaagtgttgcttgaaggttatattaataagcctgtgtgttttggtattagaccagagcatatctctcttgctagcgatgatgatgaccttaatacctttgagggagttttaacggtggttgaaaatatggggagcgaaaaatttttatattttatcgttggtgggaaggaacttattgccagagttgatacacaagatattaatccatttcatatagggaaaactttaagatttaatcttaatactgccttttgtcatgtttttgatttctataatgagaacaatctgacaaatgtaagagtgtga

SEQ ID NO: 37335 - protein, 376 aa, Klebsiella oxytoca
MATVSLRKIEKRYENGFKAVHGIDLEIHDGEFMVFVGPSGCAKSTTLRMIAGLEDISGGEIYIGNRKVNDLPPKDRGIAMVFQNYALYPHKTVFDNMAFGLKMQKRPKDEIKRRVEDAAEKLEITELLYRKPKEMSGGQRQRVAVGRAIVRKPDVFLFDEPLSNLDAKLRVSMRMKIAQLHRSLKEEGHPATMIYVTHDQTEALTLGDRICVLNHGNIMQVDTPTDLYNYPNNKFVASFIGSPSINLIDTAIRKNNERLYVEIAPGVEILIPHSKQVLLEGYINKPVCFGIRPEHISLASDDDDLNTFEGVLTVVENMGSEKFLYFIVGGKELIARVDTQDINPFHIGKTLRFNLNTAFCHVFDFYNENNLTNVRV

SEQ ID NO: 37336 - DNA, 1167 bp, Rhizobium leguminosarum
  CDS (1)..(1167)
atggcgtccatgacctttgatgggataggcaagacctttccggacggaaccgttgctgttgcgaatgtaagtttttcggtcgcggacggagaattcgtcgtgttggtcggcccgtcgggttgtggcaagtcaactttattgcggatggctgcgggtcttgaaacgctcaacagcggtcggctgctcatggatgacgccgatgtcaccgagaccgagccacaggaccgggatattgcgatggtttttcagaactacgcgctttaccctcatatgactgtttacgacaacatggcttttggcttgcagcagcgcaaaatgcccaaggacaagattgacaagctggtgcgcgatgcagccgaaatgcttgatctcgcgcgctatctcgagcgcaaaccgggggcattgtctggtggtcaacgccaacgcgtggcgatgggtcgagcgatcgttcgccatcccatggccttcttgatggacgaacctctttccaacctggatgccaagctccgcgtgcagatgcgcggtgaactgaagctgcttaatcagcggctcggcgtcacaaccctttatgtgacccacgatcaggtcgaggctatgaccatgggcgatcgcgtggctgtgctgaagccggtgtttaacggacaggagagtaatcttcagcagatcgacacgccgcagaagctttacgacaagccgtccaatctgttcgtcgcggggttcatcggttcgcccgccatgaatttcgtacgcatcgagctgacagcggaagccgggacgctgaaagctgcgattaccgggacgaatatatccttctccatccccgcccagccagcattgtcggtctttgccgggcgacaagtcattgttggaattcgcccggagatgttcaaggtttgtcccgaggccgaggcgttgttcaatgagcagatcccggttgccgaagcgcttggagccgacactttcgtgtttttcgacatcgcctcaccgccggtcaatatcaacgatgctgaggataccgaagactttcccaataagggtaagaaccggcttgtggcgcgtataccaccggcgctgacacctcgacccaatcaggtgctgccattgacagtcgacctggagaaattgcactggttcgacccagtaacgggggctgcgatccgcgactga

SEQ ID NO: 37337 - protein, 388 aa, Rhizobium leguminosarum
MASMTFDGIGKTFPDGTVAVANVSFSVADGEFVVLVGPSGCGKSTLLRMAAGLETLNSGRLLMDDADVTETEPQDRDIAMVFQNYALYPHMTVYDNMAFGLQQRKMPKDKIDKLVRDAAEMLDLARYLERKPGALSGGQRQRVAMGRAIVRHPMAFLMDEPLSNLDAKLRVQMRGELKLLNQRLGVTTLYVTHDQVEAMTMGDRVAVLKPVFNGQESNLQQIDTPQKLYDKPSNLFVAGFIGSPAMNFVRIELTAEAGTLKAAITGTNISFSIPAQPALSVFAGRQVIVGIRPEMFKVCPEAEALFNEQIPVAEALGADTFVFFDIASPPVNINDAEDTEDFPNKGKNRLVARIPPALTPRPNQVLPLTVDLEKLHWFDPVTGAAIRD

SEQ ID NO: 37338 - DNA, 945 bp, Streptomyces lividans
  CDS (1)..(945)
atggccactgttacgttcgacaaggcgacccgtgtgtacccgggttccacgaagcccgccgtcgacggtctcgacatcgacatcgcggacggcgagttcctcgtcctggtcggcccgtccggttgtggcaagtccacctcgctccggatgctcgccgggctcgaggacgtgaacggcggcgccatccgcatcggtgaccgcgacgtgacgcacctgccgccgaaggaccgggacatcgccatggtgttccagaactacgcgctgtacccgcacatgtcggtcgccgacaacatgggcttcgccctcaagatcgccggcgtcaacaaggcggagatccggcagaaggtcgaggaggccgcgaagatcctcgacctcaccgagtacctggaccgcaagccgaaggcgctctccggcggtcagcgccagcgtgtggcgatgggccgcgcgatcgtgcgtgagccgcaggtgttcctcatggacgagccgctgtccaacctggacgccaagctccggctctccacccgtacgcagatcgcctcgctccagcgccgcctgggcatcaccaccgtctacgtcacccacgaccaggtcgaggccatgacgatgggcgaccgcgtggcgtcctcaaggacggtctgctccaggcaggtcgactccccgcggaacatgtacgacaagcccgcgaacctcttcgtcgccggcttcatcggctccccggccatgaacctggtcgaggtcccgatcaccgacggcggcgtgaagttcggcaacagcgtcgtcccggtcaaccgcgacgccctgaaggccgcctccgacaagggcgaccgcacggtcaccgtcggtgtccgcccggagcacttcgacgtcgtggagctgaacggcggcgcggccaagaccctgtcgaaggactcggcggacgcccggccggcctcgcggtctcggtga

SEQ ID NO: 37339 - protein, 314 aa, Streptomyces lividans
MATVTFDKATRVYPGSTKPAVDGLDIDIADGEFLVLVGPSGCGKSTSLRMLAGLEDVNGGAIRIGDRDVTHLPPKDRDIAMVFQNYALYPHMSVADNMGFALKIAGVNKAEIRQKVEEAAKILDLTEYLDRKPKALSGGQRQRVAMGRAIVREPQVFLMDEPLSNLDAKLRLSTRTQIASLQRRLGITTVYVTHDQVEAMTMGDRVASSRTVCSRQVDSPRNMYDKPANLFVAGFIGSPAMNLVEVPITDGGVKFGNSVVPVNRDALKAASDKGDRTVTVGVRPEHFDVVELNGGAAKTLSKDSADARPASRSR

SEQ ID NO: 37340 - DNA, 1110 bp, uncultured bacterium 582
  CDS (1)..(1110)
atgtcagttatagagttaaccgatttggtgaagacctacggagagaccgaggtgatccatggcgtaaacctcaccgtggaagatggcgagttttgtgtttttgtcgggccttccggttgtggtaagtcgacgctgctgcggatgattgcaggcctggaggagaccaccaaaggtcagatttgcattggtgcgcgggacgtcacccatgccgatccggttgaccggggcgtggctatggtgtttcagacctatgcgctttatccacatatgacggtggctgaaaatatgggctttggtctgaaaatgaaccgggttcccaaggccgaaatcaacgccaaagtgaccgaggccagccggatattacagctggatgattatttgcaacgcaaacccaaggctctgtctggtggccagcggcagcgggtggccatcgggcgggcgattgtccgcggtcccgaagtgttcttatttgatgagccattgtcaaatctcgatgccgaattgcgcgttgatatgcgggttgagattgcgcgcctgcacaaagagattggcgctacgatggtctatgtcacccatgatcaggtcgaggcgatgacgctggctgataaaatagttgtgctgcgtgcgggggtgattgaacagtctggccggccggttgatttgtataatgatcctgccaataaatttgtggcaggctttatcgggtcgcctgcaatgaatttcctgaacggtgttgttgaacagggacgggtgcggattacggccttgaatgatctgaccattgaggcaccggttgcaatagctcaagatgatggcctgcctgttgtggttggcttgcgaccccaaattttgacggccaacactggtgtcagtactggggctagtactgcggctagtactgcggccacccctgacacgggattgaccgtagaaatttgtgaacatctgggtggcgtctgttatctgtatctgtcaacaccgaccggggagcggttggtggtcgagacgcgggctgaggaaatcttgcccgtggggactgaggtttccgtcagttttgagggcaaaaaagcactgttttttgatgtgataaccgagcagcggttgcgctga

SEQ ID NO: 37341 - protein, 369 aa, uncultured bacterium 582
MSVIELTDLVKTYGETEVIHGVNLTVEDGEFCVFVGPSGCGKSTLLRMIAGLEETTKGQICIGARDVTHADPVDRGVAMVFQTYALYPHMTVAENMGFGLKMNRVPKAEINAKVTEASRILQLDDYLQRKPKALSGGQRQRVAIGRAIVRGPEVFLFDEPLSNLDAELRVDMRVEIARLHKEIGATMVYVTHDQVEAMTLADKIVVLRAGVIEQSGRPVDLYNDPANKFVAGFIGSPAMNFLNGVVEQGRVRITALNDLTIEAPVAIAQDDGLPVVVGLRPQILTANTGVSTGASTAASTAATPDTGLTVEICEHLGGVCYLYLSTPTGERLVVETRAEEILPVGTEVSVSFEGKKALFFDVITEQRLR

SEQ ID NO: 37342 - DNA, 1080 bp, Rhizobium sp
  CDS (1)..(1080)
atggctaccagcgtcgttcttcagaaggtcgagaaacgctatggcgcgctcgacgtgatccacggcatcgacctcaccatcgatcccggcgagttcgccgtcttcgtcggcccgtccggctgcggcaaatccaccttgctccggatgatcgccgggctcgaggagattaccggcggcacgctgatgctcgacaacgaccggatgaacgaagtggcgcccgccaagcgcggcatcgccatggtgttccagtcctacgcgctctatccgcacatgtcggtctacaagaacctcgccttcggcctcgagacagccggatacaggaagaccgatatcgaaccgaaggtacgccgcgccgccgaaatcctgcagatcgagaaactcctcgaccgcaagccgaaggcgctgtccggcggccagcgccagcgcgtcgcgatcggccgggcgatcgtccgcgagccgcgcatcttcctctttgacgagccgctttccaacctcgacgcggaactgcgcgtccagatgcgcgtcgagatctcacggctgcaccgcgacctcggcaacaccatgatctacgtgacccacgaccaggtggaagcgatgaccatggccgacaagatcgtcgtcctgaattcgggccgcatcgagcaggtcggcgcgccgctcgatctctacaacaatccggtcaaccgctttgtcgccggcttcatcggcagcccgaagatgaacttcctgaaggcgcggatcggcggcgtcacggaaaccgaaaccgccatcgaagtctgcggcggcacgatccgcctgccgcgccgcctcaacggggcaacgcagggccaggaggtcaccttcggcattcgccccgaacacctctcggcccgcgacaggggcattgcgctagccgcggtcaatgtcgagctcgtggagaatctcggtggcgagaccatgctctacggcatcacgcccgacggccagcaactgacgatcgctctcgaaggccagcagagggtggagcgcggcgccaatctctcggtctatttcgaaccctcccgctgtcacgtattcggcctggacggcagggcgatgtag

SEQ ID NO: 37343 - protein, 359 aa, Rhizobium sp
MATSVVLQKVEKRYGALDVIHGIDLTIDPGEFAVFVGPSGCGKSTLLRMIAGLEEITGGTLMLDNDRMNEVAPAKRGIAMVFQSYALYPHMSVYKNLAFGLETAGYRKTDIEPKVRRAAEILQIEKLLDRKPKALSGGQRQRVAIGRAIVREPRIFLFDEPLSNLDAELRVQMRVEISRLHRDLGNTMIYVTHDQVEAMTMADKIVVLNSGRIEQVGAPLDLYNNPVNRFVAGFIGSPKMNFLKARIGGVTETETAIEVCGGTIRLPRRLNGATQGQEVTFGIRPEHLSARDRGIALAAVNVELVENLGGETMLYGITPDGQQLTIALEGQQRVERGANLSVYFEPSRCHVFGLDGRAM

SEQ ID NO: 37344 - DNA, 1155 bp, Alicyclobacillus acidocaldarius
  CDS (1)..(1155)
gtggctcgcgtgttgctcgagcacatttacaagacctaccccggccagacggagccgacggtgaaggacttcaacctcgacattcaggacaaggaattcaccgtgttcgtcggcccctccggctgcggcaagacgacgacgcttcgcatgatcgctggactcgaggacatcacggagggcaacctgtatatcggcgatcgccgcgtgaacgacgtgccgccgaaggatcgggacattgcgatggtgttccaaaactacgcgctctatccccatatgacggtgtatcagaacatggcgttcggcctgaagctgcgcaaggtgccgaaggccgagatcgaccggcgggtgcaggaggcggcgaagatcctcgacatcgcgcacctgctcgaccggaagccgaaggcgctctccggcggtcagcgccagcgcgtggcgttgggtcgcgccattgtgcgcgagccgcaggtgttcctgatggatgagccgctgtcgaacctggacgcgaagctgcgcgtgcagatgcgcgcggagatccgcaagctccatcagcgcttgcaaacgaccgtcatttacgttacacatgatcagacggaagccatgacgatgggcgatcgcatcgtggtcatgcgcgacggcgtcatccagcaggcggatacgccgcaggtcgtgtactcccagccgaagaacatgtttgtcgccggcttcattgggtctcctgccatgaactttattcgcggcgagatcgtgcaggacggcgatgcgttctacttccgcgcgccttccatttcgctgcgcctgccggagggccgctacggcgtgctgaaggcgtcgggggccattgggaagccggtcgtgctcggcgtgcggccggaagacctgcacgatgaggaagtgttcatgacgacgtatcccgactccgtgctgcagatgcaggtggaagtcgtggaacacatgggctcggaggtctatctgcacacgagtatcgggccgaacacgatcgtcgcgcgcgtgaacccgcgccacgtctaccacgtcggaagctcggtcaagctcgcgattgacttgaacaagatccacatcttcgacgcggagacggaggagtccatcggcttcgccgcaggtcctgcgggtgaacgtcaagaagctttggtgtga

SEQ ID NO: 37345 - protein, 384 aa, Alicyclobacillus acidocaldarius
MARVLLEHIYKTYPGQTEPTVKDFNLDIQDKEFTVFVGPSGCGKTTTLRMIAGLEDITEGNLYIGDRRVNDVPPKDRDIAMVFQNYALYPHMTVYQNMAFGLKLRKVPKAEIDRRVQEAAKILDIAHLLDRKPKALSGGQRQRVALGRAIVREPQVFLMDEPLSNLDAKLRVQMRAEIRKLHQRLQTTVIYVTHDQTEAMTMGDRIVVMRDGVIQQADTPQVVYSQPKNMFVAGFIGSPAMNFIRGEIVQDGDAFYFRAPSISLRLPEGRYGVLKASGAIGKPVVLGVRPEDLHDEEVFMTTYPDSVLQMQVEVVEHMGSEVYLHTSIGPNTIVARVNPRHVYHVGSSVKLAIDLNKIHIFDAETEESIGFAAGPAGERQEALV

SEQ ID NO: 37346 - DNA, 1113 bp, Lactobacillus acidophilus
  CDS (1)..(1113)
atggttagagtagatttagatcacgtttacaaaaagtatgacggtaatgataagaattcagttacagattttaatttacatattaaagatgaagaatttatcgttttcgttggtccatcaggttgtggtaagtcaactactttaaggatgattgctggacttgaagatatctccaaaggaacgttgaaaattggcggtaaggtaatgaacgatatagctcctaagaatcgtgatattgccatggtattccagaactatgctttgtacccccatatgagtgtatatgacaacatggcttttggattaaaactacgtcatacaacaaaagaggagattgataaaaaggtaaaaagagctgccaaaattttgggcttgtcagattacttgaagcgtaagccagctgcactttctggtggtcaaagacagcgtgttgccttaggtcgtgcaattgtgcgggatgcacctattttcttaatggacgaaccactatccaaccttgatgctaagcttcgtgtaacgatgcgtgccgaaattgctaaattacatcaacaattgaagactactactatttacgtaactcacgatcaaactgaagctatgactttagcagaccgcatcgtaattattaaagatggtattcaacaacaagttggtactcctctagaagtttacaacaaacctgctaatgtctttgtcgctggttttattggttcaccagctatgaacttcttccgtgtaattttaaaagatggaaagatcatcgataaagaacaccatgactttgaaatccccgttccagaaggtaaattaaaagttttgaaggacaaaggctacaatggtaaagaattaatctttggtatccgtcctgaagatgttcatactgaagaagtatttttggaaagtttccctgatcaagttgttactgctaaagtcgtcgtttcagaacttttaggcgcagaaactcaactttacaccaaagtaggcgatactgaattagtttcaaaggttgatgctcgtgacttcactaagccaggtactgaagtacgaatgggatttgaaatgaacaaggctcactttttcgatccagaaacagaaaaagttgttgagaattaa

SEQ ID NO: 37347 - protein, 370 aa, Lactobacillus acidophilus
MVRVDLDHVYKKYDGNDKNSVTDFNLHIKDEEFIVFVGPSGCGKSTTLRMIAGLEDISKGTLKIGGKVMNDIAPKNRDIAMVFQNYALYPHMSVYDNMAFGLKLRHTTKEEIDKKVKRAAKILGLSDYLKRKPAALSGGQRQRVALGRAIVRDAPIFLMDEPLSNLDAKLRVTMRAEIAKLHQQLKTTTIYVTHDQTEAMTLADRIVIIKDGIQQQVGTPLEVYNKPANVFVAGFIGSPAMNFFRVILKDGKIIDKEHHDFEIPVPEGKLKVLKDKGYNGKELIFGIRPEDVHTEEVFLESFPDQVVTAKVVVSELLGAETQLYTKVGDTELVSKVDARDFTKPGTEVRMGFEMNKAHFFDPETEKVVEN

SEQ ID NO: 37348 - DNA, 1107 bp, Lactobacillus acidophilus
  CDS (1)..(1107)
atgacagaagtagatttgaaccatgtatacaaaaagtatgatggaaatgataaatattcagtaaatgactttgatttacacatcaaagacaaggaatttatagtttttgttggtccatcaggttgtggtaaatcaacgaccttaagaatgattgcaggtttggaagatatcacagaaggtacgcttgaaatcgaccacatggttatgaatgatgtggctccgaagaatagagatatagcaatggtcttccagaactatgccttgtatccacatatgactatttatgacaatatggcatttggattgaagctaagacattatcctaaagaaaaaattgatacaaaagtaaagcatgcggctgagattcttggtttaactgattatttaaagaaaaagcctgccgctctttcaggtggtcaacgtcagcgtgttgcattaggtcgttcaattgttagggatgcacctatcttcctaatggatgagcctttgtcaaacttggatgctaaattgcgtgtatccatgcgtgcggaaattgctaaacttcatcaaagattaggtactactacaatttatgttactcacgatcaaactgaagctatgactttggcagatagagttgtagttatgtcagtaggtaaggtacaacaaattggtacacctttggaagtttataacaagcctaaaaacatatttgtagctggttttattggttcaccacaaatgaacttctttaatgttcattataagaatggccgtatttctgatggaaaaggcttgaatatggcaattcctaaaggtaaagccgatatgttggataagaaaggctatgacgataaggatattgtatttggtatcagaccagaagatattcacgccgaagaagcattcttagaaacttggccggatgcagtaattacctctactgttgtggtttcagaattacttggtgcaactattcaactttatcaaaaagttgatggtactgaattcgtcgcagatgtaaattcacgtgattatcacaagccaggtgatcaggtgaaaatgggctttgatattaataaggctcacttcttcgataaagatacgacaatggcaatctacaattaa

SEQ ID NO: 37349 - protein, 368 aa, Lactobacillus acidophilus
MTEVDLNHVYKKYDGNDKYSVNDFDLHIKDKEFIVFVGPSGCGKSTTLRMIAGLEDITEGTLEIDHMVMNDVAPKNRDIAMVFQNYALYPHMTIYDNMAFGLKLRHYPKEKIDTKVKHAAEILGLTDYLKKKPAALSGGQRQRVALGRSIVRDAPIFLMDEPLSNLDAKLRVSMRAEIAKLHQRLGTTTIYVTHDQTEAMTLADRVVVMSVGKVQQIGTPLEVYNKPKNIFVAGFIGSPQMNFFNVHYKNGRISDGKGLNMAIPKGKADMLDKKGYDDKDIVFGIRPEDIHAEEAFLETWPDAVITSTVVVSELLGATIQLYQKVDGTEFVADVNSRDYHKPGDQVKMGFDINKAHFFDKDTTMAIYN

SEQ ID NO: 37350 - DNA, 1128 bp, Erwinia chrysanthemi
  CDS (1)..(1128)
atggctgaagtcattttcaacaaactggaaaaagtttactccaacggtttcaaagcagttcacggtatcgacctgacgatcaaagacggcgaattcatggtgatcgtagggccgtccggctgtgcgaaatccactaccctgcgcatgctggccggtctggaaaccatcagcggcggcgaagtccgcatcggtgagaagatcgtcaacaacctggcgccgaaggatcgcggcattgcgatggtgttccagaactatgcgctctacccgcatatgacggtgcgcgaaaacctggccttcggcctgaaactcagcaaaatgccgaaagacaagatcgaagcgcaggttaacgaagcggccaagattctggaactggaagagttgatggatcgcctgccgcgccagttgtccggcggtcaggcccagcgtgtggcggtaggtcgcgccatcgtgaaaaagccggatgtgttcctgttcgacgaaccgctttccaacctggacgccaagctgcgtgcctccatgcgtatccgtatctcggatctgcataagcagttaaaaaagagcggtcacccggccaccagcgtttacgtgactcatgaccagaccgaagccatgaccatgggcgatcgtatctgcgtcatgaagctcggccacatcatgcaggtggatacgccggataatctctatcacttcccgaaaaacatgttcgtcgccggctttatcggcgcgccggaaatgaacatcaaaccgggtaagctgctggaagaaaacggccagatcacgctgcaggtaggccagtacaccatgagccttaaccaagccaaacaggacaaagtacgtggttacgtcggcaaggacatctgcttcggcgttcgcccggaatacgtcacggtatcggaagcgcctttcgacggcggtcacttccagggcgaactggtacgtgccgaaaacatgggccacgaattctttatgtacatcaaggtcgatggttttgaactaaccagccgcatgccgtccgacgaagctcgggtgattatcaataacagaatgaatagtaaggtgtatttcaaatttgatatggataaatgccatatctttgatgcaaaaacagaacaaaatatctctctttaa

SEQ ID NO: 37351 - protein, 375 aa, Erwinia chrysanthemi
MAEVIFNKLEKVYSNGFKAVHGIDLTIKDGEFMVIVGPSGCAKSTTLRMLAGLETISGGEVRIGEKIVNNLAPKDRGIAMVFQNYALYPHMTVRENLAFGLKLSKMPKDKIEAQVNEAAKILELEELMDRLPRQLSGGQAQRVAVGRAIVKKPDVFLFDEPLSNLDAKLRASMRIRISDLHKQLKKSGHPATSVYVTHDQTEAMTMGDRICVMKLGHIMQVDTPDNLYHFPKNMFVAGFIGAPEMNIKPGKLLEENGQITLQVGQYTMSLNQAKQDKVRGYVGKDICFGVRPEYVTVSEAPFDGGHFQGELVRAENMGHEFFMYIKVDGFELTSRMPSDEARVIINNRMNSKVYFKFDMDKCHIFDAKTEQNISL

SEQ ID NO: 37352 - DNA, 1062 bp, Thermoplasma volcanium
  CDS (1)..(1062)
atgaccaaaatggtgaacgtaagagtagtggatgtatacaaatcatacggtaaagtacaagtattgaaaggtataaatttcaatatagaagacggggaattttttgtattgctagggtcttccggcgctggaaaatcaactttattaaatattctcgccggtttggaagctgtagacagtggaagtatcttctttgatgataagattgttaatgacttgccacctgtagagaggggggtagctatggtttttcaaaattatgcattatatccccacatgacagtatataaaaatatggcgtttccattgaaaatgctaaattataaaaaagatagtatagatcgaatcgtcaaaaaagtagctgaaactttagatataacatggttacttaatagatacccgcgtgaattatctggagggcaagcacaacgagttgcacttggaagagcattagtacgtgatccaaagatatttttattggatgaaccactaagtaatctagatgcgaatataagatcaaagataagaaacgaattaaaattaatgcaaaaacaattaaataaaacatttatttatgtaacacatgatcaaatggaggcaatgtcacttggagaccacataggaattttacacaatggcgtattggaacaatatggaaggccaatagatatatataataacccgataaatgaatatattgcaacctttcttggagatccagaaataaatatgctatcatgcataaaatatcgggatgtatatgaatgcgatggctccataaaatttaaattggatttagatgataaaaagattacattaggaataagaccagaaaatatatatcttcatagacaaaatgataatgacatagaaggaaaaataatacctaaagtctcagaattgttaggttcgcatacattgataattggatctgtagaaaataaagaaataagaatcgttactgaagaaacaaatataagcatagggaaggaaattccaatatacattaatttgaataaatgtcttatatttaatgaaaaaggagaaaatattaataaataa

SEQ ID NO: 37353 - protein, 353 aa, Thermoplasma volcanium
MTKMVNVRVVDVYKSYGKVQVLKGINFNIEDGEFFVLLGSSGAGKSTLLNILAGLEAVDSGSIFFDDKIVNDLPPVERGVAMVFQNYALYPHMTVYKNMAFPLKMLNYKKDSIDRIVKKVAETLDITWLLNRYPRELSGGQAQRVALGRALVRDPKIFLLDEPLSNLDANIRSKIRNELKLMQKQLNKTFIYVTHDQMEAMSLGDHIGILHNGVLEQYGRPIDIYNNPINEYIATFLGDPEINMLSCIKYRDVYECDGSIKFKLDLDDKKITLGIRPENIYLHRQNDNDIEGKIIPKVSELLGSHTLIIGSVENKEIRIVTEETNISIGKEIPIYINLNKCLIFNEKGENINK

SEQ ID NO: 37354 - DNA, 1110 bp, Erwinia rhapontici
  CDS (1)..(1110)
atggcgcagttgacgctggataagattcaaaaacgctatggcgcgaaggcggaggtcatccgttcgctgaatttgcagattaaaagcggagagtttgtggtgattgtcgggccttctggctgcggcaagtcaacgctgctgcgtatgattgccgggctggaggagatcagtggtgggggcatgtacatcgatggtcactacgccaatgacgacagcccggccgaacgcggtatcggcatggttttccagtcatatgcactgtatccgcatatgagtgtttatcagaatatggcattcgcgctggagcttgcgcactgttcaaaggcggagattgatcagcgggtgagggagtgtgcacgcattttacagctggagccgttgctggaacgacggccaaaagatttgtcgggtggccagcgtcagcgcgtggcgatcgggcgtgccattatacgcgaaccgcgcttgttcctgttcgatgaaccgctatccaaccttgatgcctcgctgcgggtgcagatgcgtatggaagtctctgccctgcataaacgtctgggtgtcaccattatttatgtgacgcacgatcaggtcgaggcgatgacgctggctgaccggatcgtggtgctcaatcagggcaatatcgaacaggtgggaacgccgcttgagctgtacgaccagcccgccaatgaatttgtcgcccagtttatcggttcaccgaagatgaatctgatcccggcgacgctgcgccggtcgggcgaacagcaaagcgtggtggaactggacaatggcaaaacgctggtgttatccatcgccaccccggccgaggcggagggccgcagcgtcaacatcggtattcgtccagaacatattcgcagtggcaatgtggaacagtgcgaataccagggcgaggtgatgtttgtggaacagatgggcaatgaaaccctgctgtatctggacaacggcaatgcgggcgaaccctgggtcgtgcggcatgccgagcgttccgccatccatgttggccaaaccgttggggtacggcttccggtggaatgctgttacctgttcgacagtcacggccaggcgttccaacgtcatctggcaaaagtacactaa

SEQ ID NO: 37355 - protein, 369 aa, Erwinia rhapontici
MAQLTLDKIQKRYGAKAEVIRSLNLQIKSGEFVVIVGPSGCGKSTLLRMIAGLEEISGGGMYIDGHYANDDSPAERGIGMVFQSYALYPHMSVYQNMAFALELAHCSKAEIDQRVRECARILQLEPLLERRPKDLSGGQRQRVAIGRAIIREPRLFLFDEPLSNLDASLRVQMRMEVSALHKRLGVTIIYVTHDQVEAMTLADRIVVLNQGNIEQVGTPLELYDQPANEFVAQFIGSPKMNLIPATLRRSGEQQSVVELDNGKTLVLSIATPAEAEGRSVNIGIRPEHIRSGNVEQCEYQGEVMFVEQMGNETLLYLDNGNAGEPWVVRHAERSAIHVGQTVGVRLPVECCYLFDSHGQAFQRHLAKVH

SEQ ID NO: 37356 - DNA, 1092 bp, Sphingomonas sp
  CDS (1)..(1092)
gtggtagcaagcgtcagcattcagaacgtcgtcaagcgttacgacaagacgactgtggtccatggtgtcagcctggatatcgaaccgggtgaattcgtcgtgctggtcggcccttcgggctgcggcaagtcgacgacactacgcatggtggccggtctggaagaaatcagcggcggcacgatcaggatcgacggccgcgtcatcaacgacctcgcgccaaaagatcgcgacgtcgccatggtgttccagaactacgcgctctacccgcacctgaatgtgcgcgacaacatctcctttggcctgcgcctgaagcgcaccaagaaatccgtcatcgatgcagccgtgaagacggccgccgacatcctcggcctgcaaccgctgctcgaacgcaagccttccgatctttccggcggtcagcgtcaacgcgttgccatgggccgcgcgatcgtgcgcgacccgaaggtcttcctcttcgacgaaccgctctccaacctcgacgccaaactgcgcacgcagatgcgcgccgaaatcaagcggctgcaccaacgcctgggcaccaccgtcatttatgtgacgcacgatcaggtcgaagccatgacattggcagatcgcatcgtggtcatgcgcgacggtctgatcgaacagatcggcaagccgatggacctgttcctccatccggccaataccttcgtggccagcttcattggttcgccgccgatgaacctgatgccggcacgcattgccgtcgacagcacgcagcacgttgaattgaacggtggcaaccgcatcagcctgctgccccgtgcaggcacacatctggcaccgggtcaggaagtggtgtttggcattcgcccggaagacgtcacgctcgacggcgtcgaaggctccgaacgtgcgcagatcaaggccacggtggacatcgtcgaaccgctcggttcggaatcgatcctccacgctacggtcggcgatcactcgctggtggtgaaggtgggcggcctcaatgaagtacatccgggcgatccggtcacgctgcatgtcgatctgacacgcgtgcacctgttcgacgcccagtcacaggcctctatttactga

SEQ ID NO: 37357 - protein, 363 aa, Sphingomonas sp
MVASVSIQNVVKRYDKTTVVHGVSLDIEPGEFVVLVGPSGCGKSTTLRMVAGLEEISGGTIRIDGRVINDLAPKDRDVAMVFQNYALYPHLNVRDNISFGLRLKRTKKSVIDAAVKTAADILGLQPLLERKPSDLSGGQRQRVAMGRAIVRDPKVFLFDEPLSNLDAKLRTQMRAEIKRLHQRLGTTVIYVTHDQVEAMTLADRIVVMRDGLIEQIGKPMDLFLHPANTFVASFIGSPPMNLMPARIAVDSTQHVELNGGNRISLLPRAGTHLAPGQEVVFGIRPEDVTLDGVEGSERAQIKATVDIVEPLGSESILHATVGDHSLVVKVGGLNEVHPGDPVTLHVDLTRVHLFDAQSQASIY

SEQ ID NO: 37358 - DNA, 1110 bp, Clostridium perfringens
  CDS (1)..(1110)
atggcaaatttatcacttaaacatatttataaagtttatccaggagatgttacagcagttaaagactttaacttagaaatagctgacaaagagtttatagtattcgttggaccatcaggttgtggtaagtctactactttaagaatgattgctggattagaagaaatatcaaaaggtgaattatacattggagatagattagttaacgaagttgaaccaaaggaaagagatatagcgatggttttccaaagttacgcactatatccacatatgactgtatatgataacatggcatttggacttaagttaagaaaagttccaaaggatgaaatagataaaaaggttaaagatgctgctaaaatacttgatatagagcatttattagatagaaaaccaaaggctttatcaggaggtcaaagacaaagggttgccttaggaagagctatagtaagagaacctaaagtattcttaatggacgagcctttatcaaacttagatgctaaattaagagttcaaatgagaactgagatctctaaattacatcaaagattacaaacaacattcatatatgttacacatgaccaagttgaagctatgacaatgggtacaagaatagttgttatgaaagatggtatagttcaacaagttgactcaccacaagaaatatacaataatccagctaatatattcgttgcaggattcataggaagtccacaaatgaactttatagatggtactataaaagaagaaggcggaaaatattttgcttgcttccaaagcgaaaaaattgaaatgccaatggataaagctagattattaaaagaaaaaggatatataggaaaaaatgttataataggtgtaagacctgaacatttagatgatgaccaagaattaggagaaggaaagtcaacaacagtaataaaatcaaaagttgaagttacagagttaatgggagcagaaagttatatttatactaaacttggagatcaaaacataacagttagagtaaatggaagcactaagttacaaaatggtcaagaagctaagttctacgttgatgctaataagattcatatatttgataaagaaactgaattaaaattagtttaa

SEQ ID NO: 37359 - protein, 369 aa, Clostridium perfringens
MANLSLKHIYKVYPGDVTAVKDFNLEIADKEFIVFVGPSGCGKSTTLRMIAGLEEISKGELYIGDRLVNEVEPKERDIAMVFQSYALYPHMTVYDNMAFGLKLRKVPKDEIDKKVKDAAKILDIEHLLDRKPKALSGGQRQRVALGRAIVREPKVFLMDEPLSNLDAKLRVQMRTEISKLHQRLQTTFIYVTHDQVEAMTMGTRIVVMKDGIVQQVDSPQEIYNNPANIFVAGFIGSPQMNFIDGTIKEEGGKYFACFQSEKIEMPMDKARLLKEKGYIGKNVIIGVRPEHLDDDQELGEGKSTTVIKSKVEVTELMGAESYIYTKLGDQNITVRVNGSTKLQNGQEAKFYVDANKIHIFDKETELKLV

SEQ ID NO: 37360 - DNA, 1116 bp, Thermoanaerobacter ethanolicus
  CDS (1)..(1116)
atggcaaaaatagttttcgaacatgttactaaggaatttattgatgaaaaaagaggtaaagtaatagcggtaaatgatgcaaattttacgatagaagataaagaatttgtagtgttggttggaccttctggatgtggtaaaacaacaactttaagaatgattgctggtcttgaaagacaaacaaaaggcaatatatatattggcgagaaattagttaattatcttccacctaaagatagagatattgctatggtatttcaagattatgcattatatccacatatgaccgtttatgaaaatctttccttcggtttaagaaatcttaaggttcctagaacggaaatcgaacaaaaagtgaaaagagcagcggagatacttgggataagtgaattattagatcgaaagccgagggaattatcaggaggacagagacagagagtcgctgtgggtagagcaattgttagaaatcctaaagtttttctatttgatgagcctttatcaaatcttgatgcaaagttgagagttcagatgagagtagaacttgcagaacttcataaaaagctagaaactacgatagtatatgttacccatgatcaagtggaagcaatgacattgggacaaagaattatcgtaatgaatctcggaataattcagcaaattgctactcctgacgaactttataatagaccagttaatatgtttgtagcaggttttatcggtgctccttccatgaactttataaattgcaaagttgaaagaaacaaaataatattaagcgacggtaattctaatacgatgtttgatatacctcaaaaatttaaaaaagttatagcaaatataaacggtaaagaaatggtgatggggataagacctgaagacatttatgatgctgttttttctcaaaatattgaaaataaacttcatgttgatgtatatgtgaaagttgttgaaaaattaggctctgagaaccttatatattttgataaatacggcacaactattacggccagggttaattctcaaagtagaattgtttcaggagaatatgcaaaagtagcatttaatatagacaaaatatatttgtttgataaagaaactggaatagcaatatattag

SEQ ID NO: 37361 - protein, 371 aa, Thermoanaerobacter ethanolicus
MAKIVFEHVTKEFIDEKRGKVIAVNDANFTIEDKEFVVLVGPSGCGKTTTLRMIAGLERQTKGNIYIGEKLVNYLPPKDRDIAMVFQDYALYPHMTVYENLSFGLRNLKVPRTEIEQKVKRAAEILGISELLDRKPRELSGGQRQRVAVGRAIVRNPKVFLFDEPLSNLDAKLRVQMRVELAELHKKLETTIVYVTHDQVEAMTLGQRIIVMNLGIIQQIATPDELYNRPVNMFVAGFIGAPSMNFINCKVERNKIILSDGNSNTMFDIPQKFKKVIANINGKEMVMGIRPEDIYDAVFSQNIENKLHVDVYVKVVEKLGSENLIYFDKYGTTITARVNSQSRIVSGEYAKVAFNIDKIYLFDKETGIAIY

SEQ ID NO: 37362 - DNA, 1119 bp, Thermococcus litoralis
  CDS (1)..(1119)
atggctggtgttaggcttgtagatgtttggaaggtgtttggggaggttactgctgttagggagttgagtttggaggttaaggatggggagtttatgattcttttgggcccgagtggttgtgggaagacaacaacgctcaggatgattgctgggctggaggagccgagtagggggcagatttacattggtgataggctggttgctgacccggagaagggaattttcgtcccgccgaaggatagggatattgcgatggtttttcagagttatgcgttgtacccgcatatgactgtttatgataatattgcttttccgttgaagctcaggaaggttccgaggcaggagattgaccagcgtgttagggaggttgctgagctcctcggtttgacggagcttttgaataggaagccgagggaattaagcggtgggcagaggcagcgtgttgcgttgggtagggcgattgttaggaagccgcaggtgtttttgatggatgagcctttgagtaatttggatgctaagttgagggttaggatgcgtgctgaactgaagaagttgcagaggcagcttggtgtgacgacgatttacgtaacccacgatcaggttgaggctatgacgatgggtgataggattgctgtgatgaatcggggtgttttgcaacaagtgggttcgccggatgaggtttatgataagcctgcgaatacttttgtggctggttttattggaagcccgccgatgaattttcttgatgctattgttactgaggatgggtttgtggattttggggagtttaggttgaagcttcttccggatcagtttgaggttttgggggagttgggttatgttggtagggaggtaatctttggtattcgtccggaggatttgtatgatgcgatgtttgctcgggtgagggttcctggggagaatttggttagggctgtggttgagattgtggagaatttgggtagtgagaggattgtgcatttgcgtgttggtggtgtgacttttgttggtgcttttcgttcggagtctagggttagggagggtgtggaggttgatgttgtgtttgatatgaagaagattcacatcttcgacaaaaccacaggaaaagcaatattctag

SEQ ID NO: 37363 - protein, 372 aa, Thermococcus litoralis
MAGVRLVDVWKVFGEVTAVRELSLEVKDGEFMILLGPSGCGKTTTLRMIAGLEEPSRGQIYIGDRLVADPEKGIFVPPKDRDIAMVFQSYALYPHMTVYDNIAFPLKLRKVPRQEIDQRVREVAELLGLTELLNRKPRELSGGQRQRVALGRAIVRKPQVFLMDEPLSNLDAKLRVRMRAELKKLQRQLGVTTIYVTHDQVEAMTMGDRIAVMNRGVLQQVGSPDEVYDKPANTFVAGFIGSPPMNFLDAIVTEDGFVDFGEFRLKLLPDQFEVLGELGYVGREVIFGIRPEDLYDAMFARVRVPGENLVRAVVEIVENLGSERIVHLRVGGVTFVGAFRSESRVREGVEVDVVFDMKKIHIFDKTTGKAIF

SEQ ID NO: 37364 - DNA, 1119 bp, Thermococcus litoralis
  CDS (1)..(1119)
atggctggtgttaggcttgtggatgtttggaaggtgtttggggaggttactgctgttagggagatgagtttggaggttaaggatggggagtttatgattcttttgggcccgagtggttgtgggaaaacaacaacgctcaggatgattgctgggctggaggagccgagtagggggcagatttatattggagacaaactcgtcgcagacccggagaagggaatttttgtgccaccgaaggacagggatattgcgatggtcttccaaagctacgccctttacccgcatatgactgtttatgataatattgcttttccgttgaagctcaggaaggttccgaggcaggagattgaccagcgtgttagggaggttgctgagctcctcggtttgacggagcttttgaataggaagccgagggaattaagcggtgggcagaggcagcgtgttgcgttgggtagggcgattgttaggaagccgcaggtgtttttgatggatgagcctttgagtaatttggatgctaagttgagggttaggatgcgtgctgaactgaagaagttgcagaggcagcttggtgtgacgacgatttacgtaacccacgatcaggttgaggctatgacgatgggtgataggattgctgtgatgaatcggggtgttttgcaacaagtgggttcgccggatgaggtttatgataagcctgcgaatacttttgtggctggttttattggaagcccgccgatgaattttcttgatgctattgttactgaggatgggtttgtggattttggggagtttaggttgaagcttcttccggatcagtttgaggttttgggggagttgggttatgttggtagggaggtaatctttggtattcgtccggaggatttgtatgatgcgatgtttgctcaggtgagggttcctggggagaatttggttagggctgtggttgagattgtggagaatttgggtagtgagaggattgtgcatttgcgtgttggtggtgtgacttttgtcggctcctttaggtcggagtctagggttagggagggtgtggaggttgatgttgtgtttgatatgaagaagattcacatcttcgacaaaaccacaggaaaagcaatattttga

SEQ ID NO: 37365 - protein, 372 aa, Thermococcus litoralis
MAGVRLVDVWKVFGEVTAVREMSLEVKDGEFMILLGPSGCGKTTTLRMIAGLEEPSRGQIYIGDKLVADPEKGIFVPPKDRDIAMVFQSYALYPHMTVYDNIAFPLKLRKVPRQEIDQRVREVAELLGLTELLNRKPRELSGGQRQRVALGRAIVRKPQVFLMDEPLSNLDAKLRVRMRAELKKLQRQLGVTTIYVTHDQVEAMTMGDRIAVMNRGVLQQVGSPDEVYDKPANTFVAGFIGSPPMNFLDAIVTEDGFVDFGEFRLKLLPDQFEVLGELGYVGREVIFGIRPEDLYDAMFAQVRVPGENLVRAVVEIVENLGSERIVHLRVGGVTFVGSFRSESRVREGVEVDVVFDMKKIHIFDKTTGKAIF

SEQ ID NO: 37366 - DNA, 1089 bp, Rhizobium meliloti
  CDS (1)..(1089)
atgacaggcctgctgctgaaagatatccgcaagtcctacggggccgtcgacgtaattcacggcatcgatctcgacatcaaggaaggcgagttcgtcgtcttcgtaggaccgtccggatgcgggaagtcgacacttctgcgcatgatcgccgggctcgaggaaataaccggcggcgacatgttcatcgacggcgagcgggtcaacgacgtgccgccttcgaagcgcggcatcgccatggtgttccagtcctatgcgctctatccgcatatgaccgtttacgacaacatggccttcggcatgcgcatcgccagggaatcgaaggaggagatcgaccggcgtgtgcgtggagccgcggatatgcttcagctcaccccatatctcgaccggcttccgaaggcgctttccggcggccagcggcagcgcgtggccatcggccgggcgatctgccgcaatcccaaggtcttccttttcgacgagccgctctccaacctcgacgccgcgctccgggtagcgacccgcatcgagatcgccaagctcagcgagcggatgtcggacaccaccatgatctacgtcacccatgaccaggtggaggcgatgacgctcgccgaccggatcgtggtcctctccgccggtcacatcgaacaggtcggggcgcccctcgaactctacgagcggccggcaaacctcttcgtcgcgcgtttcatcggctccccggccatgaacgtcatcccggcgacgatcactgccaccggccaacagaccgccgtctcgctcgcgggcggaaagtcggtgacgctcgatgttccgacgaatgcctccgaaaacggcaagacggcgagcttcggcgtccgcccggaagacctgcgggtgaccgaggccgacgacttcctgttcgagggcacggtctcgatcgtcgaggcgctgggcgaggtgaccttgctctacatcgaagggctggtcgaaaacgagccgatcatcgccaagatgcccggtatcgcccgggtcggccgcggcgacaaggtgcggttcacggccgacaaggccaagctgcatctcttcgacaccaatggacagagctatcgggcgtag

SEQ ID NO: 37367 - protein, 362 aa, Rhizobium meliloti
MTGLLLKDIRKSYGAVDVIHGIDLDIKEGEFVVFVGPSGCGKSTLLRMIAGLEEITGGDMFIDGERVNDVPPSKRGIAMVFQSYALYPHMTVYDNMAFGMRIARESKEEIDRRVRGAADMLQLTPYLDRLPKALSGGQRQRVAIGRAICRNPKVFLFDEPLSNLDAALRVATRIEIAKLSERMSDTTMIYVTHDQVEAMTLADRIVVLSAGHIEQVGAPLELYERPANLFVARFIGSPAMNVIPATITATGQQTAVSLAGGKSVTLDVPTNASENGKTASFGVRPEDLRVTEADDFLFEGTVSIVEALGEVTLLYIEGLVENEPIIAKMPGIARVGRGDKVRFTADKAKLHLFDTNGQSYRA

SEQ ID NO: 37368 - DNA, 1116 bp, Shigella flexneri
  CDS (1)..(1116)
atggcgagcgtacagctgcaaaatgtaacgaaagcctggggcgaggtcgtggtatcgaaagatatcaatctcgatatccatgaaggtgaattcgtggtgtttgtcggaccgtctggctgcggtaaatcgactttactgcgcatgattgccgggcttgagacgatcaccagcggcgacctgttcatcggtgagaaacggatgaatgacactccgccagcagaacgcggcgttggtatggtgtttcagtcttacgcgctctatccccacctgtcagtagcagaaaacatgtcatttggcctgaaactggctggcgcaaaaaaagaggtgattaaccaacgcgtcaaccaggtggcggaagtgctgcaactggcgcatttgctggatcgcaaaccgaaagcgctctccggtggtcagcgtcagcgcgtggcgattggccgtacgctggtggccgagccaagcgtatttttgctcgatgaaccgctctccaacctcgatgctgcactgcgtgtgcaaatgcgtatcgaaatctcccgtctgcataaacgcctgggccgcacaatgatttacgtcacccacgatcaggtcgaagcgatgacgctggccgacaaaatcgtggtgctggacgccggtcgcgtggcacaggttgggaaaccgctggaactgtaccactatccggcagaccgttttgtcgccggatttatcggttcgccaaagatgaacttcctgccggtaaaagtgaccgccaccgcaatcgatcaagtgcaggtggagctgccgatgccaaatcgtcaacaagtctggctgcctgttgaaagccgtgatgtccaggttggagccaatatgtcgctgggtattcgcccggaacatctactgccgagtgatatcgctgacgtcatccttgagggtgaagttcaggtcgtcgagcaactcggcaacgaaacccaaatctatatccagatcccttccattcgtcaaaacctggtgtaccgccagaacgacgtggtgttggtagaagaaggtgccacattcgctatcggcctgccgccagagcgttgccatctgttccgtgaggatggcactgcatgtcgtcgactgcataaggagccgggcgtttaa

SEQ ID NO: 37369 - protein, 371 aa, Shigella flexneri
MASVQLQNVTKAWGEVVVSKDINLDIHEGEFVVFVGPSGCGKSTLLRMIAGLETITSGDLFIGEKRMNDTPPAERGVGMVFQSYALYPHLSVAENMSFGLKLAGAKKEVINQRVNQVAEVLQLAHLLDRKPKALSGGQRQRVAIGRTLVAEPSVFLLDEPLSNLDAALRVQMRIEISRLHKRLGRTMIYVTHDQVEAMTLADKIVVLDAGRVAQVGKPLELYHYPADRFVAGFIGSPKMNFLPVKVTATAIDQVQVELPMPNRQQVWLPVESRDVQVGANMSLGIRPEHLLPSDIADVILEGEVQVVEQLGNETQIYIQIPSIRQNLVYRQNDVVLVEEGATFAIGLPPERCHLFREDGTACRRLHKEPGV

SEQ ID NO: 37370 - DNA, 1122 bp, Vibrio cholerae
  CDS (1)..(1122)
atggcgagtgtcacgttaaaaaatgtatgtaaagcgtacggcgatgtgctgatttcaaagaatgtcgacttagagattcaagaaggcgaatttgtggtgttcgtcggtccttcaggttgtggtaaatccacactgctgcgctgtattgcgggtttggaagacattacgtctggcgacttgtatatcggcgaacagcgcatgaatgatgtcgaaccgtccaaacgcggcgtaggcatggttttccagtcttacgcgctttacccgcacctcaatttgtacgacaacatgtcatttggccttaagctctccaaagccgataaaagcgagatcaaaaaacgcgttgaccatgcggcggaaattctgcaactgagccacctgctcgatcgtcaacccaaagcgctttctggcggtcaacgccagcgtgtagccattggccgtactctggtttcacagcccaacgtattcctgctggatgaaccgctatccaacctcgatgccgctttgcgcgtgcaaatgcgttcagaaattaccaaactgcaacgtaaactgggctgcaccatgatttacgttacccatgaccaagtggaagccatgaccatggcggacaaaattgtggtgttggatgcgggttttgtctcgcaagttggcaagccgctggagctgtaccactacccacaaaaccgctttgtggccgggtttattggctcgccgaaaatgaacttcatgagcgtcttcattgaaggggtagaaaaagatcgggtacaggtccagctttctaacggtacgaccttctggatccctgtcgatggcaccactgtcactcgtggagaacgcatgtcactcggcattcgtcctgaacatttggtcgaagcagagcatggcgatgccaaaattgaaggcaaagtaatgatcgttgagaaactgggtaacgaaacccaagtgtatatgaacctgaagggttcagactcagatgtgatctaccgccagccagacacactcgatgtcgaaaccggtgacacgctcaccattggtattcccgcacatcgctgccatctattccacagtgatggccgtgcttgccgccgtttacataaagaaaaaggcgttgatcttcccgcataa

SEQ ID NO: 37371 - protein, 373 aa, Vibrio cholerae
MASVTLKNVCKAYGDVLISKNVDLEIQEGEFVVFVGPSGCGKSTLLRCIAGLEDITSGDLYIGEQRMNDVEPSKRGVGMVFQSYALYPHLNLYDNMSFGLKLSKADKSEIKKRVDHAAEILQLSHLLDRQPKALSGGQRQRVAIGRTLVSQPNVFLLDEPLSNLDAALRVQMRSEITKLQRKLGCTMIYVTHDQVEAMTMADKIVVLDAGFVSQVGKPLELYHYPQNRFVAGFIGSPKMNFMSVFIEGVEKDRVQVQLSNGTTFWIPVDGTTVTRGERMSLGIRPEHLVEAEHGDAKIEGKVMIVEKLGNETQVYMNLKGSDSDVIYRQPDTLDVETGDTLTIGIPAHRCHLFHSDGRACRRLHKEKGVDLPA

SEQ ID NO: 37372 - DNA, 1098 bp, Bacillus subtilis
  CDS (1)..(1098)
atggctgaattgcggatggagcacatttataaattttatgatcagaaggaaccggcggttgatgactttaaccttcatattgccgataaggaatttatcgtattcgtcggcccgtccggctgcgggaaatcaacgacgctgcgaatggtcgcaggacttgaagaaatttcgaaaggtgatttttatattgaaggaaaacgggtcaatgatgtagcgccaaaggacagggatatcgcgatggtatttcagaactacgcgctttatccgcatatgacggtctacgataatatcgcgttcgggctcaagcttcggaaaatgccgaagcctgaaatcaaaaaaagagtcgaagaagccgctaaaattctcgggcttgaggaatatttgcaccgtaaaccgaaagcgctgtcaggcggacagagacagcgggttgcgctgggccgggcaatcgtgcgggatgcaaaggtgttcctgatggatgagcctttgtcaaacctggacgcgaagctgagggtgcaaatgcgggcggaaatcattaagctccaccagagattgcagactacaacgatttatgtgacgcatgaccagacagaagcgctgacaatggcgacacggattgtagtcatgaaagatgggaaaattcagcagatcgggacgccgaaggatgtatatgaattccctgaaaacgtctttgtcggcgggtttatcggatcaccggcgatgaattttttcaaaggaaagctcacggatggcttaatcaaaatcggttctgcggcattaaccgtcccggaaggaaaaatgaaagtgctgcgtgaaaaaggctacatcggcaaagaggtcatcttcggcatccgtcctgaggatatacatgatgaattgattgtcgtggaatcatataagaactcttcgattaaggcgaaaattaatgttgcagagctgctcggttctgaaattatgatttattcgcagatagacaaccaagactttattgcgcggatcgacgcccgcctcgatattcaatcgggcgatgagctgacggttgcatttgatatgaataaaggccatttctttgacagtgagacagaagtgagaatccgataa

SEQ ID NO: 37373 - protein, 365 aa, Bacillus subtilis
MAELRMEHIYKFYDQKEPAVDDFNLHIADKEFIVFVGPSGCGKSTTLRMVAGLEEISKGDFYIEGKRVNDVAPKDRDIAMVFQNYALYPHMTVYDNIAFGLKLRKMPKPEIKKRVEEAAKILGLEEYLHRKPKALSGGQRQRVALGRAIVRDAKVFLMDEPLSNLDAKLRVQMRAEIIKLHQRLQTTTIYVTHDQTEALTMATRIVVMKDGKIQQIGTPKDVYEFPENVFVGGFIGSPAMNFFKGKLTDGLIKIGSAALTVPEGKMKVLREKGYIGKEVIFGIRPEDIHDELIVVESYKNSSIKAKINVAELLGSEIMIYSQIDNQDFIARIDARLDIQSGDELTVAFDMNKGHFFDSETEVRIR

SEQ ID NO: 37374 - DNA, 999 bp, Rhodobacter sphaeroides
  CDS (1)..(999)
atgggcaagataaccctgcgcaacgtccagaagcggttcggtgaggcggtcgtcatcccctcgctcgacctcgacatcgaggatggcgagttcgtcgtcttcgtcggcccctcgggctgcggcaaatccacgctcctgcgcctgatcgcgggcctcgaggatgtgtcggacggccagatcatgatcgacgggcgcgacgccaccgagatgccgcccgcgaagcgcggcctcgccatggtgtttcagagctacgcgctctatccgcacatgacggtgaagaagaacatcgccttcccgctgcggatggcgaagatggagccacaggagatcgagcggcgcgtgtcgaacgcggccaagatcctgaacctcaccaactatctcgaccgccgccccggccagctctcgggcgggcaacggcagcgggtggccatcgggcgcgccatcgtgcgcgagccggcggccttcctgttcgacgagccgctctcgaacctcgatgcggcgctgcgggtcaacatgcggctcgagatcaccgagctgcaccagtcgctcgagaccacgatgatctatgtcacccacgatcaggtcgaggccatgaccatggccgacaagatcgtggtgctgaacgcgggccggatcgagcaggtgggctcgcccctcaccctctaccgcaatccggcgaacctcttcgtggcgggcttcatcggcagcccgaagatgaacctgatcgaggggcccgaggccgccaagcacggcgccaccaccatcgggatccgccccgaacatatcgacctgtcgcgcgaggcgggggcgtgggagggcgaggtcggcgtctcggaacatctcggctcggacacgttcctgcatgtgcatgtcgcggggatgcccaccctcaccgtgcggacgggcggagagttcggcgtccatcacggcgaccgggtctggctcacgccgcaggccgacaagatccaccgcttcggcgccgacggaaaggcgctctga

SEQ ID NO: 37375 - protein, 332 aa, Rhodobacter sphaeroides
MGKITLRNVQKRFGEAVVIPSLDLDIEDGEFVVFVGPSGCGKSTLLRLIAGLEDVSDGQIMIDGRDATEMPPAKRGLAMVFQSYALYPHMTVKKNIAFPLRMAKMEPQEIERRVSNAAKILNLTNYLDRRPGQLSGGQRQRVAIGRAIVREPAAFLFDEPLSNLDAALRVNMRLEITELHQSLETTMIYVTHDQVEAMTMADKIVVLNAGRIEQVGSPLTLYRNPANLFVAGFIGSPKMNLIEGPEAAKHGATTIGIRPEHIDLSREAGAWEGEVGVSEHLGSDTFLHVHVAGMPTLTVRTGGEFGVHHGDRVWLTPQADKIHRFGADGKAL

SEQ ID NO: 37376 - DNA, 1071 bp, Escherichia coli
  CDS (1)..(1071)
atggcaggactgaaattacaggcagtaaccaaaagctgggatggtaaaacccaggtcattaaaccgctgacccttgatgtggcggatggcgaatttatcgtgatggtcgggccgtctggctgcgggaaatcgacgctgctgcgcatggttgccgggctggagcgggtgacagaaggcgatatctggatcaacgaccagcgcgtgactgaaatggagccaaaagatcgcgggattgcgatggtgttccagaactacgcgctttatccgcatatgagtgtcgaagaaaacatggcgtgggggctgaaaattcgcggcatgggcaagcagcaaattgccgagcgcgttaaagaagcggcgcgcattctggagctggacggtctgctcaaacgtcgcccgcgcgagctttccggcggtcagcgccagcgtgtggcgatgggccgcgcgattgtgcgcgatccggcggtgttcctgtttgatgagccgctctctaacctcgatgccaagctgcgcgtgcagatgcgtcttgaactgcaacagttgcaccgtcgcctgaaaacgacttcactctacgttactcacgatcaggttgaagcgatgacgctcgcccagcgagtaatggtgatgaacggcggtgttgccgaacagattggcacaccagttgaagtctacgaaaagcccgccagcctgtttgtagcgagttttatcggcagtccggcgatgaacctgctgacaggccgcgtgaataacgaaggcacgcatttcgaactggacggcggtattgagctgccgctaaacggtggctaccgtcagtatgccgggcgtaaaatgactctcggcattcgcccggaacatattgcgctaagctcgcaggcagaaggcggcgtaccgatggtgatggacacgctggagatcctcggcgcagataacctggcgcacggacgctggggcgagcagaagctggtggtgcgactggcgcatcaggagcgcccgacggcaggcagcacgctgtggctgcatctggcggaaaatcagctgcatctttttgatggtgaaacaggacaacgagtatga

SEQ ID NO: 37377 - protein, 356 aa, Escherichia coli
MAGLKLQAVTKSWDGKTQVIKPLTLDVADGEFIVMVGPSGCGKSTLLRMVAGLERVTEGDIWINDQRVTEMEPKDRGIAMVFQNYALYPHMSVEENMAWGLKIRGMGKQQIAERVKEAARILELDGLLKRRPRELSGGQRQRVAMGRAIVRDPAVFLFDEPLSNLDAKLRVQMRLELQQLHRRLKTTSLYVTHDQVEAMTLAQRVMVMNGGVAEQIGTPVEVYEKPASLFVASFIGSPAMNLLTGRVNNEGTHFELDGGIELPLNGGYRQYAGRKMTLGIRPEHIALSSQAEGGVPMVMDTLEILGADNLAHGRWGEQKLVVRLAHQERPTAGSTLWLHLAENQLHLFDGETGQRV

SEQ ID NO: 37378 - DNA, 22 bp, Primer
atggctcagctttcgttacaac

SEQ ID NO: 37379 - DNA, 22 bp, Primer
ttaactcgtgcccccaaccgtg

SEQ ID NO: 37380 - protein, 522 aa, consensus
  MISC_FEATURE (1)..(522): consensus for the disclosure of xaa see table XV
MXXXXXXXXXKXXXXXXXXXXXXXXXXXXXXXXXXXXXXXXXXXXXXXXXXXXXXXXXEFXVXVGPSGCGKSTXLRXXAGLEXXXXGXXXIXXXXXXXXXXXXXXXPXXRXXAMVFQXYALYPHMXVXXNXXFXLXXXXXXXXXXXXXXXXXXXXXXXXXXXXXXXXXXXXXXXXXXXXXXXXXXXXXXXXXXXXXXXXXXXXVXXXAXXLXXXXXLXRXPXXLSGGQRQRVAXGRAXVRXPXXFLXDEPLSNLDAXLRXXXRXEXXXLXXXLXXXXXXXTXXYVTHDQXEAMTXXXXXXVXXXXXXXXXXXXXGXXXQXXXPXXXYXXPXXXFVAXFXGXPXMNXXXXXXXXXXXXXXXXXXXXXXXXXXXXXXXXXXXXXXXXXXXXXXXXXXXXXGXRPEXXXXXXXXXXXXXXXXXXXXXXXXXXXXXXXXXXXXXEXXGXXXXXXXXXXXXXXXXXXXXXXXXXXXXXXXXXXXXXXXXXXXXXXXXXXXXXXXXXXXXGXXXXXXXXXXXXXXXXF

SEQ ID NO: 37381 - protein, 88 aa, consensus
  MISC_FEATURE (1)..(88): consensus for the disclosure of xaa see table XV
XXXXXXXXXXXXXXXXXGXSGXXKXTXXXXXXGXXXXXXGXXXXXXXXXXXXXXXXXXXXXXRXXXXVXQXYAXXPXXXXXXNXXXXX

SEQ ID NO: 37382 - protein, 142 aa, consensus
  MISC_FEATURE (1)..(142): consensus for the disclosure of xaa see table XV
XXXXXXXXXXXXXXXXXPXXXSGGXXQRVAXXRXXXXXXXXXXXDEPLXNLDXXXRXXXRXXXXXXXXXXXXXXXXXXXXXVTHDQXEAXXXXXXXXXXXXXXXXXXXXXXXXXXXXXXPXXXXXXPXXXXXXXFXGXPXXX

SEQ ID NO: 37383 - DNA, 1728 bp, Escherichia coli
  CDS (1)..(1728)
atgcgaaataaaaatataatcatgttgcttatgagtagtttgattttgtcaggatgtgggccgcaacctgagaataaggaaagtcagcaacaacaacccagtactcccacagagcagcaagtgcttgccgcgcagcaagctgcaataaaagaggctgagcaaagcgccgccgccgcgaaagccttggcccagcaagaagtgcaacaatattcagacaaacaggctttacaggggcgattgcaggaagcgccaacatttgcaagagcggctaaagcaaaagctacacatatcgcaaatccaggaaccgctcgctaccagcagttcgatgataatccggttaagcaggtagcgcaaaatccgttggcgacgtttagtcttgacgttgacactggcagttatgcgaatgtaaggcgtttcctcaatcaagggctgttacctccgccagacgctgtgcgggtggaggagatagtcaattatttcccgtctgattgggatatcaaagacaaacaatctattccggcctctaagccaatacctttcgctatgcgctacgaattggcacctgcaccatggaatgaacagcgaacattgctgaaagttgatatcctggcgaaagatcgcaaaagtgaagagttaccagcttctaatctggtctttcttatcgacacttctggttcaatgatttctgatgaacgtttgccacttatccagtcttcgttgaaattattggtcaaagaacttcgtgagcaggataacattgccatcgtgacctacgctggcgactcccgtattgcattgccttctatctccgggagtcataaggcggaaattaatgccgcaattgattcgctggatgccgaaggcagtaccaatggcggtgccgggctggaactggcttatcagcaggcgacgaaggggtttattaagggcggcatcaatcgcattttattagccactgacggtgactttaacgttggcattgacgatccaaaatcgattgaatcaatggtcaaaaaacagcgggagtctggtgttactctgtcgacgtttggcgtggggaatagcaattacaacgaggcaatgatggtgcgaattgccgatgttggtaacggcaactacagctacattgataccctctctgaagcgcagaaagtattgaatagtgaaatgcggcagatgttgattaccgtagcaaaagatgtcaaagcgcaaattgagtttaaccccgcgtgggtaacggaataccgtcagattggttatgaaaagcgccaacttcgggtggaacattttaataacgacaacgttgatgcaggggatataggcgcaggcaaacatataacgttgttattcgaattaacgctgaacgggcaaaaagcatcaattgataagttacgctatgccccggataacaaattagcgaaatcggacaaaacgaaagaactggcctggttaaaaattcgctggaaatacccgcagggaaaagaaagtcagttagttgaattcccgctggggccaacaataaacgcgccctctgaagatatgcgttttcgcgcagcagtagctgcatatgggcaaaagttacgcggttctgaatacctgaacaatacctcctggcagcagatcaaacagtgggctcagcaggcaaaaggggaagatccacagggttacagggcggaatttattcgcctgattgaactggcggatggtgtgactgacatcagtcagtga

SEQ ID NO: 37384 - protein, 575 aa, Escherichia coli
MRNKNIIMLLMSSLILSGCGPQPENKESQQQQPSTPTEQQVLAAQQAAIKEAEQSAAAAKALAQQEVQQYSDKQALQGRLQEAPTFARAAKAKATHIANPGTARYQQFDDNPVKQVAQNPLATFSLDVDTGSYANVRRFLNQGLLPPPDAVRVEEIVNYFPSDWDIKDKQSIPASKPIPFAMRYELAPAPWNEQRTLLKVDILAKDRKSEELPASNLVFLIDTSGSMISDERLPLIQSSLKLLVKELREQDNIAIVTYAGDSRIALPSISGSHKAEINAAIDSLDAEGSTNGGAGLELAYQQATKGFIKGGINRILLATDGDFNVGIDDPKSIESMVKKQRESGVTLSTFGVGNSNYNEAMMVRIADVGNGNYSYIDTLSEAQKVLNSEMRQMLITVAKDVKAQIEFNPAWVTEYRQIGYEKRQLRVEHFNNDNVDAGDIGAGKHITLLFELTLNGQKASIDKLRYAPDNKLAKSDKTKELAWLKIRWKYPQGKESQLVEFPLGPTINAPSEDMRFRAAVAAYGQKLRGSEYLNNTSWQQIKQWAQQAKGEDPQGYRAEFIRLIELADGVTDISQ

SEQ ID NO: 37385 - DNA, 1917 bp, Mesorhizobium loti MAFF303099
  CDS (1)..(1917)
atgcaaaagaaactcattgccacgccggcccttgccgggctcgtcgccctgccgatcgccggatacgccactttccatctgctgagggaacagccggccaaattcggcggcgacgaaaagatcaccgagacgctggccgacaagccggcgacgttgaagccggccgagccgaagcaggctccgaccgaattggccaaggacaagaaggccgacgcggatgtggaaagccgcgatgcgaccaacgtgcttgtggcgccggcttcgccgccgaaatccgaagcggcccaggccggcggtactgctcagcagactgccaatgaacgcgcggtggtggccgagccggcaccgccggcgccgacaggtgaattcacgctgaatagcaccgcgccgagcacgtcgcggctcacccgcgtgccggctgccgagtccaagctgatggcgccgcagcccaccatggcgccggcggatcagatcgcgccgcaggaggaaaaccgcaaccgcgtccaggacttcaagaccaatccggtgcatgccgcgctggaagatccggtctcgaccttctcgatcgatgtcgacacggcctcctactcctttgtgcgccgttcgctgaaggaaggctccgtgccgcaggccgacacggtccgtgtcgaggagatgatcaactacttcccctatgactggaagggaccggactcggtgtcgacgccgttcaactcgaccgtcagcgtcatgccgacgccgtggaacgcgcaaaccaagctgatgcatgtcgccatcaagggcttcgacatcaagccgaccgagcagccgaaggccaatctggtcttcttgattgacgtttcgggctcgatggacgagccggacaagctgccgctgctcaaatctgcattccggctgctggtcagcaagctcagggccgacgacacgatctcgatcgtcacctatgccggtgaggccggcaccgtgctgatgccgaccagggctgccgagaaggacaagatcctcaacgcgatcgacaatctcacgcccggtggttcgacggccggcgaggccggcatcaaggaggcctacaagcttgcccagcaatccttcgtcaaggacggcgtcaaccgggtgatgctggccaccgatggcgacttcaatgtcggccagagcgacgacgatgatctcaagcgcctgatcgaacaggagcgcaagagcggcgtcttcctgtcggtgttcggcttcggccacgacaatctgaacgaccagatgatgcagaccatcgcccagaacggcaacggcaccgccgcctatatcgacacgctggccgaggccgagaaggtgctggtcgaggatgcctcctcgacgctgttcccgatcgccaaggacgtgaagatccaggtcgagttcaaccccaacaaggtctccgaataccgcctgatcggctacgagacccgggctctcaaccgcgaggatttcaacaatgaccgcgtcgatgccggcgatatcggctcgggccattcggtcaccgcgatctatgagatcaccccgaagggcagcggcggcgagcagatcgatccgctgcgctatggccaggccacggtcaacaatggcggcgtcgccaatgcggacgaatatgccttcgtcaagatccgctacaagctgcccaacgaggacgtctcgaagctgatcaccacgccggtgacctcggccaacgaggtggcgtccttcgaccaggccagcaccgaccagcgtttctccgtcgcggtggctgccttcggccagaagctgcgcgacgaggatgcgaccgcgaagttcggctacgacaagatcatggagattgccactgccgcccgaggagccgacccgtttggatacaggtccgagttcctctcgcttgtgcgccttgcctcggcgctgggcggtaaccggtag

SEQ ID NO: 37386 - protein, 638 aa, Mesorhizobium loti MAFF303099
MQKKLIATPALAGLVALPIAGYATFHLLREQPAKFGGDEKITETLADKPATLKPAEPKQAPTELAKDKKADADVESRDATNVLVAPASPPKSEAAQAGGTAQQTANERAVVAEPAPPAPTGEFTLNSTAPSTSRLTRVPAAESKLMAPQPTMAPADQIAPQEENRNRVQDFKTNPVHAALEDPVSTFSIDVDTASYSFVRRSLKEGSVPQADTVRVEEMINYFPYDWKGPDSVSTPFNSTVSVMPTPWNAQTKLMHVAIKGFDIKPTEQPKANLVFLIDVSGSMDEPDKLPLLKSAFRLLVSKLRADDTISIVTYAGEAGTVLMPTRAAEKDKILNAIDNLTPGGSTAGEAGIKEAYKLAQQSFVKDGVNRVMLATDGDFNVGQSDDDDLKRLIEQERKSGVFLSVFGFGHDNLNDQMMQTIAQNGNGTAAYIDTLAEAEKVLVEDASSTLFPIAKDVKIQVEFNPNKVSEYRLIGYETRALNREDFNNDRVDAGDIGSGHSVTAIYEITPKGSGGEQIDPLRYGQATVNNGGVANADEYAFVKIRYKLPNEDVSKLITTPVTSANEVASFDQASTDQRFSVAVAAFGQKLRDEDATAKFGYDKIMEIATAARGADPFGYRSEFLSLVRLASALGGNR

SEQ ID NO: 37387 - DNA, 1782 bp, Salmonella typhimurium LT2
  CDS (1)..(1782)
atgcttaacggaaaaacattaatgctgttgttgggtggggttattctctcgggctgtgggccggagccctccgacccgcagggaaataatccggctgagttaaaacagaagcggactatccagaaagaaaatagcgctcaggccggggatgacactgtccagaaaagacaagccgaggccgcccaacaggctgcgaaaaaagcagccgaatatgctgaagccaaagccctggcagatgccaaagcggcatctctggcaacagccgaagcaccgcaatatgtaatgcagacacgtgccgcggcaccaaaagcgttcgctgcacaaggcggtaatgtaatggggaccgcgcgttacgaacactacgatgaaaatccgattaaacaggtaagtcaggcgccgctcgccacgtttagtctggatgtagacactggcagctacgctaacgtgcggcgctttctgaatcagggacaactgccgccgccggaagccgtgcgggtagaagagatgctcaactactttcccgcccctcagcccgttgcggataagcaggataacactaaacccattgcggcctgtataccgatgccatttgcggttaaatacgaactggctccctcgccgtggaacgcgcagcgtacgctattaaaagttgatgttcaggcccgggacatgcagaccagagatctaccacctgccaacctggtttttctcattgatacttccggctctatgcagccagcggaacgcctgccgttgatccggtcggcgctaaaactgttggtgaacgatctgcgtgcgcaggataacatcacgattgtgacctacgcgggcggcactcacgtcgcgctggcgtctacagcgggaaataacacaaccgcgattaaagcggcaattgataatctggatgcttacgggagtaccggtggtgaagcgggattacgactagcctacgagcaggccgaaaaagggtttatcaaaggcggcgttaaccgcattttgttgaccaccgacggtgattttaacctcggtattaccgatcccaaagacatcgaagcgctggtaaaaaaagagcgcgagaaaggtattaccttatctacgctgggcgtcggcgatgacaatttcaacgaagccatgatggtgagaattgctgatgtgggtaacggcaattacagctacatcgactccctctctgaggcgcaaaaagtcctcaaggatgagatgcatcaaacgctggtcaccgttgccaaagatgtaaaatcgcaaatcgaatttaatccgcagtgggtgactgagtaccggcagattggttatgaaaaacgccaactgcgcgacgaggatttcaataacgataaggttgatgccggtgatatcggcgcgggtaaacacgtcacgctattctttgaactgacgcttaacgggcagaaagcctcggtggataaactgcgctacgctcagaacaaagccgcctcaaagacaacaaaatcaagcgagctggcgtggctcaaattgcgctggaaagcgccgcagggcagcgaaagtacattagccgagttcccggtcgttatgggaaagatgccgatctttgctgacgcctctgaagattttcgtttccgcgcggcggtagcggctttcgggcaaaaactgcgtggctcagaaacgctggcagatacgacctggccgcaaattattaaatggggtgaacaggcgcgcggggaagatagacaaggctatcgcgcggagtttattaaactggtaaaactggcggaaggcttgtctcactaa

SEQ ID NO: 37388 - protein, 593 aa, Salmonella typhimurium LT2
MLNGKTLMLLLGGVILSGCGPEPSDPQGNNPAELKQKRTIQKENSAQAGDDTVQKRQAEAAQQAAKKAAEYAEAKALADAKAASLATAEAPQYVMQTRAAAPKAFAAQGGNVMGTARYEHYDENPIKQVSQAPLATFSLDVDTGSYANVRRFLNQGQLPPPEAVRVEEMLNYFPAPQPVADKQDNTKPIAACIPMPFAVKYELAPSPWNAQRTLLKVDVQARDMQTRDLPPANLVFLIDTSGSMQPAERLPLIRSALKLLVNDLRAQDNITIVTYAGGTHVALASTAGNNTTAIKAAIDNLDAYGSTGGEAGLRLAYEQAEKGFIKGGVNRILLTTDGDFNLGITDPKDIEALVKKEREKGITLSTLGVGDDNFNEAMMVRIADVGNGNYSYIDSLSEAQKVLKDEMHQTLVTVAKDVKSQIEFNPQWVTEYRQIGYEKRQLRDEDFNNDKVDAGDIGAGKHVTLFFELTLNGQKASVDKLRYAQNKAASKTTKSSELAWLKLRWKAPQGSESTLAEFPVVMGKMPIFADASEDFRFRAAVAAFGQKLRGSETLADTTWPQIIKWGEQARGEDRQGYRAEFIKLVKLAEGLSH

SEQ ID NO: 37389 - DNA, 1599 bp, Streptomyces coelicolor A3(2)
  CDS (1)..(1599)
atgaaccggtacgggaccgacgggaagcgggggctgcgcggcgcgaccgcgctgctcgcgctcaccctggcgggcgggctgctgctcaccggctgcggggggacggacgacgggtcgaacggggcgaaggacaccgcggccgactcgcggggcggctcggccccgatgcccgctcccgaccgcccgcgcggcgagggcgagcagcgctacgacggcggcacgggtgcccccgggagcggcgagggggagaagaacggcgactcccgcgagatcgcgcccgaccccgaccacctctccaccttcgccctcgacgtcgacaccgcctcctacggctacgcccgccgcaccctgtccgaggggcggctgcccgacccggccacggtccgccccgaggagttcgtcaacagcttccgccaggactacgaccgcccggacggcgacggcttctcggtgaccgtggacggcgcccgcaccgacgacgaggactggtcgctggtccgcgtcggcctggccacccgccccgccgagcggcagagcgaacgcccgccggccgccctgaccttcgtcatcgacatctccggctccatgggcgaacccggccggctcgacctcgcccaggaggcgctcggcaccatgaccgaccggctgcgcgacgacgactccgtcgcgctcgtcaccttcagcgacgaggccgagaccgtcctgcccatgacccggctcggcgaccaccgcggccgcgtgcacgacgcgatcgacggcctggagccgaccgactccaccaacctcggcgcgggcatggagaccggctacgagaccgccgtcgagggccgccgcgagggcgccaccaaccgcgtcgtcctcgtctccgacgccctcgccaacaccggcgacaccgacgcggacaccatcctcgaacgcatcgccaccgagcgccgcgaacacggcatcaccctcttcggcgtcggcgtcggcagcgactacggcgacgccctgatggaacgcctcgccgacaagggcgacggccacaccacctacgtctccaccaccgaggacgcccgcgaggtcttctccgagcagctcccgcgccacatcgagctgaccgcgcgcgacgccaaggcccaggtcgccttcgacccggagaccgtcgccgagttccggctcgtcggctacgacaaccgccaggtcgccgacgaggacttccgcgacgaccgcgtcgacggcggcgaggtcggccccggccacacggtcaccgccctgtacgccgtccgcaccaggcccggcgccgacggtcacctcgccacggccaccgtccgctggctcgaccccgacagccgcaccccgcacgaggagtccggcgacgtggcgagcgacgccctcgacggctccgtctgggagtcgggccgcgggctgcgggtcacggcgaccgcggcctacttcgccgacgcgctccggtcccggggcggcgacggcggctccctgccgggcgcaccgggcctgtccgaactctccgagcgggccgacggcctggcggaccgcacggagaacgcggacctgcgtgaactggccgaggcgatcgaggaggcgaaccggctggcctga

SEQ ID NO: 37390 - protein, 532 aa, Streptomyces coelicolor A3(2)
MNRYGTDGKRGLRGATALLALTLAGGLLLTGCGGTDDGSNGAKDTAADSRGGSAPMPAPDRPRGEGEQRYDGGTGAPGSGEGEKNGDSREIAPDPDHLSTFALDVDTASYGYARRTLSEGRLPDPATVRPEEFVNSFRQDYDRPDGDGFSVTVDGARTDDEDWSLVRVGLATRPAERQSERPPAALTFVIDISGSMGEPGRLDLAQEALGTMTDRLRDDDSVALVTFSDEAETVLPMTRLGDHRGRVHDAIDGLEPTDSTNLGAGMETGYETAVEGRREGATNRVVLVSDALANTGDTDADTILERIATERREHGITLFGVGVGSDYGDALMERLADKGDGHTTYVSTTEDAREVFSEQLPRHIELTARDAKAQVAFDPETVAEFRLVGYDNRQVADEDFRDDRVDGGEVGPGHTVTALYAVRTRPGADGHLATATVRWLDPDSRTPHEESGDVASDALDGSVWESGRGLRVTATAAYFADALRSRGGDGGSLPGAPGLSELSERADGLADRTENADLRELAEAIEEANRLA

SEQ ID NO: 37391 - DNA, 1857 bp, Xanthomonas campestris pv. campestris str. ATCC 33913
  CDS (1)..(1857)
gtgcacggcgacctccggacctcttctctcgccacgcttgtttacacaagcaaaggacgttgtatgccgcgccacagccttcttgcgctcgccctgctcctgggcgcctgcagcagcaatcagcccactaccccgtcgctcactcacgacgccgccacaccacgcgaacagcagccaccagtagcggactcggccgcaaacctgccgttacccgagaccagcatggtggcgccccaggtcgaaagctccctgcgccagcgcgcacaagggaacgtgcaggcctccaagacagcctcacgcccaatgctgcctgcaccgccggtgctttccacccccgcagcccctgtcccggcggccgcactcgcagagccgatgcacatgcacgagcggctgatgccaatgccgcccagcccgcccaccgagaaccgcgagacctatcaaacgctgagcgacaacccgatcgtgcaggccgccgaacagccggtctccaccttcagcatcgacgtggataccggcagctacagcaatgtgcgccgcttcttgaatgccggcaccttgccaccggtggatgcagtgcgcgtagaagaactgatcaactatttccgctacgacgatccggccccgacggatggcacgccgttcgcggtccgcaccgaactcgctcccacgccctggaacaccgacacgctgctgctgcgcatcggcgtcgccggccgcgaagtaccaaccgccgcgttgccggccgccaacctggtgttcctggtggatgtctccggctcgatgggcgcgccagacaagttgccgctgctgcagtcatcgctcaaattgctggtgcggcaactgcggaagcaggaccgcatcaccctggtgacctacgccggcagcaccgccgtggtgttgccgcccacatccggcgcccaacaaacgcgcatcgtcgaagccatcgacagcctgcaatcgggcggcggcaccgccggtgccagtggcatcgagctggcctacaaagcggcccagcaggcgtatctgcgcggcggcatcaaccgcatcctgctggccaccgatggcgacttcaacgtgggcgtcaccgacttcgaccagctcaagggcatggtggccgaaaagcgccgttccggcgtggcactgagcacgctcggctttggcaccggcaactacaacgacacgctcatggagcaactggccgacgccggcgatggcgcctacgcctacatcgactcggcgctggaagcacgcaaggtgctcacccacgaactgggatcgacactcgccaccatcgcgcgcgacgtcaagatccaggtcgaattcaacccaggcacggtcaaggaataccgcctgatcggctatgaaaaccgtgccctgcgccgcgaggatttcaacaacgaccaggtcgacgccggcgacatcggcgctgggcacaccgtcaccgcactgtatgaaatcaccccggcacagggcgccgcctccgtcgacccgctgcgttacgccaccaccgcggcgcggcgcccgcagcctacgaccggcaacgagctggcgcacgtcaagctgcgctacaagctgccggaggcgcagcgcagccgcctgctcgataccgtggtgcgtgccaaccagcagcaagcgctggctgccaccagcgatgcgttccgcttttcggcagcggtggccggctttggtcaacggctgcgtggcggcagccagctgcacggctgggattacccgcagctgcgcgcattggcggctggcagcctgggcagcgaccggcatggctaccgcgccgatttcctgcagctgctgcagcaggcagacgcattgagcagccggccgcttgccactaacgactga

SEQ ID NO: 37392 - protein, 618 aa, Xanthomonas campestris pv. campestris str. ATCC 33913
MHGDLRTSSLATLVYTSKGRCMPRHSLLALALLLGACSSNQPTTPSLTHDAATPREQQPPVADSAANLPLPETSMVAPQVESSLRQRAQGNVQASKTASRPMLPAPPVLSTPAAPVPAAALAEPMHMHERLMPMPPSPPTENRETYQTLSDNPIVQAAEQPVSTFSIDVDTGSYSNVRRFLNAGTLPPVDAVRVEELINYFRYDDPAPTDGTPFAVRTELAPTPWNTDTLLLRIGVAGREVPTAALPAANLVFLVDVSGSMGAPDKLPLLQSSLKLLVRQLRKQDRITLVTYAGSTAVVLPPTSGAQQTRIVEAIDSLQSGGGTAGASGIELAYKAAQQAYLRGGINRILLATDGDFNVGVTDFDQLKGMVAEKRRSGVALSTLGFGTGNYNDTLMEQLADAGDGAYAYIDSALEARKVLTHELGSTLATIARDVKIQVEFNPGTVKEYRLIGYENRALRREDFNNDQVDAGDIGAGHTVTALYEITPAQGAASVDPLRYATTAARRPQPTTGNELAHVKLRYKLPEAQRSRLLDTVVRANQQQALAATSDAFRFSAAVAGFGQRLRGGSQLHGWDYPQLRALAAGSLGSDRHGYRADFLQLLQQADALSSRPLATND

SEQ ID NO: 37393 - DNA, 1866 bp, Shewanella oneidensis MR-1
  CDS (1)..(1866)
atgacacatccattacgtttattgaacacccaactcgtttccatctcctcacataaaaaacgtcacaatgcagctgtttctgccttaacactcgccattctattggggttgagtggttgtattgataaacaaactgaatcggagagtcgcactgaattagcgactcaagctaacgaggctgcagagcagcaagctgcgcttgtgcaacgtgttgaggctgaacggcaggctaaaatacaacatgaaaatgaattaagtgcaaaatcgcaggatatgcgtgctgaacatatgccttatattgctcaatatgccgctagttctagtgtagccgcccccgggttaaacgatgattggcaaggggcagtgcttcctgagcgtaatcaatttgaaaagcaagtacaaaacggcattatggtcgcgggagaaatccctgtatcgaccttttcaatcgatgttgataccggcagttataccacattaaggcgaatgctaaaggaagggcggttaccgcagaaagacacgttacgcgttgaagaaatgctgaattatttttcttataactacccacaacccaataaaaatgaggcgccatttagtgtaacaacagagcttgcaccatcaccttataatgatgacatgatgttattgcgtattggcttaaagggatatgagcagagtaaagctgagcttggggcgagtaatttagtcttcttgctggatgtctctggctctatggcgtctgatgataagttacctctgctgcaaaccgccttaaaaatgctgactcaacaactggatgaacaggataaagtatcgattgtggtctacgcgggggctgcaggcgtggtgctcgatggcgctgcaggtaacgatattaaaatccttacctatgcattggaacagttaactgcaggaggttcaaccaatggcgcagaagggatccaactggcttatcagttagcgcagaaacattttgttaaaggtggcattaaccgagtcattctcgcaaccgacggtgattttaatgttgggaccaccaacctcgatgagttagtcgacttggttgaagtacagaaaaaacatggaattggcttgacgacacttggctttggcatgggtaactacaatgaccacttaatggagcaacttgccaataaaggtaatggacaatatgcctacattgattctgtgaacgaggctcgaaaagtgctggtagaacagttaggtgcgactttgctgaccatcgtcaaagaggtaaaagtgcaagttgagtttaatcccgctttagtttcagagtaccgtcttattggttatgaaaaccgcgccttagcccgcgaggattttaataacgataaggtggacgctggggaaattggtgcgggtcataccgttaccgcgctttatgaacttcgctatgttgaaaccggtcatatggcgaatgacaaactccgttacggttataaccctgatacaggcagtgaaaaatatagccgtgacgaaattgcctatcttaaattacgttatcaactgcccgatgcgagtaaaagccaattattgacgtatccgataagagccgatcagagcgttaaaacggtaaatcaagccagtgatgattttagatttgcggcggcagttgcgggattagggcagttactgaatcaaagccactacttgcatcaatttgattataataaacttagggggcttactcgttctgcactgggggaagatacaatgggttatcgacatgagtttatgcaacttgttgatactgcagcgctgctagcgcaaacgaatcaagtccccattaagaaatcctttgatgcagagaataaaccttttccacctcaggataaacttcattag

SEQ ID NO: 37394 - protein, 621 aa, Shewanella oneidensis MR-1
MTHPLRLLNTQLVSISSHKKRHNAAVSALTLAILLGLSGCIDKQTESESRTELATQANEAAEQQAALVQRVEAERQAKIQHENELSAKSQDMRAEHMPYIAQYAASSSVAAPGLNDDWQGAVLPERNQFEKQVQNGIMVAGEIPVSTFSIDVDTGSYTTLRRMLKEGRLPQKDTLRVEEMLNYFSYNYPQPNKNEAPFSVTTELAPSPYNDDMMLLRIGLKGYEQSKAELGASNLVFLLDVSGSMASDDKLPLLQTALKMLTQQLDEQDKVSIVVYAGAAGVVLDGAAGNDIKILTYALEQLTAGGSTNGAEGIQLAYQLAQKHFVKGGINRVILATDGDFNVGTTNLDELVDLVEVQKKHGIGLTTLGFGMGNYNDHLMEQLANKGNGQYAYIDSVNEARKVLVEQLGATLLTIVKEVKVQVEFNPALVSEYRLIGYENRALAREDFNNDKVDAGEIGAGHTVTALYELRYVETGHMANDKLRYGYNPDTGSEKYSRDEIAYLKLRYQLPDASKSQLLTYPIRADQSVKTVNQASDDFRFAAAVAGLGQLLNQSHYLHQFDYNKLRGLTRSALGEDTMGYRHEFMQLVDTAALLAQTNQVPIKKSFDAENKPFPPQDKLH

SEQ ID NO: 37395 - DNA, 1743 bp, Escherichia coli CFT073
  CDS (1)..(1743)
atgcgaaataaaaatataatcatgttgcttataagtagtttgattttgtcaggatgtgggccggaacctgaggataagaaaagtcagcaacaacaatctactacacccactgaccagcaagtgcttgccgcgcaacaagcggcaacaaaagtggctgagcaaagcgccgccaaagccgctgcagacgcgaaagccttagcccagcaagaagtgcaacaatattcagacaaacaggctttgctggggcgattgcaggcggctccaaaatatcaacatgcagccagagaaaaagcagcctcccaaatcgcaaatccaggaaccgctcgctaccagcagttcgatgataatccggttaagcaggtagcgcaaaacccgttggcgacgtttagccttgacgtcgataccggcagttatgcgaatgtgcggcgtttccttaatcaagggctgttacctccgccagacgctgtgcgggtggaggagatagtcaattatttcccgtctgactgggatatcaaagacaaacaatctattccggcctctaagccaatacctttcgctatgcgctacgaattggcacctgcaccctggaatgaacagcgaacattgctgaaagttgatatcctggcgaaagatcgcaaaagtgaagagttacccgcttctaatctggtctttcttatcgacacgtctggttcaatgatttctgatgaacgtttgccacttatccagtcttcgttgaaattattggtcaaagaacttcgtgagcaggataacattgccatcgtgacctacgctggcgactctcgtattgcgttgccttctatctccggtagtcacaaggcggaaattaatgctgcaattgattcgctggatgcagaaggcagtaccaatggcggtgccgggctggagatggcttatcagcaggcagcgaaggggtttattaaaggtggtatcaatcgcattttattggccactgacggtgactttaacgttggcattgacgatccaaaatcgattgaatcaatggtcaaaaaacagcgtgagtccggtgttactctgtcgacgcttggcgtgggggatagcaattataacgaggcaatgatggtaagaattgccgatgttggtaacggcaactatagctacattgataccctctcagaggcgcagaaagtgttgaacagtgaaatgcggcagacgttgattaccgtagcaaaagatgtcaaagcgcaaattgagtttaaccccgcgtgggtaacggaataccgtcagataggttatgaaaagcgccaacttagggcagaggattttaataacgacaacgttgatgcgggtgatattggcgcaggtaaacatataacatttttatttgaattaacgctgaaagggcaaaaagcatcaattgataagttacgctatgccccggataacaaatcagcgaaatcggacaaaacaaaagaacttgcctggttaaagattcgttggaaatccccacagggaaaagaaagtcagttagttgaattcccgttggcattcgcaataaaggcaccttcagaagatatgcgttttcgcgcagcagtggctgcatatgggcaaaagttacgcggttctgaatacctgaataatacctcctggcagcagatcaaacagtgggctcagaaggcaaaaggggaagatccacagggttacagagcggaatttattcgcctgattggactggcgaaagatctggacaattcacaaaactaa

SEQ ID NO: 37396 - protein, 580 aa, Escherichia coli CFT073
MRNKNIIMLLISSLILSGCGPEPEDKKSQQQQSTTPTDQQVLAAQQAATKVAEQSAAKAAADAKALAQQEVQQYSDKQALLGRLQAAPKYQHAAREKAASQIANPGTARYQQFDDNPVKQVAQNPLATFSLDVDTGSYANVRRFLNQGLLPPPDAVRVEEIVNYFPSDWDIKDKQSIPASKPIPFAMRYELAPAPWNEQRTLLKVDILAKDRKSEELPASNLVFLIDTSGSMISDERLPLIQSSLKLLVKELREQDNIAIVTYAGDSRIALPSISGSHKAEINAAIDSLDAEGSTNGGAGLEMAYQQAAKGFIKGGINRILLATDGDFNVGIDDPKSIESMVKKQRESGVTLSTLGVGDSNYNEAMMVRIADVGNGNYSYIDTLSEAQKVLNSEMRQTLITVAKDVKAQIEFNPAWVTEYRQIGYEKRQLRAEDFNNDNVDAGDIGAGKHITFLFELTLKGQKASIDKLRYAPDNKSAKSDKTKELAWLKIRWKSPQGKESQLVEFPLAFAIKAPSEDMRFRAAVAAYGQKLRGSEYLNNTSWQQIKQWAQKAKGEDPQGYRAEFIRLIGLAKDLDNSQN

SEQ ID NO: 37397 - DNA, 1866 bp, Bacteroides thetaiotaomicron VPI-5482
  CDS (1)..(1866)
atgaagacaaatcaactcagagcaatgatgctcacggtgatgttagtgattactacattgggtggtacggtatgggcacagcctttgatcgtaaagggaacggtgacggacggatcagacggttcgccgttggtaggatgtgcggtgacggtcaagggaacatcccgtggagctgttacgaacctacaagggcagtacaggattgaagcaaacaaaggggaaactcttatcttcagctatattggttttgataaagtggaaaaagtcgtattctctgcaaagatggacgtaagtcttaaggccagttctgatgtattggaagaatgtgttgtcgtcggatacggcagccagcgaaaggtagctgttaccggtgccatatcaaccgtcaatctggcaagtctcagacacccgtccgtacgtatggatgcagtaaatacggaagaatataaatcgatcagtgaaaatggttttaagcaggtaggagaatctccgctttctactttctctattgatgtggatgccgcttcttacagtaatatgcgtcgtatgatcaacagtggtaccttgccggtgcctgatgctatccgtacagaagagttagtgaattatttctcctacgattatgcgaagccgaccggaagcgatccggtgaagataacaatggaagcaggtgtttgcccctggaatgctgatcatcgtctggtacgtatcggactgaaagcaagggaaattccgactgacaaacttccggaatctaatctggtattcttgattgatgtatccggttctatgtggggacctacccgtctggatttggtgaagtcatctctgaagctattagttaataacctgcgtgaaaaagataaagttgccatcgttgtgtatgcaggcaacgccagcgtaaaactggaatctactccgggcagtgacaaacagaaaatacgtgatgcgatagatgaactgacatccggtggctctacggccggcggagcaggtatccaactggcttataaagtggctaaacagaacttccttcctaaaggaaacaatcggatcattctttgttccgatggagatttcaatgtaggtgtttcttctgtggaaggtttggaacagttgatagaaaaggaacgtaagagcggagtattcctgagtgtgctaggttatggaatgggtaactataaagacaataaaggtcaggctttagcagaaaaagggaatggaaatcatgcttatatcgataatttgcaggaagccaatcgtgtcctggtgggtgagtttggcgctacgcttcatacggtggcaaaggacgtgaaactgcaagtggaatttaatccggctcaggtgcaggcatatcgtctggttggttatgagagccgtttgctgaaagacgaagactttaataatgacgccaaagatgccggagaattgggagccggacatacggtgacagctttctatgaagtgattcccgtaggcgtaaagaatgactacgtaggaaagatagatgatctgaaatatcagaagaaacaaaaagagacggtgcagccgaccggttctaatgaattgctgaccgtgaaactgcgctataaagctccggataaggatgtcagcaaaaagatggaagttccctttgtggataataaaggaaataatgtttcttccgatttccgtttcgcttctgctgtggctatgttcggtcagctgcttcgggactctgacttcaaaggagaggcaagctatgataaagtgatcggtcttgccaagcagggactggataatgatgaaaaaggatacagaagagaatttatccgtttggtagaaactgccaaagggatgaagcaggagaaaaccataagtgattaa

SEQ ID NO: 37398 - protein, 621 aa, Bacteroides thetaiotaomicron VPI-5482
MKTNQLRAMMLTVMLVITTLGGTVWAQPLIVKGTVTDGSDGSPLVGCAVTVKGTSRGAVTNLQGQYRIEANKGETLIFSYIGFDKVEKVVFSAKMDVSLKASSDVLEECVVVGYGSQRKVAVTGAISTVNLASLRHPSVRMDAVNTEEYKSISENGFKQVGESPLSTFSIDVDAASYSNMRRMINSGTLPVPDAIRTEELVNYFSYDYAKPTGSDPVKITMEAGVCPWNADHRLVRIGLKAREIPTDKLPESNLVFLIDVSGSMWGPTRLDLVKSSLKLLVNNLREKDKVAIVVYAGNASVKLESTPGSDKQKIRDAIDELTSGGSTAGGAGIQLAYKVAKQNFLPKGNNRIILCSDGDFNVGVSSVEGLEQLIEKERKSGVFLSVLGYGMGNYKDNKGQALAEKGNGNHAYIDNLQEANRVLVGEFGATLHTVAKDVKLQVEFNPAQVQAYRLVGYESRLLKDEDFNNDAKDAGELGAGHTVTAFYEVIPVGVKNDYVGKIDDLKYQKKQKETVQPTGSNELLTVKLRYKAPDKDVSKKMEVPFVDNKGNNVSSDFRFASAVAMFGQLLRDSDFKGEASYDKVIGLAKQGLDNDEKGYRREFIRLVETAKGMKQEKTISD

SEQ ID NO: 37399 - DNA, 2658 bp, Rhodopirellula baltica SH 1
  CDS (1)..(2658)
atgtccaattcatccacttctcctccgtgggacgaccctcgcgtcacggcattcgttctgggcgaactgcctgagaacgaagccgctcagttcaccgaagagatgaacgccaaccctgaactcgccaccgccgttgaagaagctcgcgcggtcaccgagcaagtcgagtcgttcttccactccgccgcggtcccaccactggaatccaaccgagtcgaaagcatcgtccgcgaaagcgaaacggttccagcggcagacgagaaggctgcgacgggtttgactgctggcactgcttggtaccaagcgaaatgggttcagtgggcagtcgcggccagcgtcgttggaatccttgttggactttcgatcccaacgatccagagttcacgagaaacagccttcaatcaccaaccatcaacaggcgatatcgccaccgatcaatcgggtcccgaattttcggacacgatggtgatggatgaagagatgcaactcgaagatgtcgagatggtttaccaatcattcgacggttccgctgccaaatcaatgccaacggaaacgaaggccgagggcgagtcctttggcttgcaagcagccagccgagtctcaggaatatcgcctgccgccgaagccacttcatcggatgcgagcccacgaaccattgccgagtcctcgctttcttcggcgaacgagcgagccgtaaggtcgagacgagccaagcgagctgaggacccagcgatggacatgggaatggactccatgacgatgggcggcatggctatggagatggacatggacatgcagatggctggcccggcaatggacgacatgggcatgggaatgatgggcggaggaatgggcggtgcgtcggtcgacagcagcgtgactcctcgcttcgctcgcgaagacggctcattgtctgccaattcccccctttcgtttactgccccgaaagacgaggcgccaaccgccccccgcgaaccctcagctggaaaaccagtggtgggcgactttgcagtggctcccgttccggaacagcttgggcgtcagcaatttgacttccgtgcttcgcggggacgtacgctcgaacgccaactgggagaaaccgaggaactggcaccgacatcagaccgactggccatcttgccacccacacccgatggcgaaggccaggggcctggcatgtcaggtgacaaattcgaaccgatccaagaaaacgaattccgacgcgtcgccgatgatgcgctcagcacgttttccatcgacgttgacaccgccagctacgcgaaagtccgcagctacctgcaacgaggccaactgccacgtcccgactcggttcgcatcgaagaactgatcaactatttcgattaccagtacacgcccccatcggctgaagatcccgttccgttctcttccgcaatggcggtcgcctcctgcccatggaatgaaaacaatcggttggtgcgagttggcatccaagccaaagacatcgaccgcaaagaacgcccgcgttgcaacttggtgttcttgatcgacaccagcggatcgatgaagcgtcccaataaactgccgttggtcatcgaaggcatgaaggtgctgctcgaccaactgaaaaacagagatcgtgtggcgatcgtggtctacgcgggctcttcgggattggtgctggactcgaccccggtcaagcaaaagaagaagatcattcgcgccctgtcagctctctcggccggtggcagcaccaacggtggtgccggtttgcaactcgcttaccaaaccgcccgagaaaacttcatcgaggacggcgtgaaccgagtcatcctgtgcagcgatggcgacttcaatgtcggaatgacgggcaccgatcaattggttgccgaagcgactcgccaatccaaatcgggcaccgagttgaccgtgctgggtttcggaatgggtaaccacaacgacgccatgatggaacgcatctccaactccggcgcaggcaactacgctttcgtcgacaccatcgccgaagccaaaaaggtcctcgcggatcaggtcgccggaacgctgttcacggtcgccaaagacgtgaagatccaaatcgagttcaatcccgcggtcgtctcggcctaccgattgattggttacgaaaaccgggtcttggcaaaggaagacttcaacgacgacaaggtcgacgctggtgaaattggagccgggcaccgcgtgacggctctgtacgagatcgctccggtcggcaagcttcccgattccattgcacccgatgtcgatccactgaagtatcaacccagtggcgaggaaaatcccgattctcaggaggcaaacgaacctcgagttcccaaggactctgacgagtcagcgacaaaggaaattctgacgctgaagattcgtcacaagccaccgcaaggcgacgtcagcgagaagctcgcatttccgctggtcaacgaaagcgtgcccttccaggaagccgacaccgacttccaattcgccgtggcggtcgccgttttcgggatgcaacttcgcaacagcacccacgctggaacatggacgatggacgacgtgatcgccaccgcgacgaatgccaagggcgatgacgaacacggcctccgagctgagttcctggaactggcacgaacagcggaacgattgatcgtcaacgactga

SEQ ID NO: 37400 - protein, 885 aa, Rhodopirellula baltica SH 1
MSNSSTSPPWDDPRVTAFVLGELPENEAAQFTEEMNANPELATAVEEARAVTEQVESFFHSAAVPPLESNRVESIVRESETVPAADEKAATGLTAGTAWYQAKWVQWAVAASVVGILVGLSIPTIQSSRETAFNHQPSTGDIATDQSGPEFSDTMVMDEEMQLEDVEMVYQSFDGSAAKSMPTETKAEGESFGLQAASRVSGISPAAEATSSDASPRTIAESSLSSANERAVRSRRAKRAEDPAMDMGMDSMTMGGMAMEMDMDMQMAGPAMDDMGMGMMGGGMGGASVDSSVTPRFAREDGSLSANSPLSFTAPKDEAPTAPREPSAGKPVVGDFAVAPVPEQLGRQQFDFRASRGRTLERQLGETEELAPTSDRLAILPPTPDGEGQGPGMSGDKFEPIQENEFRRVADDALSTFSIDVDTASYAKVRSYLQRGQLPRPDSVRIEELINYFDYQYTPPSAEDPVPFSSAMAVASCPWNENNRLVRVGIQAKDIDRKERPRCNLVFLIDTSGSMKRPNKLPLVIEGMKVLLDQLKNRDRVAIVVYAGSSGLVLDSTPVKQKKKIIRALSALSAGGSTNGGAGLQLAYQTARENFIEDGVNRVILCSDGDFNVGMTGTDQLVAEATRQSKSGTELTVLGFGMGNHNDAMMERISNSGAGNYAFVDTIAEAKKVLADQVAGTLFTVAKDVKIQIEFNPAVVSAYRLIGYENRVLAKEDFNDDKVDAGEIGAGHRVTALYEIAPVGKLPDSIAPDVDPLKYQPSGEENPDSQEANEPRVPKDSDESATKEILTLKIRHKPPQGDVSEKLAFPLVNESVPFQEADTDFQFAVAVAVFGMQLRNSTHAGTWTMDDVIATATNAKGDDEHGLRAEFLELARTAERLIVND

SEQ ID NO: 37401 - DNA, 1716 bp, Bordetella bronchiseptica RB50
  CDS (1)..(1716)
atgacgccgatcctacgcccctcccccctgctgtgcacggtgctcagcctggccatgctgagcgcctgcagcccgaccgaaccgccttcggccggcgtggccggccagcccgccgccgtaccgggccagccggcgccccaggccgtgccggcggcgccgcgcggcgaaccggccggcgcgccgcagcgcgaactggcggcgcaaacctatatgcccccggcgccgcacgcggcggcccgggcgcatgccgaccaggcgcgcatgcggatcatgccggcgcccatgcccgtcatccaggaagatcgcgaaaactatgccggctaccaggacaatcctgtccagctggcacaggagcagccggtctccaccttcgggctggacgtggataccggctcgtacagcaatgtgcgccgcctgctcaacgatggccgcctgccgccggccgacgccgtgcgcgccgaagcattcatcaattacttcgactacggctacccggcccccgccacgccggccgtccccttttccctcacgaccgagatcgcgccggcgccctggaatgcgcagcgccagctgctgctggtcggcatccagggataccgggtggcgccgcaggatattcccgcggtcaacctggtgctgctgatcgacacctccggctcgatggccgaccgggccaagctgccgctgctcaaatcggccctgcgccagctggtgacgcagatgcgcgcgcaggaccgcgtcgccatcgtcgcctacgccggcagcgccggcctggtgctgccctccacgcccggcgatcgccatgcgcagatcctggcggccatcgacggcctgcaggccagcggctcgaccaatggcggcgccggcctggagctggcctacgccgaggccgccaagggcctggtcaaggatggcgtcaaccgcatcgtgctggccagcgacggcgacttcaacgtcggccgcaccgatcttgcgcagctcaaggactatgtcggcagccagcgcaagcgcggcatcgcgctgaccaccctggggctgggcagcggcaactacaacgatgccatggccatgcagctggccaacgccggcgacggcagctatcactacatcgacagcctgctgcaggcgcgcaaggtctttgccagcgagctgtcggcgaccctgctgaccatcgccaaggacgtcaaggtgcaggtcgaattcaacccggcgcgggtggccgagtaccgcctgatcggctacgagaagcgcgccctggcgcgggaggacttcaacaatgacgcggtcgacgcgggcgaactgggcgccggcgccaacgtaacggcgctgtacgagatcacgccggcgggcgcagcgcagcgcatcgatgcgctgcgttacggacagccggcccgcgccgcggacagcccgcgcgacgagctggcctatgtgcgcatccgctaccagtcgcccgaaggcggcgccagccgcctgatcgaacaaccggtggccgccgaggcggcggcgccggccgccagcgcgcgcctgaatcgcgcggcggccgcggcggccttcgcgcaatggctgcgcggcggcaaatacctggacggctacgcgccgcaggccatcgcggcgctggcgcggcaatcgcgcggcgccgacccgctgggcctgcaggccgagttcgccaacctggtcgagctggccgccagcctgggcacgccggcggcgcgctga

SEQ ID NO: 37402 - protein, 571 aa, Bordetella bronchiseptica RB50
MTPILRPSPLLCTVLSLAMLSACSPTEPPSAGVAGQPAAVPGQPAPQAVPAAPRGEPAGAPQRELAAQTYMPPAPHAAARAHADQARMRIMPAPMPVIQEDRENYAGYQDNPVQLAQEQPVSTFGLDVDTGSYSNVRRLLNDGRLPPADAVRAEAFINYFDYGYPAPATPAVPFSLTTEIAPAPWNAQRQLLLVGIQGYRVAPQDIPAVNLVLLIDTSGSMADRAKLPLLKSALRQLVTQMRAQDRVAIVAYAGSAGLVLPSTPGDRHAQILAAIDGLQASGSTNGGAGLELAYAEAAKGLVKDGVNRIVLASDGDFNVGRTDLAQLKDYVGSQRKRGIALTTLGLGSGNYNDAMAMQLANAGDGSYHYIDSLLQARKVFASELSATLLTIAKDVKVQVEFNPARVAEYRLIGYEKRALAREDFNNDAVDAGELGAGANVTALYEITPAGAAQRIDALRYGQPARAADSPRDELAYVRIRYQSPEGGASRLIEQPVAAEAAAPAASARLNRAAAAAAFAQWLRGGKYLDGYAPQAIAALARQSRGADPLGLQAEFANLVELAASLGTPAAR

SEQ ID NO: 37403 - DNA, 1833 bp, Bacteroides fragilis YCH46
  CDS (1)..(1833)
atgaaaacaaatcaattcagagcgatggtgctcgcactgctaatggcagttatctctttggctacagtgagtgcacaagctattactgtgtcgggtactgtaacagatgcaaaagatggaactccgcttgtcggctgttcggtacagataaagggtactacgaaaggtacggtgacgaacatgaacggtcaatacacgattcagtctaagaagggagagacgttgttgtttcagtatatcggctataagcaagagaaaagggtggtaaaatcgtccacgctggatgtgaagatgaaagctgacgaacttgtattggaagaatgtgtggttgtaggatacggacacgaactaagggccactaaatcaatgtctactgcttatatggcagtatgtcccgcatcgggaatcatgtataatgctgtaaatgcggaagaatatggcgagattcaggaaaatggtttcaagaatgtgtcggatgctccactttctactttttctattgacgtggatgccgcttcttacagcaatatgcgtcgttttatcaataaaggtaaactgcctccagtcgatgcaatccgtacggaagaattagtgaactacttttcctatgattatccgaaaccgacgggaagtgatcctgtgaagattacgatggaagccggaacctgcccttggaacgcagatcaccgtcttgtccgtatcggactgaaggctaaagaaatcccgacggacaatctgcctgcatccaatcttgtctttctgatcgacgtctctggctctatgtggggagcgaaccggttggatttagtgaaatcctctcttaaactattggtaaacaacttacgtgataaagataaagtagctatcgtgacttatgcaggcaatgccggagagaagctggcttctacaccgggcagtgacaaacaaaagatacgtgaagccattgacgagctggaagcaagtggttctaccgcaggaggtgaagggatcatgctggcttataaaatagcccaaaagaactttatatcaggaggcaacaatcgtattatactctgcaccgatggtgatttcaatgtgggcgtatcatcggacaaggaacttgaaaagctgattgaacaaaagcgtaaaagcggtatattcctcaccgtattgggatacggaatgggcaactacaaagacagcaagatgcagaccctctccgaaaaaggcaacggaaaccatgcctacatcgataacttacaagaagccaaccgggtattggtaaacgaattcggagcaactttacacactgttgccaaagacgtaaagttacaggtagagttcaatccggcacaagtgcaggcctaccgactgataggttacgagagccgtttgcttgcagacgaggattttaataacgatacaaaagatgccggagaaatgggagccggacatacagtgacagctttctatgaagtaattcccacgggagtaaagagtgattttgcaggaaaaatagacgatctcaaatatcagaaaaaacaaaaaccatctacgcctctcaatgaatctgacgagttattaaccattaagctacgttacaaagctccggacagtaacaccagcaagaagatagaattgccgttgattgaccataaaagcaaccgggtctctgccgatttccgctttgcagccgcagtagccatgttcggacaactactgagagactcggaattcaaaggaaacgccacttatgacaaagtgatctctttggcaaaaaccggattagaaaatgatgaaaaagggtacaaaagagaattcatacggcttgcagaaactgccaaaagtctctga

SEQ ID NO: 37404 - protein, 610 aa, Bacteroides fragilis YCH46
MKTNQFRAMVLALLMAVISLATVSAQAITVSGTVTDAKDGTPLVGCSVQIKGTTKGTVTNMNGQYTIQSKKGETLLFQYIGYKQEKRVVKSSTLDVKMKADELVLEECVVVGYGHELRATKSMSTAYMAVCPASGIMYNAVNAEEYGEIQENGFKNVSDAPLSTFSIDVDAASYSNMRRFINKGKLPPVDAIRTEELVNYFSYDYPKPTGSDPVKITMEAGTCPWNADHRLVRIGLKAKEIPTDNLPASNLVFLIDVSGSMWGANRLDLVKSSLKLLVNNLRDKDKVAIVTYAGNAGEKLASTPGSDKQKIREAIDELEASGSTAGGEGIMLAYKIAQKNFISGGNNRIILCTDGDFNVGVSSDKELEKLIEQKRKSGIFLTVLGYGMGNYKDSKMQTLSEKGNGNHAYIDNLQEANRVLVNEFGATLHTVAKDVKLQVEFNPAQVQAYRLIGYESRLLADEDFNNDTKDAGEMGAGHTVTAFYEVIPTGVKSDFAGKIDDLKYQKKQKPSTPLNESDELLTIKLRYKAPDSNTSKKIELPLIDHKSNRVSADFRFAAAVAMFGQLLRDSEFKGNATYDKVISLAKTGLENDEKGYKREFIRLAETAKSL

SEQ ID NO: 37405 - DNA, 1956 bp, Rhodobacter sphaeroides 2.4.1
  CDS (1)..(1956)
atgagcgacgaccgcaccgacgacgatctcgaggctctgcgccgggcactcgcgcgcgaggcggctccagcgcccgatcccgaggcacgggcgcgcgccatggcgctggcgctcgagaattacgacaggttccaaggacgggcgagcgggctgcgtcaggggaaggaccgcccggccggggcggggttcctcaacggagtgcgccgcatgtcgggttccttcttctcccgcccccttctcgccgccaccggatcggtcgcggctctgggcctcgccctcgtcgtggtgatgccgaacgcgcggctggccgagccgccgcagaccgcgccggacgcgcccgaggcggatgcccgcctcgccgccgcgccggacgcgggtggcggggccgagacggccggtgcgccggttcccgcggaaccgcgggcacggagcgccgagggcgccgccccgcagaccttcgccgccgacgaagcgatgcccatggctgcgccgcccgcgccggatctcgccctctcgaagcaggccgccgaagcccccgcgcgcgcccttccgcagggcgacagcgaggccttcgcgaatgcgcccgacaatccgctccgcgtgaccgccgaggatcccgtctcgaccttctcgatcgacgtggatacggcaagctacgcgatcctccgctcgagcctgcgggccgggcagcttcccccgcgcgaggcggtgcggatcgaggagatgatcaactacttcccgtacgattacccggcgccggagaacggaacgccgcccttccgccccaccctctccgtcacccggacgccctggaacccggagacgcagctcgtccatgtggcgctgcagggccggatgcccgccatcgaggaccggccgccgctgaacctcgtcttcctgatcgacacgtcgggctcgatgcaggatccggcgaagctgccgctcctcaagcagtcgttcgggctgatgctcggccgcctgcgccccgaggatcaggtggccatcgtgacctatgccggctcggcgggcgaggtgctggcgcccacggccgcgaaccagcgcagcaccatcctctccgccctcgaccggctcgatgccggcggatcgaccgcgggagaggaggggctggcgctcgcctaccggacggcctcggaaatggcgggcgcgggcgaggtcacgcgcgtggtgctggccaccgacggagacttcaacctcgggatcagcgacccggaagagctggcccgcctcgtggcgcacgagcgcgacaccggcatctatctctcggtgctgggcttcgggcgcggcaatctcgacgatgcgacgatgcaggcgctggcgcagaacggcaacgggcaggccgcctatatcgacagtctgaacgaggcgcagaaggttctggtcgaccagctcagcggcgcgctctttcccattgccgacgatgtgaaggtgcaggtggagtggaacccggcccgcgtcgcggaataccggctcatcggctacgagacccgcggcctgcgccgcgaggatttcgccaacgaccgggtcgatgcgggcgagatcggcgccggccatgcggtgacggcgatctacgagatcacgccggtggacagccccgcgcgcctgaccgatcccctgcgctacggcgccgaaccgcccgagggcgcgcatggcgacgaactgggcttcctgcggctgcgctacaaggcgccgggcgagagcacatcgaccctgatcgacacgccgatcccggacatgctgaccgaggcctccgaggacgtgcgcttctccaccgccatcgcgggcttcggcgagcttctgcgcgggtcggacaagctcggcgcctggggctgggacgaggccatcgccttggccgacggggcgcgcggggccgatcccttcggctaccgggtagaggccgtccagctgatgcgcctggccgagagcctcagccgctga

SEQ ID NO: 37406 - protein, 651 aa, Rhodobacter sphaeroides 2.4.1
MSDDRTDDDLEALRRALAREAAPAPDPEARARAMALALENYDRFQGRASGLRQGKDRPAGAGFLNGVRRMSGSFFSRPLLAATGSVAALGLALVVVMPNARLAEPPQTAPDAPEADARLAAAPDAGGGAETAGAPVPAEPRARSAEGAAPQTFAADEAMPMAAPPAPDLALSKQAAEAPARALPQGDSEAFANAPDNPLRVTAEDPVSTFSIDVDTASYAILRSSLRAGQLPPREAVRIEEMINYFPYDYPAPENGTPPFRPTLSVTRTPWNPETQLVHVALQGRMPAIEDRPPLNLVFLIDTSGSMQDPAKLPLLKQSFGLMLGRLRPEDQVAIVTYAGSAGEVLAPTAANQRSTILSALDRLDAGGSTAGEEGLALAYRTASEMAGAGEVTRVVLATDGDFNLGISDPEELARLVAHERDTGIYLSVLGFGRGNLDDATMQALAQNGNGQAAYIDSLNEAQKVLVDQLSGALFPIADDVKVQVEWNPARVAEYRLIGYETRGLRREDFANDRVDAGEIGAGHAVTAIYEITPVDSPARLTDPLRYGAEPPEGAHGDELGFLRLRYKAPGESTSTLIDTPIPDMLTEASEDVRFSTAIAGFGELLRGSDKLGAWGWDEAIALADGARGADPFGYRVEAVQLMRLAESLSR

SEQ ID NO: 37407 - DNA, 1650 bp, Pseudomonas fluorescens PfO-1
  CDS (1)..(1650)
atgttgctggtggttgccggttgcggcgtttcctccagcccggaaaccaccgtcgcgccgcctccggcgcagactgaactgaagtcctccgtgcagcccgaagcggtcatggccgatagcgcgatggccaagcgcagtgcactgacggctccgatcgccagttttgcaccgatgccggccggtgaaagttatccacagggctatcgcgacgaacagcgcgagcagtacgccaagctggccgacaatccgatccacagcgtcaccgaaaccccggtctcgacctttagcgccgatgtcgacaccggcgcctacgccaatgtgcggcgcctgctcaatcagggtcgactgccgccggaaggcgcggtgcggctggaggagatggtcaattactttccttacgactacgcgttgccgagcgatggctcgcccttcggcgtgaccaccgaactggctgcttcaccgtggaacccgcacacccgcttgctgcgtatcggcatcaaagcgtccgaccgtgcggtggcggaactggccccggcgaatctggtatttctggtggatgtgtccggctcgatggaccgccgcgaaggcttgccacttgtcaaaagcaccctgaaattgctggtcgatcaattacgcgaacaggatcgggtatcgctggtggtgtatgccggtgaatccagcgtggtgctggagccgacttccggacgggaaaaggcgaaaattcgcacagccatcgagcgattgaccgccggtggctcgactgctggtgcgtcaggcatcgaactggcttatcagatggcgcagcaggcgttcatccccaaaggcatcaaccgcatcctgttggccaccgacggtgacttcaacgtcggcaccagcgacttcgatagcctgaaacaaatggctgtggataaacgcaagaccgggatttctctgaccaccctgggtttcggtgtggataactacaatgaacatctgatggaacaactggccgatgccggtgacggcaactacgcctacatcgacaacctgcgcgaagcgcgcaaggtgctggtggatcaactcggttcgaccctcgccgtggtggcgaaaaacgtcaagttgcaggtcgagttcaacccggcgcaggtcagcgaataccggctgctcggctacgaaaatcgcgcgttgaagcgtgaggatttcagcaatgacaaggttgatgccggtgaaatcggtgcaggccatacggtgacggcgttgtatgaaattgtcccgacaggcgagaagggctggctggaaccgctgcgttacggaaaaaccgatgcagtggtttccgagaagagaggagaattggcaatgctgcgcgtgcgatatcaaaagcctgagggtgggaaaagtctgctgatcgagcggccgattgccagtcaggttgcaccagccagtgaagacctgcgctttgctgccgccgtcgctgcgttttcccagcaactcaaggacggccgctacaccggcgatttcagcctcaaggacaccgaagccctggcccgcggtgcccgcggcgatgaccgcttcggcttgcgcaacgagttcgtgcaactggtggaactggcgcagagcctgcgtacctccaccgcctccaacggaatgtccactgagcgacggattgaatag

SEQ ID NO: 37408 - protein, 549 aa, Pseudomonas fluorescens PfO-1
MLLVVAGCGVSSSPETTVAPPPAQTELKSSVQPEAVMADSAMAKRSALTAPIASFAPMPAGESYPQGYRDEQREQYAKLADNPIHSVTETPVSTFSADVDTGAYANVRRLLNQGRLPPEGAVRLEEMVNYFPYDYALPSDGSPFGVTTELAASPWNPHTRLLRIGIKASDRAVAELAPANLVFLVDVSGSMDRREGLPLVKSTLKLLVDQLREQDRVSLVVYAGESSVVLEPTSGREKAKIRTAIERLTAGGSTAGASGIELAYQMAQQAFIPKGINRILLATDGDFNVGTSDFDSLKQMAVDKRKTGISLTTLGFGVDNYNEHLMEQLADAGDGNYAYIDNLREARKVLVDQLGSTLAVVAKNVKLQVEFNPAQVSEYRLLGYENRALKREDFSNDKVDAGEIGAGHTVTALYEIVPTGEKGWLEPLRYGKTDAVVSEKRGELAMLRVRYQKPEGGKSLLIERPIASQVAPASEDLRFAAAVAAFSQQLKDGRYTGDFSLKDTEALARGARGDDRFGLRNEFVQLVELAQSLRTSTASNGMSTERRIE

SEQ ID NO: 37409 - DNA, 1617 bp, Clostridium thermocellum ATCC 27405
  CDS (1)..(1617)
atgaaaatgaatattgtttcaaaatacagaagtaatgtattatggcttttgattccgttttttttaatggcggtgttgttttcttcctgcagcagttctgtcaacaaaggtttaaattcatcattaatggttgagaattcacatttggaaaaaggtaccggatattatgacataattgacatggatattaatattggtgacgatgatacctatagtttggaatataataccgaagactataatgttattgaggaaaatatatttcttgatacctacaacaatcccctttcaacattttctgtggacgtggatacggcatcctacagcaatataaggcgttttctcaattcttcgcaaaaacctcctgtggatgccgtaagaattgaagaaatgattaactattttacatatgactatcctgatgccgacggcgatgaaccgttcagcataaccaccgagattggacagtgcccgtggaatccggaaaacaagcttatgcttgtaggacttcagacaaaaaagctctccacggaacagctgcctccaagcaacctggtttttctgatagatgtttcgggttcaatggatgaacctaacaaacttccccttttaaaatcagcttttaagcttcttgtggacgaactggacgaagatgacagagtgtctattgtagtttatgcgggtgcggcaggtttggttttggattcgactccgggaaatgaaaaggacaaaattcttgacgctctgatgaatcttgaagccggaggctcgacggcaggagccgaaggaataaaacttgcctatgacgttgctaagaaaaactttattaagtcaggcaacaatcgtgttattctggcaacggacggagattttaatgttggtataagcagcgaggctgagcttgtcaggctgattgagaaaaaaagagatgaaggtatattccttacagtgcttggttttggaacgggcaattacaaggattcaaagatggaaagccttgcagacaaaggaaacggaaactatgcctacatagacaatattgcggaagccaggaaagttcttgtaaatgaaatgggtgcaactttaaacacggttgcaaaggatgtaaaaattcaggttgaattcaatcccgcaaaggtaaaggcttacaggctgattgggtatgaaaacaggcttcttagaaatgaggattttaacaacgattcggtggacgcgggagaaataggtgcgggacactcggtaaccgcactttatgagattgtttctgcgaatttggattttgaggtttcgaaagttgacgagctcaagtatcaaaaatctcagcttgtagaaagcgatgaaattgccactgtgaaggtaagatataaaaagcctgactcggatacaagtgaactgctttcagaaactgtgttggaaaaagcagaagaaaatacatcaaaaaacctggaatttgcggcagctgtggcagaattcggcatgttgctcagagaatcaaagtataaaggcaattcttcttatgatcatgttttagaggtggcaaagcaatatgctgacggtgacgacggatacaggagtgaatttgtaaagctggtggaaaaagcggaaagtattaattga

SEQ ID NO: 37410 - protein, 538 aa, Clostridium thermocellum ATCC 27405
MKMNIVSKYRSNVLWLLIPFFLMAVLFSSCSSSVNKGLNSSLMVENSHLEKGTGYYDIIDMDINIGDDDTYSLEYNTEDYNVIEENIFLDTYNNPLSTFSVDVDTASYSNIRRFLNSSQKPPVDAVRIEEMINYFTYDYPDADGDEPFSITTEIGQCPWNPENKLMLVGLQTKKLSTEQLPPSNLVFLIDVSGSMDEPNKLPLLKSAFKLLVDELDEDDRVSIVVYAGAAGLVLDSTPGNEKDKILDALMNLEAGGSTAGAEGIKLAYDVAKKNFIKSGNNRVILATDGDFNVGISSEAELVRLIEKKRDEGIFLTVLGFGTGNYKDSKMESLADKGNGNYAYIDNIAEARKVLVNEMGATLNTVAKDVKIQVEFNPAKVKAYRLIGYENRLLRNEDFNNDSVDAGEIGAGHSVTALYEIVSANLDFEVSKVDELKYQKSQLVESDEIATVKVRYKKPDSDTSELLSETVLEKAEENTSKNLEFAAAVAEFGMLLRESKYKGNSSYDHVLEVAKQYADGDDGYRSEFVKLVEKAESIN

SEQ ID NO: 37411 - DNA, 2127 bp, Microbulbifer degradans 2-40
  CDS (1)..(2127)
atgactgattttgaaaaagacctaaatcaattcgacccgcccgcgcccagcccacaggccaagcgccgcgctataagcgctgctatgcaagcttttgaaactgcccagagcagctctcaaactgcccagagcaacttggaaacagcccagagcgcgtcgcaaacggctgcgccagaaacggcgcaaactaaaaaaagtaaaattaattcacctttgctccaaggattattgttttggcgtcgtcctaccgacaaacaaaacaacaggagcaatattatgtcgcgattaacccagcgcagttttaccatgggcttagcatcagcctgtgtacttaccttcggtttggtacttgtatttccgctattttggcagcgtagcgacgagcaaataattgtagataatagcgtgcaagtaccatcggttacgataaaagagaaagccgaaaccaaaatagccgacgttgcagagtctgagatggctgtgccgccctccgcggcgttggaagaagttgtggtaacaggtatgcgcagctcggctgcagaatctgcaaaactaagtaaaaagcctgccgctagccagaggcaggtgagcgctattcgcgcgcaagacattggtgccttaccggatcagtctaatgcagtagcactccagcgtattgctggtatgccagtggatggcgacacaattgtcgcacctgcgccacaaggcaatgacaaatttgagcacgtagaagaaaacagcgtaaaaagtgttgctgaagcacctgtttctactttttctatcgatgtagatacagcctcttactcgtttgtgcgccgccaacttaacagcggctatttgccagaaaaagatgcgattcgcgcagaagaattaatcaattattttgattacaactacccattgcctagcgatagtactgcaccgttcaagccaaacattaccgttatagattcgccttgggcgaagggcaaaaaacttgtgcatattggccttaaaggttacgacattgcacccgaccaaaagccgcgcaccaacctcgtgtttttattggatgtgtctggctctatgaattcgcaagataaactgcccttagtaaagcaatctatggagatgttgctatctacccttaaccccgacgacaccgtagccattgttgtttatgcgggggcagctggtacggtgcttgaaccaacacccgcgaaagataaacaaaaaatactgtctgccatgcaacgcctgcaagcggggggctctacagcgggtggcgctggcatagcgctggcctacgacttagcagaagctaactttgataaaaaagccgttaaccgagtaattttagctaccgatggtgattttaatgttggctcaaccaataacgaaacgttgcagggctttgtagagcgcaagcgcgaaaaaggcatatttttaagcgtgttaggttttggccaaggcaattataacgatcacttaatgcaaaccttggcgcaaaatggcaacggcgtagctgcgtatatagataccgtaagcgaagcgcaaaaagtgttggtgcaagaagcgtcttcgtcgctgtttcctattgccaaagatgtaaaaattcaagtggagtttaaccccgccaccgtggccgaataccgtttaataggctacgaaacgcgcgcattaaaccgcgaagattttaacaacgacgccgtagacgccggtgatataggcgcaggccataccgtaaccgcaatttacgagataaccccagtgggctcgtcagcagtattaattgatgaatcgcgctatgcacaaaaagaaaaagccaaagcgccgaccaatgctgagtacggtttctttaaattgcgctacaagctacccagcgaagatacctcgcgtttaatcgaggcgcccatcctgcaacagcaaccgctagtacccgccgaacttatgcaagaggttaatttttcggtagctgtagccgcctatgcgcaaaaactaaagggcagtaactttttaaacaaatacagctaccacgacatcattgctcttgcacaagccagcaaaggcagcgatgaatatggctacagaacagaatttgtacagctggtgcgcaaagcagaactagcagacgacctactacgctaa

SEQ ID NO: 37412 - protein, 708 aa, Microbulbifer degradans 2-40
MTDFEKDLNQFDPPAPSPQAKRRAISAAMQAFETAQSSSQTAQSNLETAQSASQTAAPETAQTKKSKINSPLLQGLLFWRRPTDKQNNRSNIMSRLTQRSFTMGLASACVLTFGLVLVFPLFWQRSDEQIIVDNSVQVPSVTIKEKAETKIADVAESEMAVPPSAALEEVVVTGMRSSAAESAKLSKKPAASQRQVSAIRAQDIGALPDQSNAVALQRIAGMPVDGDTIVAPAPQGNDKFEHVEENSVKSVAEAPVSTFSIDVDTASYSFVRRQLNSGYLPEKDAIRAEELINYFDYNYPLPSDSTAPFKPNITVIDSPWAKGKKLVHIGLKGYDIAPDQKPRTNLVFLLDVSGSMNSQDKLPLVKQSMEMLLSTLNPDDTVAIVVYAGAAGTVLEPTPAKDKQKILSAMQRLQAGGSTAGGAGIALAYDLAEANFDKKAVNRVILATDGDFNVGSTNNETLQGFVERKREKGIFLSVLGFGQGNYNDHLMQTLAQNGNGVAAYIDTVSEAQKVLVQEASSSLFPIAKDVKIQVEFNPATVAEYRLIGYETRALNREDFNNDAVDAGDIGAGHTVTAIYEITPVGSSAVLIDESRYAQKEKAKAPTNAEYGFFKLRYKLPSEDTSRLIEAPILQQQPLVPAELMQEVNFSVAVAAYAQKLKGSNFLNKYSYHDIIALAQASKGSDEYGYRTEFVQLVRKAELADDLLR

SEQ ID NO: 37413 - DNA, 28 bp, Primer
atgcgaaataaaaatataatcatgttgc

SEQ ID NO: 37414 - DNA, 25 bp, Primer
ttactgactgatgtcagtcacacca

SEQ ID NO: 37415 - protein, 487 aa, consensus
  MISC_FEATURE (1)..(487): consensus for the disclosure of xaa see table XV
NXXXXXXXXPXSTFSXDVDTXSYXXXRRXLXXGXLPXXXXXRXEEXXNYFXXXXXXXXXXXXXXXXXXXXXXPFXXXXXXXXXPWNXXXXLXXXXXXXXXXXXXXXPXXNLVFLXDXSGSMXXXXXLPLXXXXXXXLXXXLXXXDXXXIVXYAGXXXXXLXXTXXXXXXXXIXXAXXXLXXXGSTXGXXGXXLAYXXAXXXXXXXGXNRXXLXXDGDFNVGXXXXXXXXXXXXXXRXXGXXLXXLGXGXXNXXXXXMXXXAXXGXGXXXYIDXXXEAXKVLXXXXXXXLXXXAKDVKXQXEFNPXXVXXYRLIGYEXRXLXXEDFNNDXVDAGXXGAGXXVTAXYEXXXXXXXXXXXXXXXDXLXYXXXXXXXXXXXXXXXXXXXXXXXXXXXXEXXXXXXRXXXPXXXXSXXXXXPXXXXXXXXXXXXXSXXXXFXXAVAXXXXXLRXXXXXXXXXXXXXXXXAXXXXXXDXXGXRXEFXXLXXXA

SEQ ID NO: 37416 - protein, 50 aa, consensus
  MISC_FEATURE (1)..(50): consensus for the disclosure of xaa see table XV
XXXXXXXXXXXXTFXXDVDXXXYXXXRXXXXXXXXPXXXXXRXEXXXNXF

SEQ ID NO: 37417 - protein, 51 aa, consensus
  MISC_FEATURE (1)..(51): consensus for the disclosure of xaa see table XV
XLXXXXDXSGSMXXXXXLXLXXXXXXXXXXXXXXXDXXXXVXXXXXXXXXL

SEQ ID NO: 37418 - protein, 110 aa, consensus
  MISC_FEATURE (1)..(110): consensus for the disclosure of xaa see table XV
XXXAXXXLXXXXXTXXXXGXXXXYXXAXXXXXXXXXNRXXLXXDXDFNXGXXXXXXXXXXXXXXXXXGXXLXXXGXGXXNXXXXXXXXXXXXGXGXXXXXXXXXXAXXVX

SEQ ID NO: 37419 - protein, 55 aa, consensus
  MISC_FEATURE (1)..(55): consensus for the disclosure of xaa see table XV
XXXXKXQXXXXPXXVXXXRXXGYXXRXXXXEXFXXDXXDXGXXGXGXXXTXXXXX

SEQ ID NO: 37420 - protein, 96 aa, consensus
  MISC_FEATURE (1)..(96): consensus for the disclosure of xaa see table XV
XXXXXXXRXXXPXXXXSXXXXXXXXXXXXXXXXXXXXXXXXXXXAXAXXXXXLXXXXXXXXXXXXXXXXXXXXXXXXDXXXXXXXXXXLXXXAXXX

SEQ ID NO: 37421 - DNA, 333 bp, Escherichia coli K12; identical to SEQ ID NO: 24865
  CDS (1)..(333)

SEQ ID NO: 37422 - protein, 110 aa, Escherichia coli K12; identical to SEQ ID NO: 24866

SEQ ID NO: 37423 - DNA, 1068 bp, Mus musculus (house mouse); identical to SEQ ID NO: 24867
  CDS (64)..(996)

SEQ ID NO: 37424 - protein, 310 aa, Mus musculus (house mouse); identical to SEQ ID NO: 24868

SEQ ID NO: 37425 - DNA, 1953 bp, Helicobacter pylori; identical to SEQ ID NO: 24869
  CDS (1)..(1953)

SEQ ID NO: 37426 - protein, 650 aa, Helicobacter pylori; identical to SEQ ID NO: 24870

SEQ ID NO: 37427 - DNA, 336 bp, Pseudomonas aeruginosa; identical to SEQ ID NO: 24871
  CDS (1)..(336)

SEQ ID NO: 37428 - protein, 111 aa, Pseudomonas aeruginosa; identical to SEQ ID NO: 24872

SEQ ID NO: 37429 - DNA, 489 bp, Sulfolobus solfataricus; identical to SEQ ID NO: 24873
  CDS (1)..(489)

SEQ ID NO: 37430 - protein, 162 aa, Sulfolobus solfataricus; identical to SEQ ID NO: 24874

SEQ ID NO: 37431 - DNA, 1935 bp, Clostridium acetobutylicum; identical to SEQ ID NO: 24875
  CDS (1)..(1935)

SEQ ID NO: 37432 - protein, 644 aa, Clostridium acetobutylicum; identical to SEQ ID NO: 24876

SEQ ID NO: 37433 - DNA, 2028 bp, Yersinia pestis; identical to SEQ ID NO: 24877
  CDS (1)..(2028)

SEQ ID NO: 37434 - protein, 675 aa, Yersinia pestis; identical to SEQ ID NO: 24878

SEQ ID NO: 37435 - DNA, 1995 bp, Listeria innocua; identical to SEQ ID NO: 24879
  CDS (1)..(1995)

SEQ ID NO: 37436 - protein, 664 aa, Listeria innocua; identical to SEQ ID NO: 24880

SEQ ID NO: 37437 - DNA, 2205 bp, Borrelia burgdorferi (Lyme disease spirochete); identical to SEQ ID NO: 24881
  CDS (1)..(2205)

SEQ ID NO: 37438 - protein, 734 aa, Borrelia burgdorferi (Lyme disease spirochete); identical to SEQ ID NO: 24882

SEQ ID NO: 37439 - DNA, 2169 bp, Pyrococcus abyssi; identical to SEQ ID NO: 24883
  CDS (1)..(2169)

SEQ ID NO: 37440 - protein, 722 aa, Pyrococcus abyssi; identical to SEQ ID NO: 24884

SEQ ID NO: 37441 - DNA, 2046 bp, Deinococcus radiodurans; identical to SEQ ID NO: 24885
  CDS (1)..(2046)

SEQ ID NO: 37442 - protein, 681 aa, Deinococcus radiodurans; identical to SEQ ID NO: 24886

SEQ ID NO: 37443 - DNA, 2109 bp, Xylella fastidiosa; identical to SEQ ID NO: 24887
  CDS (1)..(2109)

SEQ ID NO: 37444 - protein, 702 aa, Xylella fastidiosa; identical to SEQ ID NO: 24888

SEQ ID NO: 37445 - DNA, 2070 bp, Halobacterium sp. NRC-1; identical to SEQ ID NO: 24889
  CDS (1)..(2070)

SEQ ID NO: 37446 - protein, 689 aa, Halobacterium sp. NRC-1; identical to SEQ ID NO: 24890

SEQ ID NO: 37447 - DNA, 1323 bp, Arabidopsis thaliana (mouse-ear cress); identical to SEQ ID NO: 24891
  CDS (1)..(1323)

SEQ ID NO: 37448 - protein, 440 aa, Arabidopsis thaliana (mouse-ear cress); identical to SEQ ID NO: 24892

SEQ ID NO: 37449 - DNA, 1974 bp, Staphylococcus aureus; identical to SEQ ID NO: 24893
  CDS (1)..(1974)

SEQ ID NO: 37450 - protein, 657 aa, Staphylococcus aureus; identical to SEQ ID NO: 24894

SEQ ID NO: 37451 - DNA, 1977 bp, Archaeoglobus fulgidus; identical to SEQ ID NO: 24895
  CDS (1)..(1977)

SEQ ID NO: 37452 - protein, 658 aa, Archaeoglobus fulgidus; identical to SEQ ID NO: 24896

SEQ ID NO: 37453 - DNA, 2172 bp, Pyrococcus horikoshii; identical to SEQ ID NO: 24897
  CDS (1)..(2172)

SEQ ID NO: 37454 - protein, 723 aa, Pyrococcus horikoshii; identical to SEQ ID NO: 24898

SEQ ID NO: 37455 - DNA, 1998 bp, Streptococcus pneumoniae; identical to SEQ ID NO: 24899
  CDS (1)..(1998)

SEQ ID NO: 37456 - protein, 665 aa, Streptococcus pneumoniae; identical to SEQ ID NO: 24900

SEQ ID NO: 37457 - DNA, 2436 bp, Treponema pallidum subsp. pallidum (syphilis spirochete); identical to SEQ ID NO: 24901
  CDS (1)..(2436)

SEQ ID NO: 37458 - protein, 811 aa, Treponema pallidum subsp. pallidum (syphilis spirochete); identical to SEQ ID NO: 24902

SEQ ID NO: 37459 - DNA, 1890 bp, Thermotoga maritima; identical to SEQ ID NO: 24903
  CDS (1)..(1890)

SEQ ID NO: 37460 - protein, 629 aa, Thermotoga maritima; identical to SEQ ID NO: 24904

SEQ ID NO: 37461 - DNA, 1983 bp, Bacillus halodurans; identical to SEQ ID NO: 24905
  CDS (1)..(1983)

SEQ ID NO: 37462 - protein, 660 aa, Bacillus halodurans; identical to SEQ ID NO: 24906

SEQ ID NO: 37463 - DNA, 1956 bp, Methanococcus jannaschii; identical to SEQ ID NO: 24907
  CDS (1)..(1956)

SEQ ID NO: 37464 - protein, 651 aa, Methanococcus jannaschii; identical to SEQ ID NO: 24908

SEQ ID NO: 37465 - DNA, 336 bp, Aquifex aeolicus; identical to SEQ ID NO: 24909
  CDS (1)..(336)

SEQ ID NO: 37466 - protein, 111 aa, Aquifex aeolicus; identical to SEQ ID NO: 24910

SEQ ID NO: 37467 - DNA, 339 bp, Pyrococcus horikoshii; identical to SEQ ID NO: 24911
  CDS (1)..(339)

SEQ ID NO: 37468 - protein, 112 aa, Pyrococcus horikoshii; identical to SEQ ID NO: 24912

SEQ ID NO: 37469 - DNA, 1887 bp, Campylobacter jejuni; identical to SEQ ID NO: 24913
  CDS (1)..(1887)

SEQ ID NO: 37470 - protein, 628 aa, Campylobacter jejuni; identical to SEQ ID NO: 24914

SEQ ID NO: 37471 - DNA, 345 bp, Vibrio cholerae; identical to SEQ ID NO: 24915
  CDS (1)..(345)

SEQ ID NO: 37472 - protein, 114 aa, Vibrio cholerae; identical to SEQ ID NO: 24916

SEQ ID NO: 37473 - DNA, 1956 bp, Methanobacterium thermoautotrophicum; identical to SEQ ID NO: 24917
  CDS (1)..(1956)

SEQ ID NO: 37474 - protein, 651 aa, Methanobacterium thermoautotrophicum; identical to SEQ ID NO: 24918

SEQ ID NO: 37475 - DNA, 1971 bp, Helicobacter pylori; identical to SEQ ID NO: 24919
  CDS (1)..(1971)

SEQ ID NO: 37476 - protein, 656 aa, Helicobacter pylori; identical to SEQ ID NO: 24920

SEQ ID NO: 37477 - DNA, 354 bp, Aeropyrum pernix; identical to SEQ ID NO: 24921
  CDS (1)..(354)

SEQ ID NO: 37478 - protein, 117 aa, Aeropyrum pernix; identical to SEQ ID NO: 24922

SEQ ID NO: 37479 - DNA, 330 bp, Pyrococcus abyssi; identical to SEQ ID NO: 24923
  CDS (1)..(330)

SEQ ID NO: 37480 - protein, 109 aa, Pyrococcus abyssi; identical to SEQ ID NO: 24924

SEQ ID NO: 37481 - DNA, 1989 bp, Lactococcus lactis subsp. lactis; identical to SEQ ID NO: 24925
  CDS (1)..(1989)

SEQ ID NO: 37482 - protein, 662 aa, Lactococcus lactis subsp. lactis; identical to SEQ ID NO: 24926

SEQ ID NO: 37483 - DNA, 2049 bp, Haemophilus influenzae; identical to SEQ ID NO: 24927
  CDS (1)..(2049)

SEQ ID NO: 37484 - protein, 682 aa, Haemophilus influenzae; identical to SEQ ID NO: 24928

SEQ ID NO: 37485 - DNA, 2879 bp, Bacillus stearothermophilus; identical to SEQ ID NO: 24929
  CDS (646)..(2595)

SEQ ID NO: 37486 - protein, 649 aa, Bacillus stearothermophilus; identical to SEQ ID NO: 24930

SEQ ID NO: 37487 - DNA, 1131 bp, Saccharomyces cerevisiae; identical to SEQ ID NO: 24931
  CDS (1)..(1131)

SEQ ID NO: 37488 - protein, 376 aa, Saccharomyces cerevisiae; identical to SEQ ID NO: 24932

SEQ ID NO: 37489 - DNA, 1995 bp, Bacillus subtilis; identical to SEQ ID NO: 24933
  CDS (1)..(1995)

SEQ ID NO: 37490 - protein, 664 aa, Bacillus subtilis; identical to SEQ ID NO: 24934

SEQ ID NO: 37491 - DNA, 2544 bp, Thermus aquaticus; identical to SEQ ID NO: 24935
  CDS (361)..(2211)

SEQ ID NO: 37492 - protein, 616 aa, Thermus aquaticus; identical to SEQ ID NO: 24936

SEQ ID NO: 37493 - DNA, 2394 bp, Arabidopsis thaliana (mouse-ear cress); identical to SEQ ID NO: 24937
  CDS (1)..(2394)

SEQ ID NO: 37494 - protein, 797 aa, Arabidopsis thaliana (mouse-ear cress); identical to SEQ ID NO: 24938

SEQ ID NO: 37495 - DNA, 853 bp, Arabidopsis thaliana (mouse-ear cress); identical to SEQ ID NO: 24939
  CDS (1)..(822)

SEQ ID NO: 37496 - protein, 273 aa, Arabidopsis thaliana (mouse-ear cress); identical to SEQ ID NO: 24940

SEQ ID NO: 37497 - DNA, 582 bp, Geodia cydonium; identical to SEQ ID NO: 24941
  CDS (62)..(511)

SEQ ID NO: 37498 - protein, 149 aa, Geodia cydonium; identical to SEQ ID NO: 24942

SEQ ID NO: 37499 - DNA, 2175 bp, Borrelia garinii PBi; identical to SEQ ID NO: 24943
  CDS (1)..(2175)

SEQ ID NO: 37500 - protein, 724 aa, Borrelia garinii PBi; identical to SEQ ID NO: 24944

SEQ ID NO: 37501 - DNA, 1956 bp, Symbiobacterium thermophilum; identical to SEQ ID NO: 24945
  CDS (1)..(1956)

SEQ ID NO: 37502 - protein, 651 aa, Symbiobacterium thermophilum; identical to SEQ ID NO: 24946

SEQ ID NO: 37503 - DNA, 1938 bp, Desulfotalea psychrophila; identical to SEQ ID NO: 24947
  CDS (1)..(1938)

SEQ ID NO: 37504 - protein, 645 aa, Desulfotalea psychrophila; identical to SEQ ID NO: 24948

SEQ ID NO: 37505 - DNA, 1119 bp, Kluyveromyces lactis NRRL Y; identical to SEQ ID NO: 24949
  CDS (1)..(1119)

SEQ ID NO: 37506 - protein, 372 aa, Kluyveromyces lactis NRRL Y; identical to SEQ ID NO: 24950

SEQ ID NO: 37507 - DNA, 624 bp, Kluyveromyces lactis NRRL Y; identical to SEQ ID NO: 24951
  CDS (1)..(624)

SEQ ID NO: 37508 - protein, 207 aa, Kluyveromyces lactis NRRL Y; identical to SEQ ID NO: 24952

SEQ ID NO: 37509 - DNA, 2031 bp, Erwinia carotovora; identical to SEQ ID NO: 24953
  CDS (1)..(2031)

SEQ ID NO: 37510 - protein, 676 aa, Erwinia carotovora; identical to SEQ ID NO: 24954

SEQ ID NO: 37511 - DNA, 1928 bp, Xenopus tropicalis; identical to SEQ ID NO: 24955
  CDS (128)..(1714)

SEQ ID NO: 37512 - protein, 528 aa, Xenopus tropicalis; identical to SEQ ID NO: 24956

SEQ ID NO: 37513 - DNA, 2058 bp, Acinetobacter sp; identical to SEQ ID NO: 24957
  CDS (1)..(2058)

SEQ ID NO: 37514 - protein, 685 aa, Acinetobacter sp; identical to SEQ ID NO: 24958

SEQ ID NO: 37515 - DNA, 1131 bp, Candida glabrata CBS138; identical to SEQ ID NO: 24959
  CDS (1)..(1131)

SEQ ID NO: 37516 - protein, 376 aa, Candida glabrata CBS138; identical to SEQ ID NO: 24960

SEQ ID NO: 37517 - DNA, 327 bp, Picrophilus torridus; identical to SEQ ID NO: 24961
  CDS (1)..(327)

SEQ ID NO: 37518 - protein, 108 aa, Picrophilus torridus; identical to SEQ ID NO: 24962

SEQ ID NO: 37519 - DNA, 354 bp, Photobacterium profundum; identical to SEQ ID NO: 24963
  CDS (1)..(354)

SEQ ID NO: 37520 - protein, 117 aa, Photobacterium profundum; identical to SEQ ID NO: 24964

SEQ ID NO: 37521 - DNA, 2043 bp, Photobacterium profundum; identical to SEQ ID NO: 24965
  CDS (1)..(2043)

SEQ ID NO: 37522 - protein, 680 aa, Photobacterium profundum; identical to SEQ ID NO: 24966

SEQ ID NO: 37523 - DNA, 1992 bp, Methanococcus maripaludis; identical to SEQ ID NO: 24967
  CDS (1)..(1992)

SEQ ID NO: 37524 - protein, 663 aa, Methanococcus maripaludis; identical to SEQ ID NO: 24968

SEQ ID NO: 37525 - DNA, 2097 bp, Parachlamydia sp; identical to SEQ ID NO: 24969
  CDS (1)..(2097)

SEQ ID NO: 37526 - protein, 698 aa, Parachlamydia sp; identical to SEQ ID NO: 24970

SEQ ID NO: 37527 - DNA, 2064 bp, Bdellovibrio bacteriovorus; identical to SEQ ID NO: 24971
  CDS (1)..(2064)

SEQ ID NO: 37528 - protein, 687 aa, Bdellovibrio bacteriovorus; identical to SEQ ID NO: 24972

SEQ ID NO: 37529 - DNA, 2217 bp, Brachydanio rerio; identical to SEQ ID NO: 24973
  CDS (65)..(1654)

SEQ ID NO: 37530 - protein, 529 aa, Brachydanio rerio; identical to SEQ ID NO: 24974

SEQ ID NO: 37531 - DNA, 2106 bp, uncultured bacterium; identical to SEQ ID NO: 24975
  CDS (1)..(2106)

SEQ ID NO: 37532 - protein, 701 aa, uncultured bacterium; identical to SEQ ID NO: 24976

SEQ ID NO: 37533 - DNA, 1998 bp, Listeria monocytogenes; identical to SEQ ID NO: 24977
  CDS (1)..(1998)

SEQ ID NO: 37534 - protein, 665 aa, Listeria monocytogenes; identical to SEQ ID NO: 24978

SEQ ID NO: 37535 - DNA, 1992 bp, Desulfovibrio vulgaris; identical to SEQ ID NO: 24979
  CDS (1)..(1992)

SEQ ID NO: 37536 - protein, 663 aa, Desulfovibrio vulgaris; identical to SEQ ID NO: 24980

SEQ ID NO: 37537 - DNA, 330 bp, Thermus thermophilus; identical to SEQ ID NO: 24981
  CDS (1)..(330)

SEQ ID NO: 37538 - protein, 109 aa, Thermus thermophilus; identical to SEQ ID NO: 24982

SEQ ID NO: 37539 - DNA, 2382 bp, Treponema denticola; identical to SEQ ID NO: 24983
  CDS (1)..(2382)

SEQ ID NO: 37540 - protein, 793 aa, Treponema denticola; identical to SEQ ID NO: 24984

SEQ ID NO: 37541 - DNA, 2331 bp, Nanoarchaeum equitans; identical to SEQ ID NO: 24985
  CDS (1)..(2331)

SEQ ID NO: 37542 - protein, 776 aa, Nanoarchaeum equitans; identical to SEQ ID NO: 24986

SEQ ID NO: 37543 - DNA, 615 bp, Ashbya gossypii; identical to SEQ ID NO: 24987
  CDS (1)..(615)

SEQ ID NO: 37544 - protein, 204 aa, Ashbya gossypii; identical to SEQ ID NO: 24988

SEQ ID NO: 37545 - DNA, 1116 bp, Ashbya gossypii; identical to SEQ ID NO: 24989
  CDS (1)..(1116)

SEQ ID NO: 37546 - protein, 371 aa, Ashbya gossypii; identical to SEQ ID NO: 24990

SEQ ID NO: 37547 - DNA, 1950 bp, Wolinella succinogenes; identical to SEQ ID NO: 24991
  CDS (1)..(1950)

SEQ ID NO: 37548 - protein, 649 aa, Wolinella succinogenes; identical to SEQ ID NO: 24992

SEQ ID NO: 37549 - DNA, 2043 bp, Porphyromonas gingivalis; identical to SEQ ID NO: 24993
  CDS (1)..(2043)

SEQ ID NO: 37550 - protein, 680 aa, Porphyromonas gingivalis; identical to SEQ ID NO: 24994

SEQ ID NO: 37551 - DNA, 336 bp, Photorhabdus luminescens; identical to SEQ ID NO: 24995
  CDS (1)..(336)

SEQ ID NO: 37552 - protein, 111 aa, Photorhabdus luminescens; identical to SEQ ID NO: 24996

SEQ ID NO: 37553 - DNA, 2028 bp, Photorhabdus luminescens; identical to SEQ ID NO: 24997
  CDS (1)..(2028)

SEQ ID NO: 37554 - protein, 675 aa, Photorhabdus luminescens; identical to SEQ ID NO: 24998

SEQ ID NO: 37555 - DNA, 2070 bp, Chromobacterium violaceum; identical to SEQ ID NO: 24999
  CDS (1)..(2070)

SEQ ID NO: 37556 - protein, 689 aa, Chromobacterium violaceum; identical to SEQ ID NO: 25000

SEQ ID NO: 37557 - DNA, 1629 bp, Anopheles gambiae str; identical to SEQ ID NO: 25001
  CDS (1)..(1629)

SEQ ID NO: 37558 - protein, 542 aa, Anopheles gambiae str; identical to SEQ ID NO: 25002

SEQ ID NO: 37559 - DNA, 339 bp, Rhodopirellula baltica; identical to SEQ ID NO: 25003
  CDS (1)..(339)

SEQ ID NO: 37560 - protein, 112 aa, Rhodopirellula baltica; identical to SEQ ID NO: 25004

SEQ ID NO: 37561 - DNA, 1932 bp, Helicobacter hepaticus; identical to SEQ ID NO: 25005
  CDS (1)..(1932)

SEQ ID NO: 37562 - protein, 643 aa, Helicobacter hepaticus; identical to SEQ ID NO: 25006

SEQ ID NO: 37563 - DNA, 2055 bp, Haemophilus ducreyi; identical to SEQ ID NO: 25007
  CDS (1)..(2055)

SEQ ID NO: 37564 - protein, 684 aa, Haemophilus ducreyi; identical to SEQ ID NO: 25008

SEQ ID NO: 37565 - DNA, 339 bp, Bordetella parapertussis; identical to SEQ ID NO: 25009
  CDS (1)..(339)

SEQ ID NO: 37566 - protein, 112 aa, Bordetella parapertussis; identical to SEQ ID NO: 25010

SEQ ID NO: 37567 - DNA, 342 bp, Bordetella bronchiseptica; identical to SEQ ID NO: 25011
  CDS (1)..(342)

SEQ ID NO: 37568 - protein, 113 aa, Bordetella bronchiseptica; identical to SEQ ID NO: 25012

SEQ ID NO: 37569 - DNA, 2079 bp, Bordetella bronchiseptica; identical to SEQ ID NO: 25013
  CDS (1)..(2079)

SEQ ID NO: 37570 - protein, 692 aa, Bordetella bronchiseptica; identical to SEQ ID NO: 25014

SEQ ID NO: 37571 - DNA, 759 bp, Oryza sativa; identical to SEQ ID NO: 25015
  CDS (1)..(759)

SEQ ID NO: 37572 - protein, 252 aa, Oryza sativa; identical to SEQ ID NO: 25016

SEQ ID NO: 37573 - DNA, 2053 bp, Xenopus laevis; identical to SEQ ID NO: 25017
  CDS (259)..(1845)

SEQ ID NO: 37574 - protein, 528 aa, Xenopus laevis; identical to SEQ ID NO: 25018

SEQ ID NO: 37575 - DNA, 2121 bp, Nitrosomonas europaea; identical to SEQ ID NO: 25019
  CDS (1)..(2121)

SEQ ID NO: 37576 - protein, 706 aa, Nitrosomonas europaea; identical to SEQ ID NO: 25020

SEQ ID NO: 37577 - DNA, 2043 bp, Shigella flexneri; identical to SEQ ID NO: 25021
  CDS (1)..(2043)

SEQ ID NO: 37578 - protein, 680 aa, Shigella flexneri; identical to SEQ ID NO: 25022

SEQ ID NO: 37579 - DNA, 333 bp, Vibrio vulnificus; identical to SEQ ID NO: 25023
  CDS (1)..(333)

SEQ ID NO: 37580 - protein, 110 aa, Vibrio vulnificus; identical to SEQ ID NO: 25024

SEQ ID NO: 37581 - DNA, 333 bp, Vibrio parahaemolyticus; identical to SEQ ID NO: 25025
  CDS (1)..(333)

SEQ ID NO: 37582 - protein, 110 aa, Vibrio parahaemolyticus; identical to SEQ ID NO: 25026

SEQ ID NO: 37583 - DNA, 2040 bp, Bacteroides thetaiotaomicron; identical to SEQ ID NO: 25027
  CDS (1)..(2040)

SEQ ID NO: 37584 - protein, 679 aa, Bacteroides thetaiotaomicron; identical to SEQ ID NO: 25028

SEQ ID NO: 37585 - DNA, 1983 bp, Vibrio vulnificus; identical to SEQ ID NO: 25029
  CDS (1)..(1983)

SEQ ID NO: 37586 - protein, 660 aa, Vibrio vulnificus; identical to SEQ ID NO: 25030

SEQ ID NO: 37587 - DNA, 333 bp, Vibrio vulnificus; identical to SEQ ID NO: 25031
  CDS (1)..(333)

SEQ ID NO: 37588 - protein, 110 aa, Vibrio vulnificus; identical to SEQ ID NO: 25032

SEQ ID NO: 37589 - DNA, 2010 bp, Streptococcus mutans; identical to SEQ ID NO: 25033
  CDS (1)..(2010)

SEQ ID NO: 37590 - protein, 669 aa, Streptococcus mutans; identical to SEQ ID NO: 25034

SEQ ID NO: 37591 - DNA, 1998 bp, Streptococcus agalactiae; identical to SEQ ID NO: 25035
  CDS (1)..(1998)

SEQ ID NO: 37592 - protein, 665 aa, Streptococcus agalactiae; identical to SEQ ID NO: 25036

SEQ ID NO: 37593 - DNA, 2031 bp, Shewanella oneidensis; identical to SEQ ID NO: 25037
  CDS (1)..(2031)

SEQ ID NO: 37594 - protein, 676 aa, Shewanella oneidensis; identical to SEQ ID NO: 25038

SEQ ID NO: 37595 - DNA, 2148 bp, Leptospira interrogans; identical to SEQ ID NO: 25039
  CDS (1)..(2148)

SEQ ID NO: 37596 - protein, 715 aa, Leptospira interrogans; identical to SEQ ID NO: 25040

SEQ ID NO: 37597 - DNA, 1209 bp, Plasmodium falciparum; identical to SEQ ID NO: 25041
  CDS (1)..(1209)

SEQ ID NO: 37598 - protein, 402 aa, Plasmodium falciparum; identical to SEQ ID NO: 25042

SEQ ID NO: 37599 - DNA, 330 bp, Thermoanaerobacter tengcongensis; identical to SEQ ID NO: 25043
  CDS (1)..(330)

SEQ ID NO: 37600 - protein, 109 aa, Thermoanaerobacter tengcongensis; identical to SEQ ID NO: 25044

SEQ ID NO: 37601 - DNA, 1230 bp, Oryza sativa; identical to SEQ ID NO: 25045
  CDS (1)..(1230)

SEQ ID NO: 37602 - protein, 409 aa, Oryza sativa; identical to SEQ ID NO: 25046

SEQ ID NO: 37603 - DNA, 858 bp, Encephalitozoon cuniculi GB; identical to SEQ ID NO: 25047
  CDS (1)..(858)

SEQ ID NO: 37604 - protein, 285 aa, Encephalitozoon cuniculi GB; identical to SEQ ID NO: 25048

SEQ ID NO: 37605 - DNA, 330 bp, Pyrococcus furiosus; identical to SEQ ID NO: 25049
  CDS (1)..(330)

SEQ ID NO: 37606 - protein, 109 aa, Pyrococcus furiosus; identical to SEQ ID NO: 25050

SEQ ID NO: 37607 - DNA, 327 bp, Pyrobaculum aerophilum; identical to SEQ ID NO: 25051
  CDS (1)..(327)

SEQ ID NO: 37608 - protein, 108 aa, Pyrobaculum aerophilum; identical to SEQ ID NO: 25052

SEQ ID NO: 37609 - DNA, 342 bp, Sulfolobus tokodaii; identical to SEQ ID NO: 25053
  CDS (1)..(342)

SEQ ID NO: 37610 - protein, 113 aa, Sulfolobus tokodaii; identical to SEQ ID NO: 25054

SEQ ID NO: 37611 - DNA, 324 bp, Thermoplasma volcanium; identical to SEQ ID NO: 25055
  CDS (1)..(324)

SEQ ID NO: 37612 - protein, 107 aa, Thermoplasma volcanium; identical to SEQ ID NO: 25056

SEQ ID NO: 37613 - DNA, 1032 bp, Drosophila melanogaster; identical to SEQ ID NO: 25057
  CDS (2)..(973)

SEQ ID NO: 37614 - protein, 323 aa, Drosophila melanogaster; identical to SEQ ID NO: 25058

SEQ ID NO: 37615 - DNA, 1726 bp, Drosophila melanogaster; identical to SEQ ID NO: 25059
  CDS (52)..(1629)

SEQ ID NO: 37616 - protein, 525 aa, Drosophila melanogaster; identical to SEQ ID NO: 25060

SEQ ID NO: 37617 - DNA, 1254 bp, Cricetulus griseus; identical to SEQ ID NO: 25061
  CDS (84)..(1163)

SEQ ID NO: 37618 - protein, 359 aa, Cricetulus griseus; identical to SEQ ID NO: 25062

SEQ ID NO: 37619 - DNA, 2010 bp, Bacillus anthracis; identical to SEQ ID NO: 25063
  CDS (28)..(2010)

SEQ ID NO: 37620 - protein, 660 aa, Bacillus anthracis; identical to SEQ ID NO: 25064

SEQ ID NO: 37621 - DNA, 1983 bp, Bacillus cereus; identical to SEQ ID NO: 25065
  CDS (1)..(1983)

SEQ ID NO: 37622 - protein, 660 aa, Bacillus cereus; identical to SEQ ID NO: 25066

SEQ ID NO: 37623 - DNA, 2112 bp, Chlorobium tepidum; identical to SEQ ID NO: 25067
  CDS (1)..(2112)

SEQ ID NO: 37624 - protein, 703 aa, Chlorobium tepidum; identical to SEQ ID NO: 25068

SEQ ID NO: 37625 - DNA, 1938 bp, Clostridium perfringens; identical to SEQ ID NO: 25069
  CDS (1)..(1938)

SEQ ID NO: 37626 - protein, 645 aa, Clostridium perfringens; identical to SEQ ID NO: 25070

SEQ ID NO: 37627 - DNA, 1926 bp, Clostridium tetani; identical to SEQ ID NO: 25071
  CDS (1)..(1926)

SEQ ID NO: 37628 - protein, 641 aa, Clostridium tetani; identical to SEQ ID NO: 25072

SEQ ID NO: 37629 - DNA, 2034 bp, Enterococcus faecalis; identical to SEQ ID NO: 25073
  CDS (25)..(2034)

SEQ ID NO: 37630 - protein, 669 aa, Enterococcus faecalis; identical to SEQ ID NO: 25074

SEQ ID NO: 37631 - DNA, 1911 bp, Fusobacterium nucleatum; identical to SEQ ID NO: 25075
  CDS (1)..(1911)

SEQ ID NO: 37632 - protein, 636 aa, Fusobacterium nucleatum; identical to SEQ ID NO: 25076

SEQ ID NO: 37633 - DNA, 2052 bp, Lactobacillus plantarum; identical to SEQ ID NO: 25077
  CDS (1)..(2052)

SEQ ID NO: 37634 - protein, 683 aa, Lactobacillus plantarum; identical to SEQ ID NO: 25078

SEQ ID NO: 37635 - DNA, 2139 bp, Methanosarcina acetivorans; identical to SEQ ID NO: 25079
  CDS (1)..(2139)

SEQ ID NO: 37636 - protein, 712 aa, Methanosarcina acetivorans; identical to SEQ ID NO: 25080

SEQ ID NO: 37637 - DNA, 2007 bp, Methanopyrus kandleri; identical to SEQ ID NO: 25081
  CDS (1)..(2007)

SEQ ID NO: 37638 - protein, 668 aa, Methanopyrus kandleri; identical to SEQ ID NO: 25082

SEQ ID NO: 37639 - DNA, 2148 bp, Methanosarcina mazei; identical to SEQ ID NO: 25083
  CDS (1)..(2148)

SEQ ID NO: 37640 - protein, 715 aa, Methanosarcina mazei; identical to SEQ ID NO: 25084

SEQ ID NO: 37641 - DNA, 2022 bp, Oceanobacillus iheyensis; identical to SEQ ID NO: 25085
  CDS (1)..(2022)

SEQ ID NO: 37642 - protein, 673 aa, Oceanobacillus iheyensis; identical to SEQ ID NO: 25086

SEQ ID NO: 37643 - DNA, 2850 bp, Oryza sativa; identical to SEQ ID NO: 25087
  CDS (44)..(2458)

SEQ ID NO: 37644 - protein, 804 aa, Oryza sativa; identical to SEQ ID NO: 25088

SEQ ID NO: 37645 - DNA, 2049 bp, Pasteurella multocida; identical to SEQ ID NO: 25089
  CDS (1)..(2049)

SEQ ID NO: 37646 - protein, 682 aa, Pasteurella multocida; identical to SEQ ID NO: 25090

SEQ ID NO: 37647 - DNA, 2175 bp, Pyrococcus furiosus; identical to SEQ ID NO: 25091
  CDS (1)..(2175)

SEQ ID NO: 37648 - protein, 724 aa, Pyrococcus furiosus; identical to SEQ ID NO: 25092

SEQ ID NO: 37649 - DNA, 2067 bp, Ralstonia solanacearum; identical to SEQ ID NO: 25093
  CDS (1)..(2067)

SEQ ID NO: 37650 - protein, 688 aa, Ralstonia solanacearum; identical to SEQ ID NO: 25094

SEQ ID NO: 37651 - DNA, 2034 bp, Salmonella typhi; identical to SEQ ID NO: 25095
  CDS (1)..(2034)

SEQ ID NO: 37652 - protein, 677 aa, Salmonella typhi; identical to SEQ ID NO: 25096

SEQ ID NO: 37653 - DNA, 1971 bp, Staphylococcus epidermidis; identical to SEQ ID NO: 25097
  CDS (1)..(1971)

SEQ ID NO: 37654 - protein, 656 aa, Staphylococcus epidermidis; identical to SEQ ID NO: 25098

SEQ ID NO: 37655 - DNA, 2001 bp, Streptococcus pyogenes; identical to SEQ ID NO: 25099
  CDS (4)..(2001)

SEQ ID NO: 37656 - protein, 665 aa, Streptococcus pyogenes; identical to SEQ ID NO: 25100

SEQ ID NO: 37657 - DNA, 1917 bp, Thermoanaerobacter tengcongensis; identical to SEQ ID NO: 25101
  CDS (1)..(1917)

SEQ ID NO: 37658 - protein, 638 aa, Thermoanaerobacter tengcongensis; identical to SEQ ID NO: 25102

SEQ ID NO: 37659 - DNA, 2196 bp, Vibrio cholerae; identical to SEQ ID NO: 25103
  CDS (145)..(2196)

SEQ ID NO: 37660 - protein, 683 aa, Vibrio cholerae; identical to SEQ ID NO: 25104

SEQ ID NO: 37661 - DNA, 2031 bp, Vibrio parahaemolyticus; identical to SEQ ID NO: 25105
  CDS (1)..(2031)

SEQ ID NO: 37662 - protein, 676 aa, Vibrio parahaemolyticus; identical to SEQ ID NO: 25106

SEQ ID NO: 37663 - DNA, 2085 bp, Xanthomonas axonopodis; identical to SEQ ID NO: 25107
  CDS (1)..(2085)

SEQ ID NO: 37664 - protein, 694 aa, Xanthomonas axonopodis; identical to SEQ ID NO: 25108

SEQ ID NO: 37665 - DNA, 2091 bp, Xanthomonas campestris; identical to SEQ ID NO: 25109
  CDS (1)..(2091)

SEQ ID NO: 37666 - protein, 696 aa, Xanthomonas campestris; identical to SEQ ID NO: 25110

SEQ ID NO: 37667 - DNA, 2109 bp, Xylella fastidiosa; identical to SEQ ID NO: 25111
  CDS (1)..(2109)

SEQ ID NO: 37668 - protein, 702 aa, Xylella fastidiosa; identical to SEQ ID NO: 25112

SEQ ID NO: 37669 - DNA, 1683 bp, Homo sapiens; identical to SEQ ID NO: 25113
  CDS (1)..(1587)

SEQ ID NO: 37670 - protein, 528 aa, Homo sapiens; identical to SEQ ID NO: 25114

SEQ ID NO: 37671 - DNA, 22 bp, Primer
atggaaaccgtggcttacgctg

SEQ ID NO: 37672 - DNA, 21 bp, Primer
ttatacgacgcgtacgcccgc

SEQ ID NO: 37673 - protein, 30 aa, consensus; identical to SEQ ID NO: 25513
  MISC_FEATURE (1)..(30): consensus for the disclosure of xaa see table XV

SEQ ID NO: 37674 - protein, 28 aa, consensus
  MISC_FEATURE (1)..(28): consensus for the disclosure of xaa see table XV
XXXXXXXXXXNXXXXXXXXXXXSXXXXX

SEQ ID NO: 37675 - DNA, 429 bp, Escherichia coli
  CDS (1)..(429)
atggctaagaaagtacaagcctatgtcaagctgcaggttgcagctggtatggctaacccgagtccgccagtaggtccggctctgggtcagcagggcgtaaacatcatggaattctgcaaagcgttcaacgcaaaaactgattccatcgaaaaaggtctgccgattccggtagtaatcaccgtttacgctgaccgttctttcactttcgttaccaagactccgccggcagcagttctgctgaaaaaagcggctggtatcaagtctggttccggtaagccgaacaaagacaaagtgggtaaaatttcccgcgctcagctgcaggaaatcgcgcagaccaaagctgccgacatgactggtgccgacattgaagcgatgactcgctccatcgaaggtactgcacgttccatgggcctggtagtggaggactaa

SEQ ID NO: 37676 - protein, 142 aa, Escherichia coli
MAKKVQAYVKLQVAAGMANPSPPVGPALGQQGVNIMEFCKAFNAKTDSIEKGLPIPVVITVYADRSFTFVTKTPPAAVLLKKAAGIKSGSGKPNKDKVGKISRAQLQEIAQTKAADMTGADIEAMTRSIEGTARSMGLVVED

SEQ ID NO: 37677 - DNA, 703 bp, Anopheles gambiae str. PEST
  CDS (57)..(647)
tgacaacaccgtgcatgcaataattcccgggcgatacagcaaataaaacctccaaaatgtcgaaagcggcgggacggctgaaaacgatgaagaaaacgttcgacaaaatcaaccacaccagcaagctgcgaacaaacatcccagccggcatggctgtggccggcccaccgctcggcccgatgctcggccagcgaggcattaacatagcggcgttttgcaaagacttcaacgaacggaccaaagagatcaaggaaggcattccgctgccgtgccgggtagctgtcacctccgaccgggcgtacgagctgacgatccactcacctcccgctacgttcctgctcaagcaagcggccggcatacagcgcggtgccatgagcccgggcaaagagattgcgggcaagatcacacgaaagcatttgtacgagatagcgaaaatcaaactgcaagatccacccaacgcactactcacgctggagcacatgtgcaaggcgctggtcggagtcgcccgcacgtgtgggatcgaaatagtgaacgagctcgatccggcagagtataaagattttctcgaacaacggcgacaagtggtcgaagatcagcgcaaggagctgcaggagaagcgggaagcgcgcatgttgcgtgtgggatagagtgcttgtgttctttatttgagcagtagaggaataaaacgacgctacgtagcaaa

SEQ ID NO: 37678 - protein, 196 aa, Anopheles gambiae str. PEST
MSKAAGRLKTMKKTFDKINHTSKLRTNIPAGMAVAGPPLGPMLGQRGINIAAFCKDFNERTKEIKEGIPLPCRVAVTSDRAYELTIHSPPATFLLKQAAGIQRGAMSPGKEIAGKITRKHLYEIAKIKLQDPPNALLTLEHMCKALVGVARTCGIEIVNELDPAEYKDFLEQRRQVVEDQRKELQEKREARMLRVG

SEQ ID NO: 37679 - DNA, 498 bp, Thermococcus kodakaraensis
  CDS (1)..(498)
atggcacaggttgttgaagttcttgtcgaaggtggaaaggcatcccccggaccgccccttggtccggctatcggtccgctcggactcaacgtcaagcaggtcgttgacgagatcaacaaggctaccaaagagttcgagggaatgcaggttcccgtcaagattatcgttgaggaccccaagaagaagaccttccgcatcgaggtcggtatcccgccgacgagccagcttatcaagaaggagctcggcattccgaagggctcaagcgaagccggccacactcccgcgggcaaccttacaatggagcaggtcatcaagatagccaagatgaagatcgaccagatgctcgcaccgaaccttaaggctgccgccaaggaggtcatcggaactgcgctcagcatgggcgttaccgttgagggcaaggatcccagggaagttcagagagagatcgacgagggtgtctatgacgagctctttgcaaaggctgaggaggcccagtga

SEQ ID NO: 37680 - protein, 165 aa, Thermococcus kodakaraensis
MAQVVEVLVEGGKASPGPPLGPAIGPLGLNVKQVVDEINKATKEFEGMQVPVKIIVEDPKKKTFRIEVGIPPTSQLIKKELGIPKGSSEAGHTPAGNLTMEQVIKIAKMKIDQMLAPNLKAAAKEVIGTALSMGVTVEGKDPREVQREIDEGVYDELFAKAEEAQ

SEQ ID NO: 37681 - DNA, 432 bp, Staphylococcus aureus subsp. aureus COL
  CDS (1)..(432)
atgcacatcgtggctaaaaaagtagataaagttgttaaattacaaattcctgcaggtaaagcgaatccagcaccaccagttggtccagcattaggtcaagcaggtgtgaacatcatgggattctgtaaagagttcaatgcacgtactcaagatcaagcaggtttaattattccggtagaaatcagtgtttatgaagatcgttcatttacatttattacaaaaactccaccggctccagtattacttaaaaaagcagctggtattgaaaaaggttcaggcgaaccaaacaaaactaaagttgctacagtaactaaaaatcaagtacgcgaaattgctaacagcaaaatgcaagacttaaacgctgctgacgaagaagcagctatgcgtattatcgaaggtactgcacgtagtatgggtatcgttgtagaataa

SEQ ID NO: 37682 - protein, 143 aa, Staphylococcus aureus subsp. aureus COL
MHIVAKKVDKVVKLQIPAGKANPAPPVGPALGQAGVNIMGFCKEFNARTQDQAGLIIPVEISVYEDRSFTFITKTPPAPVLLKKAAGIEKGSGEPNKTKVATVTKNQVREIANSKMQDLNAADEEAAMRIIEGTARSMGIVVE

SEQ ID NO: 37683 - DNA, 591 bp, Danio rerio
  CDS (1)..(591)
atgtctaagatatctaaagcagcaaaggcggtgaaaaagtcggatactggaggactgatcagagcgattgtacggtccggacaggcggctcccgggcctccactgggccccatcctgggacagaaagggattcccatcggagccttctgcaaagacttcaatgagagaaccaaagacctcaaagaaggcattcctcttcccgtcaagatcaatgtgaagccggaccggacgtatgacctgaaaattgggcagcccactgtgtcttacttcttgaaacaggctgccggcattgagaaaggagctggaaagactgggcatgagatcgcggggatggtgactgtgagggccgtatatgagattgcacgggtcaaatcgcaggatgagtgctttaagctgcgggacaccaccatgcagaacgtggtcaagagcatcatcggttcagccagatccctcggcatacaagtagtgaacgacctgtcaccagaggagtacggcgagtttctccgagagcgtgaagtgatactgaaggctcaagcagaagcagccgcagctgaagcagcagcagcagcagcagcagtcaagaagaaatga

SEQ ID NO: 37684 - protein, 196 aa, Danio rerio
MSKISKAAKAVKKSDTGGLIRAIVRSGQAAPGPPLGPILGQKGIPIGAFCKDFNERTKDLKEGIPLPVKINVKPDRTYDLKIGQPTVSYFLKQAAGIEKGAGKTGHEIAGMVTVRAVYEIARVKSQDECFKLRDTTMQNVVKSIIGSARSLGIQVVNDLSPEEYGEFLREREVILKAQAEAAAAEAAAAAAAVKKK

SEQ ID NO: 37685 - DNA, 612 bp, Rattus norvegicus
  CDS (1)..(612)
atgtcgaagctaagccgggtcactcggaccctcaagaagcccgaggccggcggcgtgatccggtccatcgtgcgagcaggccaagctatccctgggcctccattaggtcccattttgggtcagcgaggtgtctctatcaaccagttctgcaaagagttcaatgaaaaaacaaaggacatcaaagaaggcattcccttgcctacaaaaatttttataaagcccgacagaacatttgagctcaagattgggcagcccactatttcctactttttgaaggcagctgctgggattgagaagggggcccggcaaacagggaaagaggtggcaggtctggtgagtttgaagcacgtatacgagattgcccgtgtcaaagctaaggatgaggcttttgccatgcaagatgtacccctgtcttctattgtccgttccatcattggctctgcccgctccctgggcattcgtgtggtgaaagacctcagtgtagacgaactggcagcttttcagaaggaacgggccgtgtttttggctgctcagaagaggcggatttggcagctcaggcagaagctgccaaaaagtgaccccaaccttctacactctgaagtgagagactga

SEQ ID NO: 37686 - protein, 203 aa, Rattus norvegicus
MSKLSRVTRTLKKPEAGGVIRSIVRAGQAIPGPPLGPILGQRGVSINQFCKEFNEKTKDIKEGIPLPTKIFIKPDRTFELKIGQPTISYFLKAAAGIEKGARQTGKEVAGLVSLKHVYEIARVKAKDEAFAMQDVPLSSIVRSIIGSARSLGIRVVKDLSVDELAAFQKERAVFLAAQKRRIWQLRQKLPKSDPNLLHSEVRD

SEQ ID NO: 37687 - DNA, 519 bp, Dictyostelium discoideum
  CDS (1)..(519)
atgacatatattagtaaaaaacaagctgcaaaaaaagtaattgtaagagagaaaccaatcttagtaagattaaagttaataataggtgccggaacagcgtcgatgacaccaccattgggacctaatttagggcaatatggaataaatagtattgaattttttaatgattttaatacagaaacaaaagaattatttgaaacaggattagcattaagagtgatcctatggataaatgtaatgaaagcattttattttgagctacaaatgcccaaaataagtaatttattaaaggaatattataaagtagaatgtgaagccgcgaaaggtggtaatgtgtatatagaaaaagaacgattattaaaagattgttttaaaatcgcaatattactgtgtacctttaataaagcagaaaaacagtgggaacaaattgaaaaaaaatatttaagaataaccgtcttagaaatcttaggaacatgtagatcctgtaaaatatacgtaaaaaaagcagagaatgaataa

SEQ ID NO: 37688 - protein, 172 aa, Dictyostelium discoideum
MTYISKKQAAKKVIVREKPILVRLKLIIGAGTASMTPPLGPNLGQYGINSIEFFNDFNTETKELFETGLALRVILWINVMKAFYFELQMPKISNLLKEYYKVECEAAKGGNVYIEKERLLKDCFKIAILLCTFNKAEKQWEQIEKKYLRITVLEILGTCRSCKIYVKKAENE

SEQ ID NO: 37689 - DNA, 432 bp, Malawimonas jakobiformis
  CDS (1)..(432)
atgataaaacgatataaagaagtatttaaggtaacaataaatgcaaataaagctagtcctacacctccaatagggccaatgtttggtcaacgcggtataaatattatggacttttccaaagaatttaataataatacaaaagaatttaaagatgaaatgccaatacctgtagaaataactttaaataaaaatagaagtattttaataaatataaaaaaaccgaaaacgagctatataataaagaaattatgtaatatactaaaaggtagctcgcaagcaaaacattctattatttcgaatataaaaatacaacatatatatgaaatagttaaaatgttaaataaaaacaatttaacagaaaacgagtttaaaaatgaatgtaaagtattgatggcttcagcaaaatcaatgggtatagaaataacaaaataa

SEQ ID NO: 37690 - protein, 143 aa, Malawimonas jakobiformis
MIKRYKEVFKVTINANKASPTPPIGPMFGQRGINIMDFSKEFNNNTKEFKDEMPIPVEITLNKNRSILINIKKPKTSYIIKKLCNILKGSSQAKHSIISNIKIQHIYEIVKMLNKNNLTENEFKNECKVLMASAKSMGIEITK

SEQ ID NO: 37691 - DNA, 414 bp, Mycoplasma genitalium G-37
  CDS (1)..(414)
atggctaaaaaaacagttacaagaatcgctaagattaacctaattggcggacaagcaaaacctggccctgcgcttgcttctgtagggattaatatgggtgagtttaccaaacaatttaatgaaaaaaccaaggatagacaaggtgaaacgatcccttgtataatcactgcttttaacgataaatcatttacttttgtcttaaaaactacccctgttagtaacttaattaaacaagctgctaaactagaaaaaggtgctaaaaatgcaaaaactattgttggaaaaatctccttacaacaagctaaggagattgcgcaatacaagttagttgatcttaatgctaacacagttgaagcagcattaaaaatggtgttaggtacagctaaacagatgggaatagaggtaactgattaa

SEQ ID NO: 37692 - protein, 137 aa, Mycoplasma genitalium G-37
MAKKTVTRIAKINLIGGQAKPGPALASVGINMGEFTKQFNEKTKDRQGETIPCIITAFNDKSFTFVLKTTPVSNLIKQAAKLEKGAKNAKTIVGKISLQQAKEIAQYKLVDLNANTVEAALKMVLGTAKQMGIEVTD

SEQ ID NO: 37693 - DNA, 468 bp, Arabidopsis thaliana
  CDS (1)..(468)
atggcggctgctgcgaaggagatcctacggcgaccagtggcggcaacaataaggctaaccgttccggcgggaggagcgaggccagccccaccggtaggtccggcgctaggtcagtacaggcttaacctgatggctttctgcaaagacttcaacgctaggactcaaaagtacaaaccagacactccgatggccgtgacgataacggcgttcaaggacaactctttcgaattcaccgtcaagtctccgacggtgtcgtggtacatcaagaaagcagctggagtcgataaaggaagcacacgcccgggtcatttgtcggtgacgacgctatcggtgagacacgtgtacgagatcgcgaaggtgaagcagacggatccgttttgtcagtatatgccgttggaatcgatttgcaaatccatcattggtactgctaattctatgggtatcaagatcgttcaggatttggagtga

SEQ ID NO: 37694 - protein, 155 aa, Arabidopsis thaliana
MAAAAKEILRRPVAATIRLTVPAGGARPAPPVGPALGQYRLNLMAFCKDFNARTQKYKPDTPMAVTITAFKDNSFEFTVKSPTVSWYIKKAAGVDKGSTRPGHLSVTTLSVRHVYEIAKVKQTDPFCQYMPLESICKSIIGTANSMGIKIVQDLE

SEQ ID NO: 37695 - DNA, 426 bp, Thermotoga maritima MSB8
  CDS (1)..(426)
atggcgaagaaagtagcggctcagattaaattacaactgcctgccggaaaagccacgccggctccacccgttggacccgccttgggtcagcacggtgttaacatcatggagttttgtaaaaggttcaatgccgaaacagcggataaagcaggcatgatacttcctgttgttatcacagtgtacgaagacaagtcgttcactttcatcatcaaaacaccacctgcttccttccttctcaagaaagcagcgggtatagagaagggttcttccgagccaaaaagaaagatagttggaaaagttaccagaaaacagattgaagaaatagcgaaaacaaagatgccagatttgaacgcaaacagcttggaagcagccatgaagatcattgaaggaaccgctaagagtatgggaatagaagtagtggactga

SEQ ID NO: 37696 - protein, 141 aa, Thermotoga maritima MSB8
MAKKVAAQIKLQLPAGKATPAPPVGPALGQHGVNIMEFCKRFNAETADKAGMILPVVITVYEDKSFTFIIKTPPASFLLKKAAGIEKGSSEPKRKIVGKVTRKQIEEIAKTKMPDLNANSLEAAMKIIEGTAKSMGIEVVD

SEQ ID NO: 37697 - DNA, 492 bp, Halobacterium salinarum NRC-1
  CDS (1)..(492)
atggctgagacgatcgaagtgctcgttgccggtgggcaggccgaccctggcccgcccctcggtcccgagctcggtcccacgccggtcgacgtacaggcggtcgtccaggagatcaacgaccagaccgaagcgttcgacgggacggaggtcccggtcaccatcgaatacgaggacgacggctcgttctccatcgaagtcggtgttccgccgacggccgcgctggtgaaagacgaagctggcttcgacacgggctccggagagccccaggagaacttcgtcgcggacctctccatcgaacagctcaaaaccatcgccgagcagaagaaacccgacctcctggcgtacgacgcgcggaacgccgccaaagaggtcgcggggacgtgtgcgtccctcggcgtcaccatcgaaggcgaggacgcccgcacgttcaacgagcgcgtcgacgacggcgactacgacgacgtgctcggcgacgaactcgcggccgcgtaa

SEQ ID NO: 37698 - protein, 163 aa, Halobacterium salinarum NRC-1
MAETIEVLVAGGQADPGPPLGPELGPTPVDVQAVVQEINDQTEAFDGTEVPVTIEYEDDGSFSIEVGVPPTAALVKDEAGFDTGSGEPQENFVADLSIEQLKTIAEQKKPDLLAYDARNAAKEVAGTCASLGVTIEGEDARTFNERVDDGDYDDVLGDELAAA

SEQ ID NO: 37699 - DNA, 654 bp, Mycoplasma pulmonis UAB CTIP
  CDS (1)..(654)
gtggaagttgatcaatgattaacgcaattaccacacatactcgaaaggattgtgcttattatggcaaaaaaagaagttgtaaaaattgctaaattacaatttatagctgggcaagctaaaccaggaccttcattggctggtgttggaattaacatgcctgagtttactagacaatttaatgaacaaacaagagatagaggtaatgaacctgttcctgttgaaattactgcttataaagataaatcatttgattttagactttttacagcacctgcatcatttaaaattttacaagctattaaagctaaaagtggatcagcaaattcaaaaacaaacatcattggaactttaactctagctcaacttgaagaaatagctaaatataaacttccagatctaaacacagatgattacaaagttgctatgcatacaattgcaggaacagctaaaaacatgggtgttttagttgaaggttgagatgatgttaaaaaagcaaaagaagaggctaaagcagcaaaactagctcaattaaaagcagaagcaaaagaagctgctcttaaagaagctgaaaaagaattagttgattcaaaaggtaaagaagttgaagttaaacttgttggagaagaagaacaatcagaaagtgagaataactaa

SEQ ID NO: 37700 - protein, 217 aa, Mycoplasma pulmonis UAB CTIP
MEVDQWLTQLPHILERIVLIMAKKEVVKIAKLQFIAGQAKPGPSLAGVGINMPEFTRQFNEQTRDRGNEPVPVEITAYKDKSFDFRLFTAPASFKILQAIKAKSGSANSKTNIIGTLTLAQLEEIAKYKLPDLNTDDYKVAMHTIAGTAKNMGVLVEGWDDVKKAKEEAKAAKLAQLKAEAKEAALKEAEKELVDSKGKEVEVKLVGEEEQSESENN

SEQ ID NO: 37701 - DNA, 522 bp, Sulfolobus solfataricus P2
  CDS (1)..(522)
gtgaataaggtgcccataaaaacaataaaaataatggtagaaggaggtaatgttaagccaggaccaccattagcgccaacactttcgcagttagggttaaatgtaggagaagttgtcaagaaattaaatgaggctactagtagttttaaaggcatgtcagttccagttactatagaagtcgatagtagtactaaaaaatatgagataaaagtcggaatacctactactactgcattattattaaaggaagccggtgctagtgaaccatctggagatcccgcacataaaaagataggtaatttatcgttagaacaagtaattaaaatagcaattatgaaaaaaccggggttaactactaaatcgttaaaggctgcattaaaaagtatgctaggtacagctaagtctatcggactaacagtggataatagagaccctaaagaactagtaaaggaagtggaagaaggtaaatacgatgatttattagcaaaatatgagaatgaatggaatggggtgaaagagtaa

SEQ ID NO: 37702 - protein, 173 aa, Sulfolobus solfataricus P2
MNKVPIKTIKIMVEGGNVKPGPPLAPTLSQLGLNVGEVVKKLNEATSSFKGMSVPVTIEVDSSTKKYEIKVGIPTTTALLLKEAGASEPSGDPAHKKIGNLSLEQVIKIAIMKKPGLTTKSLKAALKSMLGTAKSIGLTVDNRDPKELVKEVEEGKYDDLLAKYENEWNGVKE

SEQ ID NO: 37703 - DNA, 426 bp, Bacillus subtilis subsp. subtilis str. 168
  CDS (1)..(426)
gtggctaaaaaagtagttaaagttgtaaaattgcaaattcctgctggaaaagctaacccagcaccaccagttggacctgcacttggtcaagccggtgttaacgtcatgggattctgtaaggagtttaacgctcgtacagctgaccaagctggtttaatcattcctgttgaaatttcggtttacgaagaccgttcatttacatttattacaaaaactccacctgctgcagtattgcttaaaaaagcagctggaattgagtctggttctggtgaaccaaaccgtaataaagtggcaaccgttaagcgcgataaagtacgcgaaatcgctgaaacgaaaatgcctgacttaaacgcagcagacgttgaagcggcaatgcgcatggttgaaggtactgcccgcagtatgggtattgtaatcgaggattaa

SEQ ID NO: 37704 - protein, 141 aa, Bacillus subtilis subsp. subtilis str. 168
MAKKVVKVVKLQIPAGKANPAPPVGPALGQAGVNVMGFCKEFNARTADQAGLIIPVEISVYEDRSFTFITKTPPAAVLLKKAAGIESGSGEPNRNKVATVKRDKVREIAETKMPDLNAADVEAAMRMVEGTARSMGIVIED

SEQ ID NO: 37705 - DNA, 459 bp, Thermoplasma acidophilum DSM 1728
  CDS (1)..(459)
gtgaagacgatggtggaaggtgggaaggccaccacgggaccacccataggacctgcactgggtccacttggattgaacgttgcccaggtagtcaaggagattaatgagaagacaaaggaatttcagggaatgagagtccctgttacgataaccgttgtcgatcctgagacaaagaaatacgagataaccgttggaattcctcccacctctgcactgttgaagaaaaagttgggaatagaaaagggagctgcgaagagaaaggaagcaattgctggaaatgctacgctggatcagattgttgatgttgcaaagaccaagatggcatccatgcttgcaagcgacctcaaggctgcgacacttgaggttctcgggacctgcgtatccatgggaataaacgtggatgggaaggatccgaaagaggttcagcgccaaataaaggcaggagagatctccatttaa

SEQ ID NO: 37706 - protein, 152 aa, Thermoplasma acidophilum DSM 1728
MKTMVEGGKATTGPPIGPALGPLGLNVAQVVKEINEKTKEFQGMRVPVTITVVDPETKKYEITVGIPPTSALLKKKLGIEKGAAKRKEAIAGNATLDQIVDVAKTKMASMLASDLKAATLEVLGTCVSMGINVDGKDPKEVQRQIKAGEISI

SEQ ID NO: 37707 - DNA, 435 bp, Schizosaccharomyces pombe
  CDS (1)..(435)
atggcttctactagaacgacaatcataaaattaattgtaccggcaggaaaagctacgcctacgcctccaattggacctgcccttggtgctcgcgggttgaagagcatagacttttgtaaagaatttaatgcgcggacggcaggttggatgccaaataccccagtgccttgtaaaattactgtcacacctcaaagaacatttactttcactatacatactcctccaaccagttggttaatctctaaaaccctcgaccttgaaaaaggttcaagttccccattacatgatataaagggacaattaagcttgaagcatatatatgaaattgccaaattgaaaagtactgatccaagcttacaaggaatagagcttctttctctttgtaaaagtgtcattggaacagctaaaagcatgggcgtcaaagtcgtaccttaa

SEQ ID NO: 37708 - protein, 144 aa, Schizosaccharomyces pombe
MASTRTTIIKLIVPAGKATPTPPIGPALGARGLKSIDFCKEFNARTAGWMPNTPVPCKITVTPQRTFTFTIHTPPTSWLISKTLDLEKGSSSPLHDIKGQLSLKHIYEIAKLKSTDPSLQGIELLSLCKSVIGTAKSMGVKVVP

SEQ ID NO: 37709 - DNA, 528 bp, Plasmodium falciparum 3D7
  CDS (1)..(528)
atgtccagaataggaagatttaatttaatcgttttgtctggtacggcaaaaccaagcgcaagtattggacaaaccctgggaccactaggtataaatatgatgacgttttttaaagaattcaatgatagaacgaaatgtatagccaaaaatgtaccaatacaagttacattagaacctttaaacgatagattttatttaagaacacctactgttgtgtggtttattagaagatgtgcaagagttcctatgtttagctctatggcaaaacataatactgttggttccataaccctagctgaagtttttcatattgccaagtgtaaacgtatggatccacctttgataaatttatccttaaagagtatatgtaaatatattattggaacatgcaacagcatgggcataagggtttgcaaagaattaaatgatgaagaaaagaaaaagtattttgttgatgttaataagttggataatataaaaaaagacattagaactaggaataaacaacaaaaaagatctaaaaaatga

SEQ ID NO: 37710 - protein, 175 aa, Plasmodium falciparum 3D7
MSRIGRFNLIVLSGTAKPSASIGQTLGPLGINMMTFFKEFNDRTKCIAKNVPIQVTLEPLNDRFYLRTPTVVWFIRRCARVPMFSSMAKHNTVGSITLAEVFHIAKCKRMDPPLINLSLKSICKYIIGTCNSMGIRVCKELNDEEKKKYFVDVNKLDNIKKDIRTRNKQQKRSKK

SEQ ID NO: 37711 - DNA, 546 bp, Homo sapiens
  CDS (1)..(546)
atgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggaacgttgttctgcaaatgttctaagaaatggaaagatctccatgaaggatccaagtgggagaagttcagtgtga

SEQ ID NO: 37712 - protein, 181 aa, Homo sapiens
MSKLGRAARGLRKPEVGGVIRAIVRAGLAMPGPPLGPVLGQRGVSINQFCKEFNERTKDIKEGIPLPTKILVKPDRTFEIKIGQPTVSYFLKAAAGIEKGARQTGKEVAGLVTLKHVYEIARIKAQDEAFALQDVPLSSVVRSIIGSARSLGIRVVKERCSANVLRNGKISMKDPSGRSSV

SEQ ID NO: 37713 - DNA, 543 bp, Corynebacterium efficiens YS-314
  CDS (1)..(543)
atgcctcagagcaggcctgttggtagcggcaccgagcatccggacggcagcgcccatggggtttcatcgtcccaggcgcgagccggtaacaaggaagcaggtcaaacgatggctcccaagaagaagaaggtcacaggcctcatcaagctgcagatccaggcaggacaggccaacccggctcccccggtcggccccgcactgggtgcccatggtgtcaacatcatggaattctgcaaggcctacaacgccgccaccgagaaccagcgcggcaacgtggtccctgttgagatcaccgtctacgaggatcgctccttcgatttcaagctgaagaccccaccggcagccaagctgctgctgaaggccgccggcctgcagaagggctccggcgttcctcacaccaacaaggtcggcaaggtcaccatggaccagatccgtgagatcgccgagaccaagaaggaagacctcaacgcacgcgacatcgacgccgctgcgaagatcatcgccggcaccgcccgctccatgggcatcaccgtcgagggttaa

SEQ ID NO: 37714 - protein, 180 aa, Corynebacterium efficiens YS-314
MPQSRPVGSGTEHPDGSAHGVSSSQARAGNKEAGQTMAPKKKKVTGLIKLQIQAGQANPAPPVGPALGAHGVNIMEFCKAYNAATENQRGNVVPVEITVYEDRSFDFKLKTPPAAKLLLKAAGLQKGSGVPHTNKVGKVTMDQIREIAETKKEDLNARDIDAAAKIIAGTARSMGITVEG

SEQ ID NO: 37715 - DNA, 384 bp, Eimeria tenella
  CDS (1)..(384)
atgaaaaaaaaattaattaaacttaaattaactttagaagctggaaaagctacatctaatcctccagtaggtcctttattaggtcaatacggaataaatattaatttattttgtaaagaatataataataaaacacaaaaatatataggattaaaaattccagtaattataatattttatgatcctaaaaaaattattttaaatttaaaaacaccttctttatcttatttaattttaaattttaaaaaaagtaattttattaatattaataatattaaaaaaattttatatataaaaaaaaaggaattttatcctatttctaataaaaaatatttatatatgataaagggaccattaaaatctatgaatattaatataaaataa

SEQ ID NO: 37716 - protein, 127 aa, Eimeria tenella
MKKKLIKLKLTLEAGKATSNPPVGPLLGQYGININLFCKEYNNKTQKYIGLKIPVIIIFYDPKKIILNLKTPSLSYLILNFKKSNFININNIKKILYIKKKEFYPISNKKYLYMIKGPLKSMNINIK

SEQ ID NO: 37717 - DNA, 468 bp, Oryza sativa (japonica cultivar-group)
  CDS (1)..(468)
atggcaaccactctgaaagatgcagttgcacggaagcctgtgttggcaacaatccgccttatcgttccagctggtgccgcccgccctgcgccaccagttggtccagcgctaggtttctacaggctgaacctgatggcgttctgcaaggatttcaatgccaggactcagaagtataaggcagaaactcctatgcaggttaccttaactgcctacaaggacagcacattcgagtttgtagtcaagtcaccatctgtctcatggttcctcaagaaggccgccgggattgagacagccagcggccgtccagggcacactgtagtgtcatccctttcacttcgccatgtctacgagatcgcgaaattgaagcaatctgatccctactgcaagcacatgtcactcgaggcgctgtgcaagtcaatcattggcacagccaactccatgggcattgagattgttaaagatctatga

SEQ ID NO: 37718 - protein, 155 aa, Oryza sativa (japonica cultivar-group)
MATTLKDAVARKPVLATIRLIVPAGAARPAPPVGPALGFYRLNLMAFCKDFNARTQKYKAETPMQVTLTAYKDSTFEFVVKSPSVSWFLKKAAGIETASGRPGHTVVSSLSLRHVYEIAKLKQSDPYCKHMSLEALCKSIIGTANSMGIEIVKDL

SEQ ID NO: 37719 - DNA, 438 bp, Bdellovibrio bacteriovorus HD100
  CDS (1)..(438)
ttgcaggagtgggtcatggcaaaaaaagttacaggaatgatcaagctgcagataccggcagggaaagctaatccagctccacccgttggaccggcgctcggacagcatggggtaaacatcatggaattctgtaagcagttcaacgctcgtacacaagcgttgggtgatagcatcatccctatcatcatcactgtttaccaagacagatcgtttactttcatcacaaaaacaccaccggtgtcttctttgatcaaaaaggcgttgaaactggaatccggttccaagcagcctcagaaggacaaagttggcaaaatcaataacgatcaaatcaagcaaatcgctacaacgaaattgcctgacttgaactgcttgaaagttgaatccgcaatgtcacaagttgctggtacggctaaaagcatgggcatcgacatcgcgtaa

SEQ ID NO: 37720 - protein, 145 aa, Bdellovibrio bacteriovorus HD100
MQEWVMAKKVTGMIKLQIPAGKANPAPPVGPALGQHGVNIMEFCKQFNARTQALGDSIIPIIITVYQDRSFTFITKTPPVSSLIKKALKLESGSKQPQKDKVGKINNDQIKQIATTKLPDLNCLKVESAMSQVAGTAKSMGIDIA

SEQ ID NO: 37721 - DNA, 450 bp, Eremothecium gossypii
  CDS (1)..(450)
atgtcccaacgtgccaaagagattctagttaagctgatcgtaggtgcaggccaggccgcgccgtcaccgccggttggcccggctttgggttccaaaggtatcaaagcgatggacttctgcaaagagttcaatgctcgtaccgcatcttatacgccgggtgtgccaattcccgttctcataacgatcaaacctgatcgctcattcacatttgagatgaagtctccaccgaccgggtacctacttctgcgggcattaaatcaggaaaagggacacggcaaacctaatataaagaaacctgagggcaccctaggtgagctgtcgctcaaacatatctatgagattgctaagattaaaaaggcagatggcagacacacttatttagatatggagaacatcgtgaagtctgttgtaggtgtcgcgaagagcatgggtattgcagttgttccatga

SEQ ID NO: 37722 - protein, 149 aa, Eremothecium gossypii
MSQRAKEILVKLIVGAGQAAPSPPVGPALGSKGIKAMDFCKEFNARTASYTPGVPIPVLITIKPDRSFTFEMKSPPTGYLLLRALNQEKGHGKPNIKKPEGTLGELSLKHIYEIAKIKKADGRHTYLDMENIVKSVVGVAKSMGIAVVP

SEQ ID NO: 37723 - DNA, 477 bp, Neurospora crassa
  CDS (1)..(477)
atgtccaaggccgcaaaaggtggtgctggtggtgttgagcaggtggtgaagctcattgtcggcgccggtcaggccagcccgagtcccccggtcggtccggcccttggttccaagggcatcaagtccatggacttttgcaaggagttcaacgccagaaccgcccatatcaacaccggtacccctatgcccgtccgtgttaccgtcaggcccgaccgctcgttccacttcgatgtccgcacccctcacacatcatggcttctgctcaacgccgccgaggccccgataggcaagggcggcaagagaaagggcgccagcaaccccggcaaggaggttgtcggcaccgtcagcctcaaacatgtctacgagattgccaagatcaagcagtccgagctccgtctatccggcctgcccctcgagggcctctgcagggcggtcatctaccaggccaggtcgatcggtatcaacgttatcccctga

SEQ ID NO: 37724 - protein, 158 aa, Neurospora crassa
MSKAAKGGAGGVEQVVKLIVGAGQASPSPPVGPALGSKGIKSMDFCKEFNARTAHINTGTPMPVRVTVRPDRSFHFDVRTPHTSWLLLNAAEAPIGKGGKRKGASNPGKEVVGTVSLKHVYEIAKIKQSELRLSGLPLEGLCRAVIYQARSIGINVIP

SEQ ID NO: 37725 - DNA, 1029 bp, Trypanosoma brucei
  CDS (1)..(1029)
atgctccgcgcgtgtggcgtccttcaactaagggcacggcccaagacggtgtgtgtagaacctggttcaaaccgactgcctgaagctttggtggttgagaaggcgagggatatatttgggcgacctgaatttcctgggaagcgtgtattgcacaactggcgtttctttattaaggctgggaaggcggcgacgggtcctcccgtgggacaagagttttcgaaacttgggctgaaggcgatggattttgcgaaggtgttcaatgaccggacgaagccacacttcaaggaagatgtcgagctgattgttcgcatccaagtgtactttgacaaatcgtatctttttacaattgaaccgccacctactgcgtggttcattctgcgtgcacttcggaagaagcggcgggagacgggacctgtgccgctgcgagggcactactgtgctctgatgacattggagatggcatacgaaatagcgaaaatgaaaccgttgtgttggggacgtccagagtacccgttactggagacccgtgtacgacgcgttgttgggcaagccaggcggatgggtgtttgtttcattggcgtagatacaccttacagttcccccgtgaaagatatgactgagcagcagtacacggaggaatgcgaaaggtacaggcgtatacacatggaacaatatactacgttgaggcagcgtgaacttgaagaggcaccactgattgagcggttgcaccggcccaatatgtcaccactgacggatgaacagattgaggagggtttgcgtgacccctgtttactggataccctgtggagagcgagccacccactgagcccttatcatcgtgatttgagggagcgggaacttgctcgacgttacttgaatgcacgaggttgggtgaaggacatgacgccagaggagatgcgtattgtttttatgaattaccgactccctgaaggtgagaagcggaagcagatggacgaggctgcaatgagtggggaggtgtactggacgcgtgatggggcgcagctgtga

SEQ ID NO: 37726 - protein, 342 aa, Trypanosoma brucei
MLRACGVLQLRARPKTVCVEPGSNRLPEALVVEKARDIFGRPEFPGKRVLHNWRFFIKAGKAATGPPVGQEFSKLGLKAMDFAKVFNDRTKPHFKEDVELIVRIQVYFDKSYLFTIEPPPTAWFILRALRKKRRETGPVPLRGHYCALMTLEMAYEIAKMKPLCWGRPEYPLLETRVRRVVGQARRMGVCFIGVDTPYSSPVKDMTEQQYTEECERYRRIHMEQYTTLRQRELEEAPLIERLHRPNMSPLTDEQIEEGLRDPCLLDTLWRASHPLSPYHRDLRERELARRYLNARGWVKDMTPEEMRIVFMNYRLPEGEKRKQMDEAAMSGEVYWTRDGAQL

SEQ ID NO: 37727 - DNA, 474 bp, Magnaporthe grisea 70-15
  CDS (1)..(474)
atgtccaaggcacgcgccgccgccggaggcgcagaccaaatcgttaagctcctcgtcggagccggccaggcgagccccagtcctcccgtcggtccagcactgggaagcaaaggtgtcaaatcaatggacttttgcaaggaattcaacgccaggacggcacatatcatcacgggcaccccaacgcctgtgcgcgtcgtcgtccgaccagaccgaaccttttcttttgatatccggacacctcagacctcatggttgctgctcaacgccgctgatgctccaatggggcgcaagggcaagaggaagggaaccggtttggcagggaaagagactgtaggcacagtcagcctcaaacacatctatgagattgccaaaatcaagcagacggagatgaggttatcaggccattcgctagaaggcctttgcaagtccatcatatatcagtgcaagtctattggcgtagaggttaagccttga

SEQ ID NO: 37728 - protein, 157 aa, Magnaporthe grisea 70-15
MSKARAAAGGADQIVKLLVGAGQASPSPPVGPALGSKGVKSMDFCKEFNARTAHIITGTPTPVRVVVRPDRTFSFDIRTPQTSWLLLNAADAPMGRKGKRKGTGLAGKETVGTVSLKHIYEIAKIKQTEMRLSGHSLEGLCKSIIYQCKSIGVEVKP

SEQ ID NO: 37729 - DNA, 471 bp, Gibberella zeae PH-1
  CDS (1)..(471)
atgtccaaggctcgaggtgctggaggtgtcgaccagatcgtgaaattgatcgtgggagctggacaggctagtcccagtcctcccgtcggtcctgctctgggttccaagggtgtcaagtcgatggacttttgcaaggagttcaacgcccgaactgcacacatcatcaccggtacaccaaccccttgccgagtcaccgtccgtcccgatcgatcatttacctttgatgtccgaacaccgcaaacatcatggcttctcctcaacgctgttgaagcacccatgggaaagaagggaaaacgaaagggtgccggcaagcctggccacgagactgtgggaaccatcactttgaagcacgtttacgagatcgccaagatcaagcagtccgagcttcgactctcaggcctgtctctagaaggtctttgcagggcagttatattccaagcaaagtcgataggtatcgatgtggtggcttaa

SEQ ID NO: 37730 - protein, 156 aa, Gibberella zeae PH-1
MSKARGAGGVDQIVKLIVGAGQASPSPPVGPALGSKGVKSMDFCKEFNARTAHIITGTPTPCRVTVRPDRSFTFDVRTPQTSWLLLNAVEAPMGKKGKRKGAGKPGHETVGTITLKHVYEIAKIKQSELRLSGLSLEGLCRAVIFQAKSIGIDVVA

SEQ ID NO: 37731 - DNA, 462 bp, Aspergillus nidulans FGSC A4
  CDS (1)..(462)
atggccaagaaagctatcgccaaagaccagatcgtcaaactcattgtcggagccggacaggccagtcccagtccgcccgtcggtccagctctgggtagtaagggtgtcaaaagcatggatttttgtaaggaattcaacgcgcgaacagcgcacatcactaccggagttcctattcccgcccgcgttacagtccgccccgatcgctccttccacttcgacctgcgaacgccgacaacgacgtacttactgttgcaagccgccaaggtagaaccgcgcaagaatcgaatccgcggcgcccagagacccggccatgagttcattggcaagatctccttgaagcacgtttacgagatcgcgaagatcaagcagtcagagacgagactgtcggggttgagcttggagggactttgcaagagtgttatggcacaggccaagtctgttggcattcaggttgtcccatag

SEQ ID NO: 37732 - protein, 153 aa, Aspergillus nidulans FGSC A4
MAKKAIAKDQIVKLIVGAGQASPSPPVGPALGSKGVKSMDFCKEFNARTAHITTGVPIPARVTVRPDRSFHFDLRTPTTTYLLLQAAKVEPRKNRIRGAQRPGHEFIGKISLKHVYEIAKIKQSETRLSGLSLEGLCKSVMAQAKSVGIQVVP

SEQ ID NO: 37733 - DNA, 450 bp, Candida glabrata CBS138
  CDS (1)..(450)
atgtcccaagctgcaaagaacgtattagtcaaacttattgttggcgcaggtcaagctgccccagcaccaccagttggtcctgctttaggttcaaaaggtattaaagcaattgatttctgtaaggagtttaatgcacgtactgcctcatatcaacctggtgttcccattccagttttaattacaatcagacctgatagatcttttacgtttgagatgaagtcaccaccaacaggatatctattattgaaggcgctgggagctgaaaaaggacatgggcaaccaaatattctccagaaggagaaaacattgggagaactgtctttaaagcatgtatatgagattgcaaaaataaaaaagacggatagcagacatgccatgctcgatatgccgggtatagtgaaatctataatagccgttgcaaagagcatgggaatcaaagttgtaccatag

SEQ ID NO: 37734 - protein, 149 aa, Candida glabrata CBS138
MSQAAKNVLVKLIVGAGQAAPAPPVGPALGSKGIKAIDFCKEFNARTASYQPGVPIPVLITIRPDRSFTFEMKSPPTGYLLLKALGAEKGHGQPNILQKEKTLGELSLKHVYEIAKIKKTDSRHAMLDMPGIVKSIIAVAKSMGIKVVP

SEQ ID NO: 37735 - DNA, 450 bp, Kluyveromyces lactis NRRL Y-1140
  CDS (1)..(450)
atgtcgaaggttcttaagaacgtgatagtcaaacttattgtcggagcaggtcaagctgcgccttctcctccagttggtccagctttagggtctaaaggtattaaagctattgatttctgtaaagagttcaatgccagaacagcaaacttccaaccgggtactccgattccagtactcatcaatatcaaaccagatagaacattttcgtttgaaatgaaaagccctcctactggatatcttttattgaaggcattaagtcttgagaagggacacggacaaccaaatatcagtaaccctgataatgtatgtggtgaactgtcgttaaaacatatatatgagatcgccaagatcaagaagaccgatggaagacacgctgctctggaacttgaaggaatcgtaaagtctattatcggtgttgctaagagtatgggtattaaggtagttccataa

SEQ ID NO: 37736 - protein, 149 aa, Kluyveromyces lactis NRRL Y-1140
MSKVLKNVIVKLIVGAGQAAPSPPVGPALGSKGIKAIDFCKEFNARTANFQPGTPIPVLINIKPDRTFSFEMKSPPTGYLLLKALSLEKGHGQPNISNPDNVCGELSLKHIYEIAKIKKTDGRHAALELEGIVKSIIGVAKSMGIKVVP

SEQ ID NO: 37737 - DNA, 432 bp, Debaryomyces hansenii CBS767
  CDS (1)..(432)
atgtcagctaagaatgttatggttaaattgattgtgggcgctggacaagcggcgcctgctcctccggttggtccagcgttaggttccaagggtgttaaggccatagatttttgtaaagaattcaatgcaagaactggtaattaccaaccaggtattccaattccatgcttattaaccattaagcctgatagatcattcacttttgagatgaagtcaccgcctacttcatggttgttattaaaagcagcacaagctaaaaagggatcagataagccaacgcataatatagtgggtgaagtctcgttgaaacatgtgtacgaaatcgctaagattaagaaaacagacgacagacataaggaagtagacttacaagcgatctgtggtgcggtgattctgactgctgaagcagttggtgttaaaatcgttccttag

SEQ ID NO: 37738 - protein, 143 aa, Debaryomyces hansenii CBS767
MSAKNVMVKLIVGAGQAAPAPPVGPALGSKGVKAIDFCKEFNARTGNYQPGIPIPCLLTIKPDRSFTFEMKSPPTSWLLLKAAQAKKGSDKPTHNIVGEVSLKHVYEIAKIKKTDDRHKEVDLQAICGAVILTAEAVGVKIVP

SEQ ID NO: 37739 - DNA, 666 bp, Oryza sativa (japonica cultivar-group)
  CDS (1)..(666)
atggccaccacctccttgtccctgcatggcgtcccatcccccaccgccaccaagctctcctcctcctttctcggcgcccccgcctccttcctccggccgacgccgccgccgctcgctgccccctcgcggagggcgctcgccgtcagggccatggcgccacccaagcccgggggcaagcccaagaaagtggtgggcctcataaagctggcgctggaggccgggaaggccacgccggcgccgccggtcggccccgcgcttggtgccaagggtgtgaacatcatgtccttctgcaaggagtacaatgccaagacggccgagaaggccggctacatcatccctgtcgagatcaccgtgttcgatgataaaagtttcacctttatcttgaagacccctcctgcctcagtccttctcctcaaggcagcaggtatcgagaaaggttcaaaagaaccgcagcgagagaaggttggaaaagtaacagcagatcaagtacgtacaatagctcaagagaagttgccagatttgaactgcaagagcattgactcggccatgagaattatagcgggcactgctgctaatatgggaatcgaggttgaccctccaatacttgagaagaaggaaaagatgcaaaccatttctgaacattctgcgttaactattcactgctag

SEQ ID NO: 37740 - protein, 221 aa, Oryza sativa (japonica cultivar-group)
MATTSLSLHGVPSPTATKLSSSFLGAPASFLRPTPPPLAAPSRRALAVRAMAPPKPGGKPKKVVGLIKLALEAGKATPAPPVGPALGAKGVNIMSFCKEYNAKTAEKAGYIIPVEITVFDDKSFTFILKTPPASVLLLKAAGIEKGSKEPQREKVGKVTADQVRTIAQEKLPDLNCKSIDSAMRIIAGTAANMGIEVDPPILEKKEKMQTISEHSALTIHC

SEQ ID NO: 37741 - DNA, 459 bp, Yarrowia lipolytica CLIB99
  CDS (1)..(459)
atggctcccaaaaaagcggtccagactgcaaacaccattgtgaaaatcatcgttggcgccggtgccgccaagccccagcctcccgtcggacccgtgcttggatccaagggtgtcaaggccattgatttctgcaaggagttcaacgccaagacggcccattaccaggacaacattcccattcctgttgtgttgaccatcaagcccgaccgaaccttctcgttcgagctcaaatcgccccagaccgccttcctgcttctgcgagccgccggggccgagaagggagctgccaaatacaagcctggccgggatcagcccgttggccagctgtctctcaaacacatttacgagctggctaagatcaagaagatggactcgcgacacaaggaccagcctcttgaaaacatttgcaagtccctctgtggaactgcgctttctgttggcgtggagattgttaactag

SEQ ID NO: 37742 - protein, 152 aa, Yarrowia lipolytica CLIB99
MAPKKAVQTANTIVKIIVGAGAAKPQPPVGPVLGSKGVKAIDFCKEFNAKTAHYQDNIPIPVVLTIKPDRTFSFELKSPQTAFLLLRAAGAEKGAAKYKPGRDQPVGQLSLKHIYELAKIKKMDSRHKDQPLENICKSLCGTALSVGVEIVN

SEQ ID NO: 37743 - DNA, 426 bp, Gracilaria tenuistipitata var. liui
  CDS (1)..(426)
atgggtaaaaaacttataggacttgttaaattagctctcaatgcaggtaaagctacacctgcaccaccagtaggaccagctctaggacaatacggagctaatattgttatgttttgcaaagaatataatgctagaacagcaaataaagttggtttagtaatacctgttgaaatttcaatatacgaagatcgtagcttctgtttcattttaaaaactcccccagctgctgtactactcaaaaaagcagctcagatacagagtggatcaggacagccaaacacaaaaaaaattggatctatttccttacaacaattagaagaaatcgctaaaactaaattacaagatttaaatactcaggacgtaaaaaaagcaatgaaaattgttaaaggtactgcaaaaaatatgggtattaagataaatgattag

SEQ ID NO: 37744 - protein, 141 aa, Gracilaria tenuistipitata var. liui
MGKKLIGLVKLALNAGKATPAPPVGPALGQYGANIVMFCKEYNARTANKVGLVIPVEISIYEDRSFCFILKTPPAAVLLKKAAQIQSGSGQPNTKKIGSISLQQLEEIAKTKLQDLNTQDVKKAMKIVKGTAKNMGIKIND

SEQ ID NO: 37745 - DNA, 405 bp, Bacillus cereus ZK
  CDS (1)..(405)
atggtaaaacttcaaattcctgcaggtaaagctaacccagctccaccagttggtccagcattaggacaagcaggtgttaacatcatgggcttctgtaaagagtttaacgctcgtacagcagatcaagctggtcttatcatccctgttgaaattacggtatttgaggaccgttcattcactttcattactaaaactcctcctgctgctgttcttcttaagaaagtagctggtattgagtctggttctggtgaaccaaaccgtaataaagtggcaactgttaagcgtgataaagtacgcgaaatcgctgaaactaaaatgcctgacctaaacgctgctagcgtagaagctgcaatgcgtatggttgaaggtactgcacgcagtatgggcatcgttatcgaagactaa

SEQ ID NO: 37746 - protein, 134 aa, Bacillus cereus ZK
MVKLQIPAGKANPAPPVGPALGQAGVNIMGFCKEFNARTADQAGLIIPVEITVFEDRSFTFITKTPPAAVLLKKVAGIESGSGEPNRNKVATVKRDKVREIAETKMPDLNAASVEAAMRMVEGTARSMGIVIED

SEQ ID NO: 37747 - DNA, 426 bp, Bacillus licheniformis ATCC 14580
  CDS (1)..(426)
gtggctaaaaaagtagttaaagttgtaaaattgcaaattcctgctggaaaagcgaatccagctccgccagttggtcctgcgttaggtcaagccggtgttaacatcatgggattctgtaaggagtttaacgctcgtacatctgaccaagctggtctgatcattcctgtagaaatttcggtttacgaagaccgttcatttacatttatcacaaaaactccgcctgctgctgtattgcttaaaaaagcggctggaattgagtcaggttctggtgagcctaaccgtaataaagtcgcaaccgttaaacgcgataaagtacgtgaaatcgccgaaacaaaaatgcctgacttaaatgcggcagatgttgaagcggctatgcgtatggttgaaggaactgcccgcagtatgggtattgtgatcgaagactaa

SEQ ID NO: 37748 - protein, 141 aa, Bacillus licheniformis ATCC 14580
MAKKVVKVVKLQIPAGKANPAPPVGPALGQAGVNIMGFCKEFNARTSDQAGLIIPVEISVYEDRSFTFITKTPPAAVLLKKAAGIESGSGEPNRNKVATVKRDKVREIAETKMPDLNAADVEAAMRMVEGTARSMGIVIED

SEQ ID NO: 37749 - DNA, 435 bp, Legionella pneumophila subsp. pneumophila str. Philadelphia 1
  CDS (1)..(435)
atggcaaaaaaagtagaagcatatattaaattacagattcctgcaggaaaagcaaatcctagccctccagttggacctgctttaggtcaacgtggggtaaatattatggaattctgtaaagcattcaatgctgcgacacagcaaatggaacaaggtctgcctattccagttgttatcactgtatatagtgatcgtagttttacctttataaccaagacccctccagcttcagttcttctgaaaaaggctgctggtattcaaagcggaagtggcacaccaaatactaaaaaagtagccaaactgaatgttagtcaacttgaagaaattgctaaggtcaagaaacctgatctgacagcggctgatctagcagcggcagtaagaagtattgcaggtacagcacgcagcatgggtattgaagttgaaggtttggaataa

SEQ ID NO: 37750 - protein, 144 aa, Legionella pneumophila subsp. pneumophila str. Philadelphia 1
MAKKVEAYIKLQIPAGKANPSPPVGPALGQRGVNIMEFCKAFNAATQQMEQGLPIPVVITVYSDRSFTFITKTPPASVLLKKAAGIQSGSGTPNTKKVAKLNVSQLEEIAKVKKPDLTAADLAAAVRSIAGTARSMGIEVEGLE

SEQ ID NO: 37751 - DNA, 432 bp, Methylococcus capsulatus str. Bath
  CDS (1)..(432)
atggcaaagaaaatcacaggttacatcaagcttcaggtcaaggccggtgaagccaatccgagtccgccggtcggtccggcgcttggccagcgtggcgtcaacatcatggaattctgcaaggcattcaatgcccagacccagaacgtcgagaaagggcttccgctccccgtcgtcatcacggtgtatgcggaccgtagttttacgttcatcaccaagaccccgccggcgtccgtgctcctgaagaaggcgctcgggctgaagtccggaagttccaagccgaacaccgataaggtcgggacggtcacgcgggctcagctggaagaaatcgccaagatgaagatgccggatttgacggcggcggacatggacgccgccgtgcgcaccattgccggcagtgcgaccagcatgggtttgattgtggagggtgtgtga

SEQ ID NO: 37752 - protein, 143 aa, Methylococcus capsulatus str. Bath
MAKKITGYIKLQVKAGEANPSPPVGPALGQRGVNIMEFCKAFNAQTQNVEKGLPLPVVITVYADRSFTFITKTPPASVLLKKALGLKSGSSKPNTDKVGTVTRAQLEEIAKMKMPDLTAADMDAAVRTIAGSATSMGLIVEGV

SEQ ID NO: 37753 - DNA, 450 bp, Mycoplasma hyopneumoniae 232
  CDS (1)..(450)
atggcaaagaaaaatgttgtccgggttgctaaattgcaatttaatgccgggcaagcaaaacctggcccagcccttgcaggtcttgggattgttatgccagagtttacccgaaaatttaatgatgaaactaaaaatcgcggagatgaaccggttccggtaaaaataactgtttttaaggacaaaagttttgaatttcagttatttactagcccaacatcttataaaattaagcaggcagccaaaattgaatcaggttctaaaaaatcaaaaactgaaaaagtaggaaaaattacttttgaccaattaagagagatagcggaatataaattacctgatttaaataccgaaaatctcgataaagcgattttaacagtttatggtacagcaatgcaaatgggcgttgaggttgagggaattgaagaatttatccaaaagcaaggaggaaaataa

SEQ ID NO: 37754 - protein, 149 aa, Mycoplasma hyopneumoniae 232
MAKKNVVRVAKLQFNAGQAKPGPALAGLGIVMPEFTRKFNDETKNRGDEPVPVKITVFKDKSFEFQLFTSPTSYKIKQAAKIESGSKKSKTEKVGKITFDQLREIAEYKLPDLNTENLDKAILTVYGTAMQMGVEVEGIEEFIQKQGGK

SEQ ID NO: 37755 - DNA, 435 bp, Nocardia farcinica IFM 10152
  CDS (1)..(435)
atgccccccaagaagaagaagctcgccgggatcatcaagcttcagatccaggccggccaggcgaacccggctccgccggtgggtcccgccctcggccagcacggcgtcaacatcatggagttctgcaaggcgtacaacgccgcgaccgagtcgcagcgtggcaacgtcatcccggtcgagatctcggtgtacgaggaccggaccttcgacttcaagctgaagacgccccccgccgccaagctgctgctcaaggccgccggcgtgcagaagggctcggccgagccgcaccgcaacaaggtcgcgaaggtcacgatggaccaggtgcgcgagatcgccaagaccaagatggaagatctcaacgccaacgacatcgaccaggccgcgaagatcatcgcgggcaccgcgcgctcgatgggtatcaccgtcgaggcgtaa

SEQ ID NO: 37756 - protein, 144 aa, Nocardia farcinica IFM 10152
MPPKKKKLAGIIKLQIQAGQANPAPPVGPALGQHGVNIMEFCKAYNAATESQRGNVIPVEISVYEDRTFDFKLKTPPAAKLLLKAAGVQKGSAEPHRNKVAKVTMDQVREIAKTKMEDLNANDIDQAAKIIAGTARSMGITVEA

SEQ ID NO: 37757 - DNA, 489 bp, Haloarcula marismortui ATCC 43049
  CDS (1)..(489)
atggctggaactatcgaagtcctcgttcccggtggggaggccaaccctggcccgccactcggtccggaactcggcccgacaccggtggacgtgcaggcagtcgtacaggagatcaacgaccagacggcagcgttcgacggcaccgaagtccccgtcaccgtcaagtatgacgacgacggttctttcgagatcgaagtcggtgtcccgccgacggccgaactcatcaaggacgaggctggcttcgaaaccggcagcggcgagccccaggaggacttcgtcgctgacctctctgtcgaccaggtcaaacagatcgccgagcagaagcaccccgacctgctctcctacgacctcacgaacgccgcaaaagaagtcgttgggacgtgcacctctctcggtgtcactattgaaggcgagaacccacgcgagttcaaggagcgcatcgacgcaggcgagtacgacgacgtgtttgcggccgaagcccaagcgtaa

SEQ ID NO: 37758 - protein, 162 aa, Haloarcula marismortui ATCC 43049
MAGTIEVLVPGGEANPGPPLGPELGPTPVDVQAVVQEINDQTAAFDGTEVPVTVKYDDDGSFEIEVGVPPTAELIKDEAGFETGSGEPQEDFVADLSVDQVKQIAEQKHPDLLSYDLTNAAKEVVGTCTSLGVTIEGENPREFKERIDAGEYDDVFAAEAQA

SEQ ID NO: 37759 - DNA, 426 bp, Geobacillus kaustophilus HTA426
  CDS (1)..(426)
gtggcgaaaaaagtaatcaaggtcgtcaaactgcaaattcctgcagggaaagcgaatccggcgccgccagtaggtcctgcgttgggtcaagccggtgtcaatattatggcgttttgcaaagagtttaatgcccgcacggcggaccaagcagggttgatcattccggttgaaattacggtttttgaagaccgttcatttacattcatcacgaaaacgccgccagccgctgtattgctgaaaaaagcggcgggcattgaatcgggctccggcgaaccgaaccgcaacaaagtggcgacaattaaacgcgacaaagtacgtgagatcgctgagctgaaaatgccggatttgaatgcggcgagcattgaggcggccatgcgcatgatcgaaggcacggcccgcagcatgggcattgtgattgaagactaa

SEQ ID NO: 37760 - protein, 141 aa, Geobacillus kaustophilus HTA426
MAKKVIKVVKLQIPAGKANPAPPVGPALGQAGVNIMAFCKEFNARTADQAGLIIPVEITVFEDRSFTFITKTPPAAVLLKKAAGIESGSGEPNRNKVATIKRDKVREIAELKMPDLNAASIEAAMRMIEGTARSMGIVIED

SEQ ID NO: 37761 - DNA, 444 bp, Anaplasma marginale str. St. Maries
  CDS (1)..(444)
atgagtagcgctgcgttgctttcacggataaatttagtaattgaggcagggaaggccatgccaggccccaaggtcgcttctgtgcttggtccgcgcggtattcctatgccaaagttttgcaaggagtttaatgatgccacgagtgcgcagggcgtcccttacgagacgggggacctagttactgccaggataagcgtctatgccgataatagctacagtttttctgtgagcgattcacccgtgtcatttttgttgaagaaggctgctggggttaccaaggggtcctccagccccggcaaggaaagttgtacgagcataaagatgtctgaggttgttaaaatcgctgagcggaagatggctgatatgaacgcggatagcgtggaatgtgccgttaagatggtggttggaaccgcgaagtctatgggcatgactgttgaggaatga

SEQ ID NO: 37762 - protein, 147 aa, Anaplasma marginale str. St. Maries
MSSAALLSRINLVIEAGKAMPGPKVASVLGPRGIPMPKFCKEFNDATSAQGVPYETGDLVTARISVYADNSYSFSVSDSPVSFLLKKAAGVTKGSSSPGKESCTSIKMSEVVKIAERKMADMNADSVECAVKMVVGTAKSMGMTVEE

SEQ ID NO: 37763 - DNA, 429 bp, Idiomarina loihiensis L2TR
  CDS (1)..(429)
atggcgaagaaagtatcggccattatcaaattacaggtagctgctggttcagctaacccgtcaccgccagttggtcctgcattgggtcagcacggtgtgaacattatggaattctgtaaagcgttcaacgcacagaccgacagcctggaaaaaggcgctccggttcctgttgaaattacagtgttcgaagaccgttcattcacatttattaccaaaacgcctcctgcgtctttcttattgaagaaagcggctggtatcaaaagtggttcaggcgagccgaacaccaagaaagttggtacggtaactcgcgcgcaattagaagaaattgcgaaaactaaagaaccagacctgactgctgccgacatggacgcagctgtacgcactatcgccggctctgctcgcgcgatgggcttgaacgtggagggctaa

SEQ ID NO: 37764 - protein, 142 aa, Idiomarina loihiensis L2TR
MAKKVSAIIKLQVAAGSANPSPPVGPALGQHGVNIMEFCKAFNAQTDSLEKGAPVPVEITVFEDRSFTFITKTPPASFLLKKAAGIKSGSGEPNTKKVGTVTRAQLEEIAKTKEPDLTAADMDAAVRTIAGSARAMGLNVEG

SEQ ID NO: 37765 - DNA, 432 bp, Azoarcus sp. EbN1
  CDS (1)..(432)
atggcgaagaaaatcaccggctatatcaagctgcaggtgccagctggtaaagccaaccccagccccccgatcggtcccgcactcggtcagcgcggcctgaacatcatggaattctgcaaggcgttcaacgcccggacccaggggctcgagcccggtctgccgattccggtggtgatcacggcgttcgccgacaagtccttcaccttcatcatgaagacgccgccggcgacgatcctgatcaagaaggctgcgaagatcacgaagggttcgccgaagccgcacaccgacaaggtcggttcgatcacgcgcgcccaggtcgaggaaatcgccaagaccaagatggccgatctgactgctgccgacatggaagccgcggtgcgcaccatcgccggttccgcccgcagcatgggcatcaccgtggaggggctgtaa

SEQ ID NO: 37766 - protein, 143 aa, Azoarcus sp. EbN1
MAKKITGYIKLQVPAGKANPSPPIGPALGQRGLNIMEFCKAFNARTQGLEPGLPIPVVITAFADKSFTFIMKTPPATILIKKAAKITKGSPKPHTDKVGSITRAQVEEIAKTKMADLTAADMEAAVRTIAGSARSMGITVEGL

SEQ ID NO: 37767 - DNA, 432 bp, Zymomonas mobilis subsp. mobilis ZM4
  CDS (1)..(432)
atggcaaaaaaaattaccggctatatcaagctgcaagtgccggcaggtaaagctaatccaagtccgccaatcggcccggctttgggtcagcgcggtgtcaacatcatggaattctgcaaggcatttaatgccaaatcgcagggcatggaaccgggcaccccgttgccgacgatcatcaccgtttatgctgatcgttctttctctttcgaaagcaagatgccgccggtttcttaccttttgaaaaaagcgatcaacctgaaatctggttcgaaagaacccggtaaggctgttgctggtaagatcaagcgttctcagatcgtcgaaatcgccaacaccaaaatgcctgatcttaatgccaatgatgttgaagcagctacgcgcatcatcgaaggttctgcccgtgcaatgggcctcgaagtagtggagggctaa

SEQ ID NO: 37768 - protein, 143 aa, Zymomonas mobilis subsp. mobilis ZM4
MAKKITGYIKLQVPAGKANPSPPIGPALGQRGVNIMEFCKAFNAKSQGMEPGTPLPTIITVYADRSFSFESKMPPVSYLLKKAINLKSGSKEPGKAVAGKIKRSQIVEIANTKMPDLNANDVEAATRIIEGSARAMGLEVVEG

SEQ ID NO: 37769 - DNA, 426 bp, Silicibacter pomeroyi DSS-3
  CDS (1)..(426)
atggccaagaaactgatcggcacgctgaagcttcaggtgcccgcaggcaaggcgaacccgtcgccgccagttggtccggcgctgggtcagcgcggcatcaacatcatggaattctgcaaggcgttcaacgccaagaccgcagacatggaagtgggcgcaccctgcccgaccgtgatttcctattatcaggacaagtcctttaccatggacatcaagacgccgccggcgtcgtatttcctgaagaaagcagccaagatccagtcgggcgccaacaagccctcgcgcgagaccgccggcaccgtgaccgtcgctcagatccgcgagatcgccgaagcgaagatgaaggatctgaacgccaacgatatcgacggcgcaatgcagatcatcctgggctctgcccggtccatgggcatcgaggtgaagtaa

SEQ ID NO: 37770 - protein, 141 aa, Silicibacter pomeroyi DSS-3
MAKKLIGTLKLQVPAGKANPSPPVGPALGQRGINIMEFCKAFNAKTADMEVGAPCPTVISYYQDKSFTMDIKTPPASYFLKKAAKIQSGANKPSRETAGTVTVAQIREIAEAKMKDLNANDIDGAMQIILGSARSMGIEVK

SEQ ID NO: 37771 - DNA, 435 bp, Francisella tularensis subsp. tularensis Schu 4
  CDS (1)..(435)
atggctaagaaaaaaatagaagctattattaagttgcaagttgcagcaggaaaagctaaccctagtccaccaattggtccagcgctgggtcagcatggtgttaatattatgggattctgtaaagagtttaatgctaagacacaaggtatggagccaggtatgccaataccggtagaaatatctgtttatagtgatcgtagttttacgtttgaaatgaagacgccacctgcttcttacttaattaagaaagcaattaatgtaaaatcaggttcatcaaagccttctaaagagtttgttggaactataactcgtgcgcaattagaagagatcgcaaaagttaaagatcctgatctaacagctgctgatttagatgctgctgtaagaattattgctggttctgctcgtagtatgggcgtaaaagtagagggggtttaa

SEQ ID NO: 37772 - protein, 144 aa, Francisella tularensis subsp. tularensis Schu 4
MAKKKIEAIIKLQVAAGKANPSPPIGPALGQHGVNIMGFCKEFNAKTQGMEPGMPIPVEISVYSDRSFTFEMKTPPASYLIKKAINVKSGSSKPSKEFVGTITRAQLEEIAKVKDPDLTAADLDAAVRIIAGSARSMGVKVEGV

SEQ ID NO: 37773 - DNA, 426 bp, Synechococcus elongatus PCC 6301
  CDS (1)..(426)
atggcaaaaaaagtcgttgcactgattaagttagccttgcccgctggcaaagctaacccggcgcctcccgtgggtcctgccctgggtcagcacggcgtcaacatcatggccttctgtaaggagtacaacgcccggacccaagacaaagttggcttggtcattccggtcgaaatctccgtttttgaagaccgcagtttcaccttcattctcaaaaccccgcccgcttcggtgttgatcgccaaagctgctgggattgagcgtggttcgggtaaccccaacaaaaccaaagtcggcaaaatcacgaccgcgcaactgcgcgagattgctgaaaccaaactgccggacttcaacaccaaaaacgttgaagccgccatgcgcatcgtcgaaggcactgcccgcaacatgggtgtcacgatcgccgactag

SEQ ID NO: 37774 - protein, 141 aa, Synechococcus elongatus PCC 6301
MAKKVVALIKLALPAGKANPAPPVGPALGQHGVNIMAFCKEYNARTQDKVGLVIPVEISVFEDRSFTFILKTPPASVLIAKAAGIERGSGNPNKTKVGKITTAQLREIAETKLPDFNTKNVEAAMRIVEGTARNMGVTIAD

SEQ ID NO: 37775 - DNA, 426 bp, Bacillus clausii KSM-K16
  CDS (1)..(426)
gtggctaaaaaggtaattaaaatggttaagctacaaatccctgcgggtaaagccaatccggcaccaccagttggaccggctctcggtcaagcaggtgtgaacattatgggattttgtaaagaatttaacgctcgtacatctgaccaagcaggtttgattattccagtggaaatcactgtatttgaagaccgttcgtttacattcatcacgaaaacgccacctgctgctgtgctattgaaaaaagcggcagggattgactcaggttctggcgagccgaatcgtacaaaagttgcaacggttaaacgcgataaagtacgtgagattgctgaaacaaaaatgccagatctgaatgcggcttctgtagaagcggctatgcgcatggttgagggtacagcccgcagcatgggcattgtgattgaagactaa

SEQ ID NO: 37776 - protein, 141 aa, Bacillus clausii KSM-K16
MAKKVIKMVKLQIPAGKANPAPPVGPALGQAGVNIMGFCKEFNARTSDQAGLIIPVEITVFEDRSFTFITKTPPAAVLLKKAAGIDSGSGEPNRTKVATVKRDKVREIAETKMPDLNAASVEAAMRMVEGTARSMGIVIED

SEQ ID NO: 37777 - DNA, 444 bp, Ehrlichia ruminantium str. Welgevonden
  CDS (1)..(444)
atgagtgctgttttagtatctaaaataaatttaatgatagaagctggcaaggctaatcctggacctaaaattgcttctgtattgggtcctcgtggtataccaatgcctaagttttgtaaggagtttaatgatattacaagtagtgcaggtaatcaatataaagttggcgatgtggttactgctaggatatcgatttataatgataagtcttatagttttacaattagtgattctcctgtaccttatttattaaaaaaagctgctgcagttgacaaaggctcagtcaatccagggaaagacagtgtggggaaagttaaaatgtcagctatttatgaaatagcaaaacgtaagatgtctgatatgaatgctgatacagtagatgctgcagttaagatggtgattggtacagcgtcttctatgggtattattgtagagaaggattaa

SEQ ID NO: 37778 - protein, 147 aa, Ehrlichia ruminantium str. Welgevonden
MSAVLVSKINLMIEAGKANPGPKIASVLGPRGIPMPKFCKEFNDITSSAGNQYKVGDVVTARISIYNDKSYSFTISDSPVPYLLKKAAAVDKGSVNPGKDSVGKVKMSAIYEIAKRKMSDMNADTVDAAVKMVIGTASSMGIIVEKD

SEQ ID NO: 37779 - DNA, 423 bp, Dehalococcoides ethenogenes 195
  CDS (1)..(423)
gtggcaaaaaaagtaaaggcaattgtaaagttacagatacccgcaggtaaagctaatcctgctcctcccattggtccggcgctgggtcagcacggtatcaatatcatggggttctgtaaggaatataatgaccgcacagcctctatggcgggcactattgtacctgctgagataaccatttatgatgaccgctcttttacctttattaccaagacccctccggcggctgaccttttgaaaaaggcggctggtgttgaggcaggttcgggtactcccagcaagagcgtagttgccgttatctcaaaggggcagctcagggaaattgcttcggtcaagatgaaagacctgaatgcggttaatattgagggtgctgagagaattattgaaggtactgcccgcagcatgggcattaaggtggaataa

SEQ ID NO: 37780 - protein, 140 aa, Dehalococcoides ethenogenes 195
MAKKVKAIVKLQIPAGKANPAPPIGPALGQHGINIMGFCKEYNDRTASMAGTIVPAEITIYDDRSFTFITKTPPAADLLKKAAGVEAGSGTPSKSVVAVISKGQLREIASVKMKDLNAVNIEGAERIIEGTARSMGIKVE

SEQ ID NO: 37781 - DNA, 453 bp, Rhodobacter sphaeroides 2.4.1
  CDS (1)..(453)
atggccaagaagattatcggcagcctcaagctgcaagtgaaggcgggtcaagccaacccgtccccgccggtcggtccggcgctgggtcagcgcggcctgaacatcatggccttcgtgaaggaattcaacgcgaagtccgccgacctcgagccgggcacgcccacgcccgtcatcatcacctactaccaagacaagtccttcagcctcgagctgaagacgccgccggcgtccttcatgctgaagaaggctgcgggcctcgctccggtgggcaagcggaaccgtccgaagggctcgaccaagccgggccgcgaagtggcgggttcggtgaccgtggcgcagatccgcaagatcgccgaagccaagatgaaggatctgaacgccaacgacgtcgaggcggcgatgcagatcatcctcggctcggccaaatcctgcggcatcgaggtcaaggggtaa

SEQ ID NO: 37782 - protein, 150 aa, Rhodobacter sphaeroides 2.4.1
MAKKIIGSLKLQVKAGQANPSPPVGPALGQRGLNIMAFVKEFNAKSADLEPGTPTPVIITYYQDKSFSLELKTPPASFMLKKAAGLAPVGKRNRPKGSTKPGREVAGSVTVAQIRKIAEAKMKDLNANDVEAAMQIILGSAKSCGIEVKG

SEQ ID NO: 37783 - DNA, 426 bp, Lactobacillus gasseri
  CDS (1)..(426)
atggcaaagaaagttattaacgtagttaaactgcaaattcctgctggtgcagcaactcctgcacctccagttggtcctgcattgggtcaagctggaatcaacatcgttggtttcactaaggacttcaacgcacgtactgctgatcaaaagggtatgattatccctgtagttattacagtatatgaagatcgttcattcgaattcattactaagactccaccagcagctgttcttttgaagaaggctgccaaggttgacaagggttctggtgaacctaacactaagaaggttgctaaggtaactaaggaccaagttaaggaaattgccgaaaccaagatgaaagatctaaacgctgcagatgttgaagctgctatgcgcatgattgaaggtactgctagaagcatgggcttcactgtagaagactag

SEQ ID NO: 37784 - protein, 141 aa, Lactobacillus gasseri
MAKKVINVVKLQIPAGAATPAPPVGPALGQAGINIVGFTKDFNARTADQKGMIIPVVITVYEDRSFEFITKTPPAAVLLKKAAKVDKGSGEPNTKKVAKVTKDQVKEIAETKMKDLNAADVEAAMRMIEGTARSMGFTVED

SEQ ID NO: 37785 - DNA, 432 bp, Azotobacter vinelandii
  CDS (1)..(432)
atggctaagaagattcaagcttatatcaagctgcaggtgaaggccggtcaggccaacccgtcgccgccggtcggtcctgccctgggccagcacggggtcaacatcatggagttctgcaaggcgttcaacgccaggacccaaggcatggagccgggcctgccgactccggtgatcatcaccgtctatagcgaccgcagttttaccttcgaaaccaagagcaccccggcgtctgttctgctgaagaaagcggctggcatctccagtggttcttcccgcccgaacacccagaaggtcggcaccgtgaaccgtgcccagttggaggagatcgccaaggccaagcaggccgatctgaccgccgctgacctggaagccgctgtacgcaccatcgctggctctgcacgcagcatgggcctgaatgtggagggtgtttaa

SEQ ID NO: 37786 - protein, 143 aa, Azotobacter vinelandii
MAKKIQAYIKLQVKAGQANPSPPVGPALGQHGVNIMEFCKAFNARTQGMEPGLPTPVIITVYSDRSFTFETKSTPASVLLKKAAGISSGSSRPNTQKVGTVNRAQLEEIAKAKQADLTAADLEAAVRTIAGSARSMGLNVEGV

SEQ ID NO: 37787 - DNA, 447 bp, Desulfovibrio desulfuricans G20
  CDS (1)..(447)
atgatacccatagaggttacagcaatggctaagaaagaaatagcaaagatcaaacttcagattcaggcaggcgcagcgaatccctctccgcctgttggccccgcactgggtcagcacggcctgaacatcatggagttctgcaaggcgttcaacgcccggactcaggatcagaaaggcatggtgattcccgtagtgatcaccgcatatgccgaccgttccttcacgttcatcaccaaaactccccccgcctcggttctgctggccaaggccgccaaggtcgccaagggttccggagaacccaacaagaccaaggtcggttccgtgaccatggaacaggtggaagaaatcgccaagttgaagatgcctgacctttctgccaaagatctgcccggtgccgtgaaaacgatcgcaggtaccgcacgcagcatgggcattgacgtcaagtag

SEQ ID NO: 37788 - protein, 148 aa, Desulfovibrio desulfuricans G20
MIPIEVTAMAKKEIAKIKLQIQAGAANPSPPVGPALGQHGLNIMEFCKAFNARTQDQKGMVIPVVITAYADRSFTFITKTPPASVLLAKAAKVAKGSGEPNKTKVGSVTMEQVEEIAKLKMPDLSAKDLPGAVKTIAGTARSMGIDVK

SEQ ID NO: 37789 - DNA, 426 bp, Fusobacterium nucleatum subsp. vincentii ATCC 49256
  CDS (1)..(426)
atggcaaaagaagtaattcaaataataaaactacaattaccagcaggtaaagcaaaccctgctccaccagttggaccagcattaggacaacatggtgtaaatataatggaattttgtaaggcatttaatgctaaaactcaagataaggctggatggataattcctgttgaaatatctgtttttagtgacagatctttcacattcatattaaaaactccacctgcatcagacttattaaagaaggctgctggaataacatctggagctaaaaattctaaaaaagaagttgcaggaaaaattactactgcaaagttaaaagaactagctgaaactaaaatgcctgacttaaatgcttcatctattgaaacagctatgaagataattgcgggatcagcaagatctatgggaataaaaatagaagactaa

SEQ ID NO: 37790 - protein, 141 aa, Fusobacterium nucleatum subsp. vincentii ATCC 49256
MAKEVIQIIKLQLPAGKANPAPPVGPALGQHGVNIMEFCKAFNAKTQDKAGWIIPVEISVFSDRSFTFILKTPPASDLLKKAAGITSGAKNSKKEVAGKITTAKLKELAETKMPDLNASSIETAMKIIAGSARSMGIKIED

SEQ ID NO: 37791 - DNA, 486 bp, Methanococcoides burtonii DSM 6242
  CDS (1)..(486)
atggcaagtgttgtagaagcattaattcctggcggtaaagcaaatcccggtcctccactgggccctgcgctgggacctcttggtgttaatattaaagacgtgatcgaaaagatcaatgaaaagacaaaagattacaatgggatgcaggttcctgttaaggttatcgttaatgacgataagagtgttgagatcgaagtgggtactccaccaacatccgcattaatccttaaggaacttaacatcgaaaagggctccggtgagtccggtactgttgttgttggtaatcttgagatcgcacaggtcgcaaagatcgcacgtatgaagaaagatgatatcctttcctattcgcttaaggctgcaatcaaagaagtcatgggaacctgtgttcctatgggtgtaacgattgaaaaccttgacccaagggaatgccagaaagctgttgatgagggcaagttcgacgagtctctcacagcagaagcatggtaa

SEQ ID NO: 37792 - protein, 161 aa, Methanococcoides burtonii DSM 6242
MASVVEALIPGGKANPGPPLGPALGPLGVNIKDVIEKINEKTKDYNGMQVPVKVIVNDDKSVEIEVGTPPTSALILKELNIEKGSGESGTVVVGNLEIAQVAKIARMKKDDILSYSLKAAIKEVMGTCVPMGVTIENLDPRECQKAVDEGKFDESLTAEAW

SEQ ID NO: 37793 - DNA, 432 bp, Dechloromonas aromatica RCB
  CDS (1)..(432)
atggccaagaaaattattggctacatcaagctgcaagtgccagccggcaaagcaaacccgtcgcccccgatcggcccagccctcggtcagcgcggtctgaacatcatggaattctgcaaggccttcaatgcccagactcaaggcgttgaaccgggtctgccgattcctgtcgtaattaccgcctttgcggacaagtctttcacgttcgtgatgaagaccccgccggccaccatcctgatcaagaaggctgctggtatcaagtccggttcggccaagccgcacaccgacaaggttggcaagatcacccgcgcccagtgcgaagaaatcgccaagaccaagtcgcctgacttgaccgctgccgatatggaagcagcaattcgcaccatcgccggctccgcccgttcgatgggtatcacggtagagggtctgtaa

SEQ ID NO: 37794 - protein, 143 aa, Dechloromonas aromatica RCB
MAKKIIGYIKLQVPAGKANPSPPIGPALGQRGLNIMEFCKAFNAQTQGVEPGLPIPVVITAFADKSFTFVMKTPPATILIKKAAGIKSGSAKPHTDKVGKITRAQCEEIAKTKSPDLTAADMEAAIRTIAGSARSMGITVEGL

SEQ ID NO: 37795 - DNA, 429 bp, Haemophilus influenzae R2866
  CDS (1)..(429)
atggcaaaaaaagtccaagcctatgttaagttgcaagttgcagctggtatggctaacccatcaccaccagttggtcctgcattaggtcagcaaggtgtgaacattatggaattctgtaaagcattcaacgctcgtactgagagcttagaaaaaggtttaccaattccagttgttatcactgtatatgcagaccgttcatttactttcgtcactaaaactccaccagcagcagtattattgaaaaaagctgcaggtatcaaatctggttctggtaaaccgaataaagataaagtgggtaaagtaactttagatcaagttcgtcaaatcgctgaaactaaagcagcagatatgactggcgcgtctatcgaaaccaaaatgaaatcaattgctggtactgctcgctctatgggcttagtggtggaggaataa

SEQ ID NO: 37796 - protein, 142 aa, Haemophilus influenzae R2866
MAKKVQAYVKLQVAAGMANPSPPVGPALGQQGVNIMEFCKAFNARTESLEKGLPIPVVITVYADRSFTFVTKTPPAAVLLKKAAGIKSGSGKPNKDKVGKVTLDQVRQIAETKAADMTGASIETKMKSIAGTARSMGLVVEE

SEQ ID NO: 37797 - DNA, 426 bp, Synechococcus elongatus PCC 7942
  CDS (1)..(426)
atggcaaaaaaagtcgttgcactgattaagttagccttgcccgctggcaaagctaacccggcgcctcccgtgggtcctgccctgggtcagcacggcgtcaacatcatggccttctgtaaggagtacaacgcccggacccaagacaaagttggcttggtcattccggtcgaaatctccgtttttgaagaccgcagtttcaccttcattctcaaaaccccgcccgcttcggtgttgatcgccaaagctgctgggattgagcgtggttcgggtaaccccaacaaaaccaaagtcggcaaaatcacgaccgcgcaactgcgcgagattgctgaaaccaaactgccggacctcaacaccaaaaacgttgaagccgccatgcgcatcgtcgaaggcactgcccgcaacatgggtgtcacgatcgccgactag

SEQ ID NO: 37798 - protein, 141 aa, Synechococcus elongatus PCC 7942
MAKKVVALIKLALPAGKANPAPPVGPALGQHGVNIMAFCKEYNARTQDKVGLVIPVEISVFEDRSFTFILKTPPASVLIAKAAGIERGSGNPNKTKVGKITTAQLREIAETKLPDLNTKNVEAAMRIVEGTARNMGVTIAD

SEQ ID NO: 37799 - DNA, 327 bp, Methylobacillus flagellatus KT
  CDS (1)..(327)
atggagttctgcaaggcatttaatgcagcaacccaaagcatggaacccggattgcccattccggttgtgatcactgcattcgcggacaagagcttcacattcgtgatgaagactcctcctgccaccatcctgatcaagaaggctgccaagatcgacaagggatcccctcgtcctcataccgataaggtcggcaaaattacacgtgcgcaagcagaagagatcgccaaaaccaaagcgcctgatctgacggcagcagatctggatgctgcagtgcgtactatcgcaggtagcgcacgcagtatgggtattgaagtggagggcgtgtaa

SEQ ID NO: 37800 - protein, 108 aa, Methylobacillus flagellatus KT
MEFCKAFNAATQSMEPGLPIPVVITAFADKSFTFVMKTPPATILIKKAAKIDKGSPRPHTDKVGKITRAQAEEIAKTKAPDLTAADLDAAVRTIAGSARSMGIEVEGV

SEQ ID NO: 37801 - DNA, 429 bp, Mesorhizobium sp. BNC1
  CDS (1)..(429)
atggctaagaaaattgcaggccagctcaagcttcaggttcccgcggggtcggccacgccgtcgcctccgatcggccctgcgcttggtcagcgtggcatcaatatcatggagttctgcaaggcgttcaacgcgcagagccaggacttggagaagggctcgcccatcccggtggtcataacctactaccaggataagtcgttcaccttcaccatgaagaccccgccggtgagctacttcctcaagaaggcggcgaacctgaagtcgggatcgaaggagccgggcaagcagtccgcgggccagatttcgcgagccaaggtgcgcgagatcgccgagacgaagatgaaggatctgaacgcgaacgatgtggaagccgccatgcgcatggtggaaggctccgcccgttccatgggcctcgaggttgtagggtaa

SEQ ID NO: 37802 - protein, 142 aa, Mesorhizobium sp. BNC1
MAKKIAGQLKLQVPAGSATPSPPIGPALGQRGINIMEFCKAFNAQSQDLEKGSPIPVVITYYQDKSFTFTMKTPPVSYFLKKAANLKSGSKEPGKQSAGQISRAKVREIAETKMKDLNANDVEAAMRMVEGSARSMGLEVVG

SEQ ID NO: 37803 - DNA, 438 bp, Rubrobacter xylanophilus DSM 9941
  CDS (1)..(438)
atgggcagagggcgcgggaagcgcgtcgtgcgcaagctgaagctgcagataccgggcgggcaggccaacccggcgccgcccgtgggcccggctctgggccaggcccaggtgaacatcggggagttcgtccggcagttcaacgacgccacgcgggacaggatggggcagctgatcccggtggagatcacggtctacgaggaccgctcgttcaccttcgtgaccaagacgccacccgcggcgttcctgctgaagcaggcggcgggggtcgagaagggcagcggcgagccgaaccgcagcgcggcggggcgggtcagccgggcccaggtggaggagatagccaggacgaagatgccggacctcaacgccgcggacgtggaggcggcggtgaagatcatcgagggcacggcccggagcatgggcataaaggtggagcagtga

SEQ ID NO: 37804 - protein, 145 aa, Rubrobacter xylanophilus DSM 9941
MGRGRGKRVVRKLKLQIPGGQANPAPPVGPALGQAQVNIGEFVRQFNDATRDRMGQLIPVEITVYEDRSFTFVTKTPPAAFLLKQAAGVEKGSGEPNRSAAGRVSRAQVEEIARTKMPDLNAADVEAAVKIIEGTARSMGIKVEQ

SEQ ID NO: 37805 - DNA, 432 bp, Psychrobacter sp. 273-4
  CDS (1)..(432)
atggctaagaagattgatggttacatcaaactgcaagtgcctgcaggcaaagcaaatccttcaccaccgattggtccagcattgggtcaaaaaggcgtgaacatcatggcgttctgtaaagaatttaacgctgcaacctcaaaccaagagccgggtctaccgattcctactgagatcactgtatacagcgataagtcttttaccttcatcatgaagtcaccaccagctgcgtatctactacgtaaggctgctggcattgctaaaggttctggtacacctaataccgctaaagtcggtaaagttgaccgtgcgcaactagaagaaatcgttaagactaaagatgcagatttgactgcagctgatcttgacgctgctatccgtaccatcgctggtactgcacgttcaatgggtattaccgtggagggtgtataa

SEQ ID NO: 37806 - protein, 143 aa, Psychrobacter sp. 273-4
MAKKIDGYIKLQVPAGKANPSPPIGPALGQKGVNIMAFCKEFNAATSNQEPGLPIPTEITVYSDKSFTFIMKSPPAAYLLRKAAGIAKGSGTPNTAKVGKVDRAQLEEIVKTKDADLTAADLDAAIRTIAGTARSMGITVEGV

SEQ ID NO: 37807 - DNA, 432 bp, Rubrivivax gelatinosus PM1
  CDS (1)..(432)
atggccaagaagattgtcggcttcatcaagctgcaaatcccggccggcaaggcgaatccgtcgcccccgatcggtcccgcgctgggtcagcgcggcctcaacatcatggagttctgcaaggcgttcaacgcccagacccagtcgatggaacccggcctcgtgctgccggtggtgatcaccgcgttcgcggacaagagcttcaccttcgtgctgaaatcgccgcccgccacggtgctgatcaagaaggcgatcaagctcgacaagggctcgtccaagccgcacaccgacaaggtcggcaagatcacccgggcccagctcgaggagatcgccaagaccaagaccaaggacctgacggcggccgacctggacgctgcggtccgcaccatcgcgggcaccgcccgctcgatgggcgtcaccacggagggtgtctga

SEQ ID NO: 37808 - protein, 143 aa, Rubrivivax gelatinosus PM1
MAKKIVGFIKLQIPAGKANPSPPIGPALGQRGLNIMEFCKAFNAQTQSMEPGLVLPVVITAFADKSFTFVLKSPPATVLIKKAIKLDKGSSKPHTDKVGKITRAQLEEIAKTKTKDLTAADLDAAVRTIAGTARSMGVTTEGV

SEQ ID NO: 37809 - DNA, 429 bp, Rhodospirillum rubrum
  CDS (1)..(429)
atggcaaaaaagatcatcggctacatcaagctgcaggtcccggcggggaaggccaatccttcgcccccgatcggcccggcgcttggtcagcgtggcctgaatatcatggagttctgcaaggcgttcaacgccgccacgcagggcttggagcccggcatgccgattccggtggtgatcaccgcttacggcgaccggaccttcacttacatcaccaagactccgccgatgacgtacttcctcaagaaggcggctggcatcggcaagggctcgaccacgccgggcaagggctcggccggaacggtcaccatggagcaggtgcgtgacatcgccgagaagaagatgcccgacctgaactccccgaccatcgaggcggcggttcagatggtggtcggttccgcccgttccatgggcctgcaggtggtggagtaa

SEQ ID NO: 37810 - protein, 142 aa, Rhodospirillum rubrum
MAKKIIGYIKLQVPAGKANPSPPIGPALGQRGLNIMEFCKAFNAATQGLEPGMPIPVVITAYGDRTFTYITKTPPMTYFLKKAAGIGKGSTTPGKGSAGTVTMEQVRDIAEKKMPDLNSPTIEAAVQMVVGSARSMGLQVVE

SEQ ID NO: 37811 - DNA, 432 bp, Ralstonia metallidurans CH34
  CDS (1)..(432)
atggccaagaagattattggctttatcaagctgcaaatcccggctggtaaggcaaatccctccccgcccgttggtcccgcactgggtcagcgtggtctgaacatcatggagttctgcaaggcgttcaacgcgcagactcagggcatggagcctggtctgccggtgccggtggtgattaccgccttcgctgacaagagcttcaccttcgtgatgaagtcgccgccggcgaccgtgctgatcaagaaggcagcaggcatcaccaagggttcgccgaagccccataccgacaaggttggcaagatcacccgcgcccaggctgaagaaatcgccaaggccaagaacgctgacctcaccgctgctgacctcgacgccgccgtgcgtacgatcgctggttcggcccgttcgatgggcatcaccgtggagggtctgtaa

SEQ ID NO: 37812 - protein, 143 aa, Ralstonia metallidurans CH34
MAKKIIGFIKLQIPAGKANPSPPVGPALGQRGLNIMEFCKAFNAQTQGMEPGLPVPVVITAFADKSFTFVMKSPPATVLIKKAAGITKGSPKPHTDKVGKITRAQAEEIAKAKNADLTAADLDAAVRTIAGSARSMGITVEGL

SEQ ID NO: 37813 - DNA, 429 bp, Magnetococcus sp. MC-1
  CDS (1)..(429)
atggctaaaaagattacagcttatatcaagttacagtgccccgctggtgctgctaagccaagccccccggtgggtcctgcgctgggtcagcatggtctgaacattatggagttctgtaaagcgtttaacgcacagaccgccaatatggaaccagccagccctgtgcccgtgctcatttcggtctatgcggaccgtaccttcagctttgagttgaagacccctccagcctcctacttcctgaaaaaggccgcgggcctgcagggcggtagcaaagcccccaaccgtgaccccgcagtgggcaaggttacttgggcgcaggttgaagagatcgccaaagccaagatggtggatctaaacgccaacgatattgaagcagcaaagaaaatcattgctggttcagccaactccatgggcttggaagtggtgtaa

SEQ ID NO: 37814 - protein, 142 aa, Magnetococcus sp. MC-1
MAKKITAYIKLQCPAGAAKPSPPVGPALGQHGLNIMEFCKAFNAQTANMEPASPVPVLISVYADRTFSFELKTPPASYFLKKAAGLQGGSKAPNRDPAVGKVTWAQVEEIAKAKMVDLNANDIEAAKKIIAGSANSMGLEVV

SEQ ID NO: 37815 - DNA, 486 bp, Methanosarcina barkeri str. fusaro
  CDS (1)..(486)
atgacaagtattgttgaagcacttgtccccggaggaaaagcaaatcctggaccacctttaggtccggcgcttggtccgctcggggtcaacataaaagaagtggtcgaaaagatcaacgaaaaaaccagggactataatggcatgcaggttcctgtaaaagtaattgttgacgacaagaaaaatgtcgagatcgaagtaggcactccacccactgcatccctgattatgaaagagttaggaattcaaaaagggtcaggaaatgcaggaagcgaagttgttggaaacatcagtatttcgcaggttgcaaagattgcccggatgaaaaaggaagacgtactttcctatgatctcaaggcaacaatgaaagaggtaatgggtacctgtgtccctatgggcgtgacagtagagggagttgaggctagagacagccagaaggcacttgatcagggcaagttcgatgatttgcttgctggtgaggagtggtaa

SEQ ID NO: 37816 - protein, 161 aa, Methanosarcina barkeri str. fusaro
MTSIVEALVPGGKANPGPPLGPALGPLGVNIKEVVEKINEKTRDYNGMQVPVKVIVDDKKNVEIEVGTPPTASLIMKELGIQKGSGNAGSEVVGNISISQVAKIARMKKEDVLSYDLKATMKEVMGTCVPMGVTVEGVEARDSQKALDQGKFDDLLAGEEW

SEQ ID NO: 37817 - DNA, 423 bp, Geobacter metallireducens GS-15
  CDS (1)..(423)
atggcaaagaagattacgggatacatcaagctgcagattccggcgggcaaagcaaacccttcgcccccgatcggtccggctctgggccagcatggtgtcaatatcatggagttctgcaaggcgttcaatgccaagacccagggcgacgaggggaccattactcccgttgtcataaccgtctacgcagatcgttcgttcagctttatcaccaaagtgccgcccatgtcggttctcatcaagaaggcggtcggaattgagagcggttccagcgtgccgaacaagaacaaggtcggaacgttgactgcggagcaggtgaaagagatcgcggtcaagaaaatgcccgacatgaacgctgcgtcgcttgaagctgccatgagaacggtcgaagggaccgcccgcagcatgggcgttgaaattgtttaa

SEQ ID NO: 37818 - protein, 140 aa, Geobacter metallireducens GS-15
MAKKITGYIKLQIPAGKANPSPPIGPALGQHGVNIMEFCKAFNAKTQGDEGTITPVVITVYADRSFSFITKVPPMSVLIKKAVGIESGSSVPNKNKVGTLTAEQVKEIAVKKMPDMNAASLEAAMRTVEGTARSMGVEIV

SEQ ID NO: 37819 - DNA, 432 bp, Novosphingobium aromaticivorans DSM 12444
  CDS (1)..(432)
atggccaagaagattgaaggttacatcaagctgcaggttgcagccggtgacgccaagcccgcaccgccgatcggtccggctctgggtcagcgcggcgtcaacatcatggaattctgcaagcagttcaacgctgccacgcaggaaatcgagaagggcacgccccttccgaccgtgatcacggtctacgccgaccgttcgttcaccttcgtgaccaagaccccgcccgccaccttcttcatcaagaaggccgtcggcatcaagtcgggttcgaagaccccgggcaaggcttcggccggcacgatcaagcgttcgcagctggcggaaatcgcccaggccaagatgaaggacctgaacgcgaacgacatcgacgccgcaacgaagatcatcgaaggctccgctcgcgcgatgggcctcaccgtggtggagggctga

SEQ ID NO: 37820 - protein, 143 aa, Novosphingobium aromaticivorans DSM 12444
MAKKIEGYIKLQVAAGDAKPAPPIGPALGQRGVNIMEFCKQFNAATQEIEKGTPLPTVITVYADRSFTFVTKTPPATFFIKKAVGIKSGSKTPGKASAGTIKRSQLAEIAQAKMKDLNANDIDAATKIIEGSARAMGLTVVEG

SEQ ID NO: 37821 - DNA, 477 bp, Ferroplasma acidarmanus
  CDS (1)..(477)
atggttgcagttaaaacaatggttgaaggtggaaaagccacatcagggcctcctttaggccctgcccttggtcctcttggacttaatctcgggcaggtaataaaggatataaacgaacaaacaaaggattttgctggaatgcaggtcccggtaacagtaaatgttgtggacccttctaccaagaaatatgaaataataataggaatacctccgacttcagctctgttgaagaaagaggctggaatagccaaaggttcgggaaaaaataaggaaaactacgctggaaatttgacaatggaacaggtcaaaaaggttgcggaatccaaaaaatccggtttactttcatacacaatgaaaggagctgtccttgaagttcttggcactgcgctgtctctgggcattacagtagatggcataaatgctgcagaactacagaaaaaaatcaaggctggcgaaatagatgtcggtgagaaataa

SEQ ID NO: 37822 - protein, 158 aa, Ferroplasma acidarmanus
MVAVKTMVEGGKATSGPPLGPALGPLGLNLGQVIKDINEQTKDFAGMQVPVTVNVVDPSTKKYEIIIGIPPTSALLKKEAGIAKGSGKNKENYAGNLTMEQVKKVAESKKSGLLSYTMKGAVLEVLGTALSLGITVDGINAAELQKKIKAGEIDVGEK

SEQ ID NO: 37823 - DNA, 444 bp, Cytophaga hutchinsonii
  CDS (1)..(444)
atggcaaaggaaattaccggatatgtgaagctacagattaaaggtggggcagcaaacccttcacctccagttggtccggctcttggttccaagggtttgaacatcatggaattctgtaagcaattcaatgcaagaactcaggataaaccgggcgtattgcttccagtattaattacagtttacacagacaaatctttcgatttcgtcgtaaaaactcctccagcagctattctattagcggaagcagctaagattaaaaaaggttctgcagaacctaaccgtgttaaggttggatctgtgaactgggatcaaatccgtacaattgcggaaacaaagatgccggatcttaatgcttttaaaatagaatctgcaatgaaaatggtagcaggtactgcccgtagtatgggattaacagtatcaggtaaagcaccgtgggagaactaa

SEQ ID NO: 37824 - protein, 147 aa, Cytophaga hutchinsonii
MAKEITGYVKLQIKGGAANPSPPVGPALGSKGLNIMEFCKQFNARTQDKPGVLLPVLITVYTDKSFDFVVKTPPAAILLAEAAKIKKGSAEPNRVKVGSVNWDQIRTIAETKMPDLNAFKIESAMKMVAGTARSMGLTVSGKAPWEN

SEQ ID NO: 37825 - DNA, 426 bp, Clostridium thermocellum ATCC 27405
  CDS (1)..(426)
atggcaaagaaagtagtcggctatataaaacttcaaattcctgcggggaaagcaactccggctccaccggttggaccagctttaggacaacatggcgtaaacataatggcgttttgtaaggaattcaatgagaggacggcaaaggacgcaggtcttgtaatacctgtggttattaccgtatatgctgacagatccttctcattcgttacgaaaactccgccggcgtcagtgcttattaaaagagcatgcaagatagaaaaaggatccggtagaccgaacagggaaaaagttgccaagatttcgaaagaggaagtaagaaaaatagctgaaatgaaaatgcccgaccttaatgcagcaagccttgaggctgccatgagcatgattgcaggtactgcaagaagcatgggcgttgttgttgaggactaa

SEQ ID NO: 37826 - protein, 141 aa, Clostridium thermocellum ATCC 27405
MAKKVVGYIKLQIPAGKATPAPPVGPALGQHGVNIMAFCKEFNERTAKDAGLVIPVVITVYADRSFSFVTKTPPASVLIKRACKIEKGSGRPNREKVAKISKEEVRKIAEMKMPDLNAASLEAAMSMIAGTARSMGVVVED

SEQ ID NO: 37827 - DNA, 432 bp, Microbulbifer degradans 2-40
  CDS (1)..(432)
atggctaaaaaagtagaagcttatatcaagctgcaagttgcagcaggtaaagcaaacccaagtccccctgttggtccagctttgggtcaaaagggcgtaaacatcatggagttctgtaaggcgtttaacgcacagactcaaggtatggagccaggttcaccagtaccagtagttatatctgtgtacagtgaccgcagctttaccttcaccatgaaaacccctcctgcctctttcttacttaagaaagcagctggccttaaaagtggtagtgcccgtccaaatactcaaaaagtgggtaaggttacgcgcgcgcaattggaagaaattgcaaccattaaaatggcagacttaactgcaggtgatatggacgcagctgttcgcactattgctggttctgctcgtgcaatgggcttagagactgagggcgtataa

SEQ ID NO: 37828 - protein, 143 aa, Microbulbifer degradans 2-40
MAKKVEAYIKLQVAAGKANPSPPVGPALGQKGVNIMEFCKAFNAQTQGMEPGSPVPVVISVYSDRSFTFTMKTPPASFLLKKAAGLKSGSARPNTQKVGKVTRAQLEEIATIKMADLTAGDMDAAVRTIAGSARAMGLETEGV

SEQ ID NO: 37829 - DNA, 609 bp, Oenococcus oeni PSU-1
  CDS (1)..(609)
atgagaggaggcattatcgtggcaaaaaatgtcgtaaaaattgttaaattacaaattccagccgctaaagctactccagccccaccggttggaccagctttaggacaagctggtgttaatattggtgaatttaccaagagttttaatgcacagacaaaggatatggtgggatcaatcgttccagtcgtaatttcggtttacgaagaccgttcatacacttttgtattaaagaccccaccggcttctgacttattacggaaagcagctaaggtcgacaaaggttcgggacaaccgaatactttgaaagttgctaacgtgacttcagcacaaattgaagaaattgctaagaccaagctgcctgacttgaatgccggcagccttgaagcagctattaacattgttaagggaacggctcgttcaatgggatttcttgttgatggcaaatcccttgatcaaggtgctgcccgtctggcaaccggtgctgaaattgccgaagccgaagctgaagccgaagctgaaggtgctgctgccgaagctggcgttacggttaaaaaagatgatgaagatgctgatgcaactgatactccagcggaagggagcgctgaataa

SEQ ID NO: 37830 - protein, 202 aa, Oenococcus oeni PSU-1
MRGGIIVAKNVVKIVKLQIPAAKATPAPPVGPALGQAGVNIGEFTKSFNAQTKDMVGSIVPVVISVYEDRSYTFVLKTPPASDLLRKAAKVDKGSGQPNTLKVANVTSAQIEEIAKTKLPDLNAGSLEAAINIVKGTARSMGFLVDGKSLDQGAARLATGAEIAEAEAEAEAEGAAAEAGVTVKKDDEDADATDTPAEGSAE

SEQ ID NO: 37831 - DNA, 426 bp, Trichodesmium erythraeum IMS101
  CDS (1)..(426)
atggcaaaaaaagtcgtggcagttataaagttggctattacggcaggaaaggctaacccttctccgcccattggtccagctttaggtcaacatggtgtaaatattatggcgttttgcaaagaatataacgccaaaacagcagatcaagctggtacagtggtaccagtagaaatctcagtttatgaagaccgtagttttacttttgtcttgaagactccgcctgcagcggtattaataaaaaaagcagcaggtgtagaaagtggttcaagtgaaccaaaccgaacaaaggtaggctctattacgcaagctcaactccaagaaatcgcacaaacgaaaatgccagacctcaatgctaacaatattgaagctgcaatgaaaattgtggcaggtacagcaagaaatatgggtattaccatcagtgattga

SEQ ID NO: 37832 - protein, 141 aa, Trichodesmium erythraeum IMS101
MAKKVVAVIKLAITAGKANPSPPIGPALGQHGVNIMAFCKEYNAKTADQAGTVVPVEISVYEDRSFTFVLKTPPAAVLIKKAAGVESGSSEPNRTKVGSITQAQLQEIAQTKMPDLNANNIEAAMKIVAGTARNMGITISD

SEQ ID NO: 37833 - DNA, 426 bp, Moorella thermoacetica ATCC 39073
  CDS (1)..(426)
atggccaagaaagtagcagctatagtcaaattgcaagtaccggcaggcaaagcaacgccagccccaccggtgggcccggccctgggccagcacggggttaatattatggcctttgtaaaggagtttaacgaccggacggcttcccaggctggtctgattatcccggtagaaatcaccgtttatgaggatcgttcctttacatttatcactaaaacgccgccggcagccgttttgctgaaaaaagccctgggtatagagacggcctcgggcgagcccaatcgcaagaaggtgggcaaggtttctcgggagaaaatccgggaaattgccgagatgaaaatgaaagacctcaatgctgccagtattgaggctgccatgcgcatgattgagggaactgcccggagcatgggcgtggaagtagaggcctga

SEQ ID NO: 37834 - protein, 141 aa, Moorella thermoacetica ATCC 39073
MAKKVAAIVKLQVPAGKATPAPPVGPALGQHGVNIMAFVKEFNDRTASQAGLIIPVEITVYEDRSFTFITKTPPAAVLLKKALGIETASGEPNRKKVGKVSREKIREIAEMKMKDLNAASIEAAMRMIEGTARSMGVEVEA

SEQ ID NO: 37835 - DNA, 426 bp, Streptococcus suis 89/1591
  CDS (1)..(426)
atggctaaaaaagtcgaaaaactcgtaaaacttcaaattcctgcaggtaaagctactccagctccaccagtcggaccagcacttggtcaagcaggtatcaacatcatgggattcacaaaagagtttaacgctcgtacagctgaccaagctggtatgatcatcccagtagttatctctgtgtatgaagataaatcattcactttcatcactaaaacaccaccagctgctgttcttttgaaaaaagctgcaggtgttgaaaaaggttcaggtacaccaaacaaaactaaagttgcaacagttactcgtgcacaagtacaagaaattgctgaaactaaaatgcctgacttgaacgctgcatctcttgaagctgcaatgcgtatgatcgaaggtactgctcgttctatgggattcactgttactgactaa

SEQ ID NO: 37836 - protein, 141 aa, Streptococcus suis 89/1591
MAKKVEKLVKLQIPAGKATPAPPVGPALGQAGINIMGFTKEFNARTADQAGMIIPVVISVYEDKSFTFITKTPPAAVLLKKAAGVEKGSGTPNKTKVATVTRAQVQEIAETKMPDLNAASLEAAMRMIEGTARSMGFTVTD

SEQ ID NO: 37837 - DNA, 432 bp, Thiobacillus denitrificans ATCC 25259
  CDS (1)..(432)
atggcaaagaagattgtcggctacatcaagctgcaagtgccggcgggtaaagccaacccgtcgccccccatcggtcctgcgctcggtcagcgcggcctgaacatcatggaattctgcaaggcgttcaacgccaagacccagggcatggagcccggtctgccgattccggtcgtgatcactgcgttcgcggacaagagcttcaccttcatcatgaagacgccgcccgcgaccgtcttgatcaagaaggcgatcaagctcgacaagggcagctcgaagccgcataccgacaaggtcggcacgatcacccgcgcccagctcgaggagattgccaagaccaaggagcccgatctgaccgcggccgacatggacgcggcggtgcgcaccatcgctggtaccgcccgctcgatgggcatcgtggtggagggagtctga

SEQ ID NO: 37838 - protein, 143 aa, Thiobacillus denitrificans ATCC 25259
MAKKIVGYIKLQVPAGKANPSPPIGPALGQRGLNIMEFCKAFNAKTQGMEPGLPIPVVITAFADKSFTFIMKTPPATVLIKKAIKLDKGSSKPHTDKVGTITRAQLEEIAKTKEPDLTAADMDAAVRTIAGTARSMGIVVEGV

SEQ ID NO: 37839 - DNA, 402 bp, Silicibacter sp. TM1040
  CDS (1)..(402)
atgaagctgcaggttcctgcaggtcaggcaaacccatccccgccagttggccccgcactgggtcagcgcggcatcaacatcatggaattctgcaaggcgttcaacgccaagaccgcagacatggagcccggcgctccgtgcccgaccgtgatcacctactatcaggacaagtccttcaccatggacatcaagacgccgcccgcgtcttactacctgaagaaggctgcaaagattaaatccggcgcgaacaacccgagccgtgagaccgcaggcaccgtcactgccgctcaggtgaaagagatcgccgaagcgaagatgaaagatctgaacgcgaacgacatcgaagccgcgatgcagatcatcctgggctccgcccgctccatgggcatcgaggtgaagtaa

SEQ ID NO: 37840 - protein, 133 aa, Silicibacter sp. TM1040
MKLQVPAGQANPSPPVGPALGQRGINIMEFCKAFNAKTADMEPGAPCPTVITYYQDKSFTMDIKTPPASYYLKKAAKIKSGANNPSRETAGTVTAAQVKEIAEAKMKDLNANDIEAAMQIILGSARSMGIEVK

SEQ ID NO: 37841 - DNA, 438 bp, Rickettsia akari str. Hartford
  CDS (1)..(438)
atgtctcagaaggcaataaaaggttatattaacttgataattccagccggtggcgctactcctgctcctcctataggaccggcccttgggcaaagaaaagttaatattaaaacattttgtgatgaatttaataatagtacaaaagatatggacaaaggagtacctttgccaactttaattactgtttatgaagatagtagtttttcttttaaaatcaaaactcctcctgcctcttattttttaaagaaatatgctaaaattactaaaggttctagtgctactaagaaagaagccgtggtaggtaaagttactatggatgattgtcgtgaaattgcaaaattaaaaatgcctgatttaaatacaaaagatattgaagcagcaacaaaaattatttgtggtagcgctgcatctatgggacttgaagtggtagggaattaa

SEQ ID NO: 37842 - protein, 145 aa, Rickettsia akari str. Hartford
MSQKAIKGYINLIIPAGGATPAPPIGPALGQRKVNIKTFCDEFNNSTKDMDKGVPLPTLITVYEDSSFSFKIKTPPASYFLKKYAKITKGSSATKKEAVVGKVTMDDCREIAKLKMPDLNTKDIEAATKIICGSAASMGLEVVGN

SEQ ID NO: 37843 - DNA, 426 bp, Nostoc punctiforme PCC 73102
  CDS (1)..(426)
atggcgaagaaagtagtggcggtcattaaactggccctgaatgctggaaaagccaacccagcaccgccagttgggcccgccttgggtcaacatggcgttaacatcatgatgttctgcaaggagtacaacgccaaaacagcagaccaagctggaatggtgataccagtagaaatttgggtttttgaagaccggagttttacatttgtactcaaaacgccaccagcatcagtgctgattagaaaggcggcaaaagttgaaaaaggctcgaatgaacccaacaaaaagaaggttgggtcaattactaaagcccaattgcaagaaatcgcccaaacgaaactccccgacctcaatgccaacgacatcgacgcggcaatgaagattgtggcaggaacggctaagaatatgggtataacagtcaaagattag

SEQ ID NO: 37844 - protein, 141 aa, Nostoc punctiforme PCC 73102
MAKKVVAVIKLALNAGKANPAPPVGPALGQHGVNIMMFCKEYNAKTADQAGMVIPVEIWVFEDRSFTFVLKTPPASVLIRKAAKVEKGSNEPNKKKVGSITKAQLQEIAQTKLPDLNANDIDAAMKIVAGTAKNMGITVKD

SEQ ID NO: 37845 - DNA, 456 bp, Polaromonas sp. JS666
  CDS (1)..(456)
atgacccgcaaggagaaaagtatggcgaaaaaaatcgtcggcttcgtcaagctgcaagtaccagctggcaaggccaacccgtcccccccgatcggcccggcactgggtcagcgcggcttgaacatcatggaattctgcaaggcattcaatgcccagacccagggtgttgagccaggcctgccattgcccgtggtgatcaccgcgtacgcagacaaaagcttcaccttcatcatcaagacgcctccggctgtcacgctgatcaagaaggccatcaagctcgacaagggctctgccacgccgcataccgcgaaagtcggcaagatcacccgcgcccagctggaagaaattgccaagaccaaaatgaaagacatgacggccgccgatctcgacgccgccgtccgtactattgccggttccgcccgctccatgggtgtgacggtggagggtgttgtatga

SEQ ID NO: 37846 - protein, 151 aa, Polaromonas sp. JS666
MTRKEKSMAKKIVGFVKLQVPAGKANPSPPIGPALGQRGLNIMEFCKAFNAQTQGVEPGLPLPVVITAYADKSFTFIIKTPPAVTLIKKAIKLDKGSATPHTAKVGKITRAQLEEIAKTKMKDMTAADLDAAVRTIAGSARSMGVTVEGVV

SEQ ID NO: 37847 - DNA, 426 bp, Campylobacter lari RM2100
  CDS (1)..(426)
atggctaaaaaagtcgtaggagaaataaaattacaaatagctgctactaaggctaacccatcaccaccagttggtcctgctttgggtcaacaaggtgttaatattatggaattttgtaaagcatttaatgagagaacaaaagatatggctggtttcaatatcccagttgttatcactgtgtatgctgataaaagctttacattcataacaaaacaaccaccagctacagatttaattaaaaaagctgcaggaatttctaaaggtgcagataaccctttaaaaaacaaagtgggcaaactaactaaagcacaagttttagaaattgttgataaaaaaatcgctgatatgaatacaaaagatagagagcaggctgctaaaattatcatgggttctgctcgttctatgggtgttgaaatcgtagattaa

SEQ ID NO: 37848 - protein, 141 aa, Campylobacter lari RM2100
MAKKVVGEIKLQIAATKANPSPPVGPALGQQGVNIMEFCKAFNERTKDMAGFNIPVVITVYADKSFTFITKQPPATDLIKKAAGISKGADNPLKNKVGKLTKAQVLEIVDKKIADMNTKDREQAAKIIMGSARSMGVEIVD

SEQ ID NO: 37849 - DNA, 579 bp, Xenopus laevis
  CDS (1)..(579)
atgtcaaaggctttacgtgcagcgaaaactgtgaagaaagccaatgtagctggtgtgattcgagcattggtgagagcgggacaggcagctccgggaccaccgcttggacccatcctgggacagcgaggtatccccattggccaattttgtaaggagttcaatgataaaaccaaagagttgaaggaaggaatccctctacctgtgaaaatatctgtaaagcccgatagaacttatgatttaaaaattgggcagcctccggtgtcttatttcttaaaggctgcggctgggattgaaaaaggagcctcgcagacaggtcatgaaatagcagggatggtaacactgaagcagctgtatgagatcgctttagtaaagtcgcaggatgaaccttttgtaatgcgagatatgcaactaagagatgtggtgaaaagcatcatgggaagtgccaagtcactggggatcaaagtagtgaaagatttgacagcagaggagtatgaaaagttcttagaagagcggaaacttgttctccaagctgctgccgacgctcaagctgcagaagttgcaggttccaaaaagaaataa

SEQ ID NO: 37850 - protein, 192 aa, Xenopus laevis
MSKALRAAKTVKKANVAGVIRALVRAGQAAPGPPLGPILGQRGIPIGQFCKEFNDKTKELKEGIPLPVKISVKPDRTYDLKIGQPPVSYFLKAAAGIEKGASQTGHEIAGMVTLKQLYEIALVKSQDEPFVMRDMQLRDVVKSIMGSAKSLGIKVVKDLTAEEYEKFLEERKLVLQAAADAQAAEVAGSKKK

SEQ ID NO: 37851 - DNA, 429 bp, uncultured marine gamma proteobacterium EBAC20E09
  CDS (1)..(429)
atggcaaagaagttagttaacgtattgaagttacaaataccagctggaggagcaaatccaagcccgcctgttggtcctgcattgggtcaagttggtcttaacataatggatttttgtaatgcatttaattctgcaacccaagattctgaaaaaggaattcctttaccagttgtcataaatgtatatgaagataaatcatttgattttgttgttaagactccgccagctgctgtattaattagaaaagctttaaaaattgaaaaaggaagtggcgagcctaacagagaaaaagtaggtaaattgacaagagcgcaacttgaagaaattgcaaaaactaaagaacctgatttaaatgcaaatgatatagatgcagcggtaaaaattattgctgggactgccagaagcatgggagttgaaacagagctatga

SEQ ID NO: 37852 - protein, 142 aa, uncultured marine gamma proteobacterium EBAC20E09
MAKKLVNVLKLQIPAGGANPSPPVGPALGQVGLNIMDFCNAFNSATQDSEKGIPLPVVINVYEDKSFDFVVKTPPAAVLIRKALKIEKGSGEPNREKVGKLTRAQLEEIAKTKEPDLNANDIDAAVKIIAGTARSMGVETEL

SEQ ID NO: 37853 - DNA, 429 bp, uncultured bacterium 562
  CDS (1)..(429)
atggcaaaaaaagtagcaaatattttaaaattacagattcctgctggcggtgctaaccccagtcctcctgttggaccagctttaggtcaagtaggagtaaatataatggatttctgtaatgcatttaatgcagaaactcagagtgctgaaaaaggtatgcctcttccagttgtaatcactgtctatgaggataaatcttttacatttgttgttaagacacctccagctgcagttttaataaaaaagattcttggtattgccaagggaagtggagagcctaacagagaaaaggttggtaaattaacaagagcacagttagaagatatagctaaacaaaaagaaccagaccttaattcaaatgatattgatgctgcagttctaattattgctggtacagcaagaagcatgggagtagaggtagatctatga

SEQ ID NO: 37854 - protein, 142 aa, uncultured bacterium 562
MAKKVANILKLQIPAGGANPSPPVGPALGQVGVNIMDFCNAFNAETQSAEKGMPLPVVITVYEDKSFTFVVKTPPAAVLIKKILGIAKGSGEPNREKVGKLTRAQLEDIAKQKEPDLNSNDIDAAVLIIAGTARSMGVEVDL

SEQ ID NO: 37855 - DNA, 429 bp, uncultured marine alpha proteobacterium HOT2C01
  CDS (1)..(429)
atggcaaaagagatagaaggcacattaaaattacaagtacctgcaggacaggcaaacccttcaccaccagtcggacctgcacttggacaaagaggaattaatatcatggacttttgtaaaatgtttaatgacaaaagtaaaagtgagcaaccaggcgttatgctgcctgttgttgtcacttattttactgataagagtttcacaatggacataaaacttccacctgcatctttttttattaaagaggctttaaaaataaaaaaaggatctaaggaacctggaagggatataattaaaactatttctattaaacaatgtgaggaaatagctgagaagaaattaaaagatttgaacgctaatactgtagatcagggagttaagataatcgtaggatccgcaaagtccatgggtattgaggtaacacaataa

SEQ ID NO: 37856 - protein, 142 aa, uncultured marine alpha proteobacterium HOT2C01
MAKEIEGTLKLQVPAGQANPSPPVGPALGQRGINIMDFCKMFNDKSKSEQPGVMLPVVVTYFTDKSFTMDIKLPPASFFIKEALKIKKGSKEPGRDIIKTISIKQCEEIAEKKLKDLNANTVDQGVKIIVGSAKSMGIEVTQ

SEQ ID NO: 37857 - DNA, 708 bp, Chlorarachnion sp
  CDS (1)..(708)
atgcgacgaccgatgctggtgggcagtatagccctgaatgcgctactttgtgggttgatggtcttgaacgccagaaacggagcaagtagcaatcgattaggcgcaccagtggttcggtcaagggcagcaggcacactggcagggactagttttgcagcaccccaacgactcacagggccatctttcctagactatcgtcctcacccatatcatgctcccgtcatgcacgaagcatctgctcgggcttttaggttgggaagaaataccatggtgaacgctgcaaaggttacacagattatcaagctagctttggatgcagggaaagcaaaccctgcgccgcccgtgggtcctgcgctcggtgcagctggtgttaacatcatgcaattctgcaaggagtacaacgctgccacatccacaaaagcaggccaggtaattccagtagagatcaccgtcttcgcagaccgttctttcacgttcattctcaagactccacccgcatcaaagcttctgcttaaggctgctggacttgagaaaggttcaggcacacctgataaggaaactcttgcaactattactcgtgatcaagtcaaggaaattgctgagattaagatgccggatttaaacgcaaaggatattgaaggggcaatgagaattatagaaggaactgcaaaaaatatgggaattgctgttgaagcacctgctgcataa

SEQ ID NO: 37858 - protein, 235 aa, Chlorarachnion sp
MRRPMLVGSIALNALLCGLMVLNARNGASSNRLGAPVVRSRAAGTLAGTSFAAPQRLTGPSFLDYRPHPYHAPVMHEASARAFRLGRNTMVNAAKVTQIIKLALDAGKANPAPPVGPALGAAGVNIMQFCKEYNAATSTKAGQVIPVEITVFADRSFTFILKTPPASKLLLKAAGLEKGSGTPDKETLATITRDQVKEIAEIKMPDLNAKDIEGAMRIIEGTAKNMGIAVEAPAA

SEQ ID NO: 37859 - DNA, 474 bp, Schistosoma japonicum
  CDS (1)..(474)
atggcttctcgtgcagccgcaaaagtggtccgcaaaacgaaagtaccaactgaccccatagtccactcaccctttttaaaaataattataccggcgcaacaggctcgaccagctccacctttgggaccacagttaggtagaagaaatgttaatattgcgaatttctgcaaagatttcaatgaaaaaacaaaggatgttattgaaggaattccaatgccatgttttatatctgtcaaggcggatagatcatatgacttagtcataagtcacccatcttctatgcatttgttaagaatggctgccgcagctaaaaaaggtgctgctttgccaggtactgaagtatgtggacgtcttactctgaagcatatttaccacattgccgaactcaaaaaacaggatccacatctaatgagaagggatttacaaatgatttgtaaaatgctagattggtacagcacaccgtttaggtattga

SEQ ID NO: 37860 - protein, 157 aa, Schistosoma japonicum
MASRAAAKVVRKTKVPTDPIVHSPFLKIIIPAQQARPAPPLGPQLGRRNVNIANFCKDFNEKTKDVIEGIPMPCFISVKADRSYDLVISHPSSMHLLRMAAAAKKGAALPGTEVCGRLTLKHIYHIAELKKQDPHLMRRDLQMICKMLDWYSTPFRY

SEQ ID NO: 37861 - DNA, 558 bp, Echinococcus multilocularis
  CDS (1)..(558)
atgacctcccgtgtaacaaaactgggtaaaaaggtcaaagcagcggtggactcggtcagacatcctcccttcataaaaatgtatatcccagcacagcaagcaaaacctgctccccctcttggcccacagctggggaagcgcaacatcaatatcgccaatttttgcaaggacttcaacgaacgtaccaaacacatcaaacctggagttcctatcccctgcaccatcatagttaatcctgacaggagctatcagctacaaatatcgcatcctccctcccaattcctccttcgcatggctgctggcaccaaaaagggcgctgctaccccaggcacggaggtttctggtcaattgacactgaagcatatatatgagattgcggtgttgaagagcgaggacgcggcgctgcgcacgacttcgttgcaggcgatctgcgccagcctgatcgcggaggcgcatcgcatgggcatcgaggtactctcgcgtgaagaggaagcgggatgttcgcaaagaccccgattcagctgccagcacttacgccgaatttctgcgccgacgtga

SEQ ID NO: 37862 - protein, 185 aa, Echinococcus multilocularis
MTSRVTKLGKKVKAAVDSVRHPPFIKMYIPAQQAKPAPPLGPQLGKRNINIANFCKDFNERTKHIKPGVPIPCTIIVNPDRSYQLQISHPPSQFLLRMAAGTKKGAATPGTEVSGQLTLKHIYEIAVLKSEDAALRTTSLQAICASLIAEAHRMGIEVLSREEEAGCSQRPRFSCQHLRRISAPT

SEQ ID NO: 37863 - DNA, 417 bp, Candidatus Tremblaya princeps
  CDS (1)..(417)
atgcctcagacaaggagtgttcaagccaaggtcaggcttaccataccagcaggtaaggccagccctgccccgcctatcggtccagtacttgggcagaggggaattaacatccagcagttctgcaaggccttcaacgctgcaacatcagcgctggcagagggtgttccagttacaacgcgagtcgtagtatacgacgacaggactttcgacatgagcataggcactgtgcctacgtctcacatggtcagggaggcgatgagaaaggcaggccgtggttttataacccagtcagatgttgctgacatagcccgtgcaaagctgccatcgctgaacacaaacagcctagatggcgcaattaggaccatagcaggcacggtcagatcaatgcacaccgccattgcagatgcagggcactaa

SEQ ID NO: 37864 - protein, 138 aa, Candidatus Tremblaya princeps
MPQTRSVQAKVRLTIPAGKASPAPPIGPVLGQRGINIQQFCKAFNAATSALAEGVPVTTRVVVYDDRTFDMSIGTVPTSHMVREAMRKAGRGFITQSDVADIARAKLPSLNTNSLDGAIRTIAGTVRSMHTAIADAGH

SEQ ID NO: 37865 - DNA, 465 bp, Triticum aestivum
  CDS (1)..(465)
atggcaacacttaaagatgtggcaacgcggaagcctattctagcgacaatccgcctcctagttcctgctggagcagcccgtcccgcaccccctgtcggaccagctctgggtttctacaggctcaatctgatggctttctgcaaggatttcaatgcaaggacacagaagtacaaggcggagactccgatgcaagtcacgctgactgcctacaaggacagcacttttgagtttgtagtcaagtcgccctcggtctcatggttcctcaagaaagcggcgggcgtcgagacggcaagcagccggccaggccacaacatggtgacgtccctctcgctccgccatgtctacgagatcgcgaagctgaagcagtcagacccgttctgcaagcacatgtcgctcgaggccctgtgcaagtccatcatcggcacggccaagtccatgggcatcgaaatcgtcaaggatctctga

SEQ ID NO: 37866 - protein, 154 aa, Triticum aestivum
MATLKDVATRKPILATIRLLVPAGAARPAPPVGPALGFYRLNLMAFCKDFNARTQKYKAETPMQVTLTAYKDSTFEFVVKSPSVSWFLKKAAGVETASSRPGHNMVTSLSLRHVYEIAKLKQSDPFCKHMSLEALCKSIIGTAKSMGIEIVKDL

SEQ ID NO: 37867 - DNA, 423 bp, Staphylococcus aureus
  CDS (1)..(423)
gtggctaaaaaagtagataaagttgttaaattacaaattcctgcaggtaaagcgaatccagcaccaccagttggtccagcattaggtcaagcaggtgtgaacatcatgggattctgtaaagagttcaatgcacgtactcaagatcaagcaggtttaattattccggtagaaatcagtgtttatgaagatcgttcatttacatttattacaaaaactccaccggctccagtattacttaaaaaagcagctggtattgaaaaaggttcaggcgaaccaaacaaaactaaagttgctacagtaactaaaaatcaagtacgcgaaattgctaacagcaaaatgcaagacttaaacgctgctgacgaagaagcagctatgcgtattatcgaaggtactgcacgtagtatgggtatcgttgtagaataa

SEQ ID NO: 37868 - protein, 140 aa, Staphylococcus aureus
MAKKVDKVVKLQIPAGKANPAPPVGPALGQAGVNIMGFCKEFNARTQDQAGLIIPVEISVYEDRSFTFITKTPPAPVLLKKAAGIEKGSGEPNKTKVATVTKNQVREIANSKMQDLNAADEEAAMRIIEGTARSMGIVVE

SEQ ID NO: 37869 - DNA, 429 bp, Carsonella ruddii
  CDS (1)..(429)
atgaaaattttaaaatttaaattaaaactaatattaaaaccaaacaaagcaactccttcaagtggaattggacctatattaggacaatatggaattaatttaattgatttttgtaataaatttaatgatttaactaagtttatatgtttagaaaaaataaacgttaaaattgcaatttttaatgataattcttatcaaatactaataaatacaatgtctttatctgattatataaaagaaaaaaaaaatattttaagtttttctaaaaaaccaggatataatcaattaacaaatataaatttaaacgatgttgttgaaatatcttattttagaaatatttatgaaaaaaaaaaattaaattcattaagaaaaatgatgttaggaactttaattagcatgggatattttaatgaaaaaaagtataaatga

SEQ ID NO: 37870 - protein, 142 aa, Carsonella ruddii
MKILKFKLKLILKPNKATPSSGIGPILGQYGINLIDFCNKFNDLTKFICLEKINVKIAIFNDNSYQILINTMSLSDYIKEKKNILSFSKKPGYNQLTNINLNDVVEISYFRNIYEKKKLNSLRKMMLGTLISMGYFNEKKYK

SEQ ID NO: 37871 - DNA, 633 bp, Oryza sativa
  CDS (1)..(633)
atggccaccacctccttgtccctgcatggcgtcccatcccccaccgccaccaagctctcctcctcctttctcggcgcccccgcctccttcctccggccgacgccgccgccgctcgctgccccctcgcggagggcgctcgccgtcagggccatggcgccacccaagcccgggggcaagcccaagaaagtggtgggcctcataaagctggcgctggaggccgggaaggccacgccggcgccgccggtcggccccgcgcttggtgccaagggtgtgaacatcatgtccttctgcaaggagtacaatgccaagacggccgagaaggccggctacatcatccctgtcgagatcaccgtgttcgatgataaaagtttcacctttatcttgaagacccctcctgcctcagtccttctcctcaaggcagcaggtatcgagaaaggttcaaaagaaccgcagcgagagaaggttggaaaagtaacagcagatcaagtacgtacaatagctcaagagaagttgccagatttgaactgcaagagcattgactcggccatgagaattatagcgggcactgctgctaatatgggaatcgaggttgaccctccaatacttgagaagaaggaaaaggtgctcttgtag

SEQ ID NO: 37872 - protein, 210 aa, Oryza sativa
MATTSLSLHGVPSPTATKLSSSFLGAPASFLRPTPPPLAAPSRRALAVRAMAPPKPGGKPKKVVGLIKLALEAGKATPAPPVGPALGAKGVNIMSFCKEYNAKTAEKAGYIIPVEITVFDDKSFTFILKTPPASVLLLKAAGIEKGSKEPQREKVGKVTADQVRTIAQEKLPDLNCKSIDSAMRIIAGTAANMGIEVDPPILEKKEKVLL

SEQ ID NO: 37873 - DNA, 669 bp, Arabidopsis thaliana
  CDS (1)..(669)
atggcgtcttcttctctatcaactctttgcagctcaacttcttcttctctacatcccaactccaaactctcacattctctttcagctaaattatcctccaaagcaaatgtttccgtccaatttctgggaaagaaacagtctccgcttctctcctcaactccgagatttctcactgttactgccatggctccacctaaacccggaggcaaagctaaaaaagttgtgggagttatcaaacttgctttagaggcgggaaaagcaactccggcaccaccggttggtccggcgcttggttctaagggagttaacattatggctttttgcaaggattataatgcaagaactgctgataaagctggttatatcattcctgttgaaatcactgtcttcgatataagagcttcacgtttattctcaagaccccgcctgcttcggttttgttgcttaaagctgcagggtgttgagaagggatcaaaagatccacagcaagataaagttggggtgataacaatagaccacgtacgcacaattgcagcagagaagctacccgacctgaactgcacgaccattgaatccgctatgagaatcattgcaggaactgcagctaacatggggatagacattgaccctccgattcttgaacccaaaaagaaagcagttttattgtaa

SEQ ID NO: 37874 - protein, 222 aa, Arabidopsis thaliana
MASSSLSTLCSSTSSSLHPNSKLSHSLSAKLSSKANVSVQFLGKKQSPLLSSTPRFLTVTAMAPPKPGGKAKKVVGVIKLALEAGKATPAPPVGPALGSKGVNIMAFCKDYNARTADKAGYIIPVEITVFDIRASRLFSRPRLLRFCCLKLQGVEKGSKDPQQDKVGVITIDHVRTIAAEKLPDLNCTTIESAMRIIAGTAANMGIDIDPPILEPKKKAVLL

SEQ ID NO: 37875 - DNA, 669 bp, Arabidopsis thaliana
  CDS (1)..(669)
atggcgtcttcttctctatcaactctttgcagctcaacttcttcttctctacatcccaactccaaactctcacattctctttcagctaaattatcctccaaagcaaatgtttccgtccaatttctgggaaagaaacagtctccgcttctctcctcaactccgagatttctcactgttatcgccatggctccacctaaacccggaggcaaagctaaaaaagttgtgggagttatcaaacttgctttagaggcgggaaaagcaactccggcaccaccggttggtccggcgcttggttctaagggagttaacattatggctttttgcaaggattataatgcaagaactgctgataaagctggttatatcattcctgttgaaatcactgtcttcgatgataagagcttcacgtttattctcaagaccccgcctgcttcggttttgttgcttaaagctgcaggtgttgagaagggatcaaaagatccacagcaagataaagttggggtgataacaatagaccagctacgcacaattgcagcagagaagctacccgacctgaactgcacgaccattgaatccgctatgagaatcattgcaggaactgcagctaacatggggatagacattgaccctccgattcttgaacccaaaaagaaagcagttttattgtaa

SEQ ID NO: 37876 - protein, 222 aa, Arabidopsis thaliana
MASSSLSTLCSSTSSSLHPNSKLSHSLSAKLSSKANVSVQFLGKKQSPLLSSTPRFLTVIAMAPPKPGGKAKKVVGVIKLALEAGKATPAPPVGPALGSKGVNIMAFCKDYNARTADKAGYIIPVEITVFDDKSFTFILKTPPASVLLLKAAGVEKGSKDPQQDKVGVITIDQLRTIAAEKLPDLNCTTIESAMRIIAGTAANMGIDIDPPILEPKKKAVLL

SEQ ID NO: 37877 - DNA, 426 bp, Cyanidium caldarium
  CDS (1)..(426)
atgataaaaaaaattataacaacagttaaactagccctacctgcaggcaaggctactccagccccaccagttggtcctgcgctaggtcaacatggagtcaacataatgatgtttgtaaaggaatacaatgcgcgaacagaagagcaaaaaggatcaattattcctgcagaaattcaaatttatgaagataaaagcttcacgtttattttgaaaacaccaccagcatctatactactgaaacaagctacaggcatagaaaaagcaactaaagctccaagaagagaacaagtcggaagtatctcttacaaagagatacaaaatattgctaaaataaaaataaatgagctaaacaccaaagacctatcaaaagctataaaaataattgaaggtacagcaaaaaatatggggatctcagtagagacctaa

SEQ ID NO: 37878 - protein, 141 aa, Cyanidium caldarium
MIKKIITTVKLALPAGKATPAPPVGPALGQHGVNIMMFVKEYNARTEEQKGSIIPAEIQIYEDKSFTFILKTPPASILLKQATGIEKATKAPRREQVGSISYKEIQNIAKIKINELNTKDLSKAIKIIEGTAKNMGISVET

SEQ ID NO: 37879 - DNA, 417 bp, Cyanidioschyzon merolae
  CDS (1)..(417)
atgggtaaaaaggtactagcagtagtcaaattagctttaccagcaggcaaagctactcctgccccacctgtaggtccggctttgggccaatatggggtgaatttagtaatgtttacaaaagaatataatgctaaaaccgctgatcaaataggtttaattattccagcacaaattacaatctatgaagataagagttactcattcattctcaaaaccccacccgcttctgtacttttaaaacgtgctgcacaaatcgaaaaaggttcaaacaatggcacgatagtggcttcaatcactcaagaacaattacaacaaatagctctcaccaaattacctgaccttaatacgaaagacgtgaaaaaagctatgtccattatttctggcacagctgctaatatggggattcaaattctatga

SEQ ID NO: 37880 - protein, 138 aa, Cyanidioschyzon merolae
MGKKVLAVVKLALPAGKATPAPPVGPALGQYGVNLVMFTKEYNAKTADQIGLIIPAQITIYEDKSYSFILKTPPASVLLKRAAQIEKGSNNGTIVASITQEQLQQIALTKLPDLNTKDVKKAMSIISGTAANMGIQIL

SEQ ID NO: 37881 - DNA, 426 bp, Cyanophora paradoxa
  CDS (1)..(426)
atggcaaaaaaagtaatcgccataattaagatcgttttaccagcaggaaaagcaacaccagcacctccagtaggtccagcattaggaccatatggggttagtagtgttaatttttgtaaagaatataatgctaaaactgctgataaaggtggcttagttataccggccgaaattacagtatatgatgatagaagttatagctttgttttaaaaacacctcctgcttctgtattaattgctaaagcagcaagtgtagaaaaaggatctggtgaacctaatcgtaaaaaagtaggttctataacaaaagctcaattagaacaaattgctaaggtcaaatttccggatttaaatactcaaaatcttgaagcagcaagccgaatcgtagaaggtactgcacgaaatatgggtattaccattactgattaa

SEQ ID NO: 37882 - protein, 141 aa, Cyanophora paradoxa
MAKKVIAIIKIVLPAGKATPAPPVGPALGPYGVSSVNFCKEYNAKTADKGGLVIPAEITVYDDRSYSFVLKTPPASVLIAKAASVEKGSGEPNRKKVGSITKAQLEQIAKVKFPDLNTQNLEAASRIVEGTARNMGITITD

SEQ ID NO: 37883 - DNA, 426 bp, Guillardia theta
  CDS (1)..(426)
atggctaaaaaggttgtcgctatcattaagttagctttagaagcaggtaaagcaactcctgctccaccagttggcccggcattagggcaacgaggtgtaaatatcgtgatgttttgtaaagattacaatgcaagaacagcggataaggctggtttaattattccagttgagattacagtatatgaagacaaaagttacacatttgttcttaaaactccaccagcttctgtattactagctaaagctgctggagtacaaaagggttcgggaaacccaaaaaaaacacaagttggttctgtaactaagaaacaagttgaggaaatcgctcaaacaaaactaccagatttaaatacacgacgattggaatcagcaatacgcattattgaaggtactgctaaaaacatgggtattggagtaacagattaa

SEQ ID NO: 37884 - protein, 141 aa, Guillardia theta
MAKKVVAIIKLALEAGKATPAPPVGPALGQRGVNIVMFCKDYNARTADKAGLIIPVEITVYEDKSYTFVLKTPPASVLLAKAAGVQKGSGNPKKTQVGSVTKKQVEEIAQTKLPDLNTRRLESAIRIIEGTAKNMGIGVTD

SEQ ID NO: 37885 - DNA, 426 bp, Odontella sinensis
  CDS (1)..(426)
atggctaaaaaaataactgcattaattaaattagctttaccagcaggaaaagctacaccagcacctccagttggccccgcgttaggtcaacatggcgtcaatatcgcagctttttgtaaagaatataacgcaaaaacaactgataaaactggtctgattattccagtagaaatttcagtttatgaagatagaagttatacttttattcttaaaacaccacctgcttctgttctattagctaatgcggcaaaaattaaaaaaggttcatcaactcctaatcgagtaaatgtgggttctattacaaaaagccaattagaagaaattgctagtattaaactaccagatttgaatactaccaaaataagtagtgctatgaaaattgttgaaggaactgctcgtaatatgggcatttctattgtagattaa

SEQ ID NO: 37886 - protein, 141 aa, Odontella sinensis
MAKKITALIKLALPAGKATPAPPVGPALGQHGVNIAAFCKEYNAKTTDKTGLIIPVEISVYEDRSYTFILKTPPASVLLANAAKIKKGSSTPNRVNVGSITKSQLEEIASIKLPDLNTTKISSAMKIVEGTARNMGISIVD

SEQ ID NO: 37887 - DNA, 426 bp, Porphyra purpurea
  CDS (1)..(426)
atggccaaaaaagttacgggtattgttaagttagcattaaacgcaggtaaagctactcctgctcctccagttgggcctgccttagggcagcatggcgtaaatattgttatgttctgcaaagaatataatgcccgtacagcagataaaacaggactagtaattcctgtagaaatttcagtatatgaagatagaagcttttctttcatcttaaaaacgccacccgcatcagtattaattgtaaaagctgctggtctgaataaaggatctggtgaacctaatataaaaaaaataggtagtataactactaaacagcttgaatctattgctgagacgaagctacctgatttaaatacaaacaatttatctcaagctatgaaaatagttggaggaactgcaaaaaatatgggaatcttgatagaagattaa

SEQ ID NO: 37888 - protein, 141 aa, Porphyra purpurea
MAKKVTGIVKLALNAGKATPAPPVGPALGQHGVNIVMFCKEYNARTADKTGLVIPVEISVYEDRSFSFILKTPPASVLIVKAAGLNKGSGEPNIKKIGSITTKQLESIAETKLPDLNTNNLSQAMKIVGGTAKNMGILIED

SEQ ID NO: 37889 - DNA, 675 bp, Spinacia oleracea
  CDS (1)..(675)
atggcgcaacctttagtagcagcaccgtcttcatcttccataacttcaccaattcccagaaaactatgttcctctctcctcacaccttcctccttaagcttatcctctaaccccagaaactccctccaatttctcaacagcaaactttttctctctcctccttccacttctcacagacgtctttccattgtcgccatggctcctaaacccggaaaagctaaaaaggtgattggagtaattaaactggcgttggaggctggaaaagcgacaccggcaccaccagtgggacctgcgctgggttcaaagggtgtgaatataatggcgttttgcaaggattataatgctagaactgctgataaacccggtttcgttattcctgttgagatcaccgtttttgatgataaaagttttactttcattttgaagactccacctgcatctgttcttcttctgaaggcttcaggtgcggaaaaaggatcaaaggatccacaaatggaaaaagtggggaagatcacgatcgaccaactacgaggaatcgccactgaaaagttgcctgacttgaattgcacaaccattgaatcagcaatgagaattattgcaggaactgctgccaacatgggaatcgatatcgatcctcctatcctcgtcaagaagaaaaaagaagttatcttctaa

SEQ ID NO: 37890 - protein, 224 aa, Spinacia oleracea
MAQPLVAAPSSSSITSPIPRKLCSSLLTPSSLSLSSNPRNSLQFLNSKLFLSPPSTSHRRLSIVAMAPKPGKAKKVIGVIKLALEAGKATPAPPVGPALGSKGVNIMAFCKDYNARTADKPGFVIPVEITVFDDKSFTFILKTPPASVLLLKASGAEKGSKDPQMEKVGKITIDQLRGIATEKLPDLNCTTIESAMRIIAGTAANMGIDIDPPILVKKKKEVIF

SEQ ID NO: 37891 - DNA, 429 bp, Acinetobacter sp
  CDS (1)..(429)
atggctaagaagattgacggctatatcaagctgcaagttccagctggtaaagcgaatccatctccaccaattggtcctgctttgggtcaacgtggtgtaaacatcatggcattctgtaaagaattcaatgctgctacacaaaaacttgaagttggtttgccaattccagtcgtgatcactgtgtacaacgacaagtcgttcacattcatcatgaaaactcctcctgcatctattcttcttaagaaagctgctggtatccaaaagggttcttctgtaccaaacaaaactaaagttggtaagttgactcgtgctcagttagaagaaatcgcgactactaaagaaccagatcttactggtgctgatttagacgcacgtgttcgtaccatcgctggttctgcacgttctatgggcttggaagtggagctataa

SEQ ID NO: 37892 - protein, 142 aa, Acinetobacter sp
MAKKIDGYIKLQVPAGKANPSPPIGPALGQRGVNIMAFCKEFNAATQKLEVGLPIPVVITVYNDKSFTFIMKTPPASILLKKAAGIQKGSSVPNKTKVGKLTRAQLEEIATTKEPDLTGADLDARVRTIAGSARSMGLEVEL

SEQ ID NO: 37893 - DNA, 432 bp, Agrobacterium tumefaciens
  CDS (1)..(432)
atggctaagaaagttgcaggccagctcaagttgcaggtaaaggctgggtcggccaatccgtccccgccgatcggtccggcacttggtcagcgtggcattaacatcatggaattctgcaaggcgttcaatgccgccacgcaggaaatggaaaagggtatgccgatcccggtcgtcatcacctattaccaggacaagtccttcaccttcgcgatgaagcagccgccgatgacctattggctgaagaaggaagcgaagatcacctccggttccaagacgcctggcaagggcgccaaggtcggctccatcaccaaggctcaggtcaagacgatcgctgaagccaagatgaaggatctgaacgcagccgacatcgaaggcgcaatggcaatggttgagggctccgcccgcgccatgggcctggaagtggtaggttga

SEQ ID NO: 37894 - protein, 143 aa, Agrobacterium tumefaciens
MAKKVAGQLKLQVKAGSANPSPPIGPALGQRGINIMEFCKAFNAATQEMEKGMPIPVVITYYQDKSFTFAMKQPPMTYWLKKEAKITSGSKTPGKGAKVGSITKAQVKTIAEAKMKDLNAADIEGAMAMVEGSARAMGLEVVG

SEQ ID NO: 37895 - DNA, 426 bp, Anabaena sp
  CDS (1)..(426)
atggcgaagaaagtagtagcggtcattaaattggccctgaatgctggaaaagccaacccagcacccccagttggtcccgccttgggtcaacatggtgttaatatcatgatgttctgcaaagagtacaatgccaaaacagccgaccaagctggcatggtaattcctgtagaaatatcggtttatgaagaccggagtttcacatttgtactcaaaaccccaccagcatctgtattaatccgtaaggcagcgaaaattgaaagaggttccaacgaacctaataagaaaaaagttggcacaattaccacagcacaactgcgggaaattgcccaaactaaactgcctgacctcaacgctaacgacatagatgcggcgatgaaaattgtggcaggaaccgccagaaatatgggcgttacagtcaccgattag

SEQ ID NO: 37896 - protein, 141 aa, Anabaena sp
MAKKVVAVIKLALNAGKANPAPPVGPALGQHGVNIMMFCKEYNAKTADQAGMVIPVEISVYEDRSFTFVLKTPPASVLIRKAAKIERGSNEPNKKKVGTITTAQLREIAQTKLPDLNANDIDAAMKIVAGTARNMGVTVTD

SEQ ID NO: 37897 - DNA, 438 bp, Aquifex aeolicus
  CDS (1)..(438)
atggctaagaaggtggtagccacaattgagctaatgttaccggctcaacaggcgtctccggcaccaccggtaggtcccgctctgggtcagcacggtgttaacataatggagttcgttaagcaatttaacgccgcgagcagggactacgaacccggaacgatactgccggtcgttataaccgtttaccaggacagaagctttaccttcataatgaaaacaccccccgtctcgtacctacttaaaaaggcggcgggggttgagaagggctcttccgatcccaaaagggtaaaggtcggaaagataacggtaaagcaactcgaagaaatagcgaagatgaagatgaaggacatgaacaccagagacctgaaagccgctatgagaacagttgcgggaactgcaaagagcatgggtattgaaatagaaggttggaaggagtag

SEQ ID NO: 37898 - protein, 145 aa, Aquifex aeolicus
MAKKVVATIELMLPAQQASPAPPVGPALGQHGVNIMEFVKQFNAASRDYEPGTILPVVITVYQDRSFTFIMKTPPVSYLLKKAAGVEKGSSDPKRVKVGKITVKQLEEIAKMKMKDMNTRDLKAAMRTVAGTAKSMGIEIEGWKE

SEQ ID NO: 37899 - DNA, 474 bp, Archaeoglobus fulgidus
  CDS (1)..(474)
atggtgcaggtggtagaggttctggtaccaggaggtcaggcttctccgggtccacctttgggtccggcaataggtcctctcggtttgaacgtgaagcaggttgttgacaaaataaacgaggctacgaaggactacgaggggttgagcgttccggtcaaaataatagtcaaggacgacagaagctttgagattgaggttggcatccctccagtttcagcgctgattaaaagggagctggggattgaaaagggagcctccaatccgggcagggaggttgttggaaacctcacgatggagcagctgctaaacattgcaaggataaagaggcagcagtccctgtcatacacgcttaaagaggtagtcaaagaggtcctcggaacctgcaactcgatgggaataaccgttgagggcaaaagcccgaaggaactcacaaggatgattgaagagggacaggtcgagattccagaggagtaa

SEQ ID NO: 37900 - protein, 157 aa, Archaeoglobus fulgidus
MVQVVEVLVPGGQASPGPPLGPAIGPLGLNVKQVVDKINEATKDYEGLSVPVKIIVKDDRSFEIEVGIPPVSALIKRELGIEKGASNPGREVVGNLTMEQLLNIARIKRQQSLSYTLKEVVKEVLGTCNSMGITVEGKSPKELTRMIEEGQVEIPEE

SEQ ID NO: 37901 - DNA, 444 bp, Bacteroides fragilis
  CDS (1)..(444)
atggctaaagaagttgctggactaatcaaattacagattaaaggaggcgcggcaaacccatcacctcccgttggacctgcattaggttctaagggaatcaacatcatggagttttgcaagcaattcaacgccagaacccaagacaaagcaggtaagattttacctgttatcattacttactacgcagataagtctttcgattttgtaatcaagactcctcccgttgccattcagttgcttgaagtggctaaggtaaagagtggttctgctgagcctaaccgtaagaaagttgccgagattacttgggaacaggttcgtacgattgctcaggacaaaatggttgacttgaactgttttactgtggaagctgccatgagaatggttgcaggtacagctagaagtatgggtatcgctgtaaaaggggagttcccggttaataattaa

SEQ ID NO: 37902 - protein, 147 aa, Bacteroides fragilis
MAKEVAGLIKLQIKGGAANPSPPVGPALGSKGINIMEFCKQFNARTQDKAGKILPVIITYYADKSFDFVIKTPPVAIQLLEVAKVKSGSAEPNRKKVAEITWEQVRTIAQDKMVDLNCFTVEAAMRMVAGTARSMGIAVKGEFPVNN

SEQ ID NO: 37903 - DNA, 429 bp, Bartonella henselae
  CDS (1)..(429)
atggcaaaaaaaagtataggtcagctaaagttgcaggttcctgcaggagcggctactccgtctccaccgattggtcctgctcttggtcagcgtggtattaatattatggaattctgtaaggcgtttaatgcggctacacaagaaatggaaaagggtgcaccaattcccgtaattatcacttattaccaagataagtcttttacattttctctaaagacgcctcctgtatcgtttttcttaaagaaggaagcaaatttgaaatctggttcaaaagagccgggtaaagtctctgtagggagtatttctcgcgataaaattcgttcaattgcacaagcaaagatgaaggatcttaatgcaaatgacattgaagcggcgatgcgcatggtagaaggttctgctcgctctatgggcttggaagtggtgggctaa

SEQ ID NO: 37904 - protein, 142 aa, Bartonella henselae
MAKKSIGQLKLQVPAGAATPSPPIGPALGQRGINIMEFCKAFNAATQEMEKGAPIPVIITYYQDKSFTFSLKTPPVSFFLKKEANLKSGSKEPGKVSVGSISRDKIRSIAQAKMKDLNANDIEAAMRMVEGSARSMGLEVVG

SEQ ID NO: 37905 - DNA, 429 bp, Bartonella quintana
  CDS (1)..(429)
atggcaaaaaaaagtataggtcagctcaagttgcaggttcctgcaggagcggctaccccgtctccaccgattggtcctgctcttggtcagcgcggtattaatatcatggaattctgtaaggcgtttaatgcggcgacccaggaaatggaaaagggtgcaccgattccagtcattatcacttattaccaagataaatctttcacattttctctaaaaacgcctcctgtatcatttttcttgaagaaggaagtaaatttgaaatctggttcaaaagaacctggtaaagtgtctgtcggtaggatctctcgggataaaattcgttcaattgcagaagcaaagatgaaggatcttaacgcaaatgacattgaggcggcaatgcgcatggttgaaggttctgctcgctctatgggcttggaagtggtgggctaa

SEQ ID NO: 37906 - protein, 142 aa, Bartonella quintana
MAKKSIGQLKLQVPAGAATPSPPIGPALGQRGINIMEFCKAFNAATQEMEKGAPIPVIITYYQDKSFTFSLKTPPVSFFLKKEVNLKSGSKEPGKVSVGRISRDKIRSIAEAKMKDLNANDIEAAMRMVEGSARSMGLEVVG

SEQ ID NO: 37907 - DNA, 432 bp, Bifidobacterium longum
  CDS (1)..(432)
atggctcccaagaagaaagtctcggcgctgatcaagctccagatccaggctggcaaggccaacccggccccgccgctgggcccggctctgggttcgcatggcgtgaacatcatggacttctgcaaggcatacaatgcccagacgcaggacaagatgggtcaggtcatccctgtcgagatcaccgtttacgaagatcgttccttcaccttcgtgctcaagaccccgccggctgcagctctgctgaagaaggccgctggcgttgagaagggcaccgagaacccgctgacccacaaggtcggctctgtcaccaaggcgcaggttcgcgaaatcgccgagatcaagatggaagatctgtctgctcgcgatatcgaggccggcatgaagatcatcgagggcaccgctcgctcgatgggcatcacggttacggactga

SEQ ID NO: 37908 - protein, 143 aa, Bifidobacterium longum
MAPKKKVSALIKLQIQAGKANPAPPLGPALGSHGVNIMDFCKAYNAQTQDKMGQVIPVEITVYEDRSFTFVLKTPPAAALLKKAAGVEKGTENPLTHKVGSVTKAQVREIAEIKMEDLSARDIEAGMKIIEGTARSMGITVTD

SEQ ID NO: 37909 - DNA, 432 bp, Bordetella bronchiseptica
  CDS (1)..(432)
atggcgaagaagatcgtcggctttatcaagctgcaagtgccggctggtaaggcaaacccctcccccccgattggcccggcgctgggtcagcgcggcctgaacatcatggaattctgcaaggcgttcaacgccaagacccagggcatggagcccggtctgccgattccggtggtgatcaccgccttcgcggacaagagcttcaccttcatcatgaagaccccgcccgcgacggtcctcatcaagaaggcgtccggcgtgcaaaagggttcggccaagccgcataccgacaaggtcggcacgctgacgcgcgcccaggctgaagaaatcgccaagaccaagcagcccgacctgaccgcggccgatctggacgccgccgtccgtacgatcgctggcagcgcccgcagcatgggcatcacggttgagggggtttaa

SEQ ID NO: 37910 - protein, 143 aa, Bordetella bronchiseptica
MAKKIVGFIKLQVPAGKANPSPPIGPALGQRGLNIMEFCKAFNAKTQGMEPGLPIPVVITAFADKSFTFIMKTPPATVLIKKASGVQKGSAKPHTDKVGTLTRAQAEEIAKTKQPDLTAADLDAAVRTIAGSARSMGITVEGV

SEQ ID NO: 37911 - DNA, 429 bp, Bradyrhizobium japonicum
  CDS (1)..(429)
atggcaaagaaagtgaccggatacctgaagcttcaggtcccggccggtgcggcgaatccttcgcccccgatcggtcccgcgcttggtcagcgcggtctcaacatcatggagttctgcaaggcgttcaacgcccagacccagaaggaagagaagaacaccccgatcccggtgatcatcaccatctatgcggaccgttccttcaccttcgagatgaagacgccgccgatgtcctacttcctcaagcaggccgccaagatccagtccggctcgaaggcgccgggccgcgacaaggccggcaaggtgaccaaggcgcaggtgcgcgagatcgccgagaagaagatgaaggacctgaattgcgacaccatcgaatcggccatgaagatggtcgagggctctgcccgttcgatgggtctggaagtggcggggtaa

SEQ ID NO: 37912 - protein, 142 aa, Bradyrhizobium japonicum
MAKKVTGYLKLQVPAGAANPSPPIGPALGQRGLNIMEFCKAFNAQTQKEEKNTPIPVIITIYADRSFTFEMKTPPMSYFLKQAAKIQSGSKAPGRDKAGKVTKAQVREIAEKKMKDLNCDTIESAMKMVEGSARSMGLEVAG

SEQ ID NO: 37913 - DNA, 429 bp, Brucella melitensis
  CDS (1)..(429)
atggctaagaaagttgcaggccagctgaagctccaggttccggcaggtgcggccaatccgtcgcccccgatcggtccggctctgggtcagcgcggcattaacatcatggaattctgcaaggcgttcaatgctgcctcgcaggaaatggaaaaaggttcgcctattccggtcctgatcacctattaccaggacaagtccttcaccttcgtgatgaagacgcctccggtgacctacttcctcaagaaggctgctaacctgaagtccggttccaagaccccgggcaaggcaagcgccggcacgatcacgcgcgacaaggttcgtgcgatcgccgaagcgaagatgaaggatctgaacgccgctgacgttgaagcagcgatgcgcatgatcgaaggttctgcccgttcgatgggcctggaagtggtgggctga

SEQ ID NO: 37914 - protein, 142 aa, Brucella melitensis
MAKKVAGQLKLQVPAGAANPSPPIGPALGQRGINIMEFCKAFNAASQEMEKGSPIPVLITYYQDKSFTFVMKTPPVTYFLKKAANLKSGSKTPGKASAGTITRDKVRAIAEAKMKDLNAADVEAAMRMIEGSARSMGLEVVG

SEQ ID NO: 37915 - DNA, 429 bp, Buchnera aphidicola
  CDS (1)..(429)
atggcaaaaaaaatacaatcttatataaaacttcaagttgcagcaggaatggctaatcctagtccaccaataggacctgcattaggacaaaaaggagtaaacattatggaattttgcaaattatttaataaaacaacagaaaatgtggaaaaaggtttaccgataccagtaattgttacagtatattctgatcgttcgtttacatttattacaaaaacacctccagcatctgttttattgaaaaaagcagctggaatcaaatcaggttctagcaaaccaaaaatagagacaacaggaaaaataacaaaattacaaattgaagaaatagcaaaaactaaaaaaaatgatatgactggtttaaatattgaaagtatgatgcgatctattgaaggaacagctaaatctatgggtttgattgttgaggattaa

SEQ ID NO: 37916 - protein, 142 aa, Buchnera aphidicola
MAKKIQSYIKLQVAAGMANPSPPIGPALGQKGVNIMEFCKLFNKTTENVEKGLPIPVIVTVYSDRSFTFITKTPPASVLLKKAAGIKSGSSKPKIETTGKITKLQIEEIAKTKKNDMTGLNIESMMRSIEGTAKSMGLIVED

SEQ ID NO: 37917 - DNA, 441 bp, Buchnera aphidicola
  CDS (1)..(441)
atggcaaaaacaatacaagcatacataaaattacaagtatcagctgggacagctaaccctagcccaccaataggtccagcattaggtcaaaaaggtattaatattatggagttttgtaaagcatttaatactcgaacaaataatttagaaaaaggtttacctattcctactattataactgtttattcagataaatcattttcttttattactaaaacacctccagcttcggtactactaaaaaaagctgccggaattacaaaaggatcttcaaaaccaaatcaaaacaaagttgggacaattacaatgcaacaaatattagatattgcacaaataaaaaaaatagatatgaccgggtcaaatatagataatatttcaaaatctattataggaactgcaaattctataggtttaattatagcagaagggactaataaatga

SEQ ID NO: 37918 - protein, 146 aa, Buchnera aphidicola
MAKTIQAYIKLQVSAGTANPSPPIGPALGQKGINIMEFCKAFNTRTNNLEKGLPIPTIITVYSDKSFSFITKTPPASVLLKKAAGITKGSSKPNQNKVGTITMQQILDIAQIKKIDMTGSNIDNISKSIIGTANSIGLIIAEGTNK

SEQ ID NO: 37919 - DNA, 432 bp, Burkholderia mallei
  CDS (1)..(432)
atggcaaagaagattgtcggctttatcaagctgcagattcctgcaggtaaagccaacccgtcgccgcccgtcggtccggcactgggccagcgcggcctgaacatcatggagttctgcaaggcgttcaacgcgcagactcaaggcatggaaccgggcctgccggtgccggtcgtcatcacggcgtacgcggacaagagcttcacgttcgtgatgaagacgccgcccgcgacggtcttgatcaagaaggcggcgaaggtcgacaagggctcgagcaagccccataccgacaaggtcggcaagatcacccgcgcacaagcggaagaaatcgcgaagaccaagatgccggatcttacggcagcggatctcgacgcggccgttcgcaccatcgctggtagcgcacgctcgatgggcatcactgtggagggcgtgtaa

SEQ ID NO: 37920 - protein, 143 aa, Burkholderia mallei
MAKKIVGFIKLQIPAGKANPSPPVGPALGQRGLNIMEFCKAFNAQTQGMEPGLPVPVVITAYADKSFTFVMKTPPATVLIKKAAKVDKGSSKPHTDKVGKITRAQAEEIAKTKMPDLTAADLDAAVRTIAGSARSMGITVEGV

SEQ ID NO: 37921 - DNA, 426 bp, Campylobacter jejuni
  CDS (1)..(426)
atggctaaaaaagtcgtaggcgaaattaaattgcaaattgctgccacaaaagcaaacccatcaccacctgttggtcctgctttgggtcagcaaggtgttaatattatggagttttgtaaggcttttaatgaaagaacaaaagatatggcaggttttaatatccctgttgttatcactgtttatgcagataaaagttttacttttattacaaaacaaccgccagctacggatttgatcaaaaaagcagctggaatttctaaaggtacggataatccacttaaaaataaggtgggtaagttaactcgtgctcaagttttagaaatagtagataagaaaattgcagatttaaatactaaagatagagatcaagctgctaaaattattgcaggttcagctcgttctatgggtgttgaaatcgtagattaa

SEQ ID NO: 37922 - protein, 141 aa, Campylobacter jejuni
MAKKVVGEIKLQIAATKANPSPPVGPALGQQGVNIMEFCKAFNERTKDMAGFNIPVVITVYADKSFTFITKQPPATDLIKKAAGISKGTDNPLKNKVGKLTRAQVLEIVDKKIADLNTKDRDQAAKIIAGSARSMGVEIVD

SEQ ID NO: 37923 - DNA, 441 bp, Candidatus Blochmannia floridanus
  CDS (1)..(441)
atgattgttaaaaaaaaagttcaatcatgtattaaattacaaattgaggctagatcggctactcctagtcctcctattggtcctgctttaggacagcaaggaattaatattatgaagttttgtaaggattttaatactaggactgcggattttgaaatggggttgattttacctgtggttattacagtatatgttgatcgttctttttcgtttgtaattaaaacacctacagctgtatttttgttaaaaaaggcagctggaattaagtcaggatctgaaaaaccaaaatgtgtaagtgtaggaaaagtattgattagtcaaatttatgagattgcaaaaataaaattaattgatatgacgagtttaaatttggaatcggcatcgaaatctattatgggaactgctcgttctataggattagaagtagaggataatttatga

SEQ ID NO: 37924 - protein, 146 aa, Candidatus Blochmannia floridanus
MIVKKKVQSCIKLQIEARSATPSPPIGPALGQQGINIMKFCKDFNTRTADFEMGLILPVVITVYVDRSFSFVIKTPTAVFLLKKAAGIKSGSEKPKCVSVGKVLISQIYEIAKIKLIDMTSLNLESASKSIMGTARSIGLEVEDNL

SEQ ID NO: 37925 - DNA, 432 bp, Caulobacter crescentus
  CDS (1)..(432)
atggctaagaagatcctgggctacatcaagctccaggtgaaggctggctcggccacgccttcgccccccatcggcccggctctgggtcagcgcggcgtcaacatcatgggcttctgtaaggagttcaacgcgcgcaccgagaacgtcgaaaagggcacccccctgccgaccgtgatcaccgtctaccaagacaagtcgttcaccttcatcaccaagacgcccccggcgacgcactacctgaagcagatcaccggtctgaagtcgggcgccaagctgaccggtcgtgagaccgtcggcgaagtgacgcgcacccagctgcgcgaaatcgccgaaaagaagatgaaggacctgaacgccaacgatctcgaggctgcggccaagatcatcgaaggctccgccaaggccatgggcctgaagatcgtggaggcctaa

SEQ ID NO: 37926 - protein, 143 aa, Caulobacter crescentus
MAKKILGYIKLQVKAGSATPSPPIGPALGQRGVNIMGFCKEFNARTENVEKGTPLPTVITVYQDKSFTFITKTPPATHYLKQITGLKSGAKLTGRETVGEVTRTQLREIAEKKMKDLNANDLEAAAKIIEGSAKAMGLKIVEA

SEQ ID NO: 37927 - DNA, 426 bp, Chlamydophila caviae
  CDS (1)..(426)
atgtcgaataaaaaggtaattaagttaattaaactgcaaatccctggtggcaaagccaatccagctcctccaataggacctgctttaggtgccgcaggtgtgaatattatgggattttgcaaagagtttaatgctgcaacgcaagatcgtcctggagacctattgccagtagtgattactgtttattcagacaaaacttttacattcatcaccaaacaacctcccgtatcttctttgatcaaaaaggcattgaatctagagtctgggtctaaaattcctaacagaaataaagttggaaaattaactcaggcacaagtgacagctattgccgaacaaaaaatgaaagatatggacgtcgttcttctggattctgcaaaacgcatggtggaaggaacagcccgaagtatgggtatagacgtcgagtaa

SEQ ID NO: 37928 - protein, 141 aa, Chlamydophila caviae
MSNKKVIKLIKLQIPGGKANPAPPIGPALGAAGVNIMGFCKEFNAATQDRPGDLLPVVITVYSDKTFTFITKQPPVSSLIKKALNLESGSKIPNRNKVGKLTQAQVTAIAEQKMKDMDVVLLDSAKRMVEGTARSMGIDVE

SEQ ID NO: 37929 - DNA, 426 bp, Chlamydia muridarum
  CDS (1)..(426)
atgtcgaataaaaaaattattaaaatcattaaattgcaaatccctggagggaaagccaacccagccccaccaattggtcctgctttaggtgctgcaggcgtaaacattatgggattttgcaaagagtttaatgcggcaactcaagaccgtccaggtgatttgcttcctgttgtaatcactgtatattcggataaaactttttcttttgtgatgaaacagcctcctgtttcttcattaatcaagaaagctttgggactagaatctggatctaagattcctaatagaaacaaagttggtaaattggctcgagcacaaattacagcgattgctgagcaaaagatgaaagatatggatgttgttctcttagagtctgccgaaagaatggttgaagggactgcccgaagcatgggtgtggatgtagagtaa

SEQ ID NO: 37930 - protein, 141 aa, Chlamydia muridarum
MSNKKIIKIIKLQIPGGKANPAPPIGPALGAAGVNIMGFCKEFNAATQDRPGDLLPVVITVYSDKTFSFVMKQPPVSSLIKKALGLESGSKIPNRNKVGKLARAQITAIAEQKMKDMDVVLLESAERMVEGTARSMGVDVE

SEQ ID NO: 37931 - DNA, 426 bp, Chlamydia pneumoniae
  CDS (1)..(426)
atgtcggtaaaaaaggtaatcaaaataattaagttgcaaatccctgggggtaaagcaaatcctgcgccacccataggaccagctttaggtgctgctggagtcaatattatgggcttctgtaaggagtttaatgctgcaactcaagataagcctggagacttacttccagtagtcatcactgtttatgctgataaaacttttacttttataaccaaacagcctccagtctcctctttaataaagaaaactttgaatctggaatcaggatctaaaattcctaatcgtaataaagtaggaaaacttactcaggctcaagttgaagcaattgctgaacaaaaaatgaaagatatggatattgtccttctagaatctgcgaaacgtatggtggaaggaactgcccgtagtatgggtatagacgtagaataa

SEQ ID NO: 37932 - protein, 141 aa, Chlamydia pneumoniae
MSVKKVIKIIKLQIPGGKANPAPPIGPALGAAGVNIMGFCKEFNAATQDKPGDLLPVVITVYADKTFTFITKQPPVSSLIKKTLNLESGSKIPNRNKVGKLTQAQVEAIAEQKMKDMDIVLLESAKRMVEGTARSMGIDVE

SEQ ID NO: 37933 - DNA, 426 bp, Chlorobium tepidum
  CDS (1)..(426)
atggcaaaaaagataacagggttcatcaagttgcaaattcctgcaggaggcgccaatcctgcaccccccgtcggtccggcgcttggtcagaagggtgtgaatatcatggagttctgcaagcagttcaacgccaaaacgcagtctgaggctggtatgatcatccctgtggtgatcacggtttactccgacaagtctttcacctttgtcaccaaaacgccgcctgccgccgtgctcctgctcaaggaggccaagctgcaaaagggttccggcgagccgaaccgcaacaaggtcggtacggtcacgatggatcaggtgcgcaagatcgccgagctgaagaggcccgatctgaactccatcgatctcgaaggtgcgacccagatggttataggcacggcccgcagcatgggtatcgtcgtcgagggctga

SEQ ID NO: 37934 - protein, 141 aa, Chlorobium tepidum
MAKKITGFIKLQIPAGGANPAPPVGPALGQKGVNIMEFCKQFNAKTQSEAGMIIPVVITVYSDKSFTFVTKTPPAAVLLLKEAKLQKGSGEPNRNKVGTVTMDQVRKIAELKRPDLNSIDLEGATQMVIGTARSMGIVVEG

SEQ ID NO: 37935 - DNA, 432 bp, Chromobacterium violaceum
  CDS (1)..(432)
gtggcaaagaaaattgtcggctacatcaagctgcaagtgcccgctggcaaagccaacccgtcgcctccgatcggtccggcactgggtcagcgcggtctgaacatcatggaattctgcaaggcgttcaatgctcaaactcagggcatggaacccggcatgccgattccggttgtgatcaccgcctacgcggacaagtccttcaccttcacgatgaagactcctccggccaccttcctgctgaagaaggccgctggcatcaagtccggctccgccaaggcgcacgtggacaaggttggtaaagtgactcgcgctcagctggaagaaatcgccaagaccaagcaagcggatctgaccgctgccgatctggacgccgctgttcgcaccatcgccggctccgcccgttcgatgggtctggaagtggagggcgtgtaa

SEQ ID NO: 37936 - protein, 143 aa, Chromobacterium violaceum
MAKKIVGYIKLQVPAGKANPSPPIGPALGQRGLNIMEFCKAFNAQTQGMEPGMPIPVVITAYADKSFTFTMKTPPATFLLKKAAGIKSGSAKAHVDKVGKVTRAQLEEIAKTKQADLTAADLDAAVRTIAGSARSMGLEVEGV

SEQ ID NO: 37937 - DNA, 426 bp, Clostridium acetobutylicum
  CDS (1)..(426)
atggcaaagaaagtagtaggtttaataaaactacaattacctgcaggaaaagcaactccagcaccaccagttggtccagcattaggacagcatggtgtaaatatcatggcattctgtaaagaatacaatgctaaaactgctaatcaagctggatttactattccagttgtaattacagtttatcaggatagatcttttagtttcatacttaagactcctcctgcagcagttttgataaagaaagcagctggtattgaaagtggttcaggcgttcctaacaagaataaagttggtaaaataactaaagaacaagttaaggaaattgctcaaactaaaatgccagatttgaatgcagcatctttagaagctgcaatgagcatgatagctggaacagctagaagcatgggtgtagaagtagtagattag

SEQ ID NO: 37938 - protein, 141 aa, Clostridium acetobutylicum
MAKKVVGLIKLQLPAGKATPAPPVGPALGQHGVNIMAFCKEYNAKTANQAGFTIPVVITVYQDRSFSFILKTPPAAVLIKKAAGIESGSGVPNKNKVGKITKEQVKEIAQTKMPDLNAASLEAAMSMIAGTARSMGVEVVD

SEQ ID NO: 37939 - DNA, 426 bp, Clostridium perfringens
  CDS (1)..(426)
atggctaagaaagtaacaggaatgataaaacttcaacttcctgcaggaaaagcaacaccagcaccaccagtaggaccagctttaggtcaacacggtgtaaacataatgggattctgtaaagaattcaacgcaaagactgctgataaagctggcttaataataccagttgtaataactgtatatcaagacagatcattcagcttcatattaaaaactccaccagctgcagttcttataaagaaagaattaggcttagaaagtggatcaggtgttccaaacagaactaaagttggaaacatcactaaagagcaaataagaaaaattgctgaattaaaaatgccagacttaaatgctgcaacaatcgaaactgcaatgagcatgatcgaaggtactgctagaagtatgggtgtagtagtagtagaataa

SEQ ID NO: 37940 - protein, 141 aa, Clostridium perfringens
MAKKVTGMIKLQLPAGKATPAPPVGPALGQHGVNIMGFCKEFNAKTADKAGLIIPVVITVYQDRSFSFILKTPPAAVLIKKELGLESGSGVPNRTKVGNITKEQIRKIAELKMPDLNAATIETAMSMIEGTARSMGVVVVE

SEQ ID NO: 37941 - DNA, 426 bp, Clostridium tetani
  CDS (1)..(426)
atggctaaaaaagttacaggaatgatcaaacttcaactcgctgcaggaaaagcaagtccagcaccaccagtaggtccagctcttggtcaacatggtgtaaatattatggcattctgtaaggagtttaatgaaaaaacagctaaacaagctgggttaataattccagtagtaattacagtataccaagataggtcctttagtttcatattaaagacaccaccagcagcagttcttattaagaaagccgttggaatagaaagtggttctggtgttccaaataaaacaaaggttgctaaaattactaaagagcaattaaaagaaattgctgaaatgaagatgccagatttaaatgctggttcagtagaagctgctatgagaatggtagctggtacagctagaagtatgggtgtaactgttgaagaatag

SEQ ID NO: 37942 - protein, 141 aa, Clostridium tetani
MAKKVTGMIKLQLAAGKASPAPPVGPALGQHGVNIMAFCKEFNEKTAKQAGLIIPVVITVYQDRSFSFILKTPPAAVLIKKAVGIESGSGVPNKTKVAKITKEQLKEIAEMKMPDLNAGSVEAAMRMVAGTARSMGVTVEE

SEQ ID NO: 37943 - DNA, 429 bp, Corynebacterium diphtheriae
  CDS (1)..(429)
atggctccgaagaagaaggtcaccggccttatcaagctgcagattcaggctggacaggcaaaccctgctcctccagtcggcccagctcttggtgctcacggcgtgaacatcatggagttctgcaaggcttacaacgctgcgactgagaaccagcgcggcaacgtggtcccagttgagatcactgtgtacgaagaccgctccttcgacttcaagttgaagaccccacctgctgctaagctgctgctgaaggctgctggcctgcagaagggttccggtgttcctcacacccaaaaggtcggctccgtgaccatggatcaggtcaaggaaatcgcacagaccaagatggaagacctcaacgctaacgacattgagaacgctgcacgcatcatcgctggtaccgcacgttccatgggtatcgaggttaagtaa

SEQ ID NO: 37944 - protein, 142 aa, Corynebacterium diphtheriae
MAPKKKVTGLIKLQIQAGQANPAPPVGPALGAHGVNIMEFCKAYNAATENQRGNVVPVEITVYEDRSFDFKLKTPPAAKLLLKAAGLQKGSGVPHTQKVGSVTMDQVKEIAQTKMEDLNANDIENAARIIAGTARSMGIEVK

SEQ ID NO: 37945 - DNA, 438 bp, Corynebacterium glutamicum
  CDS (1)..(438)
atggctcctaagaagaagaagaaggtcactggcctcatcaagctccagatccaggcaggacaggcaaaccctgctcctccagttggcccagcacttggtgctcacggcgtcaacatcatggaattctgcaaggcttacaacgctgcgactgaaaaccagcgcggcaacgttgttcctgttgagatcaccgtttacgaagaccgttcattcgacttcaagctgaagactcctccagctgcaaagcttcttctgaaggctgctggcctgcagaagggctccggcgttcctcacacccagaaggtcggcaaggtttccatggctcaggttcgtgagatcgctgagaccaagaaggaagacctgaacgctcgcgatatcgacgctgctgcgaagatcatcgctggtaccgctcgttccatgggcatcaccgtcgaaggctaa

SEQ ID NO: 37946 - protein, 145 aa, Corynebacterium glutamicum
MAPKKKKKVTGLIKLQIQAGQANPAPPVGPALGAHGVNIMEFCKAYNAATENQRGNVVPVEITVYEDRSFDFKLKTPPAAKLLLKAAGLQKGSGVPHTQKVGKVSMAQVREIAETKKEDLNARDIDAAAKIIAGTARSMGITVEG

SEQ ID NO: 37947 - DNA, 438 bp, Coxiella burnetii
  CDS (1)..(438)
atggcaaagaaaataacgggctatattcgccttcaaataaaggccggtgaagccaatcccagtccgccggtgggcccagcgttgggtcagcatggtgttaacatccgggaattttgtgaatcatttaatacggcaaccaaaaatattgaaaagggcttgccgactcccgtcattatcacggtgtatgcggatcgcactttttcttttattaccaaaacgccgccggcttctgttttattgaaaaagtttgtgcttaaaggtaaaagcggtagtgcgcgccctaacacggaaaaagtaggtaaagcgacgcgtcagcaattagaagaaattgccaaaatgaaaacgcccgatctgactgcggctgatttagaggctgctattcgcaccatcgcaggaacggcgcgcagcatgggtattgatgtagagggggttgaataa

SEQ ID NO: 37948 - protein, 145 aa, Coxiella burnetii
MAKKITGYIRLQIKAGEANPSPPVGPALGQHGVNIREFCESFNTATKNIEKGLPTPVIITVYADRTFSFITKTPPASVLLKKFVLKGKSGSARPNTEKVGKATRQQLEEIAKMKTPDLTAADLEAAIRTIAGTARSMGIDVEGVE

SEQ ID NO: 37949 - DNA, 435 bp, Deinococcus radiodurans
  CDS (1)..(435)
atgaagaaagtcgcagggattgtcaaactgcaactcccggcgggcaaggccaccccggccccccctgtcggtcccgcgctcggtcagtacggcgcgaacatcatggagttcactaaggcgttcaacgcccagacggcggacaagggtgacgcgatcatccccgtcgagatcaccatctatgccgaccgctcctttaccttcatcaccaagacccccccgatgagctacctgatccgcaaggcggcaggcatcggcaagggcagctcgacccccaacaaggccaaggtcggcaagctgaactgggatcaggtgctggaaatcgccaagaccaagatgcccgacctgaacgcggggagcgtcgaagccgccgccaacacggtcgccggcaccgcccgcagcatgggcgtgactgtggaaggaggccccaatgcctaa

SEQ ID NO: 37950 - protein, 144 aa, Deinococcus radiodurans
MKKVAGIVKLQLPAGKATPAPPVGPALGQYGANIMEFTKAFNAQTADKGDAIIPVEITIYADRSFTFITKTPPMSYLIRKAAGIGKGSSTPNKAKVGKLNWDQVLEIAKTKMPDLNAGSVEAAANTVAGTARSMGVTVEGGPNA

SEQ ID NO: 37951 - DNA, 426 bp, Desulfotalea psychrophila
  CDS (1)..(426)
atggccaaaaaagcgatggcatacatcaagttgcagataccagcaggtaaggcgaatccttcacctcctgtcggacctgcacttggacagcacggtgtcaacatcatggaattctgtaaaggctttaacgccaggacacaatccatgggtgataccattgttcctgtagttatcactgtttatcaagatcgctctttcagtttcattacaaagacaccacctgcagctgttcttcttatgaaggctgctaatatcaccaagggttccagtaatcctaagagtgagcgtgttgctgaaattagcaaagagaagattcgtgagatcgcagagattaaaatgccagatctcaatgcatatgatattgatgctgcaatgcttattattgaaggcactgcacgcagcgcaggtatcactgtagttgagtag

SEQ ID NO: 37952 - protein, 141 aa, Desulfotalea psychrophila
MAKKAMAYIKLQIPAGKANPSPPVGPALGQHGVNIMEFCKGFNARTQSMGDTIVPVVITVYQDRSFSFITKTPPAAVLLMKAANITKGSSNPKSERVAEISKEKIREIAEIKMPDLNAYDIDAAMLIIEGTARSAGITVVE

SEQ ID NO: 37953 - DNA, 423 bp, Enterococcus faecalis
  CDS (1)..(423)
gtggctaaaaaagtagaaaaaatcgttaaattacaaattcctgcggggaaagcaacaccagctccaccagtaggtccagcgttaggtcaagcaggtatcaacatcatgggattcactaaagaattcaatgctcgtacagctgaccaagcaggcttaattattccagtagtaatctctgtatatgaagatcgttcatttacattcattactaaaacaccacctgctgcagtcttattgaaaaaagctgcaaaaatcgaaaaaggttcaggtgaaccaaacaaaactaaagttgcaacagtttcaagcgatcaagtgaaagaaatcgctgaacttaaaatggcagacctaaacgccgctgacgttgaagcagcaatgcgcatggttgcaggaactgcacgaagcatgggtatcatcgtagaataa

SEQ ID NO: 37954 - protein, 140 aa, Enterococcus faecalis
MAKKVEKIVKLQIPAGKATPAPPVGPALGQAGINIMGFTKEFNARTADQAGLIIPVVISVYEDRSFTFITKTPPAAVLLKKAAKIEKGSGEPNKTKVATVSSDQVKEIAELKMADLNAADVEAAMRMVAGTARSMGIIVE

SEQ ID NO: 37955 - DNA, 429 bp, Erwinia carotovora
  CDS (1)..(429)
atggccaagaaagtacaagcctatgtcaagctgcaagttgcagctggtatggctaacccgagcccaccagtaggtccggctctgggtcagcaaggtgttaacatcatggaattctgtaaggcgttcaatgctaaaactgaaagcattgagaagggcctgccgactccggttgttattaccgtttattctgaccgttctttcaccttcgttaccaaaacgcctccagcagcagttctgctgaagaaagctgctggtatcaagtctggttccggcaagccgaacaaagacaaagtaggtaaagtaacgagcgctcaggttcgtgaaatcgcagaaactaaagctgcggacatgactggttctgatgtagacgccatggtgcgctctatagcaggtactgctcgttccatgggcctggtagtggaggattaa

SEQ ID NO: 37956 - protein, 142 aa, Erwinia carotovora
MAKKVQAYVKLQVAAGMANPSPPVGPALGQQGVNIMEFCKAFNAKTESIEKGLPTPVVITVYSDRSFTFVTKTPPAAVLLKKAAGIKSGSGKPNKDKVGKVTSAQVREIAETKAADMTGSDVDAMVRSIAGTARSMGLVVED

SEQ ID NO: 37957 - DNA, 426 bp, Fusobacterium nucleatum
  CDS (1)..(426)
atggcaaaagaagtaattcaaataataaaactacaattaccagcaggtaaagcgaaccctgctccaccagttggaccagcattaggacaacatggtgtaaatataatggaattttgtaaggcgtttaatgctaaaactcaagataaggctggatggataattcctgttgaaatatctgtttatagtgatagatctttcacatttatattaaaaactccacctgcatcagatttattaaagaaagctgctggaataacatcaggagcaaaaaactctaaaaaagaagttgcaggaaaaattactactgcaaagttaaaagaactagctgaaactaaaatgcctgacttaaatgcttcatctgttgaaacagctatgaagataattgcaggatcagcaagatctatgggaataaaaatagaagactaa

SEQ ID NO: 37958 - protein, 141 aa, Fusobacterium nucleatum
MAKEVIQIIKLQLPAGKANPAPPVGPALGQHGVNIMEFCKAFNAKTQDKAGWIIPVEISVYSDRSFTFILKTPPASDLLKKAAGITSGAKNSKKEVAGKITTAKLKELAETKMPDLNASSVETAMKIIAGSARSMGIKIED

SEQ ID NO: 37959 - DNA, 426 bp, Geobacter sulfurreducens
  CDS (1)..(426)
atggccaagaagattaccggttacatcaagctgcaaatcccggcagccaaggcgaacccgtcccccccgatcggtcctgcactgggtcagcacggcgtcaatatcatggagttctgcaaggcattcaatgccaagacccaggctgacgaagggaccatcatccccgtcgtcataactgtatatgccgaccgctcgttcaccttcatcacgaaggttccgcccatgtcggtgctcatcaagaaagccgtcggcattgagagcggttccagtgttcccaataagaacaaggtgggcaagcttacccgcgaacaggtcagggaaatcgccaccaaaaagctgcccgacatgaatgcggcctctcttgaggcggccatgaggacggttgaaggtaccgcccgcagcatgggcgttgaaatagtcaactag

SEQ ID NO: 37960 - protein, 141 aa, Geobacter sulfurreducens
MAKKITGYIKLQIPAAKANPSPPIGPALGQHGVNIMEFCKAFNAKTQADEGTIIPVVITVYADRSFTFITKVPPMSVLIKKAVGIESGSSVPNKNKVGKLTREQVREIATKKLPDMNAASLEAAMRTVEGTARSMGVEIVN

SEQ ID NO: 37961 - DNA, 426 bp, Gloeobacter violaceus
  CDS (1)..(426)
atggccaagaaagtctcagcaaagatcaagctggctttgcccgccggcaaggcgaaccctgctcctcccgtcggcccggccctcggtcagcacggcgtgaacatcatgatgttctgcaaagaatacaacgcccgcaccgccgatcaggtgggcatggtgatcccggtcgaaatcacggtctttgaagatcgcagcttcaccttcgtgctcaagaccccaccggcgtcggtgctgctcaccaaggcggcgggcgtcgagaagggctcgggcaagcccaacaaagaaaaagcaggtacgatcaccggcgcccaactgcgccagattgccgagcagaagctgcccgacctcaacgccaacgacgtcgaggcggcgatgaagatcatcgccggcaccgcccgcaacatgggcatcgtcatcgccgactag

SEQ ID NO: 37962 - protein, 141 aa, Gloeobacter violaceus
MAKKVSAKIKLALPAGKANPAPPVGPALGQHGVNIMMFCKEYNARTADQVGMVIPVEITVFEDRSFTFVLKTPPASVLLTKAAGVEKGSGKPNKEKAGTITGAQLRQIAEQKLPDLNANDVEAAMKIIAGTARNMGIVIAD

SEQ ID NO: 37963 - DNA, 480 bp, Halobacterium volcanii
  CDS (1)..(480)
atggctggaactatcgaagtactcgttcccggcgggaaggcgaaccccggtccgccgctcggcccggaactcggcccgacccccgtcgacgtgcaggacgtcgtcaacgacatcaacgaccagacggctgccttcgacggcatggaagtccccgtcaccgtcgagtacgacgacgacggctcgttcagcatcgaagtcggcgtcccgccgacggcggcgctcatcaaggacgaagtcggattcgacaccggcagcggcgaaccccaggagaacttcgtcgccgacatgtccatcgaacagctgaagaaggtcgcagagcagaagtcctctgacctgctctcgtacgacctcaagaacgcctcgaaggaagtcgctgggacgtgtgcgtccctcggcgtcaccatcgagggcgaagacgcccgcacgttcaaacagcgcatcgacggcggcgacttcgacgactacttcgacgacgagtaa

SEQ ID NO: 37964 - protein, 159 aa, Halobacterium volcanii
MAGTIEVLVPGGKANPGPPLGPELGPTPVDVQDVVNDINDQTAAFDGMEVPVTVEYDDDGSFSIEVGVPPTAALIKDEVGFDTGSGEPQENFVADMSIEQLKKVAEQKSSDLLSYDLKNASKEVAGTCASLGVTIEGEDARTFKQRIDGGDFDDYFDDE

SEQ ID NO: 37965 - DNA, 426 bp, Helicobacter pylori J99
  CDS (1)..(426)
atggctaaaaaagtagtcggagaaatcaaacttcaaatccctgccggtaaggcaaacccttcacctcctgtagggccggcattgggtcaaagaggggttaatatcatggaattttgtaaggcttttaacgaaagaactaaagacatggggagttttaatatcccggtcattatcacggtttatcaagataagagtttcacttttatcaccaaaaagcccccagtaacggatttaatcaaaaaagcttctggggttgaaaaaggctctgacaacccgcttaaaaacaagatcgcaaagctcacccacaagcaagtagaagaaatcgcgcaattgaaaatggaagatttaaacacaagcaccatggaagcggctaaaaaaatcgttatgggtagcgctaggagcatgggcgtagaagttgtggattga

SEQ ID NO: 37966 - protein, 141 aa, Helicobacter pylori J99
MAKKVVGEIKLQIPAGKANPSPPVGPALGQRGVNIMEFCKAFNERTKDMGSFNIPVIITVYQDKSFTFITKKPPVTDLIKKASGVEKGSDNPLKNKIAKLTHKQVEEIAQLKMEDLNTSTMEAAKKIVMGSARSMGVEVVD

SEQ ID NO: 37967 - DNA, 426 bp, Lactobacillus johnsonii
  CDS (1)..(426)
gtggcaaagaaagttattaacgtagttaaactgcaaattcctgctggtgcagcaactcctgcacctccagttggtcctgcattgggtcaagctggaatcaacatcgttggtttcactaaggacttcaacgcacgtactgctgatcaaaagggtatgattatccctgtagttattactgtatatgaagatcgttcattcgaattcattactaagactccaccagctgctgttcttttgaagaaggctgctaaagtggacaagggttctggtgaacctaacactaagaaggttgctaaggtaactaaggaccaagttaaggaaattgccgaaaccaagatgaaagatctaaacgctgcagatattgaagctgctatgcgcatgattgaaggtactgctagaagcatgggcttcactgtagaagactag

SEQ ID NO: 37968 - protein, 141 aa, Lactobacillus johnsonii
MAKKVINVVKLQIPAGAATPAPPVGPALGQAGINIVGFTKDFNARTADQKGMIIPVVITVYEDRSFEFITKTPPAAVLLKKAAKVDKGSGEPNTKKVAKVTKDQVKEIAETKMKDLNAADIEAAMRMIEGTARSMGFTVED

SEQ ID NO: 37969 - DNA, 432 bp, Leifsonia xyli
  CDS (1)..(432)
atggcaccgaagaagaaggtcaccggtctgatcaagcttcagatcaacgccggcgccgcgaaccctgccccgccgatcggcccggccctgggtcagcacggcgtgaacatcatggagttctgcaaggcgtacaacgcggcgaccgagtcgcagcgcggcaacgtcatcccggtcgagatcaccgtctacgaggaccgttcgttcacgttcgtcctgaagaccccgcccgcggccgagctcatcaagaaggcggccggcgtcgccaagggctccggcgtgccgcacaccaccaaggttggcaagctgacccaggagcaggtgcgcgccatcgccgagcagaagatggtcgacctgaacgccaacgacatcgacgcggcctccaagatcatcgccggaaccgcccgctcgatgggcatcaccgtcgaggcgtaa

SEQ ID NO: 37970 - protein, 143 aa, Leifsonia xyli
MAPKKKVTGLIKLQINAGAANPAPPIGPALGQHGVNIMEFCKAYNAATESQRGNVIPVEITVYEDRSFTFVLKTPPAAELIKKAAGVAKGSGVPHTTKVGKLTQEQVRAIAEQKMVDLNANDIDAASKIIAGTARSMGITVEA

SEQ ID NO: 37971 - DNA, 429 bp, Leptospira interrogans
  CDS (1)..(429)
atggcagcaaaaaaagtagtaaagcagatcaaacttcaggtggaagcaggaaaagcgaatcctgcacctcccgttggtccggctcttggtcaggccggtttgaacatcatggaattctgcaaacaattcaatgaaagatccaaagcacaaattggactcaaacttccggttgtgatcactgttttttcagatcgtagttttacattcattactaaatcacctccggccgcccttctggttaaaaaggcgatcggtttggaaaccggatctgcgacgcctcacacacacaaggttggaaagatcactcgtaaacaattggaagagatcgctaaaactaaaatggaagatctcaatgcaaacgacatagacgctgctgtgaatattattgcgggaacttgccgctccatgggcgtcactgtagaggcttag

SEQ ID NO: 37972 - protein, 142 aa, Leptospira interrogans
MAAKKVVKQIKLQVEAGKANPAPPVGPALGQAGLNIMEFCKQFNERSKAQIGLKLPVVITVFSDRSFTFITKSPPAALLVKKAIGLETGSATPHTHKVGKITRKQLEEIAKTKMEDLNANDIDAAVNIIAGTCRSMGVTVEA

SEQ ID NO: 37973 - DNA, 429 bp, Liberibacter asiaticus
  CDS (1)..(429)
atggctaaagtagtttctcgtatagttaagttgcagatagagtcgggttctgcaaagccttcgccgccggttggtcctgcaattggacaggctggtattcccattatggcgttttgtaaggcgtttaatgcggcaactgagggtatggaaaagggtattcccatcccaactactgtgacttgttataaagataagtcttttacttttacgatgagtcagccacctgtaagcttttttcttaaaaaagaggtggggattaagtcgggatctaaacttcctggtaaggagtcttgcggttcgattactcgggaaaatattagaaaaattgcacagttaaagatgcaagatatgggggctattgatattgaaggggctatgcgtatggtggaaggttcggcctgttcaatgggtataagtgtggtggattaa

SEQ ID NO: 37974 - protein, 142 aa, Liberibacter asiaticus
MAKVVSRIVKLQIESGSAKPSPPVGPAIGQAGIPIMAFCKAFNAATEGMEKGIPIPTTVTCYKDKSFTFTMSQPPVSFFLKKEVGIKSGSKLPGKESCGSITRENIRKIAQLKMQDMGAIDIEGAMRMVEGSACSMGISVVD

SEQ ID NO: 37975 - DNA, 426 bp, Listeria innocua
  CDS (1)..(426)
gtggcaaaaaaagtgattaaagaagttaaacttcaaattccagcaggtaaagcaaatcctgcacctccagttggacctgcattaggtcaagctggcgtaaacatcatgggattctgtaaagagtttaatgctcgcacagccgatcaagctggtcttattattcctgttgtgatcactgtatttgaagaccgttcgtttacgttcatcactaaaactccaccagcagctgtattacttaaaaaagcagctaaagtggaaaaaggatccggtgaaccaaacaaaacaaaagttgcatctgtaactcgcgctcaagtacaggaaattgctgaaacaaaaatgccagaccttaacgctgcaaatgttgaatctgcaatgctaatggttgaaggtactgcacgttctatgggtatcactatccaagactaa

SEQ ID NO: 37976 - protein, 141 aa, Listeria innocua
MAKKVIKEVKLQIPAGKANPAPPVGPALGQAGVNIMGFCKEFNARTADQAGLIIPVVITVFEDRSFTFITKTPPAAVLLKKAAKVEKGSGEPNKTKVASVTRAQVQEIAETKMPDLNAANVESAMLMVEGTARSMGITIQD

SEQ ID NO: 37977 - DNA, 429 bp, Mannheimia succiniciproducens
  CDS (1)..(429)
atggcaaaaaaagtccaagcatacgttaagttgcaagttgcagctggtatggctaacccttcaccaccggttggtccggcattaggtcaacaaggtgtaaacatcatggaattctgtaaagcgttcaatgctcgcacagagagcttagaaaaaggtttaccgattcctgtcgttattaccgtttacgcagaccgctcattcactttcgtaactaaaactccaccggcggcggtattattgaaaaaagctgcgggcgttaaatctggttcaggtaaaccgaacaaagaaaaagtgggtaaagtgactttagatcaagttcgtcaaatcgctgaaactaaagcggcggatatgacaggcgcaactatcgaaactaaaatgaaatcaatcgctggtacggctcgctcaatgggcttagtagtagaggaataa

SEQ ID NO: 37978 - protein, 142 aa, Mannheimia succiniciproducens
MAKKVQAYVKLQVAAGMANPSPPVGPALGQQGVNIMEFCKAFNARTESLEKGLPIPVVITVYADRSFTFVTKTPPAAVLLKKAAGVKSGSGKPNKEKVGKVTLDQVRQIAETKAADMTGATIETKMKSIAGTARSMGLVVEE

SEQ ID NO: 37979 - DNA, 429 bp, Mesoplasma florum
  CDS (1)..(429)
gtggctaaaagaattacacgtattgccaaattagaatttatggcgatgcaagcaaaaccaggagcagaattagcttctttaggtattaacatgcctgaatttacaaaacaatttaacgatgctactaaagatcgtgcaggagacgttgttcctgtagttattacagcatatgatgacaaatcatttgactttatactaaaaacaacaccagctgctattttattaaaaaaagcagcaggaattgaaaaaggtgcaagcaatgctaaaactcaaacagttgctactatttcagctgacaaagttagagaaattgctgagtacaaattagttgatttaaatgcaaatgatgttgaagcagcaatgaaaattattgctggtacagctaaaaacatgggaatcaaaattacaggtatggaggaaactaactaa

SEQ ID NO: 37980 - protein, 142 aa, Mesoplasma florum
MAKRITRIAKLEFMAMQAKPGAELASLGINMPEFTKQFNDATKDRAGDVVPVVITAYDDKSFDFILKTTPAAILLKKAAGIEKGASNAKTQTVATISADKVREIAEYKLVDLNANDVEAAMKIIAGTAKNMGIKITGMEETN

SEQ ID NO: 37981 - DNA, 486 bp, Methanosarcina acetivorans
  CDS (1)..(486)
atgacaagtattgttgaagcacttgtccccggaggcaaagcgaatcccggaccaccattaggtccggcacttggtccgctcggggtcaacataaaagaagtggtcgaaaagatcaacgaaaaaacaagggactacaatggaatgcaggtccctgtgaaagtaattgttgacgacaagaaaaatgtcgagatcgaagtaggcacccctccgaccgcatctctggtcatgaaagagctggggatccagaaagggtcaggaaatgcgggaagcgaggtagttggaaaccttacaatctcgcaggtagcaaaagtcgcccgtatgaaaaaggaagacgtgctatcttatgacctcaaagctgcaatgaaagaagtaatgggctcctgtgtcccgatgggcgtgaacgtagagggaatgaaagctaaggactgccagaaggcactcgatgaaggcaaatttgacgatttgcttgcaggcgaggcatggtaa

SEQ ID NO: 37982 - protein, 161 aa, Methanosarcina acetivorans
MTSIVEALVPGGKANPGPPLGPALGPLGVNIKEVVEKINEKTRDYNGMQVPVKVIVDDKKNVEIEVGTPPTASLVMKELGIQKGSGNAGSEVVGNLTISQVAKVARMKKEDVLSYDLKAAMKEVMGSCVPMGVNVEGMKAKDCQKALDEGKFDDLLAGEAW

SEQ ID NO: 37983 - DNA, 486 bp, Methanococcus jannaschii
  CDS (1)..(486)
atggctaaggaggttgttgaagtattagttactggaggtagagcaacagcagggccaccattagggcctgcaattgggcctttaggagtcaatgtcatgcaagttgttaaagagattaatgaaaaaacaaaagactatgaaggaatgcaagttccagttaaagttatagttgataccgaaacaagaaagtttgaaattgaagttggaattcctccaacaactgctctaattaaaaaggagttaggaattgaaaccgctgctcacgaaccaagacatgaagttgttggaaacttaacattggaacaggttattaaaatagctaagatgaaaaaagatgctatgctctcatatacattaaagaacgctgtaaaagaggttttaggaacctgtggttcaatgggagtgacagttgaaggaaaagaccctaaagaagtccaaaaagagattgatgctggagtttatgatgaatactttaaagaagaataa

SEQ ID NO: 37984 - protein, 161 aa, Methanococcus jannaschii
MAKEVVEVLVTGGRATAGPPLGPAIGPLGVNVMQVVKEINEKTKDYEGMQVPVKVIVDTETRKFEIEVGIPPTTALIKKELGIETAAHEPRHEVVGNLTLEQVIKIAKMKKDAMLSYTLKNAVKEVLGTCGSMGVTVEGKDPKEVQKEIDAGVYDEYFKEE

SEQ ID NO: 37985 - DNA, 501 bp, Methanopyrus kandleri
  CDS (1)..(501)
atgccgaaggaagaggttgaagttctcatcgaaggaggtaaagctgaccctggaccaccgctcggacccgctctaggtccgctcggtgttaacatacaggaagttgttgaagagattaaccgtaagacgaaggacttcaaaggtatggaagtcccagtcaagatcatagttgacacggagaccagagagttcgaagtgaaagttggatcacctccgacttctgcgataatcaagtcagaacttggtattgataagggagcgcatgaacctagacacgaaacagtgggcgatctctcgatggaacaggtgatcaaaatcgcgaaaatgaagttcgacgatttactgtcatatgatttgaagacggcggctaaagagatcctaggaacatgtggaagtatgggagttacggttgaagggaaggatccaaaggaggttcagaaagaaatcgacgaaggaaagtgggatgacctgttcgagaagtacgaggaggaagaggagtaa

SEQ ID NO: 37986 - protein, 166 aa, Methanopyrus kandleri
MPKEEVEVLIEGGKADPGPPLGPALGPLGVNIQEVVEEINRKTKDFKGMEVPVKIIVDTETREFEVKVGSPPTSAIIKSELGIDKGAHEPRHETVGDLSMEQVIKIAKMKFDDLLSYDLKTAAKEILGTCGSMGVTVEGKDPKEVQKEIDEGKWDDLFEKYEEEEE

SEQ ID NO: 37987 - DNA, 486 bp, Methanosarcina mazei
  CDS (1)..(486)
atgacaagtattgttgaagcacttgtccccggaggaaaagcgaatcccggaccaccattaggtccggcacttggtccgctcggggttaacataaaagaagtggtcgaaaagatcaacgaaaaaacaagggactacaatggaatgcaggtccctgtgaaagtaattgttgacgacaagaaaaacgtcgaaatcgaggtaggtaccccaccgactgcatccctggtcatgaaagagcttgggatccagaaagggtctggaaatgcaggaagtgaggttgttggaaacctgacaatccctcaggttgcaaagatcgcccgtatgaaaaaggaagacgtactttcttacgacctcaaagctacaatgaaagaggtcatgggcacctgtgtccctatgggcgtgaatgtagagggaatgaaggcaaaggactgccagaaagcactcgatgaaggcaaatttgacgatttgcttgcaaacgaggcgtggtaa

SEQ ID NO: 37988 - protein, 161 aa, Methanosarcina mazei
MTSIVEALVPGGKANPGPPLGPALGPLGVNIKEVVEKINEKTRDYNGMQVPVKVIVDDKKNVEIEVGTPPTASLVMKELGIQKGSGNAGSEVVGNLTIPQVAKIARMKKEDVLSYDLKATMKEVMGTCVPMGVNVEGMKAKDCQKALDEGKFDDLLANEAW

SEQ ID NO: 37989 - DNA, 483 bp, Methanobacterium thermoautotrophicum
  CDS (1)..(483)
atggctaaagaaaccgttgaaattcttattgatggtggaaaagccactccaggaccacctctgggtcctgcgattggtccgcttggaattaacatgatgcaggtagttgaggagataaaccgcaagacagctgactttgaggggatgaaggtccctgtaaagatcatagtggacactgatacaagggactttgaggttgaagtgggtacccctccaacaactgccctcatcatggatgaactcaagctggagaaggggtcccaggatccagggatggataagatagcagacatttcaatggaacaggtgctgaagatcgccaggatgaaattcgatgcgctcctctcaaatgactacaaacgtgcagtcaaggagataatgggtacctgtgtcagcatgggtataacagtgaacggtaaggacccccgtgaggttcagagggaggttgaccagggagtctatgatgacctcctcacatcataa

SEQ ID NO: 37990 - protein, 160 aa, Methanobacterium thermoautotrophicum
MAKETVEILIDGGKATPGPPLGPAIGPLGINMMQVVEEINRKTADFEGMKVPVKIIVDTDTRDFEVEVGTPPTTALIMDELKLEKGSQDPGMDKIADISMEQVLKIARMKFDALLSNDYKRAVKEIMGTCVSMGITVNGKDPREVQREVDQGVYDDLLTS

SEQ ID NO: 37991 - DNA, 459 bp, Mycoplasma gallisepticum
  CDS (1)..(459)
gtgttgcttgtggctaaaaaagaaatcacaagaattgccaaactagaactaatcggtggtcaggctaagcctggaccagctttagcttcagttgggattaatatgggtgaattcaccaaacaatttaacgaaaaaactaaagaccgaatgggagacgtagttcctgttattattactgcatttaatgacaagagcttcttattcgaattaaaaacaactccagtaacggttcttttaaaaaaagctgctaagatcgaaagtggtgctaaaaaccctaagactgaaaaagttggaaagatctctaaagcagaagctttaaagattgctgaatataagatggctgatcttaatgcttatgatactgaagctgctttaagaatgatcgctggtacagctaaacaaatgggattagagatcgaaggtgttgatcctgttactaagagcaagaaaggatcttaa

SEQ ID NO: 37992 - protein, 152 aa, Mycoplasma gallisepticum
MLLVAKKEITRIAKLELIGGQAKPGPALASVGINMGEFTKQFNEKTKDRMGDVVPVIITAFNDKSFLFELKTTPVTVLLKKAAKIESGAKNPKTEKVGKISKAEALKIAEYKMADLNAYDTEAALRMIAGTAKQMGLEIEGVDPVTKSKKGS

SEQ ID NO: 37993 - DNA, 429 bp, Mycobacterium leprae
  CDS (1)..(429)
atggccacgaaaaagaaagtcgccgggctgatcaagcttcagattcaggcggggcaggccaaccctgctccgccggtcgggcccgcgctcggccagcacggcgtcaacatcatggagttctgcaaggcgtacaatgctgccactgagaaccagcgtggccaggtcataccggtggagatcacggtctacgaggaccgcagcttcacttttgcgctcaagacgccgcctgccgccaagttgctcctcgatgctgccggggtgggcaagggggtggccgagccgcacaagactaaggtcgttaaggtcagctgggatcaagttcgggagattgctgaaaccaagaaggctgacctcaacgccaacgacatcgacgcagccgccaagatcatcgccggtaccgccaggtcgatgggcatcaccgtcgagtaa

SEQ ID NO: 37994 - protein, 142 aa, Mycobacterium leprae
MATKKKVAGLIKLQIQAGQANPAPPVGPALGQHGVNIMEFCKAYNAATENQRGQVIPVEITVYEDRSFTFALKTPPAAKLLLDAAGVGKGVAEPHKTKVVKVSWDQVREIAETKKADLNANDIDAAAKIIAGTARSMGITVE

SEQ ID NO: 37995 - DNA, 429 bp, Mycobacterium paratuberculosis
  CDS (1)..(429)
atggccccgaagaagaaagtcgtcgggctgatcaagctccagatccaggcggggcaggccaacccggcgccgccggtcgggcccgcgctcggtcagcacggcgtcaacatcatggagttctgcaaggcctacaacgccgccaccgagaaccagcgcggccaggtcatccccgtcgagatcaccgtctacgaggaccgcagcttcacgttcgcgctcaagaccccgcccgcggccaagctgttgctcaaggccgccggtgtgggtaagggctcggccgagccgcacaagaacaaagtcgccaaggtcagctgggaccaggtcaaggagatcgccgagaccaagaaggccgacctgaacgccaacgacatcgacgccgcggccaagatcatcgccggcaccgcccggtcgatgggtatcaccgtcgagtag

SEQ ID NO: 37996 - protein, 142 aa, Mycobacterium paratuberculosis
MAPKKKVVGLIKLQIQAGQANPAPPVGPALGQHGVNIMEFCKAYNAATENQRGQVIPVEITVYEDRSFTFALKTPPAAKLLLKAAGVGKGSAEPHKNKVAKVSWDQVKEIAETKKADLNANDIDAAAKIIAGTARSMGITVE

SEQ ID NO: 37997 - DNA, 483 bp, Nanoarchaeum equitans
  CDS (1)..(483)
atgggtgagatagcaattagacttttagttacaggaggtaaagcgacccctggcccaccaatagggcctgcacttagcccattcaaaataaaccctggtaaggttgtcgcagaaataaacaaactcactaaagaatatgaaggtttgcctgtacctgtagaaataataataaatccagaaaccaaggaatataaaatcatcgttggtttgcctccaacttcagcattattaatgaaagctgctggagtaacaaggggcccacaaagaacagttcacgaatgggttggtaatgtatctatgaaagatgttgtggaaatagctaaaaagaaaatagattctatgccaactagttctttaaaagcagcagtcaaatctgtattaggtacagcgagggccactggtataaaagttgagaacaaagacccaaaagaagtaactaaagaggttgacgaaggaaaatgggaccatattataaatgaatag

SEQ ID NO: 37998 - protein, 160 aa, Nanoarchaeum equitans
MGEIAIRLLVTGGKATPGPPIGPALSPFKINPGKVVAEINKLTKEYEGLPVPVEIIINPETKEYKIIVGLPPTSALLMKAAGVTRGPQRTVHEWVGNVSMKDVVEIAKKKIDSMPTSSLKAAVKSVLGTARATGIKVENKDPKEVTKEVDEGKWDHIINE

SEQ ID NO: 37999 - DNA, 435 bp, Neisseria meningitidis
  CDS (1)..(435)
gtggcaaagaaaattatcggctatattaaactgcaaattcctgcaggtaaagccaatccatctcctccggttggtcctgctttgggtcagcgcggtttgaatattatggaattttgtaaggcatttaatgctgcaacccaaggtatggagcctggcttaccgattccggttgtgattactgcatttgcagataaatcattcacatttgtgatgaaaaccccgccagcttctatcttgttgaaaaaggctgccggtttgcaaaaaggtagttctaatcctctgaccaacaaagtgggtaaattgacccgtgcccagttggaagaaattgctaaaactaaagagcctgatttgactgctgctgacttggatgcggctgtccgtactatagcaggttctgctcgctcaatgggcttggatgtggagggtgttgtataa

SEQ ID NO: 38000 - protein, 144 aa, Neisseria meningitidis
MAKKIIGYIKLQIPAGKANPSPPVGPALGQRGLNIMEFCKAFNAATQGMEPGLPIPVVITAFADKSFTFVMKTPPASILLKKAAGLQKGSSNPLTNKVGKLTRAQLEEIAKTKEPDLTAADLDAAVRTIAGSARSMGLDVEGVV

SEQ ID NO: 38001 - DNA, 435 bp, Neisseria meningitidis
  CDS (1)..(435)
gtggcaaagaaaattatcggctatattaaactgcaaattcctgcaggtaaagccaatccatctcctccggttggtcctgctttgggtcagcgcggtttgaatattatggaattttgtaaggcatttaatgctgcaacccaaggtatggagcctggcttaccgattccggttgtgattactgcatttgcagataaatcattcacatttgtgatgaaaaccccgccagcttctatcttgttgaaaaaggctgccggtttgcaaaaaggtagttctaatcctctgaccaacaaagtgggtaaattgacccgtgcccagttggaagaaattgctaaaactaaagatcctgatttgactgctgctgacttggatgcggctgtccgtactatagcaggttctgctcgctcaatgggcttggatgtggagggtgttgtataa

SEQ ID NO: 38002 - protein, 144 aa, Neisseria meningitidis
MAKKIIGYIKLQIPAGKANPSPPVGPALGQRGLNIMEFCKAFNAATQGMEPGLPIPVVITAFADKSFTFVMKTPPASILLKKAAGLQKGSSNPLTNKVGKLTRAQLEEIAKTKDPDLTAADLDAAVRTIAGSARSMGLDVEGVV

SEQ ID NO: 38003 - DNA, 432 bp, Nitrosomonas europaea
  CDS (1)..(432)
ttggcaaaaaaaatagtaggttatataaagctgcaaataccagcaggtaaagcaaatccaagtcctccagtggggccagcacttgggcagcgccagctgaatattatggaattttgtaaagcttttaacgcagcaactcaaaaaatggagcctggattgcccgtgccggtggtaattacagcttatgcagataagagttttacattcatcctgaaaacaacccctgcatctgttttaattaagaaattagccggtctcagtaaaggtagcgcacaacctcatgtagataaggtgggtaaattaacccgcagtcaggcagaagaaatcgcgaaaataaaaatggctgatcttactgctgcagatatggatgcagctgtccggacaattgccggtagtgcccggagtatgggtgtggaagtcgatggggtatga

SEQ ID NO: 38004 - protein, 143 aa, Nitrosomonas europaea
MAKKIVGYIKLQIPAGKANPSPPVGPALGQRQLNIMEFCKAFNAATQKMEPGLPVPVVITAYADKSFTFILKTTPASVLIKKLAGLSKGSAQPHVDKVGKLTRSQAEEIAKIKMADLTAADMDAAVRTIAGSARSMGVEVDGV

SEQ ID NO: 38005 - DNA, 426 bp, Onion yellows phytoplasma
  CDS (1)..(426)
atggctaaaaaagttgttaaaacggtaaaattacaaattcctgcaggaaaagctaatccagctcctccagtaggacctgctttagggcaagcccaagttaatattccttctttttgttcccaatttaacgaaacaactaaagatcaaatgggtttcgttatccctgttatcatttctgtttatgaggacagaacatttacttttgtaactaaaactcctccagcaagcgatcttttaaaaaaagctgctaaaattgaatctggttctgctaatgcaagtcaaaccaaagtagctactatcacccacaaacaagtagaagaaatcgccaatttaaagcttccagacctaaatgcttattgcgttgaaaaagcttgcaaaatcattgaaggaacagctcgtaatatgggaattttagtaaaagattaa

SEQ ID NO: 38006 - protein, 141 aa, Onion yellows phytoplasma
MAKKVVKTVKLQIPAGKANPAPPVGPALGQAQVNIPSFCSQFNETTKDQMGFVIPVIISVYEDRTFTFVTKTPPASDLLKKAAKIESGSANASQTKVATITHKQVEEIANLKLPDLNAYCVEKACKIIEGTARNMGILVKD

SEQ ID NO: 38007 - DNA, 429 bp, Parachlamydia sp
  CDS (1)..(429)
atgtcaaaaaaagttgttaaggtgatcaagctgcagattcctgcagggaaagccaatccagctcctccaatcggaccagcattgggagcagcgggtgtaaacatcatggctttttgtaaggaatttaatgcgaaaacacaagcgatggcgggggatgtacttcctacactcatcactgtgtatcatgataagtcgttttcatttataactaaaaagccccctgttgccgaattgcttaaaaaagcaaaaggaatagcgaaaggttcaggcgttccaaaccgagataaagttgcaaaaattacacgttcagaagcgcgcaaaattgctgaagaaaaaattcaggatatgaacgctgcagatttggaaatggcaactaatattgttttgggaacagctcgttccatgggaattgatctcataaaagagtag

SEQ ID NO: 38008 - protein, 142 aa, Parachlamydia sp
MSKKVVKVIKLQIPAGKANPAPPIGPALGAAGVNIMAFCKEFNAKTQAMAGDVLPTLITVYHDKSFSFITKKPPVAELLKKAKGIAKGSGVPNRDKVAKITRSEARKIAEEKIQDMNAADLEMATNIVLGTARSMGIDLIKE

SEQ ID NO: 38009 - DNA, 429 bp, Pasteurella multocida
  CDS (1)..(429)
atggcaaaaaaagtacaagcctatgttaagttgcaagttgcagctggtatggctaacccttcaccaccagttggtcctgcgttaggtcaacaaggtgtgaacatcatggaattctgtaaagcattcaacgctcgtactgagagtttagaaaaaggtttaccaattccagttgttattactgtgtatgcagaccgttcattcacgttcattacgaaaacaccaccagcagcagtattattgaaaaaagctgcaggtatcaagtctggttcaggtaaaccaaacaaagataaagtgggtaaagtaacattagaacaagttcgtcaaatcgctgaaaccaaagcagcagatatgacaggttcttctatcgaaacgaaaatgaaatcaatcgctggtacagctcgctcaatgggcttagtggtggaggaataa

SEQ ID NO: 38010 - protein, 142 aa, Pasteurella multocida
MAKKVQAYVKLQVAAGMANPSPPVGPALGQQGVNIMEFCKAFNARTESLEKGLPIPVVITVYADRSFTFITKTPPAAVLLKKAAGIKSGSGKPNKDKVGKVTLEQVRQIAETKAADMTGSSIETKMKSIAGTARSMGLVVEE

SEQ ID NO: 38011 - DNA, 429 bp, Photorhabdus luminescens
  CDS (1)..(429)
atggctaagaaagtacaagcctatgtcaagttgcaggttgcagctggtatggctaatccaagccctccagtaggtcctgctctgggtcagcagggtgttaacatcatggaattctgtaaggcgttcaatgctaaaactgatagcattgaaaaaggtctgccaattcctgttgtgatcactgtttattctgatcgttccttcactttcgttactaaaaccccaccagcggctgttctgctgaagaaagcggcgggcattaaatcgggttccggcaaaccgaacaaagacaaagttggtaaagtgaccagcgcacagattcgtgaaattgctgaaactaaagctgcggatatgaccggtgctagcgttgacgcaatgatgcgttcaattgaaggtactgctcgttccatgggcctggtagtggagggttaa

SEQ ID NO: 38012 - protein, 142 aa, Photorhabdus luminescens
MAKKVQAYVKLQVAAGMANPSPPVGPALGQQGVNIMEFCKAFNAKTDSIEKGLPIPVVITVYSDRSFTFVTKTPPAAVLLKKAAGIKSGSGKPNKDKVGKVTSAQIREIAETKAADMTGASVDAMMRSIEGTARSMGLVVEG

SEQ ID NO: 38013 - DNA, 429 bp, Photobacterium profundum
  CDS (1)..(429)
atggctaaaaaagtagaagcgtacatcaagctgcaggttgcagctggtgcagcaaacccaagtccaccagttggtcctgctctaggtcagcacggtgttaacatcatggaattctgtaaagcgttcaacgcacgtacagattctgttgagaagggtcttccgactcctgttgttatcacagtttacagtgaccgttctttcacgttcatcactaagactccacctgctgcagttcttcttaagaaagcagctggcgttaagtctggttctggccgtccgaatactgaaaaagttgggactgttactgacgctcaggttcaggaaattgctgaaactaaagcagctgatatgactggtgctgacatcgaagctatgaagcgttcgattgcaggtactgctcgttcaatgggcctagtggtagagggttaa

SEQ ID NO: 38014 - protein, 142 aa, Photobacterium profundum
MAKKVEAYIKLQVAAGAANPSPPVGPALGQHGVNIMEFCKAFNARTDSVEKGLPTPVVITVYSDRSFTFITKTPPAAVLLKKAAGVKSGSGRPNTEKVGTVTDAQVQEIAETKAADMTGADIEAMKRSIAGTARSMGLVVEG

SEQ ID NO: 38015 - DNA, 468 bp, Picrophilus torridus
  CDS (1)..(468)
atggtagcagtcaaaaccatggttgagggtggtaaggcaacaaccgggccgcctcttggacctgcccttggtccccttggccttaatcttggccaggtggttaaggacataaatgaaaaaacaaagaacttcgccgggatgcaggttcctgttacggtaaatgttatagatcccgcaacaaagaagtatgagatcattgttggtgttccaccaacatcagcacttcttaaaaaggagcttggcattgagaagggggcatccaagaagaaggaaaagatagctggcaatgccacgcttgagcagataaagaaggttgcagaatcaaagagatcggccctgctttcatataatatgaagggcgccgttcttgaggttcttggaagcgcagtatcgcttggaataacagttgatggcagggatccaaaggaagtacagaagatgataaagaacggtgagatagagatataa

SEQ ID NO: 38016 - protein, 155 aa, Picrophilus torridus
MVAVKTMVEGGKATTGPPLGPALGPLGLNLGQVVKDINEKTKNFAGMQVPVTVNVIDPATKKYEIIVGVPPTSALLKKELGIEKGASKKKEKIAGNATLEQIKKVAESKRSALLSYNMKGAVLEVLGSAVSLGITVDGRDPKEVQKMIKNGEIEI

SEQ ID NO: 38017 - DNA, 438 bp, Porphyromonas gingivalis
  CDS (1)..(438)
atggctaaagaagttgctggacaaatcaaattgcaaataaaaggtggtgcagctaatccctcaccccccgttgggcctgcacttggtgcaaagggcatcaacatcatggagttttgcaagcaatttaatgccagaacccaagacaaagccggcaaagtattgcctgtagtaattacgtactatgccgataagtcttttgattttatcgtaaaaactcctcctgttgctattcaactccttgaagctagcaaacagaagagtggttctgcagaacctaatcgtaagaaggtagcagaaatcacatgggagcaagtacgtacgatcgcagaagataagcttgtcgatttgaattgcttcgatatcaaagctgccatgaaaatggtagccggtactgctcgaagcatgggtatcgcgattaaaggggacttcccggaataa

SEQ ID NO: 38018 - protein, 145 aa, Porphyromonas gingivalis
MAKEVAGQIKLQIKGGAANPSPPVGPALGAKGINIMEFCKQFNARTQDKAGKVLPVVITYYADKSFDFIVKTPPVAIQLLEASKQKSGSAEPNRKKVAEITWEQVRTIAEDKLVDLNCFDIKAAMKMVAGTARSMGIAIKGDFPE

SEQ ID NO: 38019 - DNA, 429 bp, Gamma
  CDS (1)..(429)
atggcaaaaaaagtagcaaatattctaaaattacagattcctgctggcggtgctaaccccagtcctcctgttggaccagctttaggtcaagttggagtaaatataatggatttctgtaatgcatttaatgcagaaactcagagtgctgaaaaaggtatgcctcttccagttgtaatcactgtctatgaggataaatcttttacatttgttgttaagacacctccagctgcagttttaataagaaagattcttggtattgccaagggaagtggagagcctaacagagaaaaggttggtaaattaacaagagcacagttagaagatatagctaaacaaaaagaaccagaccttaattcaaatgatattgatgctgcagttctaattattgctggtacagcaagaagcatgggagtcgaggtagatctatga

SEQ ID NO: 38020 - protein, 142 aa, Gamma
MAKKVANILKLQIPAGGANPSPPVGPALGQVGVNIMDFCNAFNAETQSAEKGMPLPVVITVYEDKSFTFVVKTPPAAVLIRKILGIAKGSGEPNREKVGKLTRAQLEDIAKQKEPDLNSNDIDAAVLIIAGTARSMGVEVDL

SEQ ID NO: 38021 - DNA, 426 bp, Prochlorococcus marinus subsp
  CDS (1)..(426)
atggcaaaaaaaattgttgcggttatcaagctagcacttcaagctggcaaagcaaatccagccccaccagtgggtccagctttaggtcaacacggtgtaaatatcatggcattttgcaaagaatataatgcaagaacacaagataaagccggttttgttatacctgttgaaatttcagtttttgaagataggagctttacctttataaccaaaactccacctgcttcagtcttaataactaaagccgctggaatagaaaaaggagctggtgagtcatccaaaggatctgttggcaatataagtaaatctcaattagaggagatagccaaaacaaagcttcctgatttaaactgtacgagtattgaatcagctatgaaggtaattgaaggaactgctcgaaacatgggtgtttctattacagaataa

SEQ ID NO: 38022 - protein, 141 aa, Prochlorococcus marinus subsp
MAKKIVAVIKLALQAGKANPAPPVGPALGQHGVNIMAFCKEYNARTQDKAGFVIPVEISVFEDRSFTFITKTPPASVLITKAAGIEKGAGESSKGSVGNISKSQLEEIAKTKLPDLNCTSIESAMKVIEGTARNMGVSITE

SEQ ID NO: 38023 - DNA, 432 bp, Pseudomonas aeruginosa
  CDS (1)..(432)
atggctaagaaaatccaggcttatatcaagctgcaagtaaaggccggtcaggccaacccgtcgccgccggtcggccctgccctgggtcagcacggcgtgaacatcatggaattctgcaaggcgttcaacgccaagacccaaggccaagagccgggcctgccgactcctgtgatcatcaccgtttacagcgaccgtagcttcaccttcgaaaccaagagcaccccggctgccgtcctgctgaaaaaagcagctggcatcaccagcggctccgctcgtccgaactcccagaaagtcggtaccgttacccgtgcccagctggaagagatcgccaagaccaagcaggctgacctgaccgctgctgatctggacgctgctgtacgtaccatcgctggctccgcgcgcagcatgggcctgaacgtggagggtgtgtaa

SEQ ID NO: 38024 - protein, 143 aa, Pseudomonas aeruginosa
MAKKIQAYIKLQVKAGQANPSPPVGPALGQHGVNIMEFCKAFNAKTQGQEPGLPTPVIITVYSDRSFTFETKSTPAAVLLKKAAGITSGSARPNSQKVGTVTRAQLEEIAKTKQADLTAADLDAAVRTIAGSARSMGLNVEGV

SEQ ID NO: 38025 - DNA, 432 bp, Pseudomonas putida
  CDS (1)..(432)
atggctaagaagattcaggcttacatcaagctgcaagttaaggccggccaggccaacccaagcccacccgttggtccagcactgggtcaacatggtgtgaacatcatggaattctgcaaggccttcaacgcccgtacccagggtcaagaagccggcctgccgactccagtgatcatcactgtctacagcgaccgtagcttcaccttcgagaccaagagcacccctgcctcggttctgctgaagaaagctgctggcctgaccagtggttcggctcgcccgaacaccgttaaagtcggtaccgttacccgtgctcagctggaagacatcgcgaaagccaaacaggctgacctgactgccgctgacctggacgctgctgtacgcaccatcgctggctctgcccgcagcatgggcctgaacgtggagggtgtgtaa

SEQ ID NO: 38026 - protein, 143 aa, Pseudomonas putida
MAKKIQAYIKLQVKAGQANPSPPVGPALGQHGVNIMEFCKAFNARTQGQEAGLPTPVIITVYSDRSFTFETKSTPASVLLKKAAGLTSGSARPNTVKVGTVTRAQLEDIAKAKQADLTAADLDAAVRTIAGSARSMGLNVEGV

SEQ ID NO: 38027 - DNA, 432 bp, Pseudomonas syringae
  CDS (1)..(432)
atggccaagaagataaccgcatacatcaagctgcaagtgaaagccgctcaggctaaccctagcccgccagttggtcctgctctgggtcagcacggtgtgaacatcatggaattctgcaaagcgttcaacgcccgtactcagggtattgagccaggcctgccgactccagtgatcatcactgtatacagcgaccgtagcttcacttttgaaacaaaaagtactcctgcatcggttctgctgaagaaagctgcaggcttgaccagcggctcggctcgcccgaacaccgttaaagtcggcaccgtgactcgtgctcagctggaagatatcgctaaagcaaaaaatgcggatctgactgcagctgacatggaagcggccgtgcgtaccatcgccggttccgctcgtagcatgggccttaacgtggagggtgtgtaa

SEQ ID NO: 38028 - protein, 143 aa, Pseudomonas syringae
MAKKITAYIKLQVKAAQANPSPPVGPALGQHGVNIMEFCKAFNARTQGIEPGLPTPVIITVYSDRSFTFETKSTPASVLLKKAAGLTSGSARPNTVKVGTVTRAQLEDIAKAKNADLTAADMEAAVRTIAGSARSMGLNVEGV

SEQ ID NO: 38029 - DNA, 495 bp, Pyrococcus horikoshii
  CDS (1)..(495)
atgaagaagcaggtcgttgaggttctagttgagggaggaaaggcaactcccggtcctcctcttggtcccgcgataggaccacttggattaaatgtaaagcaagtcgttgataagataaacgaagcgactaaggaattcgccggaatgcaggttccagtgaagataatagttgatccagtaacaaagcagttcgaaattgaggtcggtgttccaccgacgagtcagttgataaagaaggaacttggacttgagaagggaagtggagaacctaagcacaacatcgttggtaacttaaccatggaacaggttataaaaatagccaagatgaagagaagtcaaatgctcgcactaacattaaaagcggcagctaaggaggtcattggaacggccttaagcatgggggttacggttgaagggaaggatccgaggattgtacaaagggaaattgatgagggggtttatgacgaactttttgagaaggccgagaaggagtga

SEQ ID NO: 38030 - protein, 164 aa, Pyrococcus horikoshii
MKKQVVEVLVEGGKATPGPPLGPAIGPLGLNVKQVVDKINEATKEFAGMQVPVKIIVDPVTKQFEIEVGVPPTSQLIKKELGLEKGSGEPKHNIVGNLTMEQVIKIAKMKRSQMLALTLKAAAKEVIGTALSMGVTVEGKDPRIVQREIDEGVYDELFEKAEKE

SEQ ID NO: 38031 - DNA, 432 bp, Ralstonia solanacearum
  CDS (1)..(432)
atggccaagaagattattggctttatcaagctgcagatcccggctggtaaagcaaatccctccccgcccgtcggcccggccctgggtcagcgcggtctgaacatcatggagttctgcaaggcgttcaacgcgcagactcaaggcatggagccgggtctgccggtgccggtggtgatcaccgccttcgcagacaagagcttcaccttcgtgatgaagtcgccgcccgcgaccgtgctcatcaagaaggctgcaggcgttcagaagggttcggccaagccgcataccgacaaggtcggcaagatcacccgcgcccaggctgaagaaatcgccaaggcgaagaacgcggatctcaccgcagcggatctcgacgccgccgtgcgtacgatcgccggtagcgcccgttcgatgggtatcacggtggagggcctgtaa

SEQ ID NO: 38032 - protein, 143 aa, Ralstonia solanacearum
MAKKIIGFIKLQIPAGKANPSPPVGPALGQRGLNIMEFCKAFNAQTQGMEPGLPVPVVITAFADKSFTFVMKSPPATVLIKKAAGVQKGSAKPHTDKVGKITRAQAEEIAKAKNADLTAADLDAAVRTIAGSARSMGITVEGL

SEQ ID NO: 38033 - DNA, 429 bp, Rhizobium meliloti
  CDS (1)..(429)
atggctaagaaagttgcaggccagctcaagctgcaggtaaaggccggctcggcgaatccgtcgccgccgatcggtcctgcgcttggtcagcgtggcattaacatcatggaattctgcaaggcgttcaacgccgccacgcaggaaatggaaaagggtatgccgatcccggtcgtcatcacctattaccaggacaagtccttcacattcgtcatgaagcagccgccggtcagctacttcctgaagcgcgaagcgaaggtccaggcgggctccaagaccccgggcaaggccaaggccggctcgatctccaaggctcagatccgcacgatcgcagaggccaagatgaaggacctcaacgcggccgatatcgatggcgcaatggcgatggttgagggctcggcccgctccatgggcctggaagtgacgggctaa

SEQ ID NO: 38034 - protein, 142 aa, Rhizobium meliloti
MAKKVAGQLKLQVKAGSANPSPPIGPALGQRGINIMEFCKAFNAATQEMEKGMPIPVVITYYQDKSFTFVMKQPPVSYFLKREAKVQAGSKTPGKAKAGSISKAQIRTIAEAKMKDLNAADIDGAMAMVEGSARSMGLEVTG

SEQ ID NO: 38035 - DNA, 426 bp, Rhodopirellula baltica
  CDS (1)..(426)
atggcaaaacaagtcaccggccaagccaagttccaagtccccggcggtcaagccactcctgcacctcctgttggtacatcgctgggtaaatacggcgtgaacttgggacaattcgtccaacagttcaacgatcgcaccaaggaatacaacggcacgccgatacctgtgatcgtaacggtttacaacgaccgcagctttgatttcatcacaaagagcccaccagcggcctcgatgttgatgcaatcagccggcatcgccaaaggcagcggcgtccccaacaaggacaaagttgcaacggtcacccgagcacaatgcgaagagatcgctcaaaagaagatggaagatctcaatgctcgcgacatcgatcaagcgactcgcatgatcgaaggcaccgctcgcagcatgggcatcatcgtcgacggctga

SEQ ID NO: 38036 - protein, 141 aa, Rhodopirellula baltica
MAKQVTGQAKFQVPGGQATPAPPVGTSLGKYGVNLGQFVQQFNDRTKEYNGTPIPVIVTVYNDRSFDFITKSPPAASMLMQSAGIAKGSGVPNKDKVATVTRAQCEEIAQKKMEDLNARDIDQATRMIEGTARSMGIIVDG

SEQ ID NO: 38037 - DNA, 429 bp, Rhodopseudomonas palustris
  CDS (1)..(429)
atggcaaagaaagtgaccggatacctgaagttgcaggtgccggctggagcggcgaacccgtcgcctccgatcggtcccgcgcttggtcagcgcggcctcaacatcatggagttctgcaaggcgttcaacgcgcagacccagaaggaagagaagaacacgccgattccggtggtgatcacgatctacgccgatcggtcgttcaccttcgagatgaagaccccgccgatgtcctacttcctcaagcaggccgccaagatccagtccggctccaagctgccgggccgtgacttcgccggcaaggtgacctccgcccaggtgcgcgagattgccgagaagaagatgaaggatctcaattgcgacaccgtcgagtcggccatgcgcatggtcgagggctctgcccgttcgatgggcctgcgggtcgaggggtaa

SEQ ID NO: 38038 - protein, 142 aa, Rhodopseudomonas palustris
MAKKVTGYLKLQVPAGAANPSPPIGPALGQRGLNIMEFCKAFNAQTQKEEKNTPIPVVITIYADRSFTFEMKTPPMSYFLKQAAKIQSGSKLPGRDFAGKVTSAQVREIAEKKMKDLNCDTVESAMRMVEGSARSMGLRVEG

SEQ ID NO: 38039 - DNA, 438 bp, Rickettsia typhi
  CDS (1)..(438)
atgtctcagaaaacaataaaggggtatattaacttaataattcctgctgctggagctactcctgctcctcctatagggcctgcactaggtcaaagaaaagttaatatagcagcattttgtaaagattttaatgatgctacgaacggtatggagaaaggagtacctttacctactgtaattacagtttatgacgataatagtttttcttttaaagttaaaactccacctgcttcatattttctaaaaaagtatgctaaaattactaaaggttctagcgctactaaaaaagaagctatggttggtaaagtgactctagatgcttgtcgtgaaattgcaaagttaaaaatatctgatttaaatacaaaaaatattgaagcagcaaccaagattatttgtggtagtgctgcatctatgggacttgaagtagtagggaattaa

SEQ ID NO: 38040 - protein, 145 aa, Rickettsia typhi
MSQKTIKGYINLIIPAAGATPAPPIGPALGQRKVNIAAFCKDFNDATNGMEKGVPLPTVITVYDDNSFSFKVKTPPASYFLKKYAKITKGSSATKKEAMVGKVTLDACREIAKLKISDLNTKNIEAATKIICGSAASMGLEVVGN

SEQ ID NO: 38041 - DNA, 429 bp, Shewanella oneidensis
  CDS (1)..(429)
atggcaaaaaagattgatgcttatattaagctacaagtgaaatcaggttctgcgaacccttcaccaccagttggtccagctctgggtcagaaaggtgtgaacatcatggaattctgtaaagcgtttaacgctcgtacagaaaaaatggaaaaaggcatgcctattccagtcgtgatcactgtatacagtgaccgttcattcactttcgaaactaagactccaccagcttcttacttactgaagactgctgcaggcctgaaatcaggttctccacgtccaaacactcagaaagtaggtactatcgctcgtgctaagattcaggaaattgctgaaatgaaagccgccgatatgactggtgctgatgttgaagcgatgactcgctcaatcgaaggtactgcgcgttcaatgggtttggttgtagagggttaa

SEQ ID NO: 38042 - protein, 142 aa, Shewanella oneidensis
MAKKIDAYIKLQVKSGSANPSPPVGPALGQKGVNIMEFCKAFNARTEKMEKGMPIPVVITVYSDRSFTFETKTPPASYLLKTAAGLKSGSPRPNTQKVGTIARAKIQEIAEMKAADMTGADVEAMTRSIEGTARSMGLVVEG

SEQ ID NO: 38043 - DNA, 423 bp, Staphylococcus epidermidis
  CDS (1)..(423)
gtggctaaaaaagtagaaaaagtagttaaattgcaaattcctgcaggtaaagcgaatccagcaccaccagttggtccagcattaggtcaagcaggtgtgaacattatgggattctgtaaagaattcaatgctcgtacgcaagaacaagcaggtttaatcattccggtagaaatcagtgtttatgaagaccgttcatttacattcattacaaaaactccgccggctccagtactacttaaaaaagcagctggtgttgaaaaaggttctggtgaacctaataaaactaaagttgcaacagtaactaaagatcaagtacgcgaaattgctcaaacaaaaatgcaagacttaaatgctgcagacgaagaagcggcaatgcgtattattgaaggtactgcacgtagcatgggtatcactgtacaataa

SEQ ID NO: 38044 - protein, 140 aa, Staphylococcus epidermidis
MAKKVEKVVKLQIPAGKANPAPPVGPALGQAGVNIMGFCKEFNARTQEQAGLIIPVEISVYEDRSFTFITKTPPAPVLLKKAAGVEKGSGEPNKTKVATVTKDQVREIAQTKMQDLNAADEEAAMRIIEGTARSMGITVQ

SEQ ID NO: 38045 - DNA, 426 bp, Synechococcus elongatus
  CDS (1)..(426)
atggcgaaaaaggtcgtcgcagttattaaactggccattcaagcaggtaaagccaaccctgctccccccattggtccagcccttggtcagcacggtgtgaacatcatgatgttctgtaaagagtacaatgcgcgcaccgccgatcaagtggggatggtggttcccgttgaaatttcggtctatgaagatcgcagtttcacctttgttctcaaaacgccgcccgcttccgtactgatccaaaaagctgctggcattgaaaagggctccggcgaacccaataagaaaaaagtgggcagcatcacccgtgcccaactgcgggaaattgctgagaagaaaatgccggatctgaatgctaacgatattgaagcggccatgcgcattatcgagggcacggcccgcaatatgggtgtgaccattaccgactaa

SEQ ID NO: 38046 - protein, 141 aa, Synechococcus elongatus
MAKKVVAVIKLAIQAGKANPAPPIGPALGQHGVNIMMFCKEYNARTADQVGMVVPVEISVYEDRSFTFVLKTPPASVLIQKAAGIEKGSGEPNKKKVGSITRAQLREIAEKKMPDLNANDIEAAMRIIEGTARNMGVTITD

SEQ ID NO: 38047 - DNA, 426 bp, Synechococcus sp
  CDS (1)..(426)
atggccaagaaagtcaccgctgttatcaagctggccctccaggccggcaaagccaaccccgcgccgccggtgggccctgccctcggtcagcacggtgtgaacatcatgatgttctgcaaggagtacaacgctcggacgcaggacaaggccggttttgtgattccggtggagatctcggtctatgaagaccgcagcttcaccttcatcaccaagacgcccccggcgtcggtgttgatcaccaaggccgccaagatcgagaaaggttccggcgagtccgccaagggcaatgttggatcgatcaaccgagctcagctcgaggagatcgccaaaaccaagcttcccgatctcaactgcacaagcgttgagtccgcgatgcggatcatcgaaggaaccgcccgaaacatgggcgtgtccatcagcgactga

SEQ ID NO: 38048 - protein, 141 aa, Synechococcus sp
MAKKVTAVIKLALQAGKANPAPPVGPALGQHGVNIMMFCKEYNARTQDKAGFVIPVEISVYEDRSFTFITKTPPASVLITKAAKIEKGSGESAKGNVGSINRAQLEEIAKTKLPDLNCTSVESAMRIIEGTARNMGVSISD

SEQ ID NO: 38049 - DNA, 471 bp, Thermoplasma acidophilum
  CDS (1)..(471)
atggcacagtcagtgaagacgatggtggaaggtgggaaggccaccacgggaccacccataggacctgcactgggtccacttggattgaacgttgcccaggtagtcaaggagattaatgagaagacaaaggaatttcagggaatgagagtccctgttacgataaccgttgtcgatcctgagacaaagaaatacgagataaccgttggaattcctcccacctctgcactgttgaagaaaaagttgggaatagaaaagggagctgcgaagagaaaggaagcaattgctggaaatgctacgctggatcagattgttgatgttgcaaagaccaagatggcatccatgcttgcaagcgacctcaaggctgcgacacttgaggttctcgggacctgcgtatccatgggaataaacgtggatgggaaggatccgaaagaggttcagcgccaaataaaggcaggagagatctccatttaa

SEQ ID NO: 38050 - protein, 156 aa, Thermoplasma acidophilum
MAQSVKTMVEGGKATTGPPIGPALGPLGLNVAQVVKEINEKTKEFQGMRVPVTITVVDPETKKYEITVGIPPTSALLKKKLGIEKGAAKRKEAIAGNATLDQIVDVAKTKMASMLASDLKAATLEVLGTCVSMGINVDGKDPKEVQRQIKAGEISI

SEQ ID NO: 38051 - DNA, 426 bp, Thermotoga maritima; identical to SEQ ID NO: 37695
  CDS (1)..(426)

SEQ ID NO: 38052 - protein, 141 aa, Thermotoga maritima; identical to SEQ ID NO: 37696

SEQ ID NO: 38053 - DNA, 444 bp, Thermus thermophilus
  CDS (1)..(444)
atgaagaaagtcgttgcggtggtcaaacttcagctgcccgcgggcaaggccacgcccgcgcccccggtgggcccggctttgggccagcacggggccaacatcatggagttcgtcaaggccttcaacgcggccacggccaacatgggggacgccatcgtccccgtggagatcaccatctacgcggaccgctccttcaccttcgtcaccaagaccccgcccgcgagctacctgatccgcaaggcggcgggcttggagaagggggcccacaagcccggccgggagaaggtgggccggatcacctgggagcaggtcctggagatcgccaagcagaagatgcccgatctgaacaccaccgacctcgaggccgccgcccggatgatcgcgggctcggcccggtccatgggcgtggaggtggtgggcgctccggaggtgaaggatgcctaa

SEQ ID NO: 38054 - protein, 147 aa, Thermus thermophilus
MKKVVAVVKLQLPAGKATPAPPVGPALGQHGANIMEFVKAFNAATANMGDAIVPVEITIYADRSFTFVTKTPPASYLIRKAAGLEKGAHKPGREKVGRITWEQVLEIAKQKMPDLNTTDLEAAARMIAGSARSMGVEVVGAPEVKDA

SEQ ID NO: 38055 - DNA, 423 bp, Thermoanaerobacter tengcongensis
  CDS (1)..(423)
atggcaaagaaggttgtagctgttgtgaagattcaactgccagcgggcaaagccactcctgcgccaccagtgggtactgcgttaggtccccatggtgttaatataatggctttttgtaaagaatttaacgaaagaacagcaaaagacgcagggcttatcatccctgttgtgataacaatatactcagataggtcctttagtttcataacaaagactcctccagcgtctgttttgctcaaaaaagctgctggaattgagtctggttctcctcagccaaataagcagaaagtcggtaaaattacgaagcagcaattaagagagattgctgagataaagatgagagatttaaacaccacagatatagaggctgctatgaggatgattgctggaactgctagaagcatgggaatagaaattgtgtaa

SEQ ID NO: 38056 - protein, 140 aa, Thermoanaerobacter tengcongensis
MAKKVVAVVKIQLPAGKATPAPPVGTALGPHGVNIMAFCKEFNERTAKDAGLIIPVVITIYSDRSFSFITKTPPASVLLKKAAGIESGSPQPNKQKVGKITKQQLREIAEIKMRDLNTTDIEAAMRMIAGTARSMGIEIV

SEQ ID NO: 38057 - DNA, 477 bp, Thermoplasma volcanium
  CDS (1)..(477)
atggcgcagtcagtaaagactatggtggaaggtggaaaagccaccacgggaccacctatagggccagcattgggtccacttggactaaacgtagcacaggtagtaaaggaaataaatgaaaagactaaagagtttcagggtatgcaggtgcctgtgactgtaaccgttatagatccagagacgaagaagtatgagataacggtaggggttccgcccacgtcagctcttctaaaaaaagagcttgggcttgagaagggagcttctaagaaaaaggaagctgtagcaggtaacgctaccttagagcagataaaaaatgtagcgataaagaagatgccatccatgctcgccaaagacctaaagtcagctgttttggaggttcttggtacctgcgtagctatgggaataaacgttgaggggaaagatccgaaggaagtccagaagctaataaagagtggacaaatcaagatcgaacagtag

SEQ ID NO: 38058 - protein, 158 aa, Thermoplasma volcanium
MAQSVKTMVEGGKATTGPPIGPALGPLGLNVAQVVKEINEKTKEFQGMQVPVTVTVIDPETKKYEITVGVPPTSALLKKELGLEKGASKKKEAVAGNATLEQIKNVAIKKMPSMLAKDLKSAVLEVLGTCVAMGINVEGKDPKEVQKLIKSGQIKIEQ

SEQ ID NO: 38059 - DNA, 432 bp, Treponema denticola
  CDS (1)..(432)
atggcaaagaaaaaggttgtgacacagattaaacttcagtgtcccgcaggaaaagcaactcctgcgccgcctataggcccggctctaggtccgcacggtgtaagtgcgccccagtttgtacagcagttcaatgaccgtacaaagtccatggagcccggtttggttatccccgttgttattacggtatatgccgataagagttttacttttatcctcaaaacaccgcccgcatcggttttaatcaaaaaagcctgtaagattgaaaaaggttctgccacatcggttactgcaaaagtcggaaaactttcaaaggccgcattggaagaaatcgcaaaaacaaagatgcccgatatcaatgcaaacgacattgaagctgcaaagaaaatcattgcaggaactgcacgaagtatgggtgtagaggtggagcgctag

SEQ ID NO: 38060 - protein, 143 aa, Treponema denticola
MAKKKVVTQIKLQCPAGKATPAPPIGPALGPHGVSAPQFVQQFNDRTKSMEPGLVIPVVITVYADKSFTFILKTPPASVLIKKACKIEKGSATSVTAKVGKLSKAALEEIAKTKMPDINANDIEAAKKIIAGTARSMGVEVER

SEQ ID NO: 38061 - DNA, 426 bp, Tropheryma whipplei
  CDS (1)..(426)
atggctgataaaaaagtggttggagtaataaaactgcaaatccaggctggtgctgcaaatccggcgccaccggttgggcccgctctgggacagcacggtgttaacataatggaattttgtaaggcgtacaacgcggcaaccgaatcacagaagggtaatgttattccggttgagatcagtgtttatgaggataggtcatttacttttgtcctaaaaaccccgcctgtggttgagcttatcaagaaagctgcgcgtatttccaagggttcgccgactccccacaaccttaaggttgctcagattacccctgagcaagtcaagagtattgcagaggctaagatggttgatttgaatgcaaacgatattgatgcggcatcaaagattgttcggggaaccgcacgttctatgggtgtgactgtagcatga

SEQ ID NO: 38062 - protein, 141 aa, Tropheryma whipplei
MADKKVVGVIKLQIQAGAANPAPPVGPALGQHGVNIMEFCKAYNAATESQKGNVIPVEISVYEDRSFTFVLKTPPVVELIKKAARISKGSPTPHNLKVAQITPEQVKSIAEAKMVDLNANDIDAASKIVRGTARSMGVTVA

SEQ ID NO: 38063 - DNA, 453 bp, Ureaplasma parvum
  CDS (1)..(453)
gtggctcctaaaaagaaagaagttacaagaatcgcaaagttaaatctaattggtggacaagctaaacctggtccagcattagcatcagttggtattaatatggctgagtttactaagtcatttaatgataaaactaaagaccaaaacggtaaggttatcccagtaattattacagcttataaagataaatcatttgattatgttatcaaaactactcccgtgacttttttactaaaagatattgctaaaatcaaaagtggtgccaaagatcctaaaaagcaaactgttgcaacaatttcaaaagaacaagctttagaaatagctcgttataaattgattgatatgacagcatatgatgaagaagccgctttaagaatgattgctggttctgcaaaacaaatgggaattgtaattgaaggcgtaagtgcatataaagaaaagaaaggtaactaa

SEQ ID NO: 38064 - protein, 150 aa, Ureaplasma parvum
MAPKKKEVTRIAKLNLIGGQAKPGPALASVGINMAEFTKSFNDKTKDQNGKVIPVIITAYKDKSFDYVIKTTPVTFLLKDIAKIKSGAKDPKKQTVATISKEQALEIARYKLIDMTAYDEEAALRMIAGSAKQMGIVIEGVSAYKEKKGN

SEQ ID NO: 38065 - DNA, 429 bp, Vibrio parahaemolyticus
  CDS (1)..(429)
atggctaagaaagttgaagcttacatcaagctacaagttgctgctggcgctgcgaacccaagtccaccagttggtcctgctctaggtcaacacggtgttaacatcatggaattctgtaaagcgttcaacgcgaaaacagaatctctagagaagggtctaccaactccagtagttatcacagtatacagcgaccgttctttcacgttcgtaactaagactccacctgctgctgttcttcttaagaaagctgctggcgttaagtctggttcaggccgtccaaacactgaaaaagtgggcactgtaactgacgctcaaatccaagaaatcgcagaaactaaagctgcagatatgactggtgctgacatcgaagcgatgaagcgttctatcgctggtactgctcgttcaatgggcctagtggtagagggttaa

SEQ ID NO: 38066 - protein, 142 aa, Vibrio parahaemolyticus
MAKKVEAYIKLQVAAGAANPSPPVGPALGQHGVNIMEFCKAFNAKTESLEKGLPTPVVITVYSDRSFTFVTKTPPAAVLLKKAAGVKSGSGRPNTEKVGTVTDAQIQEIAETKAADMTGADIEAMKRSIAGTARSMGLVVEG

SEQ ID NO: 38067 - DNA, 429 bp, Vibrio vulnificus
  CDS (1)..(429)
atggctaagaaagttgaagcttatatcaagctgcaagttgctgctggtatggcaaacccaagtccaccggttggtccagcactaggtcaacgtggtgttaacatcatggaattctgtaaagcgttcaacgcaaaaacagaatcaatggaaaaaggtcttcctgttcctgttgttatcactgtatacagcgaccgttctttcacgttcgtaactaagactccacctgctgcagttctactgaagaaagctgctggtatcaagtctggttcaggtcgtccaaacactgaaaaagtgggtactgtaactgacgctcaaatccaagagatcgcagaagctaaagctgctgatatgactggtgctgacatcgaagcgatgaagcgttctatcgcaggtactgctcgttcaatgggcctagtggtagagggttaa

SEQ ID NO: 38068 - protein, 142 aa, Vibrio vulnificus
MAKKVEAYIKLQVAAGMANPSPPVGPALGQRGVNIMEFCKAFNAKTESMEKGLPVPVVITVYSDRSFTFVTKTPPAAVLLKKAAGIKSGSGRPNTEKVGTVTDAQIQEIAEAKAADMTGADIEAMKRSIAGTARSMGLVVEG

SEQ ID NO: 38069 - DNA, 429 bp, Wigglesworthia glossinidia brevipalpis
  CDS (1)..(429)
atgacaaaaaaaataaaagcatatgtaaaattacaaattaaagctgggtctgcaaatcctagccctcctataggaccagctcttgggcaacaaggagttaacattatagaattttgtaaatcctttaacgcaaaaacaaataaaatagataaggatacacctatacctgtaattatatctgtatataatgatcgcactttttctttcataacaaaaactcctcctaccgctttctttctaaaacaagcagctaatataaaatctggatctgataatcctaaaaacaaaaaaattggtaaaatatctatttttaaaatcaatgaaattgcaaaaaaaaaatctccagatatgacaggaagcacattaaatagtatttcaaaatctattattggaacagctaagtctatgggattatctatagaggattaa

SEQ ID NO: 38070 - protein, 142 aa, Wigglesworthia glossinidia brevipalpis
MTKKIKAYVKLQIKAGSANPSPPIGPALGQQGVNIIEFCKSFNAKTNKIDKDTPIPVIISVYNDRTFSFITKTPPTAFFLKQAANIKSGSDNPKNKKIGKISIFKINEIAKKKSPDMTGSTLNSISKSIIGTAKSMGLSIED

SEQ ID NO: 38071 - DNA, 441 bp, Wolbachia pipientis wMel
  CDS (1)..(441)
atgagtgttatagttgctaagattaacttacttatggaagctgggaaagcagttccaggaccgaaaattgcttcagtacttggtccacgtggtatacctgttcctaagttttgtgaagcttttaataaagttactagtgctgctaacgctaattataaagtaggcgatttagtaacagtgcgaatttccataaaggatgatcgctctcatgattttactgtcagcggtccgcctgtggcttatttacttaagcaggaggctaaattaagtaaaagttctggtaatcctggtaaagaattagtggctaaattacctatgtctgctataattaaagtagcaaagtgcaagatggttgatatgaaagtggataatgaagattcagcagtgaaaatggttgtaggcactgcaaaatctatgggtatagaagttgtggaaggttag

SEQ ID NO: 38072 - protein, 146 aa, Wolbachia pipientis wMel
MSVIVAKINLLMEAGKAVPGPKIASVLGPRGIPVPKFCEAFNKVTSAANANYKVGDLVTVRISIKDDRSHDFTVSGPPVAYLLKQEAKLSKSSGNPGKELVAKLPMSAIIKVAKCKMVDMKVDNEDSAVKMVVGTAKSMGIEVVEG

SEQ ID NO: 38073 - DNA, 426 bp, Wolinella succinogenes
  CDS (1)..(426)
atggctaagaaaattattggcgaactcaagcttcagattcctgcagggaaggccaacccttctccccccgttggtcctgcgctaggtcagcgaggcgtcaacatcatggaattctgcaaagcattcaatgagcgaacaaaagatatggggagttttaatatccctgtcgtgttgaccatctaccaagacaagagcttcacgttcatcaccaagaagcctcctgtgaccgatctgattaagaaggctgctggaatccaaaaaggttctgacaaccccctgaaaaacaaaatcggcaagatcactaaggctcaagtggctgagattgcagcaaccaagatggaagatcttaacgctaagtcaaccgaaggagcgattaagatcgttgagggaagcgctcgaagcatgggcattgagattgtagattaa

SEQ ID NO: 38074 - protein, 141 aa, Wolinella succinogenes
MAKKIIGELKLQIPAGKANPSPPVGPALGQRGVNIMEFCKAFNERTKDMGSFNIPVVLTIYQDKSFTFITKKPPVTDLIKKAAGIQKGSDNPLKNKIGKITKAQVAEIAATKMEDLNAKSTEGAIKIVEGSARSMGIEIVD

SEQ ID NO: 38075 - DNA, 429 bp, Xanthomonas axonopodis
  CDS (1)..(429)
atggctaagaagattaccgctttcatcaagttgcaggtcaaggccggtcaggccaaccctgcgccgccggttggccctgcactgggtcagcgcggtctgaacatcatggaattctgcaaggcattcaacgcggcaacgtcgaagctggagccgggtctgccgacgccggtgatcatcaccgcgtattccgaccgtaccttcacgttcgtcaccaagagcactccggccagcgtgctgctcaagaaggccgcaggcgtgagctccggctcgaagcgtcccaacaccgacaaggtgggcaaggtgacgcgcaagcagctggaagagatcgccaaggtcaaggaagccgatttgacggcagccgagctggaagcggcggtgcgcacgattgcgggttctgcccgcagcatgggtttgacggtggagggctaa

SEQ ID NO: 38076 - protein, 142 aa, Xanthomonas axonopodis
MAKKITAFIKLQVKAGQANPAPPVGPALGQRGLNIMEFCKAFNAATSKLEPGLPTPVIITAYSDRTFTFVTKSTPASVLLKKAAGVSSGSKRPNTDKVGKVTRKQLEEIAKVKEADLTAAELEAAVRTIAGSARSMGLTVEG

SEQ ID NO: 38077 - DNA, 429 bp, Xanthomonas campestris
  CDS (1)..(429)
atggctaagaaagtagttgctttaatcaagttgcaggtcaaggccggacaggccaatcctgcgccgccggtcggtcctgcgctgggtcagcgcggtctgaacatcatggagttctgcaaggcgttcaatgccgcgacctccaagctggagccgggcctgccgacgccggtgatcatcaccgcgtactcggaccgtaccttcaccttcatcaccaagagcaccccggccagcgtgctgctcaagaaggctgccggcgtgagctccgggtccaagcgcccgaacaccgacaaggtgggcaaggtgacgcgcaagcagctggaagagatcgtcaaggtcaaggaagccgatctcacggcggccgagctggaagcggcagtgcgcacgattgcgggttctgcccgcagcatgggtttgacggtggagggctaa

SEQ ID NO: 38078 - protein, 142 aa, Xanthomonas campestris
MAKKVVALIKLQVKAGQANPAPPVGPALGQRGLNIMEFCKAFNAATSKLEPGLPTPVIITAYSDRTFTFITKSTPASVLLKKAAGVSSGSKRPNTDKVGKVTRKQLEEIVKVKEADLTAAELEAAVRTIAGSARSMGLTVEG

SEQ ID NO: 38079 - DNA, 429 bp, Xylella fastidiosa
  CDS (1)..(429)
atggcaaagaaagttattgcttacattaagcttcaggtgaaggccggtcaggcgtctccttcaccgcccgttggtcccgctttggggcagcgtggtttgaatattatggatttttgtaaggcgtttaatgctgcaactcaaaaggttgagcagggtttgccgattccggtagtaattactgcttactcggatcgtactttcacctttattacaaaaactcctccagcgtcgattttgttgaagaaaattgtcggtatacaatccggctccaagcgtcccaacacagagaaggtgggcaaagtcactcgcaagcagcttgaggatatcgctaagactaaggagctcgatatgacggctgctgatttagatgctgctgtacgtacgattgcaggttcggctcgcagtatgggtttggtggtggagggttga

SEQ ID NO: 38080 - protein, 142 aa, Xylella fastidiosa
MAKKVIAYIKLQVKAGQASPSPPVGPALGQRGLNIMDFCKAFNAATQKVEQGLPIPVVITAYSDRTFTFITKTPPASILLKKIVGIQSGSKRPNTEKVGKVTRKQLEDIAKTKELDMTAADLDAAVRTIAGSARSMGLVVEG

SEQ ID NO: 38081 - DNA, 429 bp, Yersinia pestis
  CDS (1)..(429)
atggctaagaaagtacaagcctatgtcaagctgcaagtagcagctggtatggcgaacccaagcccaccagtcggtccggctctgggtcagcagggtgttaacatcatggagttctgtaaagcgttcaatgctaagactgaaagcattgaaaaaggcctgccgatcccagttgttattactgtttattctgatcgctctttcactttcgttactaaaaccccgccagcagcagttctgctgaaaaaagcggcaggtattaagtctggttctggcgtgccgaacaaagacaaagtaggtaaagtgaccagtgctcaggtccgtgaaatcgcagaaaccaaagctgcggatatgactggttctgacgttgacgcgatgatgcgttcaatcgaaggtactgctcattccatgggcctggtagtggagggttaa

SEQ ID NO: 38082 - protein, 142 aa, Yersinia pestis
MAKKVQAYVKLQVAAGMANPSPPVGPALGQQGVNIMEFCKAFNAKTESIEKGLPIPVVITVYSDRSFTFVTKTPPAAVLLKKAAGIKSGSGVPNKDKVGKVTSAQVREIAETKAADMTGSDVDAMMRSIEGTAHSMGLVVEG

SEQ ID NO: 38083 - DNA, 588 bp, Caenorhabditis elegans
  CDS (1)..(588)
atggcaagcaaaggtgcggcccgtgtcagaaagaaggagattgtcaaagttgttcatggagcgttactcagaaccaatattaaagcacaaatggcgtcggctgctccaccacttggaccacaacttggtcaacgtgggctcaatgtcgcgaatttttgcaaagagttcaacaaagaaacaggccatttcaaacaaggagtcccacttcccacacgaatcactgtaaagccagatagaacatatgatttggagatttgtacaccgacgacgacatggcttttgaaacaagccgctggtattgggagaggaaaagcaagtaaagacgaaatcgttggaaaattaacggtaaaacatctgtatgaaatcgccaaaatcaaatcacgagataaagctttacaacacgtcccgcttgaacaaatctgtcgaatgctgataaaaacatgtagaacattgggaattgatgtacaatatcatgatttggatccagtcgaattgaaagaatttttagttgcccggaaagagaaagttgatgctcagttgaaggatttggcagataaaaaggcggcgaagatgctccgaaccacttaa

SEQ ID NO: 38084 - protein, 195 aa, Caenorhabditis elegans
MASKGAARVRKKEIVKVVHGALLRTNIKAQMASAAPPLGPQLGQRGLNVANFCKEFNKETGHFKQGVPLPTRITVKPDRTYDLEICTPTTTWLLKQAAGIGRGKASKDEIVGKLTVKHLYEIAKIKSRDKALQHVPLEQICRMLIKTCRTLGIDVQYHDLDPVELKEFLVARKEKVDAQLKDLADKKAAKMLRTT

SEQ ID NO: 38085 - DNA, 591 bp, Drosophila melanogaster
  CDS (1)..(591)
atgtcgaaggcagcgggtaagctgaaatcgctaaagaagacggtggaacgtgtgacgcacacgagcaaactgaagacgaatatacctgcgggaatggctgctgcaggtccgccattgggaccgatgttgggacagagagcgattaatatcgccgctttctgcaaggactttaatgccaagaccgcggaaatgaaagagggcgtaccgctgccgtgcagaatttccgtaaacagcgatcgcagctacgacttggccatccaccatccgccggccacatttttcctgaagcaagcggcgggcatacaaaggggcaccatgactcctggcaaggaggttgccggcatgatcactctcaagcatttgtacgagattgcagctattaagattcaggacccgcccaatgtacttcttaccatgcagcaaatgtgtgagatgctcatcagcattgctcggacctgtggcatcaaagtggtcagggaaatagatccggcggcctatggcgagttcctggaggagcgcaagttaattgtggaacagcaacggcgcgagttgcaggagaagcgggaagcaaagatgttgcgcacgggctag

SEQ ID NO: 38086 - protein, 196 aa, Drosophila melanogaster
MSKAAGKLKSLKKTVERVTHTSKLKTNIPAGMAAAGPPLGPMLGQRAINIAAFCKDFNAKTAEMKEGVPLPCRISVNSDRSYDLAIHHPPATFFLKQAAGIQRGTMTPGKEVAGMITLKHLYEIAAIKIQDPPNVLLTMQQMCEMLISIARTCGIKVVREIDPAAYGEFLEERKLIVEQQRRELQEKREAKMLRTG

SEQ ID NO: 38087 - DNA, 438 bp, Reclinomonas americana
  CDS (1)..(438)
atgaataaaataattggttttattagattagaaatagaatcaggtaaagcaagtccatcacctccagttggtcctgcacttggtcttagaggtgtgaatattatgcagttttgtaaagaatttaataatcgttgtaaacaattaaatataaaagatggtgttcctgtgccaacaataataacagtatatgatgataaaacatttagttttaaaatgaaaacaccttcgattacatattttataaaaaaacatttagaaataagtaaaggtgcatcaaaaccgggcaaagaaaattttttaaatattgatattagatctttatatgaaatagctgaaattaaaaaaatagattctaatttagatataaaatctatatgtaaatcattaattggttctgtaaaatctatgggtattaaaactataattgttaaaaattaa

SEQ ID NO: 38088 - protein, 145 aa, Reclinomonas americana
MNKIIGFIRLEIESGKASPSPPVGPALGLRGVNIMQFCKEFNNRCKQLNIKDGVPVPTIITVYDDKTFSFKMKTPSITYFIKKHLEISKGASKPGKENFLNIDIRSLYEIAEIKKIDSNLDIKSICKSLIGSVKSMGIKTIIVKN

SEQ ID NO: 38089 - DNA, 477 bp, Saccharomyces cerevisiae
  CDS (1)..(477)
atgtcacaggcagcaaaaaacgtgatagtaaagctaatagtaggagcaggccaagcggcaccatcacctcccgtggggcccgcattgggctccaagggtataaaagccattgacttttgtaaggaatttaatgcaagatcagcaaactatcagccaggtgtaccggttccagtattaatcacaataaaacctgatagaacatttacgtttgaaatgaaatctccaccaaccggatatttgctgctaaaagctcttaaaatggacaagggacatggacaaccgaatgtggggacaatgttaggcagtgcacctgccaagggaccaacccgtgctttaggagagttatcgctgaagcacgtttacgaaatagccaagataaaaaagagtgatgaaaggcatagtttattggagatggaaggtattgttaaatcaatagttggcgttgcaaaaagtatgggtattaaggttgtaccttga

SEQ ID NO: 38090 - protein, 158 aa, Saccharomyces cerevisiae
MSQAAKNVIVKLIVGAGQAAPSPPVGPALGSKGIKAIDFCKEFNARSANYQPGVPVPVLITIKPDRTFTFEMKSPPTGYLLLKALKMDKGHGQPNVGTMLGSAPAKGPTRALGELSLKHVYEIAKIKKSDERHSLLEMEGIVKSIVGVAKSMGIKVVP

SEQ ID NO: 38091 - DNA, 25 bp, Primer
atggctaagaaagtacaagcctatg

SEQ ID NO: 38092 - DNA, 22 bp, Primer
ttagtcctccactaccaggccc

SEQ ID NO: 38093 - protein, 167 aa, consensus
  MISC_FEATURE (1)..(167): consensus for the disclosure of xaa see table XV
VXXXIKLXVXAGXAXPXXXXGPALGXXGVNIXXFXKXFNXXTXXXXXXXXXGXXIPVXITXXXDXXRSFXFXXKXPPXXXLLXKXXXIXXXXXXXXXXGSXXPXXXXXXXXXXXXXXXXXVGXITXXXVXXIAXXKXXDXXXXLXXXXLXXXXRXIXGTARSMGIXV

SEQ ID NO: 38094 - protein, 38 aa, consensus
  MISC_FEATURE (1)..(38): consensus for the disclosure of xaa see table XV
XXXXXXXXXAXXXXXXXXXXXXXXXXXXXXXXXXNXXX
